United States Patent 8,030,546 (BIOTIC AND ABIOTIC STRESS TOLERANCE IN PLANTS) - sequence listing, part 2

SEQ ID NO: 2669 - protein, 82 aa, Arabidopsis thaliana
  G622,ABI3/VP-1 domain
LFEKTLSASDAGRIGRLVLPKACAEAYFPPISQSEGIPLKIQDVRGREWTFQFRYWPNNNSRMYVLEGVTPCIQSMMLQAGD

SEQ ID NO: 2670 - protein, 80 aa, Arabidopsis thaliana
  G624,ABI3/VP-1 domain
LFEKILSATDTGKRLVLPKKYAEAFLPQLSHTKGVPLTVQDPMGKEWRFQFRFWPSSKGRIYVLEGVTPFIQTLQLQAGD

SEQ ID NO: 2671 - protein, 57 aa, Arabidopsis thaliana
  G627,MADS domain
MVRGKTEMKRIENATSRQVTFSKRRNGLLKKAFELSVLCDAEVALVIFSPRSKLYEF

SEQ ID NO: 2672 - protein, 61 aa, Arabidopsis thaliana
  G629,bZIP domain
DKMKRRLAQNREAARKSRLRKKAYVQQLEESRLKLSQLEQELEKVKQQGHLGPSGSINTGI

SEQ ID NO: 2673 - protein, 73 aa, Arabidopsis thaliana
  G630,bZIP domain
RKQRRMVSNRESARRSRMRKQRHLDELLSQVAWLRSENHQLLDKLNQVSDNNDLVIQENSSLKEENLELRQVI

SEQ ID NO: 2674 - protein, 86 aa, Arabidopsis thaliana
  G634,1st TH domain
RWPREETLALLRIRSDMDSTFRDATLKAPLWEHVSRKLLELGYKRSSKKCKEKFENVQKYYKRTKETRGGRHDGKAYKFFSQLEAL

SEQ ID NO: 2675 - protein, 57 aa, Arabidopsis thaliana
  G634,2nd TH domain
RWPKAEILALINLRSGMEPRYQDNVPKGLLWEEISTSMKRMGYNRNAKRCKEKWENI

SEQ ID NO: 2676 - protein, 85 aa, Arabidopsis thaliana
  G635,TH domain
KWKPEEIKKVIRMRGELHSRFQVVKGRMALWEEISSNLSAEGINRSPGQCKSLWASLIQKYEESKADERSKTSWPHFEDMNNILS

SEQ ID NO: 2677 - protein, 91 aa, Arabidopsis thaliana
  G636,1st TH domain
GFGGNRWPRQETLALLKIRSDMGIAFRDASVKGPLWEEVSRKMAEHGYIRNAKKCKEKFENVYKYHKRTKEGRTGKSEGKTYRFFDQLEAL

SEQ ID NO: 2678 - protein, 94 aa, Arabidopsis thaliana
  G636,2nd TH domain
SSRWPKVEIEALIKLRTNLDSKYQENGPKGPLWEEISAGMRRLGFNRNSKRCKEKWENINKYFKKVKESNKKRPEDSKTCPYFHQLDALYRERN

SEQ ID NO: 2679 - protein, 88 aa, Arabidopsis thaliana
  G638,TH domain
RWPRQETLTLLEIRSRLDHKFKEANHKGPLWDEVSRIMSEEHGYQRSGKKCREKFENLYKYYSKTKEGEAGRQDGKHHRFFRQLQALY

SEQ ID NO: 2680 - protein, 39 aa, Arabidopsis thaliana
  G643,TH domain
KWTMITENCNALDVSRNLNQCRRKWDSLMSDYNQIKKWE

SEQ ID NO: 2681 - protein, 43 aa, Arabidopsis thaliana
  G646,Z-Dof domain
CPRCNSTNTKFCYYNNYSLTQPRYFCKGCRRYWTEGGSLRNIP

SEQ ID NO: 2682 - protein, 27 aa, Arabidopsis thaliana
  G651,1st Z-C2H2 domain
HKCKLCWKSFANGRALGGHMRSHMLIH

SEQ ID NO: 2683 - protein, 21 aa, Arabidopsis thaliana
  G651,2nd Z-C2H2 domain
CETCEKVFKSYQALGGHRASH

SEQ ID NO: 2684 - protein, 24 aa, Arabidopsis thaliana
  G651,3rd Z-C2H2 domain
HHECPICAKVFTSGQALGGHKRSH

SEQ ID NO: 2685 - protein, 22 aa, Arabidopsis thaliana
  G652,1st Z-CLDSH domain
FGFITPSDGGDDLFVHQSSIRS

SEQ ID NO: 2686 - protein, 15 aa, Arabidopsis thaliana
  G652,2nd Z-CLDSH domain
SCFKCGEPGHMAREC

SEQ ID NO: 2687 - protein, 15 aa, Arabidopsis thaliana
  G652,3rd Z-CLDSH domain
CYSCGESGHFARDCT

SEQ ID NO: 2688 - protein, 52 aa, Arabidopsis thaliana
  G653,1st Z-LIM domain
CRACEKTVYPVELLSADGISYHKACFKCSHCKSRLQLSNYSSMEGVVYCRPH

SEQ ID NO: 2689 - protein, 52 aa, Arabidopsis thaliana
  G653,2nd Z-LIM domain
CATCTKTVYPIEKVTVESQCYHKSCFKCSHGGCPISPSNYAALEGILYCKHH

SEQ ID NO: 2690 - protein, 153 aa, Arabidopsis thaliana
  G657,MYB-(R1)R2R3 domain
KGQWTPEEDEVLCKAVERFQGKNWKKIAECFKDRTDVQCLHRWQKVLNPELVKGPWSKEEDNTIIDLVEKYGPKKWSTISQHLPGRIGKQCRERWHNHLNPGINKNAWTQEEELTLIRAHQIYGNKWAELMKFLPGRSDNSIKNHWNSSVKKK

SEQ ID NO: 2691 - protein, 103 aa, Arabidopsis thaliana
  G663,MYB-(R1)R2R3 domain
RKGAWTAEEDSLLRLCIDKYGEGKWHQVPLRAGLNRCRKSCRLRWLNYLKPSIKRGRLSNDEVDLLLRLHKLLGNRWSLIAGRLPGRTANDVKNYWNTHLSKK

SEQ ID NO: 2692 - protein, 103 aa, Arabidopsis thaliana
  G664,MYB-(R1)R2R3 domain
KGAWTKEEDERLVAYIKAHGEGCWRSLPKAAGLLRCGKSCRLRWINYLRPDLKRGNFTEEEDELIIKLHSLLGNKWSLIAGRLPGRTDNEIKNYWNTHIRRKL

SEQ ID NO: 2693 - protein, 103 aa, Arabidopsis thaliana
  G666,MYB-(R1)R2R3 domain
KGPWTPEEDIILVTYIQEHGPGNWRAVPTNTGLLRCSKSCRLRWTNYLRPGIKRGNFTEHEEKMIVHLQALLGNRWAAIASYLPQRTDNDIKNYWNTHLKKKL

SEQ ID NO: 2694 - protein, 102 aa, Arabidopsis thaliana
  G668,MYB-(R1)R2R3 domain
KGPWTPEEDIILVSYIQEHGPGNWRSVPTHTGLRCSKSCRLRWTNYLRPGIKRGNFTEHEEKTIVHLQALLGNRWAAIASYLPERTDNDIKNYWNTHLKKKL

SEQ ID NO: 2695 - protein, 104 aa, Arabidopsis thaliana
  G669,MYB-(R1)R2R3 domain
NRGAWTDHEDKILRDYITTHGEGKWSTLPNQAGLKRCGKSCRLRWKNYLRPGIKRGNISSDEEELIIRLHNLLGNRWSLIAGRLPGRTDNEIKNHWNSNLRKRL

SEQ ID NO: 2696 - protein, 109 aa, Arabidopsis thaliana
  G670,MYB-(R1)R2R3 domain
KGLWSPEEDEKLLTHITNHGHGCWSSVPKLAGLQRCGKSCRLEQIWYRRLRWINYLRPDLKRGAFSPEEENLIVELHAVLGNRWSQIASRLPGRTDNEIKNLWNSSIKK

SEQ ID NO: 2697 - protein, 101 aa, Arabidopsis thaliana
  G671,MYB-(R1)R2R3 domain
KGAWTPEEDQKLLSYLNRHGEGGWRTLPEKAGLKRCGKSCRLRWANYLRPDIKRGEFTEDEERSIISLHALHGNKWSAIARGLPGRTDNEIKNYWNTHIKK

SEQ ID NO: 2698 - protein, 101 aa, Arabidopsis thaliana
  G674,MYB-(R1)R2R3 domain
KGLWSPEEDEKLRSHVLKYGHGCWSTIPLQAGLQRNGKSCRLRWVNYLRPGLKKSLFTKQEETILLSLHSMLGNKWSQISKFLPGRTDNEIKNYWHSNLKK

SEQ ID NO: 2699 - protein, 104 aa, Arabidopsis thaliana
  G675,MYB-(R1)R2R3 domain
KKGPWTPEEDQKLIDYIHKHGHGSWRALPKLADLNRCGKSCRLRWTNYLRPDIKRGKFSAEEEQTILHLHSILGNKWSAIATHLQGRTDNEIKNFWNTHLKKKL

SEQ ID NO: 2700 - protein, 103 aa, Arabidopsis thaliana
  G676,MYB-(R1)R2R3 domain
KKGLWTVEEDKILMDYVKAHGKGHWNRIAKKTGLKRCGKSCRLRWMNYLSPNVKRGNFTEQEEDLIIRLHKLLGNRWSLIAKRVPGRTDNQVKNYWNTHLSKK

SEQ ID NO: 2701 - protein, 47 aa, Arabidopsis thaliana
  G680,MYB-related domain
ERWTEDEHERFLEALRLYGRAWQRIEEHIGTKTAVQIRSHAQKFFTK

SEQ ID NO: 2702 - protein, 107 aa, Arabidopsis thaliana
  G681,MYB-(R1)R2R3 domain
KGEWTAEEDQKLGAYINEHGVCDWRSLPKRAGLQRCGKSCRLRWLNYLKPGIRRGKFTPQEEEEIIQLHAVLGNRWAAMAKKMQNRTDNDIKNHWNSCLKKRLSRKG

SEQ ID NO: 2703 - protein, 45 aa, Arabidopsis thaliana
  G682,MYB-related domain
VNMSQEEEDLVSRMHKLVGDRWELIAGRIPGRTAGEIERFWVMKN

SEQ ID NO: 2704 - protein, 61 aa, Arabidopsis thaliana
  G707,HB domain
KKKKRYHRHTPKQIQDLESVFKECAHPDEKQRLDLSRRLNLDPRQVKFWFQNRRTQMKTQI

SEQ ID NO: 2705 - protein, 93 aa, Arabidopsis thaliana
  G714,CAAT domain
KEIEKTTDFKNHSLPLARIKKIMKADEDVRMISAEAPVVFARACEMFILELTLRSWNHTEENKRRTLQKNDIAAAVTRTDIFDFLVDIVPRED

SEQ ID NO: 2706 - protein, 97 aa, Arabidopsis thaliana
  G715,CAAT domain
QEIEQVNDFKNHQLPLARIKKIMKADEDVRMISAEAPILFAKACELFILELTIRSWLHAEENKRRTLQKNDIAAAITRTDIFDFLVDIVPRDEIKDE

SEQ ID NO: 2707 - protein, 74 aa, Arabidopsis thaliana
  G718,SBP domain
CQVEGCNLDLSSAKDYHRKHRICENHSKFPKVVVSGVERRFCQQCSRFHCLSEFDEKKRSCRRPLSDHNARRRK

SEQ ID NO: 2708 - protein, 49 aa, Arabidopsis thaliana
  G720,GARP domain
WTPELHKKFVQAVEQLGVDQAIPSRILELMKVGTLTRHNVASHLQKFRQ

SEQ ID NO: 2709 - protein, 50 aa, Arabidopsis thaliana
  G728,GARP domain
WSQELHRKFVDALHRLGGPQVATPKQIRDLMKVDGLTNDEVKSHLQKYRM

SEQ ID NO: 2710 - protein, 49 aa, Arabidopsis thaliana
  G729,GARP domain
WTSSLHARFVHAVELLGGHERATPKSVLELMDVKDLTLAHVKSHLQMYR

SEQ ID NO: 2711 - protein, 49 aa, Arabidopsis thaliana
  G730,GARP domain
WTTTLHAHFVHAVQLLGGHERATPKSVLELMDVQDLTLAHVKSHLQMYR

SEQ ID NO: 2712 - protein, 61 aa, Arabidopsis thaliana
  G732,bZIP domain
RKRKRMLSNRESARRSRMRKQKHVDDLTAQINQLSNDNRQILNSLTVTSQLYMKIQAENSV

SEQ ID NO: 2713 - protein, 85 aa, Arabidopsis thaliana
  G735,bZIP domain
KRVKRMLSNRESARRSRRRKQAHLSELETQVSQLRVENSKLMKGLTDVTQTFNDASVENRVLKANIETLRAKVKMAEETVKRLTG

SEQ ID NO: 2714 - protein, 58 aa, Arabidopsis thaliana
  G736,Z-Dof domain
PDKIIACPRCKSMETKFCYFNNYNGNQPRHFCKGCHRYWTAGGALRNVPVGAGRRKSK

SEQ ID NO: 2715 - protein, 43 aa, Arabidopsis thaliana
  G738,Z-Dof domain
CPRCNSSNTKFCYYNNYSLAQPRYLCKSCRRYWTEGGSLRNVP

SEQ ID NO: 2716 - protein, 19 aa, Arabidopsis thaliana
  G740,1st Z-CLDSH domain
YGFITPDDGSVELFVHQSS

SEQ ID NO: 2717 - protein, 37 aa, Arabidopsis thaliana
  G740,2nd Z-CLDSH domain
CYSCGGVGHIARDCATKRQPSRGCYQCGGSGHLARDC

SEQ ID NO: 2718 - protein, 42 aa, Arabidopsis thaliana
  G744,RING/C3H2C3 domain
CTICLQDIKTGEITRSLPKCDHTFHLVCVDKWLIRHGSCPIC

SEQ ID NO: 2719 - protein, 29 aa, Arabidopsis thaliana
  G748,Z-Dof domain
CPRCKSMETKFCYYNNYNINQPRHFCKAC

SEQ ID NO: 2720 - protein, 41 aa, Arabidopsis thaliana
  G752,RING/C3H2C3 domain
PSDNKEDAKCSICQEEYTIGDEVGRLHCEHTYHVKCVQEWL

SEQ ID NO: 2721 - protein, 145 aa, Arabidopsis thaliana
  G760,NAC domain
GFRFHPTDEELVRYYLKRKVCNKPFKFDAISVTDIYKSEPWDLPDKSKLKSRDLEWYFFSMLDKKYSNGSKTNRATEKGYWKTTGKDREIRNGSRVVGMKKTLVYHKGRAPRGERTNWVMHEYRLSDEDLKKAGVPQEAYVLCRI

SEQ ID NO: 2722 - protein, 150 aa, Arabidopsis thaliana
  G772,NAC domain
LAPGFRFHPTDEELVSYYLKRKVLGKPVRFDAIGEVDIYKHEPWDLAVFSKLKTRDQEWYFFSALDKKYGNGARMNRATNKGYWKATGKDREIRRDIQLLGMKKTLVFHSGRAPDGLRTNWVMHEYRLVEYETETNGSLLQDAYVLCRVF

SEQ ID NO: 2723 - protein, 143 aa, Arabidopsis thaliana
  G773,NAC domain
GFRFYPTDEELMVEYLCRKAAGHDFSLQLIAEIDLYKFDPWVLPSKALFGEKEWYFFSPRDRKYPNGSRPNRVAGSGYWKATGTDKVISTEGRRVGIKKALVFYIGKAPKGTKTNWIMHEYRLIEPSRRNGSTKLDDWVLCRI

SEQ ID NO: 2724 - protein, 149 aa, Arabidopsis thaliana
  G776,NAC domain
LAPGFRFHPTDEELVSYYLKRKVLGQPVRFDAIGEVDIYKHEPWDLAVFSRLKTRDQEWYFYSALDKKYGNGARMNRATNRGYWKATGKDREIRRDILLLGMKKTLVFHSGRAPDGLRTNWVMHEYRLVEYETEKNGNLVQDAYVLCRV

SEQ ID NO: 2725 - protein, 59 aa, Arabidopsis thaliana
  G777,HLH/MYC domain
KKEAVCSQKAEREKLRRDKLKEQFLELGNALDPNRPKSDKASVLTDTIQMLKDVMNQVD

SEQ ID NO: 2726 - protein, 58 aa, Arabidopsis thaliana
  G778,HLH/MYC domain
KRSRAAAIHNQSERKRRDKINQRMKTLQKLVPNSSKTDKASMLDEVIEYLKQLQAQVS

SEQ ID NO: 2727 - protein, 58 aa, Arabidopsis thaliana
  G779,HLH/MYC domain
NVRISDDPQTVVARRRRERISEKIRILKRIVPGGAKMDTASMLDEAIRYTKFLKRQVR

SEQ ID NO: 2728 - protein, 59 aa, Arabidopsis thaliana
  G782,HLH/MYC domain
DVSARKSQKAGREKLRREKLNEHFVELGNVLDPERPKNDKATILTDTVQLLKELTSEVN

SEQ ID NO: 2729 - protein, 59 aa, Arabidopsis thaliana
  G783,HLH/MYC domain
GKVPKRINKAVRERLKREHLNELFIELADTLELNQQNSGKASILCEATRFLKDVFGQIE

SEQ ID NO: 2730 - protein, 58 aa, Arabidopsis thaliana
  G789,HLH/MYC domain
RRSRAAEVHNLSERRRRDRINERMKALQELIPHCSRTDKASILDEAIDYLKSLQMQLQ

SEQ ID NO: 2731 - protein, 60 aa, Arabidopsis thaliana
  G791,HLH/MYC domain
ESSSATSSKACREKQRRDRLNDKFMELGAILEPGNPPKTDKAAILVDAVRMVTQLRGEAQ

SEQ ID NO: 2732 - protein, 58 aa, Arabidopsis thaliana
  G793,HLH/MYC domain
RRGQATDPHSIAERLRRERIAERIRSLQELVPTVNKTDRAAMIDEIVDYVKFLRLQVK

SEQ ID NO: 2733 - protein, 29 aa, Arabidopsis thaliana
  G798,Z-Dof domain
CPRCDSSNTKFCYYNNYNFSQPRHFCKAC

SEQ ID NO: 2734 - protein, 62 aa, Arabidopsis thaliana
  G801,PCF domain
KDRHSKVDGRGRRIRMPIICAARVFQLTRELGHKSDGQTIEWLLRQAEPSIIAATGTGTTPA

SEQ ID NO: 2735 - protein, 81 aa, Arabidopsis thaliana
  G802,PCF domain
TKDRHTKVDGRGRRIRMPALCAARVFQLTRELGHKSDGETIEWLLQQAEPAIVAATGTGTIPANFSTLSVSLRSSGSTLSA

SEQ ID NO: 2736 - protein, 64 aa, Arabidopsis thaliana
  G805,PCF domain
STKDRHTKVEGRGRRIRMPAMCAARVFQLTRELGHKSDGETIEWLLQQAEPAVIAATGTGTIPA

SEQ ID NO: 2737 - protein, 92 aa, Arabidopsis thaliana
  G807,HS domain
PFLSKTYDMVDDPLTNEVVSWSSGNNSFVVWSAPEFSKVLLPKYFKHNNFSSFVRQLNTYGFRKVDPDRWEFANEGFLRGRKQLLKSIVRRK

SEQ ID NO: 2738 - protein, 92 aa, Arabidopsis thaliana
  G811,HS domain
PFIVKTYQMVNDPSTDWLITWGPAHNSFIVVDPLDFSQRILPAYFKHNNFSSFVRQLNTYGFRKVDPDRWEFANEHFLRGQKHLLNNIARRK

SEQ ID NO: 2739 - protein, 92 aa, Arabidopsis thaliana
  G812,HS domain
PFLTKTFEMVDDPNTDHIVSWNRGGTSFVVWDLHSFSTILLPRHFKHSNFSSFIRQLNTYGFRKIEAERWEFANEEFLLGQRQLLKNIKRRN

SEQ ID NO: 2740 - protein, 92 aa, Arabidopsis thaliana
  G818,HS domain
PFLRKTFEIVDDKVTDPVVSWSPTRKSFIIWDSYEFSENLLPKYFKHKNFSSFIRQLNSYGFKKVDSDRWEFANEGFQGGKKHLLKNIKRRS

SEQ ID NO: 2741 - protein, 517 aa, Arabidopsis thaliana
  G831,AKR domain
EHTPCEDAKRSLKFSRERLEYRQRHCPEREEILKCRIPAPYGYKTPFRWPASRDVAWFANVPHTELTVEKKNQNWVRYENDRFWFPGGGTMFPRGADAYIDDIGRLIDLSDGSIRTAIDTGCGVASFGAYLLSRNITTMSFAPRDTHEAQVQFALERGVPAMIGIMATIRLPYPSRAFDLAHCSRCLIPWGQNDGAYLMEVDRVLRPGGYWILSGPPINWQKRWKGWERTMDDLNAEQTQIEQVARSLCWKKVVQRDDLAIWQKPFNHIDCKKTREVLKNPEFCRHDQDPDMAWYTKMDSCLTPLPEVDDAEDLKTVAGGKVEKWPARLNAIPPRVNKGALEEITPEAFLENTKLWKQRVSYYKKLDYQLGETGRYRNLVDMNAYLGGFAAALADDPVWVMNVVPVEAKLNTLGVIYERGLIGTYQNWCEAMSTYPRTYDFIHADSVFTLYQGQCEPEEILLEMDRILRPGGGVIIRDDVDVLIKVKELTKGLEWEGRIADHEKGPHEREKIYYAVK

SEQ ID NO: 2742 - protein, 505 aa, Arabidopsis thaliana
  G837,AKR domain
DYIPCLDNWQAIRKLHSTKHYEHRERHCPEESPRCLVSLPEGYKRSIKWPKSREKIWYTNIPHTKLAEVKGHQNWVKMSGEYLTFPGGGTQFKNGALHYIDFLQESYPDIAWGNRTRVILDVGCGVASFGGYLFDRDVLALSFAPKDEHEAQVQFALERGIPAMSNVMGTKRLPFPGSVFDLIHCARCRVPWHIEGGKLLLELNRALRPGGFFVWSATPVYRKTEEDVGIWKAMSKLTKAMCWELMTIKKDELNEVGAAIYQKPMSNKCYNERSQNEPPLCKDSDDQNAAWNVPLEACIHKVTEDSSKRGAVWPESWPERVETVPQWLDSQEGVYGKPAQEDFTADHERWKTIVSKSYLNGMGIDWSYVRNVMDMRAVYGGFAAALKDLKLWVMNVVPIDSPDTLPIIYERGLFGIYHDWCESFSTYPRTYDLLHADHLFSSLKKRCNLVGVMAEVDRILRPQGTFIVRDDMETIGEIEKMVKSMKWNVRMTHSKDGEGLLSVQK

SEQ ID NO: 2743 - protein, 126 aa, Arabidopsis thaliana
  G839,1st AKR domain
SDAEIIVDGVPVGVHRCILAARSKFFQDLFKKEKKISKTEKPKYQLREMLPYGAVAHEAFLYFLSYIYTGRLKPFPLEVSTCVDPVCSHDCCRPAIDFVVQLMYASSVLQVPELVSSFQRRLCNFV

SEQ ID NO: 2744 - protein, 64 aa, Arabidopsis thaliana
  G839,2nd AKR domain
DQANGLHYSVVYSDPKVVAEILALDMGDVNYRNSRGYTVLHFAAMRREPSIIISLIDKGANASE

SEQ ID NO: 2745 - protein, 60 aa, Arabidopsis thaliana
  G843,1st MISC domain
LSGLVRFKCAVCMDFDLCVECFSVGVELNRHKNSHPYRVMDNLSFSLVTSDWNADEEILL

SEQ ID NO: 2746 - protein, 81 aa, Arabidopsis thaliana
  G843,2nd MISC domain
TELYGYNLKREEFEIEHDNDAEQLLADMEFKDSDTDAEREQKLQVLRIYSKRLDERKRRKEFVLERNLLYPDQYEMSLSAE

SEQ ID NO: 2747 - protein, 310 aa, Arabidopsis thaliana
  G846,1st SWI/SNF domain
LSVPLMKHQKIALAWMFQKETNSLHCMGGILADDQGLGKTVSTIALILKQMHEAKLKSKNSGNQEAEALDLDADDESENAFEKPESKASNGSGVNGDSGIKKAKGEEASTSTRKFNRKRPAAGTLIVCPASVVRQWARELDEKVTDEAKLSVLIYHGGNRTKDPIELAKYDVVMTTYAIVSNEVPKQPLVDDDENDEKNSEKYGLASGFSINKKRKNVVGTTKKSKKKKGNNNAGDSSDPDSGTLAKVGWFRVVLDEAQTIKNHRTQVARACCGLRAKRRWCLSGTPIQNTIDDLYSYFRFLKYDPYAVY

SEQ ID NO: 2748 - protein, 41 aa, Arabidopsis thaliana
  G846,2nd SWI/SNF domain
CCVCHDPPEDPVVTLCGHIFCYQCVSDYITGDEDTCPAPRC

SEQ ID NO: 2749 - protein, 84 aa, Arabidopsis thaliana
  G846,3rd SWI/SNF domain
DLVELSLIENSIEFRRLDGTMSLIARDRAVKEFSNDPDVKVMIMSLKAGNLGLNMIAACHVILLDLWWNPTTEDQAIDRAHRIG

SEQ ID NO: 2750 - protein, 80 aa, Arabidopsis thaliana
  G849,1st BPF-1 domain
VKLSIKSFRIPELFIEVPETATVGSLKRTVMEAVSVLLSGGIRVGVLMHGKKVRDERKTLSQTGISCDENLDNLGFTLEP

SEQ ID NO: 2751 - protein, 87 aa, Arabidopsis thaliana
  G849,2nd BPF-1 domain
QRRTRRPFSVTEVEALVQAVEELGTGRWRDVKLRAFEDADHRTYVDLKDKWKTLVHTASISPQQRRGEPVPQELLDRVLRAYGYWSQ

SEQ ID NO: 2752 - protein, 66 aa, Arabidopsis thaliana
  G852,1st SCR domain
MQVLFEVCPCFKFGFLAANGAILEAIKGEEEVHIIDFDINQGNQYMTLIRSIAELPGKRPRLRLTG

SEQ ID NO: 2753 - protein, 89 aa, Arabidopsis thaliana
  G852,2nd SCR domain
FQLHHMPDESVTTVNQRDELLHMVKSLNPKLVTVVEQDVNTNTSPFFPRFIEAYEYYSAVFESLDMTLPRESQERMNVERQCLARDIVN

SEQ ID NO: 2754 - protein, 74 aa, Arabidopsis thaliana
  G852,3rd SCR domain
CEGEERIERYEAAGKWRARMMMAGFNPKPMSAKVTNNIQNLIKQQYCNKYKLKEEMGELHFCWEEKSLIVASAW

SEQ ID NO: 2755 - protein, 57 aa, Arabidopsis thaliana
  G859,MADS domain
MGRKKVEIKRIENKSSRQVTFSKRRNGLIEKARQLSILCESSIAVLVVSGSGKLYKS

SEQ ID NO: 2756 - protein, 56 aa, Arabidopsis thaliana
  G860,MADS domain
GRGKIAIKRINNSTSRQVTFSKRRNGLLKKAKELAILCDAEVGVIIFSSTGRLYDF

SEQ ID NO: 2757 - protein, 56 aa, Arabidopsis thaliana
  G861,MADS domain
AREKIQIRKIDNATARQVTFSKRRRGLFKKAEELSVLCDADVALIIFSSTGKLFEF

SEQ ID NO: 2758 - protein, 63 aa, Arabidopsis thaliana
  G864,AP2 domain
EKKFRGVRQRPWGKWAAEIRDPLKRVRLWLGTYNTAEEAAMVYDNAAIQLRGPDALTNFSVTP

SEQ ID NO: 2759 - protein, 68 aa, Arabidopsis thaliana
  G865,AP2 domain
RRHYRGVRQRPWGKWAAEIRDPKKAARVWLGTFETAEEAALAYDRAALKFKGTKAKLNFPERVQGPTT

SEQ ID NO: 2760 - protein, 258 aa, Arabidopsis thaliana
  G866,WRKY domain
NVDCSEITDFTVSKFKKVISLLNRSGHARFRRGPVHSPPSSSVPPPVKVTTPAPTQISAPAPVSFVQANQQSVTLDFTRPSVFGAKTKSSEVVEFAKESFSVSSNSSFMSSAITGDGSVSKGSSIFLAPAPAVPVTSSGKPPLSGLPYRKRCFEHDHSEGFSGKISGSGNGKCHCKKSRKNRMKRTVRVPAVSAKIADIPPDEYSWRKYGQKPIKGSPHPRGYYKCSTFRGCPARKHVERALDDSTMLIVTYEGEHRH

SEQ ID NO: 2761 - protein, 56 aa, Arabidopsis thaliana
  G869,AP2 domain
RKKPVGVRQRKWGKWAAEIRDPIKKTRTWLGTFDTLEEAAKAYDAKKLEFDAIVAG

SEQ ID NO: 2762 - protein, 67 aa, Arabidopsis thaliana
  G872,AP2 domain
QSKYKGVRKRKWGKWVSEIRLPHSRERIWLGSYDTPEKAARAFDAAQFCLRGGDANFNFPNNPPSIS

SEQ ID NO: 2763 - protein, 57 aa, Arabidopsis thaliana
  G877,1st WRKY domain
AEDGYNWRKYGQKLVKGSEYPRSYYKCTNPNCQVKKKVERSREGHITEIIYKGAHNH

SEQ ID NO: 2764 - protein, 117 aa, Arabidopsis thaliana
  G877,2nd WRKY domain
DDGYRWRKYGQKVVKGNPNPRSYYKCTAPGCTVRKHVERASHDLKSVITTYEGKHNHDVPAARNSSHGGGGDSGNGNSGGSAAVSHHYHNGHHSEPPRGRFDRQVTTNNQSPFSRPF

SEQ ID NO: 2765 - protein, 56 aa, Arabidopsis thaliana
  G878,1st WRKY domain
DDGYNWRKYGQKQVKGSDFPRSYYKCTHPACPVKKKVERSLDGQVTEIIYKGQHNH

SEQ ID NO: 2766 - protein, 61 aa, Arabidopsis thaliana
  G878,2nd WRKY domain
DDGYRWRKYGQKVVKGNPYPRSYYKCTTPDCGVRKHVERAATDPKAVVTTYEGKHNHDVPA

SEQ ID NO: 2767 - protein, 58 aa, Arabidopsis thaliana
  G881,WRKY domain
KDGFQWRKYGQKVTRDNPSPRAYFRCSFAPSCPVKKKVQRSAEDPSLLVATYEGTHNH

SEQ ID NO: 2768 - protein, 58 aa, Arabidopsis thaliana
  G883,WRKY domain
PDEYSWRKYGQKPIKGSPHPRGYYKCSTFRGCPARKHVERALDDPAMLIVTYEGEHRH

SEQ ID NO: 2769 - protein, 59 aa, Arabidopsis thaliana
  G884,1st WRKY domain
PADDGYNWRKYGQKQVKGSEFPRSYYKCTNPGCPVKKKVERSLDGQVTEIIYKGQHNHE

SEQ ID NO: 2770 - protein, 59 aa, Arabidopsis thaliana
  G884,2nd WRKY domain
LLDDGYRWRKYGQKVVKGNPYPRSYYKCTTPGCGVRKHVERAATDPKAVVTTYEGKHNH

SEQ ID NO: 2771 - protein, 94 aa, Arabidopsis thaliana
  G892,RING/C3H2C3 domain
GASSLEQLIEQLTQDDRPGPPPASEPTINSLPSVKITPQHLTNDMSQCTVCMEEFIVGGDATELPCKHIYHKDCIVPWLRLNNSCPICRRDLPL

SEQ ID NO: 2772 - protein, 22 aa, Arabidopsis thaliana
  G896,Z-LSDlike domain
CSGCRTPLQLPSGARSIRCALC

SEQ ID NO: 2773 - protein, 38 aa, Arabidopsis thaliana
  G898,RING/C3HC4 domain
CPICMCPFTEEMSTKCGHIFCKGCIKMAISRQGKCPTC

SEQ ID NO: 2774 - protein, 25 aa, Arabidopsis thaliana
  G903,Z-C2H2 domain
CEVCGKGFQRDQNLQLHRRGHNLPW

SEQ ID NO: 2775 - protein, 42 aa, Arabidopsis thaliana
  G904,RING/C3H2C3 domain
CAVCLSKFEPEDQLRLLPLCCHAFHADCIDIWLVSNQTCPLC

SEQ ID NO: 2776 - protein, 42 aa, Arabidopsis thaliana
  G905,RING/C3H2C3 domain
CPVCLNEFEDDETLRLIPQCCHVFHPGCIDAWLRSQTTCPLC

SEQ ID NO: 2777 - protein, 24 aa, Arabidopsis thaliana
  G910,1st Z-CO-like domain
CEFCKAYRAVVYCIADTANLCLTC

SEQ ID NO: 2778 - protein, 27 aa, Arabidopsis thaliana
  G910,2nd Z-CO-like domain
CHGCNDKFHGGGSSEHRRRDLRCYTGC

SEQ ID NO: 2779 - protein, 44 aa, Arabidopsis thaliana
  G911,RING/C3H2C3 domain
CTVCLSDFESDDKVRQLPKCGHVFHHHCLDRWIVDYNKMKCPVC

SEQ ID NO: 2780 - protein, 68 aa, Arabidopsis thaliana
  G912,AP2 domain
HPIYRGVRQRNSGKWVCEVREPNKKSRIWLGTFPTVEMAARAHDVAALALRGRSACLNFADSAWRLRI

SEQ ID NO: 2781 - protein, 67 aa, Arabidopsis thaliana
  G913,AP2 domain
HSIFRGIRLRNGKWVSEIREPRKTTRIWLGTYPVPEMAAAAYDVAALALKGPDAVLNFPGLALTYVA

SEQ ID NO: 2782 - protein, 57 aa, Arabidopsis thaliana
  G916,WRKY domain
DGCQWRKYGQKMAKGNPCPRAYYRCTMAVGCPVRKQVQRCAEDRTILITTYEGNHNH

SEQ ID NO: 2783 - protein, 56 aa, Arabidopsis thaliana
  G917,MADS domain
RKGKRVIKKIEEKIKRQVTFAKRKKSLIKKAYELSVLCDVHLGLIIFSHSNRLYDF

SEQ ID NO: 2784 - protein, 58 aa, Arabidopsis thaliana
  G921,WRKY domain
KDGYQWRKYGQKVTRDNPSPRAYFKCACAPSCSVKKKVQRSVEDQSVLVATYEGEHNH

SEQ ID NO: 2785 - protein, 66 aa, Arabidopsis thaliana
  G922,1st SCR domain
RRLFFEMFPILKVSYLLTNRAILEAMEGEKMVHVIDLDASEPAQWLALLQAFNSRPEGPPHLRITG

SEQ ID NO: 2786 - protein, 70 aa, Arabidopsis thaliana
  G922,2nd SCR domain
FLNAIWGLSPKVMVVTEQDSDHNGSTLMERLLESLYTYAALFDCLETKVPRTSQDRIKVEKMLFGEEIKN

SEQ ID NO: 2787 - protein, 74 aa, Arabidopsis thaliana
  G922,3rd SCR domain
CEGFERRERHEKLEKWSQRIDLAGFGNVPLSYYAMLQARRLLQGCGFDGYRIKEESGCAVICWQDRPLYSVSAW

SEQ ID NO: 2788 - protein, 58 aa, Arabidopsis thaliana
  G926,CAAT domain
EPVYVNAKQYEGILRRRKARAKAELERKVIRDRKPYLHESRHKHAMRRARASGGRFAK

SEQ ID NO: 2789 - protein, 64 aa, Arabidopsis thaliana
  G927,CAAT domain
STIYVNSKQYHGIIRRRQSRAKAAAVLDQKKLSSRCRKPYMHHSRHLHALRRPRGSGGRFLNTK

SEQ ID NO: 2790 - protein, 60 aa, Arabidopsis thaliana
  G928,CAAT domain
DPVFVNAKQYHAIMRRRQQRAKLEAQNKLIRARKPYLHESRHVHALKRPRGSGGRFLNTK

SEQ ID NO: 2791 - protein, 60 aa, Arabidopsis thaliana
  G929,CAAT domain
EPVFVNAKQYHGILRRRQSRAKLEARNRAIKAKKPYMHESRHLHAIRRPRGCGGRFLNAK

SEQ ID NO: 2792 - protein, 60 aa, Arabidopsis thaliana
  G931,CAAT domain
EPVFVNAKQFHAIMRRRQQRAKLEAQNKLIKARKPYLHESRHVHALKRPRGSGGRFLNTK

SEQ ID NO: 2793 - protein, 105 aa, Arabidopsis thaliana
  G932,MYB-(R1)R2R3 domain
KGPWTPEEDIILVSYIQEHGPGNWRSVPTHTGLRRCSKSCRLRWTNYLRPGIKRGNFTEHEEKMILHLQALLGNRWAAIASYLPERTDNDIKNYWNTHLKKKLKK

SEQ ID NO: 2794 - protein, 50 aa, Arabidopsis thaliana
  G937,GARP domain
WNPELHRRFVDALQQLGGPGVATPKQIREHMQEEGLTNDEVKSHLQKYRL

SEQ ID NO: 2795 - protein, 9 aa, Arabidopsis thaliana
  G938,EIL domain
AQDGILKYM

SEQ ID NO: 2796 - protein, 10 aa, Arabidopsis thaliana
  G939,EIL domain
AQDGILKYMS

SEQ ID NO: 2797 - protein, 171 aa, Arabidopsis thaliana
  G957,NAC domain
GQSKVPPGFRFHPTEEELLHYYLRKKVNSQKIDLDVIREVDLNKLEPWDIQEECRIGSTPQNDWYFFSHKDKKYPTGTRTNRATVAGFWKATGRDKIICSCVRRIGLRKTLVFYKGRAPHGQKSDWIMHEYRLDDTPMSNGYADVVTEDPMSYNEEGWVVCRVFRKKNYQK

SEQ ID NO: 2798 - protein, 150 aa, Arabidopsis thaliana
  G958,NAC domain
PPGFRFHPTDEELVIYYLKRKINGRTIELEIIPEIDLYKCEPWDLPGKSLLPSKDLEWFFFSPRDRKYPNGSRTNRATKAGYWKATGKDRKVTSHSRMVGTKKTLVYYRGRAPHGSRTDWVMHEYRLEEQECDSKSGIQDAYALCRVFKK

SEQ ID NO: 2799 - protein, 169 aa, Arabidopsis thaliana
  G961,NAC domain
QSQVPPGFRFHPTEEELLQYYLRKKVNSIEIDLDVIRDVDLNKLEPWDIQEMCKIGTTPQNDWYFFSHKDKKYPTGTRTNRATAAGFWKATGRDKIIYSNGRRIGMRKTLVFYKGRAPHGQKSDWIMHEYRLDDNIISPEDVTVHEVVSIIGEASQDEGWVVCRIFKKK

SEQ ID NO: 2800 - protein, 123 aa, Arabidopsis thaliana
  G962,NAC domain
PGFRFHPTEEELIEFYLRRKVEGKRFNVELITFLDLYRYDPWELPAMAAIGEKEWYFYVPRDRKYRNGDRPNRVTTSGYWKATGADRMIRSETSRPIGLKKTLVFYSGKAPKGTRTSWIMNEY

SEQ ID NO: 2801 - protein, 61 aa, Arabidopsis thaliana
  G964,HB domain
ETSRKKLRLSKDQSAFLEETFKEHNTLNPKQKLALAKKLNLTARQVEVWFQNRRARTKLKQ

SEQ ID NO: 2802 - protein, 64 aa, Arabidopsis thaliana
  G965,HB domain
EAWRPQRGLPERSVNILRAWLFEHFLNPYPSDADKHLLARQTGLSRNQVSNWFINARVRLWKPM

SEQ ID NO: 2803 - protein, 67 aa, Arabidopsis thaliana
  G971,AP2 domain
SSQYRGVTFYRRTGRWESHIWDCGKQVYLGGFDTAYAAARAYDRAAIKFRGLDADINFVVDDYRHDI

SEQ ID NO: 2804 - protein, 68 aa, Arabidopsis thaliana
  G974,AP2 domain
TKLYRGVRQRHWGKWVAEIRLPRNRTRLWLGTFDTAEEAALAYDKAAYKLRGDFARLNFPDLRHNDEY

SEQ ID NO: 2805 - protein, 68 aa, Arabidopsis thaliana
  G975,AP2 domain
TKKFRGVRQRHWGSWVAEIRHPLLKRRIWLGTFETAEEAARAYDEAAVLMSGRNAKTNFPLNNNNTGE

SEQ ID NO: 2806 - protein, 67 aa, Arabidopsis thaliana
  G976,AP2 domain
NPVYRGIRCRSGKWVSEIREPKKTTRVWLGTYPTPEMAAAAYDVAALALKGGDTLLNFPDSLGSYPI

SEQ ID NO: 2807 - protein, 68 aa, Arabidopsis thaliana
  G977,AP2 domain
QQRFRGVRQRHWGSWVSEIRHPLLKTRIWLGTFETAEDAARAYDEAARLMCGPRARTNFPYNPNAIPT

SEQ ID NO: 2808 - protein, 77 aa, Arabidopsis thaliana
  G979,1st AP2 domain
SSIYRGVTRHRWTGRFEAHLWDKSSWNSIQNKKGKQVYLGAYDSEEAAAHTYDLAALKYWGPDTILNFPAETYTKEL

SEQ ID NO: 2809 - protein, 69 aa, Arabidopsis thaliana
  G979,2nd AP2 domain
VSKYRGVARHHHNGRWEARIGRVFGNKYLYLGTYNTQEEAAAAYDMAAIEYRGANAVTNFDISNYIDRL

SEQ ID NO: 2810 - protein, 68 aa, Arabidopsis thaliana
  G987,1st SCR domain
YQTYISVCPFKKIAIIFANHSIMRLASSANAKTIHIIDFGISDGFQWPSLIHRLAWRRGSSCKLRITG

SEQ ID NO: 2811 - protein, 89 aa, Arabidopsis thaliana
  G987,2nd SCR domain
FRFRNLLDETVAVHSPRDTVLKLIRKIKPDVFIPGILSGSYNAPFFVTRFREVLFHYSSLFDMCDTNLTREDPMRVMFEKEFYGREIMN

SEQ ID NO: 2812 - protein, 76 aa, Arabidopsis thaliana
  G987,3rd SCR domain
KDTAADTIRAYRVYLSSSPFVTLMYFFSIWMILDVAKDAPVLHIVDFGILYGFQWPMFIQSISDRKDVPRKLRITG

SEQ ID NO: 2813 - protein, 94 aa, Arabidopsis thaliana
  G987,4th SCR domain
VNAGLRLKNLQDETGSEENCPRDAVLKLIRNMNPDVFIHAIVNGSFNAPFFISRFKEAVYHYSALFDMFDSTLPRDNKERIRFEREFYGREAMN

SEQ ID NO: 2814 - protein, 68 aa, Arabidopsis thaliana
  G988,1st SCR domain
NQLTPFIRFGHLTANQAILDATETNDNGALHILDLDISQGLQWPPLMQALAERSSNPSSPPPSLRITG

SEQ ID NO: 2815 - protein, 90 aa, Arabidopsis thaliana
  G988,2nd SCR domain
VNCVHFLHKIFNDDGDMIGHFLSAIKSLNSRIVTMAEREANHGDHSFLNRFSEAVDHYMAIFDSLEATLPPNSRERLTLEQRWFGKEILD

SEQ ID NO: 2816 - protein, 74 aa, Arabidopsis thaliana
  G988,3rd SCR domain
EETERKQRHRRFEIWEEMMKRFGFVNVPIGSFALSQAKLLLRLHYPSEGYNLQFLNNSLFLGWQNRPLFSVSSW

SEQ ID NO: 2817 - protein, 66 aa, Arabidopsis thaliana
  G989,1st SCR domain
LQTYNSVSPLIKFSHFTANQAIFQALDGEDSVHIIDLDVMQGLQWPALFHILASRPRKLRSIRITG

SEQ ID NO: 2818 - protein, 89 aa, Arabidopsis thaliana
  G989,2nd SCR domain
VVVHWMQHRLYDVTGNNLETLEILRRLKPNLITVVEQELSYDDGGSFLGRFVEALHYYSALFDALGDGLGEESGERFTVEQIVLGTEIR

SEQ ID NO: 2819 - protein, 73 aa, Arabidopsis thaliana
  G989,3rd SCR domain
NIVAHGGGRRKRMKWKEELSRVGFRPVSLRGNPATQAGLLLGMLPWNGYTLVEENGTLRLGWKDLSLLTASAW

SEQ ID NO: 2820 - protein, 8 aa, Arabidopsis thaliana
  G991,1st IAA domain
LELRLAPP

SEQ ID NO: 2821 - protein, 12 aa, Arabidopsis thaliana
  G991,2nd IAA domain
PVVGWPPVRSSR

SEQ ID NO: 2822 - protein, 34 aa, Arabidopsis thaliana
  G991,3rd IAA domain
YVKINMEGVPIGRKVNLSAYNNYQQLSHAVDQLF

SEQ ID NO: 2823 - protein, 37 aa, Arabidopsis thaliana
  G991,4th IAA domain
TLVYEDTEGDKVLVGDVPWEMFVSTVKRLHVLKTSHA

SEQ ID NO: 2824 - protein, 66 aa, Arabidopsis thaliana
  G993 AP2 domain
SSKYKGVVPQPNGRWGAQIYEKHQRVWLGTFNEEEEAASSYDIAVRRFRGRDAVTNFKSQVDGNDA

SEQ ID NO: 2825 - protein, 100 aa, Arabidopsis thaliana
  G993 B3 domain
REVLFEKTVTPSDVGKLNRLVIPKQHAEKHFPLPAMTTAMGMNPSPTKGVLINLEDRTGKVWRFRYSYWNSSQSYVLTKGWSRFVKEKNLRAGDVVCFER

SEQ ID NO: 2826 - protein, 110 aa, Arabidopsis thaliana
  G994,MYB-(R1)R2R3 domain
RKGPWTVEEDGKLVDFLRARGNCGGGGGGWCWRDVPKLAGLRRCGKSCRLRWTNYLRPDLKRGLFTEEEIQLVIDLHARLGNRWSKIAVELPGRTDNDIKNYWNTHIKRK

SEQ ID NO: 2827 - protein, 101 aa, Arabidopsis thaliana
  G996,MYB-(R1)R2R3 domain
KGLWSPEEDEKLLRYITKYGHGCWSSVPKQAGLQRCGKSCRLRWINYLRPDLKRGAFSQDEENLIIELHAVLGNRWSQIAAQLPGRTDNEIKNLWNSCLKK

SEQ ID NO: 2828 - protein, 65 aa, Arabidopsis thaliana
  G1006,AP2 domain
KAKHYRGVRQRPWGKFAAEIRDPAKNGARVWLGTFETAEDAALAYDIAAFRMRGSRALLNFPLRV

SEQ ID NO: 2829 - protein, 68 aa, Arabidopsis thaliana
  G1007,AP2 domain
KGVYRGARMRSWGKWVSEIREPRKKSRIWLGTFPTAEMAARAHDVAALSIKGSSAILNFPELADFLPR

SEQ ID NO: 2830 - protein, 56 aa, Arabidopsis thaliana
  G1011,MADS domain
VRGKIEMKKIENATSRQVTFSKRRNGLLKKAYELSVLCDAQLSLIIFSQRGRLYEF

SEQ ID NO: 2831 - protein, 57 aa, Arabidopsis thaliana
  G1012,WRKY domain
DDGYRWRKYGQKSVKNSLYPRSYYRCTQHMCNVKKQVQRLSKETSIVETTYEGIHNH

SEQ ID NO: 2832 - protein, 57 aa, Arabidopsis thaliana
  G1013,WRKY domain
DDGYKWRKYGQKSIKNSPNPRSYYKCTNPICNAKKQVERSIDESNTYIITYEGFHFH

SEQ ID NO: 2833 - protein, 374 aa, Arabidopsis thaliana
  G1017,ARF domain
PQLWHACAGSMVQIPSLNSTVFYFAQGHTEHAHAPPDFHAPRVPPLILCRVVSVKFLADAETDEVFAKITLLPLPGNDLDLENDAVLGLTPPSSDGNGNGKEKPASFAKTLTQSDANNGGGFSVPRYCAETIFPRLDYSAEPPVQTVIAKDIHGETWKFRHIYRGTPRRHLLTTGWSTFVNQKKLIAGDSIVFLRSESGDLCVGIRRAKRGGLGSNAGSDNPYPGFSGFLRDDESTTTTSKLMMMKRNGNNDGNAAATGRVRVEAVAEAVARAACGQAFEVVYYPRASTPEFCVKAADVRSAMRIRWCSGMRFKMAFETEDSSRISWFMGTVSAVQVADPIRWPNSPWRLLQVAWDEPDLLQNVKRVSPWLVEL

SEQ ID NO: 2834 - protein, 68 aa, Arabidopsis thaliana
  G1020,AP2 domain
EIRYRGVRKRPWGRYAAEIRDPVKKTRVWLGTFDTAQQAARAYDAAARDFRGVKAKTNFGVIVGSSPT

SEQ ID NO: 2835 - protein, 69 aa, Arabidopsis thaliana
  G1023,AP2 domain
VSKPVGVRQRKWGKWAAEIRHPITKVRTWLGTYETLEQAADAYATKKLEFDALAAATSAASSVLSNESG

SEQ ID NO: 2836 - protein, 73 aa, Arabidopsis thaliana
  G1033,HMG domain
DPNKPKRAPSAFFVFLEDFRVTFKKENPNVKAVSAVGKAGGQKWKSMSQAEKAPYEEKAAKRKAEYEKQMDAY

SEQ ID NO: 2837 - protein, 124 aa, Arabidopsis thaliana
  G1037,1st GARP domain
DQFPVGMRVLAVDDDQTCLKILESLLRHCQYHVTTTNQAQKALELLRENKNKFDLVISDVDMPDMDGFKLLELVGLEMDLPVIMLSAHSDPKYVMKGVTHGACDYLLKPVRIEELKNIWQHVVR

SEQ ID NO: 2838 - protein, 49 aa, Arabidopsis thaliana
  G1037,2nd GARP domain
WTVELHKKFVAAVNQLGYEKAMPKKILDLMNVEKLTRENVASHLQKFRL

SEQ ID NO: 2839 - protein, 50 aa, Arabidopsis thaliana
  G1038,GARP domain
WSFELHHKFVNAVNQIGCDHKAGPKKILDLMNVPWLTRENVASHLQKYRL

SEQ ID NO: 2840 - protein, 50 aa, Arabidopsis thaliana
  G1040,GARP domain
RWTSTLHAHFVHAVQLLGGHERATPKSVLELMNVKDLTLAHVKSHLQMYR

SEQ ID NO: 2841 - protein, 60 aa, Arabidopsis thaliana
  G1043,WRKY domain
EDAFSWRKYGQKEILNAKFPRSYFRCTHKYTQGCKATKQVQKVELEPKMFSITYIGNHTC

SEQ ID NO: 2842 - protein, 52 aa, Arabidopsis thaliana
  G1047,bZIP domain
RKRKRMESNRESAKRSRMRKQRHIDNLKDEANRLGLENRELANRLRIVLYNI

SEQ ID NO: 2843 - protein, 53 aa, Arabidopsis thaliana
  G1048,bZIP domain
DAVAKKRRRRVRNRDAAVRSRERKKEYVQDLEKKSKYLERECLRLGRMLECFV

SEQ ID NO: 2844 - protein, 56 aa, Arabidopsis thaliana
  G1049,bZIP domain
IINERKQRRMISNRESARRSRMRKQRHLDELWSQVMWLRIENHQLLDKLNNLSESH

SEQ ID NO: 2845 - protein, 54 aa, Arabidopsis thaliana
  G1050,bZIP domain
KRVKRILANRVSAARSKERKTRYMAELEHKVQTLQTEATTLSAQLTHLQRDSMG

SEQ ID NO: 2846 - protein, 62 aa, Arabidopsis thaliana
  G1051,bZIP domain
RVKRILANRQSAQRSRVRKLQYISELERSVTSLQAEVSVLSPRVAFLDHQRLLLNVDNSALK

SEQ ID NO: 2847 - protein, 61 aa, Arabidopsis thaliana
  G1052,bZIP domain
HDPKRVKRILANRQSAQRSRVRKLQYISELERSVTSLQTEVSVLSPRVAFLDHQRLLLNVD

SEQ ID NO: 2848 - protein, 47 aa, Arabidopsis thaliana
  G1053,bZIP domain
RKQRRMLSNRESARRSRMRKQRHLDELWSQVIRLRNENNCLIDKLNR

SEQ ID NO: 2849 - protein, 58 aa, Arabidopsis thaliana
  G1062,HLH/MYC domain
KKKGMPAKNLMAERRRRKKLNDRLYMLRSVVPKISKMDRASILGDAIDYLKELLQRIN

SEQ ID NO: 2850 - protein, 58 aa, Arabidopsis thaliana
  G1063,HLH/MYC domain
NVRISKDPQSVAARHRRERISERIRILQRLVPGGTKMDTASMLDEAIHYVKFLKKQVQ

SEQ ID NO: 2851 - protein, 64 aa, Arabidopsis thaliana
  G1064,PCF domain
STKDRHTKVDGRGRRIRMPALCAARVFQLTRELGHKSDGETIEWLLQQAEPSVIAATGTGTIPA

SEQ ID NO: 2852 - protein, 9 aa, Arabidopsis thaliana
  G1067 AT-hook domain
KRPRGRPPG

SEQ ID NO: 2853 - protein, 154 aa, Arabidopsis thaliana
  G1067,2nd conserved domain
GSKNKAKPPIIVTRDSPNALRSHVLEVSPGADIVESVSTYARRRGRGVSVLGGNGTVSNVTLRQPVTPGNGGGVSGGGGVVTLHGRFEILSLTGTVLPPPAPPGAGGLSIFLAGGQGQVVGGSVVAPLIASAPVILMAASFSNAVFERLPIEEE

SEQ ID NO: 2854 - protein, 8 aa, Arabidopsis thaliana
  G1068,AT-hook domain
KRNRGRPP

SEQ ID NO: 2855 - protein, 9 aa, Arabidopsis thaliana
  G1069,AT-hook domain
RRPRGRPPG

SEQ ID NO: 2856 - protein, 9 aa, Arabidopsis thaliana
  G1075,AT-hook domain
RRPRGRPAG

SEQ ID NO: 2857 - protein, 9 aa, Arabidopsis thaliana
  G1076,AT-hook domain
RRPRGRPPG

SEQ ID NO: 2858 - protein, 53 aa, Arabidopsis thaliana
  G1078,1st BZIPT2 domain
MGCAASKLDNEDAVRRCKDRRRLMKEAVYARHHLAAAHADYCRSLRITGSALS

SEQ ID NO: 2859 - protein, 111 aa, Arabidopsis thaliana
  G1078,2nd BZIPT2 domain
LCSTLDRLLAWEKKLYEEIKAREGFKIEHEKKLSQLQSQEYKGEDEAKLDKTKASITRLQSLIIVTSQAVTTTSTAIIRLRDTDLVPQLVELCHGFMYMWKSMHQYHETQN

SEQ ID NO: 2860 - protein, 50 aa, Arabidopsis thaliana
  G1079,BZIPT2 domain
MGCAASRIDNEEKVLVCRQRKRLMKKLLGFRGEFADAQLAYLRALRNTGV

SEQ ID NO: 2861 - protein, 53 aa, Arabidopsis thaliana
  G1082,1st BZIPT2 domain
MGCTSSKLDDLPAVALCRERCAFLEAAIHQRYALAESHVAYTHSLREIGHSLH

SEQ ID NO: 2862 - protein, 111 aa, Arabidopsis thaliana
  G1082,2nd BZIPT2 domain
NLSSTLHKLHLWEKKLYHEVKAEEKLRLAHEKKLRKLKRLDQRGAEAIKVDKTRKLVRDMSTKIRIAIQVVDKISVTINKIRDEDLWPQLNALIQGLTRMWKTMLECHQSQ

SEQ ID NO: 2863 - protein, 53 aa, Arabidopsis thaliana
  G1084,1st BZIPT2 domain
MGCSHSKLDDEEAVQICKDRKRFIKQAIEHRTKFASGHIAYIHSLRKVSDALH

SEQ ID NO: 2864 - protein, 130 aa, Arabidopsis thaliana
  G1084,2nd BZIPT2 domain
SHQTTLDRLFAWEKKLYDEVRVSNKRYKQLSGERVRRAYEKKCMQLRNQDVKGDDPLAVDKTRATIRDLDTQIKVSIHSIESISKRIETLRDQELLPQLLELVEGLTNGNHDHNRLTRMWKVMAESHQIQ

SEQ ID NO: 2865 - protein, 76 aa, Arabidopsis thaliana
  G1089,BZIPT2 domain
LEENETHATVLDKLLAWEKKLYDEVKAGELMKIEYQKKVAHLNRVKKRGGHSDSLERAKAAVSHLHTRYIVDMQSM

SEQ ID NO: 2866 - protein, 68 aa, Arabidopsis thaliana
  G1090,AP2 domain
QLSYRGIRRRKWGKWVSEIREPGKKTRIWLGSYETAEMAAAAYDAAALHLRGRGTNLNFPELVDSFPR

SEQ ID NO: 2867 - protein, 26 aa, Arabidopsis thaliana
  G1095,RING/C3H2C3 domain
CSVCLNEFQEDEKLRIIPNCCHVFHI

SEQ ID NO: 2868 - protein, 42 aa, Arabidopsis thaliana
  G1100,RING/C3H2C3 domain
CAVCICEFEDHETLRLMPECCHVFHADCVSVWLSDHSTCPLC

SEQ ID NO: 2869 - protein, 41 aa, Arabidopsis thaliana
  G1108,RING/C3H2C3 domain
CCICLAKYANNEELRELPCSHFFHKECVDKWLKINASCPLC

SEQ ID NO: 2870 - protein, 44 aa, Arabidopsis thaliana
  G1113,RING/C3H2C3 domain
CTVCLSDFVSDDKIRQLPKCGHVFHHRCLDRWIVDCNKITCPIC

SEQ ID NO: 2871 - protein, 9 aa, Arabidopsis thaliana
  G1128,AT-hook domain, domain in aa coordinates: 78-86
KKKRGRPRK

SEQ ID NO: 2872 - protein, 59 aa, Arabidopsis thaliana
  G1129,HLH/MYC domain
RRGQATDSHSIAERVRREKISERMKFLQDLVPGCDKITGKAGMLDEIINYVQSLQRQIE

SEQ ID NO: 2873 - protein, 58 aa, Arabidopsis thaliana
  G1133,HLH/MYC domain
SSKQETGSGLSDEQSRKDKIHTALRILESVVPGAKGKEALLLLDEAIDYLKLLKQSLN

SEQ ID NO: 2874 - protein, 59 aa, Arabidopsis thaliana
  G1134,HLH/MYC domain
KRGCATHPRSIAERVRRTRISDRIRKLQELVPNMDKQTNTADMLEEAVEYVKVLQRQIQ

SEQ ID NO: 2875 - protein, 58 aa, Arabidopsis thaliana
  G1136,HLH/MYC domain
NGREEPLNHVEAERQRREKLNQRFYSLRAVVPNVSKMDKASLLGDAISYINELKSKLQ

SEQ ID NO: 2876 - protein, 58 aa, Arabidopsis thaliana
  G1137,HLH/MYC domain
STKEDTGSGLSNEQSKKDKIRTALKILESVVPGAKGNEALLLLDEAIDYLKLLKRDLI

SEQ ID NO: 2877 - protein, 56 aa, Arabidopsis thaliana
  G1140,MADS domain
AREKIRIKKIDNITARQVTFSKRRRGIFKKADELSVLCDADVALIIFSATGKLFEF

SEQ ID NO: 2878 - protein, 58 aa, Arabidopsis thaliana
  G1142,HLH/MYC domain
RALAALRNHKEAERRRRERINSHLNKLRNVLSCNSKTDKATLLAKVVQRVRELKQQTL

SEQ ID NO: 2879 - protein, 58 aa, Arabidopsis thaliana
  G1143,HLH/MYC domain
EDENFKSPNLEAERRRREKLHCRLMALRSHVPIVTNMTKASIVEDAITYIGELQNNVK

SEQ ID NO: 2880 - protein, 44 aa, Arabidopsis thaliana
  G1145,bZIP domain
RRQKRMIKNRESAARSRARKQAYTHELEIKVSRLEEENERLRKQ

SEQ ID NO: 2881 - protein, 11 aa, Arabidopsis thaliana
  G1146,PAZ domain
GTSRPAHYHVL

SEQ ID NO: 2882 - protein, 21 aa, Arabidopsis thaliana
  G1150,PAZ domain
GVKGTSRPTHYHILWDENEFT

SEQ ID NO: 2883 - protein, 92 aa, Arabidopsis thaliana
  G1181,HS domain
PFLTKTFNLVEDSSIDDVISWNEDGSSFIVWNPTDFAKDLLPKHFKHNNFSSFVRQLNTYGFKKVVPDRWEFSNDFFKRGEKRLLREIQRRK

SEQ ID NO: 2884 - protein, 509 aa, Arabidopsis thaliana
  G1190,AKR domain
DYTPCTDPKRWKKYGVHRLSFLERHCPPVYEKNECLIPPPDGYKPPIRWPKSREQCWYRNVPYDWINKQKSNQHWLKKEGDKFHFPGGGTMFPRGVSHYVDLMQDLIPEMKDGTVRTAIDTGCGVASWGGDLLDRGILSLSLAPRDNHEAQVQFALERGIPAILGIISTQRLPFPSNAFDMAHCSRCLIPWTEFGGIYLLEIHRIVRPGGFWVLSGPPVNYNRRWRGWNTTMEDQKSDYNKLQSLLTSMCFKKYAQKDDIAVWQKLSDKSCYDKIAKNMEAYPPKCDDSIEPDSAWYTPLRPCVVAPTPKVKKSGLGSIPKWPERLHVAPERIGDVHGGSANSLKHDDGKWKNRVKHYKKVLPALGTDKIRNVMDMNTVYGGFSAALIEDPIWVMNVVSSYSANSLPVVFDRGLIGTYHDWCEAFSTYPRTYDLLHLDSLFTLESHRCEMKYILLEMDRILRPSGYVIIRESSYFMDAITTLAKGIRWSCRREETEYAVKSEKILVCQK

SEQ ID NO: 2885 - protein, 76 aa, Arabidopsis thaliana
  G1196,AKR domain
LHYAVAYSDPKVVTQVLDLDMADVNFRNSRGYTVLHIAAMRREPTIIIPLIQKGANASDFTFDGRSAVNICRRLTR

SEQ ID NO: 2886 - protein, 51 aa, Arabidopsis thaliana
  G1198,bZIP domain
KQLDAKTLRRLAQNREAARKSRLRKKAYVQQLESSRIKLSQLEQELQRARS

SEQ ID NO: 2887 - protein, 515 aa, Arabidopsis thaliana
  G1202,AKR domain
EYTPCEFVNRSLNFPRERLIYRERHCPEKHEIVRCRIPAPYGYSLPFRWPESRDVAWFANVPHTELTVEKKNQNWVRYEKDRFLFPGGGTMFPRGADAYIDEIGRLINLKDGSIRTAIDTGCGVASFGAYLMSRNIVTMSFAPRDTHEAQVQFALERGVPAIIGVLASIRLPFPARAFDIAHCSRCLIPWGQYNGTYLIEVDRVLRPGGYWILSGPPINWQRHWKGWERTRDDLNSEQSQIERVARSLCWRKLVQREDLAVWQKPTNHVHCKRNRIALGRPPFCHRTLPNQGWYTKLETCLTPLPEVTGSEIKEVAGGQLARWPERLNALPPRIKSGSLEGITEDEFVSNTEKWQRRVSYYKKYDQQLAETGRYRNFLDMNAHLGGFASALVDDPVWVMNVVPVEASVNTLGVIYERGLIGTYQNWCEAMSTYPRTYDFIHADSVFSLYKDRCDMEDILLEMDRILRPKGSVIIRDDIDVLTKVKKITDAMQWEGRIGDHENGPLEREKILFLVK

SEQ ID NO: 2888 - protein, 47 aa, Arabidopsis thaliana
  G1206,1st ENBP domain
CHQCLKGERITLLICSECEKTMFCLQCIRKWYPNLSEDDVVEKCPLC

SEQ ID NO: 2889 - protein, 274 aa, Arabidopsis thaliana
  G1206,2nd ENBP domain
LPRHCDEFISALPFQEYSDPRTGILNIATKLPEGFIKPDLGPKTYIAYGIPDELGRGDSVTKLHCDMSDAVNILTHTAEVTLSQEQISSVKALKQKHKLQNKVDKQSTEDCNEKEEEEEEELNMPEISSNENEETGSALWDIFRREDVPKLEEYLRKHCKEFRHTYCSPVTKVTTPTCINFMTNLFPVLTVSSFQVYHPIHDQSCYLTLEHKRKLKAEYGIEPWTFVQKLGEAVFIPAGCPHQVRNLKSCTKVAVDFVSPENIHECLRLTEEFR

SEQ ID NO: 2890 - protein, 60 aa, Arabidopsis thaliana
  G1225,HLH/MYC domain
EAENQRMTHIAVERNRRRQMNQHLSVLRSLMPQPFAHKGDQASIVGGAIDFIKELEHKLL

SEQ ID NO: 2891 - protein, 60 aa, Arabidopsis thaliana
  G1226,HLH/MYC domain
EVENQRMTHIAVERNRRRQMNEHLNSLRSLMPPSFLQRGDQASIVGGAIDFIKELEQLLQ

SEQ ID NO: 2892 - protein, 60 aa, Arabidopsis thaliana
  G1228,HLH/MYC domain
EIENQRINHIAVERNRRRQMNEHINSLRALLPPSYIQRGDQASIVGGAINYVKVLEQIIQ

SEQ ID NO: 2893 - protein, 60 aa, Arabidopsis thaliana
  G1229,HLH/MYC domain
QDGQQKMSHVTVERNRRKQMNEHLTVLRSLMPCFYVKRGDQASIIGGVVEYISELQQVLQ

SEQ ID NO: 2894 - protein, 85 aa, Arabidopsis thaliana
  G1242,1st SWI/SNF domain
DILEDYLMYRGYQYCRIDGNTGGDERDASIEAYNKPGSEKFVFLLSTRAGGLGINLATADVVILYDSDWNPQVDLQAQDRAHRIG

SEQ ID NO: 2895 - protein, 50 aa, Arabidopsis thaliana
  G1242,2nd SWI/SNF domain
GFSTWSRRDFNAFIRACEKYGRNDIKSIASEMEGKTEEEVERYAQVFQVR

SEQ ID NO: 2896 - protein, 62 aa, Arabidopsis thaliana
  G1242,3rd SWI/SNF domain
KGKLYNEECDRFMICMVHKLGYGNWDELKAAFRTSPLFRFDWFVKSRTTQELARRCDTLIRL

SEQ ID NO: 2897 - protein, 113 aa, Arabidopsis thaliana
  G1246,MYB-(R1)R2R3 domain
KKGPWTAAEDEILAAYVRENGEGNWNAVQKNTGLARCGKSCRLRWANHLRPNLKKGSFTGDEERLIIQLHAQLGNKWARMAAQLPGRTDNEIKNYWNTRLKRLLRQGLPLYPP

SEQ ID NO: 2898 - protein, 124 aa, Arabidopsis thaliana
  G1247,MYB-(R1)R2R3 domain
KSKWKPEEDRILKDYVIQYGDRTWTHVPKRTGLPHNPASCRFRWMNHLKPSLKKGPFTDEEEKRVLQLHAVLGNKWSQMAREVCNSLSFFFHSLHFHLLLLFDLNFCFFKFPGRTDNEIKNFWN

SEQ ID NO: 2899 - protein, 84 aa, Arabidopsis thaliana
  G1248,CAAT domain
QEESMMVKEQDRLLPIANVGRIMKNILPANAKVSKEAKETMQECVSEFISFVTGEASDKCHKEKRKTVNGDDICWAMANLGFDD

SEQ ID NO: 2900 - protein, 77 aa, Arabidopsis thaliana
  G1249,CAAT domain
PIGRVKKIMKLDKDINKINSEALHVITYSTELFLHFLAEKSAVVTAEKKRKTVNLDHLRIAVKRHQPTSDFLLDSLP

SEQ ID NO: 2901 - protein, 39 aa, Arabidopsis thaliana
  G1255,Z-CO-like domain
SCVKRRARWYCAADDAFLCQSCDSLVHSANPLARRHERV

SEQ ID NO: 2902 - protein, 69 aa, Arabidopsis thaliana
  G1266,AP2 domain
EKSYRGVRRRPWGKFAAEIRDSTRNGIRVWLGTFESAEEAALAYDQAAFSMRGSSAILNFSAERVQESL

SEQ ID NO: 2903 - protein, 58 aa, Arabidopsis thaliana
  G1267,WRKY domain
SDSWAWRKYGQKPIKGSPYPRGYYRCSSSKGCPARKQVERSRVDPSKLMITYACDHNH

SEQ ID NO: 2904 - protein, 47 aa, Arabidopsis thaliana
  G1269,MYB-related domain
EKWTEAEHEKFVEALKLYGRAWRRIEEHVGTKTAVQIRSHAQKFFTK

SEQ ID NO: 2905 - protein, 38 aa, Arabidopsis thaliana
  G1272,PAZ domain
PENVPPGTIIDNKICHPKNNDFYLCAHAGMIGTTRPTH

SEQ ID NO: 2906 - protein, 56 aa, Arabidopsis thaliana
  G1273,1st WRKY domain
VDGYNWRKYGQKQVKGSECPRSYYKCTHPKCPVKKKVERSVEGQVSEIVYQGEHNH

SEQ ID NO: 2907 - protein, 57 aa, Arabidopsis thaliana
  G1273,2nd WRKY domain
EDGFRWRKYGQKVVGGNAYPRSYYRCTSANCRARKHVERASDDPRAFITTYEGKHNH

SEQ ID NO: 2908 - protein, 57 aa, Arabidopsis thaliana
  G1275,WRKY domain
DDGFKWRKYGKKMVKNSPHPRNYYKCSVDGCPVKKRVERDRDDPSFVITTYEGSHNH

SEQ ID NO: 2909 - protein, 67 aa, Arabidopsis thaliana
  G1276,1st AP2 domain
SSQYRGVTFYRRTGRWESHIWDCGKQVYLGGFDTAHAAARAYDRAAVKFRGLEADINFVIGDYEEDL

SEQ ID NO: 2910 - protein, 56 aa, Arabidopsis thaliana
  G1276,2nd AP2 domain
NSRYQGVALQKIGGWGAQMEQLHGNMGCDKAAVQWKGREAASLIEPHASRMIPEAA

SEQ ID NO: 2911 - protein, 68 aa, Arabidopsis thaliana
  G1277,AP2 domain
ERPFKGIRMRKWGKWVAEIREPNKRSRLWLGSYSTPEAAARAYDTAVFYLRGPTATLNFPELLPCTSA

SEQ ID NO: 2912 - protein, 489 aa, Arabidopsis thaliana
  G1289,AKR domain
DYIPCLDNYAAIKQLKSRRHMEHRERHCPEPSPKCLLPLPDNYKPPVPWPKSRDMIWYDNVPHPKLVEYKKEQNWVKKEGEFLVFPGGGTQFKFGVTHYVEFIEKALPSIKWGKNIRVVLDVGCGVASFGGSLLDKDVITMSFAPKDEHEAQIQFALERGIPATLSVIGTQQLTFPSNAFDLIHCARCRVHWDADGGKPLLELNRVLRPGGFFIWSATPVYRDNDRDSRIWNEMVSLTKSICWKVVTKTVDSSGIGLVIYQKPTSESCYNKRSTQDPPLCDKKEANGSWYVPLAKCLSKLPSGNVQSWPELWPKRLVSVKPQSISVKAETLKKDTEKWSASVSDVYLKHLAVNWSTVRNVMDMNAGFGGFAAELINQPLWVMNDVPVDKPDTLSVVYDRGLIGVYHDWCESVNTYPRTYDLLHSSFLLGDLTQRCEIVQVVAEIDRIVRPGGYLVVQDNMETIMKLESILGSLHWSTKIYEDRFLVGRK

SEQ ID NO: 2913 - protein, 97 aa, Arabidopsis thaliana
  G1290,AKR domain
IYKALDSDDVELVKMLLLEGHTNLDEAYALHFAIAHCAVKTAYDLLELELADVNLRNPRGYTVLHVAAMRKEPKLIISLLMKGANILDTTLDGRTAL

SEQ ID NO: 2914 - protein, 106 aa, Arabidopsis thaliana
  G1304,MYB-(R1)R2R3 domain
KKGPWTQEEDDKLIDHIQKHGHGSWRALPKQAGLNRCGKSCRLRWTNYLRPDIKRGNFTEEEEQTIINLHSLLGNKWSSIAGNLPGRTDNEIKNYWNTHLRKKLLQ

SEQ ID NO: 2915 - protein, 104 aa, Arabidopsis thaliana
  G1305,MYB-(R1)R2R3 domain
KRGPWSDEESERLRSFILKNGHQNWRSLPKLAGLMRCGKSCRLRWINYLRPGLKRGNFTKEEEDTIIHLHQAYGNKWSKIASNFPGRTDNEIKNVWNTHLKKRL

SEQ ID NO: 2916 - protein, 103 aa, Arabidopsis thaliana
  G1309,MYB-(R1)R2R3 domain
RKGLWSPEEDQKLKSFILSRGHACWTTVPILAGLQRNGKSCRLRWINYLRPGLKRGSFSEEEEETILTLHSSLGNKWSRIAKYLPGRTDNEIKNYWHSYLKKR

SEQ ID NO: 2917 - protein, 102 aa, Arabidopsis thaliana
  G1311,MYB-(R1)R2R3 domain
RGPWLEEEDERLVKVISLLGERRWDSLAIVSGLKRSGKSCRLRWMNYLNPTLKRGPMSQEEERIIFQLHALWGNKWSKIARRLPGRTDNEIKNYWRTHYRKK

SEQ ID NO: 2918 - protein, 104 aa, Arabidopsis thaliana
  G1313,MYB-(R1)R2R3 domain
LKKGPWSSAEDDILIDYVNKHGEGNWNAVQKHTSLFRCGKSCRLRWANHLRPNLKKGAFSQEEEQLIVELHAKMGNRWARMAAHLPGRTDNEIKNYWNTRIKRR

SEQ ID NO: 2919 - protein, 103 aa, Arabidopsis thaliana
  G1314,MYB-(R1)R2R3 domain
RGPWSPEEDSKLRDYIEKYGNGGNWISFPLKAGLRRCGKSCRLRWLNYLRPNIKHGDFSEEEDRIIFSLFAAIGSRWSIIAAHLPGRTDNDIKNYWNTKLRKK

SEQ ID NO: 2920 - protein, 106 aa, Arabidopsis thaliana
  G1317,MYB-(R1)R2R3 domain
KKGPWTAEEDQKLIDYIRFHGPGNWRTLPKNAGLHRCGKSCRLRWTNYLRPDIKRGRFSFEEEETIIQLHSVMGNKWSAIAARLPGRTDNEIKNHWNTHIRKRLVR

SEQ ID NO: 2921 - protein, 105 aa, Arabidopsis thaliana
  G1322,MYB-(R1)R2R3 domain
RKGPWTMEEDFILFNYILNHGEGLWNSVAKASGLKRTGKSCRLRWLNYLRPDVRRGNITEEEQLLIIQLHAKLGNRWSKIAKHLPGRTDNEIKNFWRTKIQRHMK

SEQ ID NO: 2922 - protein, 102 aa, Arabidopsis thaliana
  G1323,MYB-(R1)R2R3 domain
KRGPWSHDEDLKLISFIHKNGHENWRSLPKQAGLLRCGKSCRLRWINYLRPDVKRGNFSAEEEDTIIKLHQSFGNKWSKIASKLPGRTDNEIKNVWHTHLKK

SEQ ID NO: 2923 - protein, 99 aa, Arabidopsis thaliana
  G1324,MYB-(R1)R2R3 domain
RRGPWTLEEDTLLTNYILHNGEGRWNHVAKCAGLKRTGKSCRLRWLNYLKPDIRRGNLTPQEQLLILELHSKWGNRWSKIAQYLPGRTDNEIKNYWRTR

SEQ ID NO: 2924 - protein, 104 aa, Arabidopsis thaliana
  G1326,MYB-(R1)R2R3 domain
QRGHWRPVEDDNLRQLVEQYGPKNWNFIAQHLYGRSGKSCRLRWYNQLDPNITKKPFTEEEEERLLKAHRIQGNRWASIARLFPGRTDNAVKNHFHVIMARRKR

SEQ ID NO: 2925 - protein, 103 aa, Arabidopsis thaliana
  G1327,MYB-(R1)R2R3 domain
VKRGPWSPQEDLTLITFIQKHGHQNWRSLPKLAGLLRCGKSCRLRWINYLRPDVKRGNFSKKEEDAIIHYHQTLGNKWSKIASFLPGRTDNEIKNVWNTHLKK

SEQ ID NO: 2926 - protein, 106 aa, Arabidopsis thaliana
  G1328,MYB-(R1)R2R3 domain
KKGPWTPEEDQKLIDYINIHGYGNWRTLPKNAGLQRCGKSCRLRWTNYLRPDIKRGRFSFEEEETIIQLHSIMGNKWSAIAARLPGRTDNEIKNYWNTHIRKRLLK

SEQ ID NO: 2927 - protein, 107 aa, Arabidopsis thaliana
  G1330,MYB-(R1)R2R3 domain
RGPWTVEEDLELINYIASHGEGRWNSLARCAELKRTGKSCRLRWLNYLRPDVRRGNITLEEQLLILELHTRWGNRWSKIAQYLPGRTDNEIKNYWRTRVQKHAKQLK

SEQ ID NO: 2928 - protein, 102 aa, Arabidopsis thaliana
  G1331,MYB-(R1)R2R3 domain
KGPWTAEEDRLLIEYVRVHGEGRWNSVSKLAGLKRNGKSCRLRWVNYLRPDLKRGQITPHEESIILELHAKWGNRWSTIARSLPGRTDNEIKNYWRTHFKKK

SEQ ID NO: 2929 - protein, 104 aa, Arabidopsis thaliana
  G1332,MYB-(R1)R2R3 domain
KRGLWKPEEDMILKSYVETHGEGNWADISRRSGLKRGGKSCRLRWKNYLRPNIKRGSMSPQEQDLIIRMHKLLGNRWSLIAGRLPGRTDNEVKNYWNTHLNKKP

SEQ ID NO: 2930 - protein, 58 aa, Arabidopsis thaliana
  G1334,CAAT domain
DGTIYVNSKQYHGIIRRRQSRAKAEKLSRCRKPYMHHSRHLHAMRRPRGSGGRFLNTK

SEQ ID NO: 2931 - protein, 20 aa, Arabidopsis thaliana
  G1335,1st Z-CLDSH domain
FGFITPDDGGDDLFVHQSSI

SEQ ID NO: 2932 - protein, 14 aa, Arabidopsis thaliana
  G1335,2nd Z-CLDSH domain
CYKCGEPGHMARDC

SEQ ID NO: 2933 - protein, 19 aa, Arabidopsis thaliana
  G1335,3rd Z-CLDSH domain
CYSCGESGHFARDCTSGGR

SEQ ID NO: 2934 - protein, 67 aa, Arabidopsis thaliana
  G1337,Z-CO-like domain
CDFCGERTAVLFCRADTAKLCLPCDQQVHTANLLSRKHVRSQICDNCGNEPVSVRCFTDNLILCQEC

SEQ ID NO: 2935 - protein, 89 aa, Arabidopsis thaliana
  G1340,TH domain
KPAELRWKWIEEYCWRRGCYRNQNQCNDKWDNLMRDYKKIREYERSRVESSFNTVTSSSYWKMDKTERKEKNLPSNMLPQIYDVLSELV

SEQ ID NO: 2936 - protein, 34 aa, Arabidopsis thaliana
  G1341,1st BZIPT2 domain
MGCCQSRIDSKEIVSRCKARKRYLKHLVKARQTL

SEQ ID NO: 2937 - protein, 111 aa, Arabidopsis thaliana
  G1341,2nd BZIPT2 domain
SHSSTVDRLYAWEKKLYQEVKYAESIKMDHEKKVEQVRRLEMKRAEYVKTEKAKKDVEKLESQLSVSSQAIQSASNEIIKLRETELYPQLVELVKGLMCMWRSMYESHQVQ

SEQ ID NO: 2938 - protein, 142 aa, Arabidopsis thaliana
  G1357,NAC domain
GFKFSPTDIELISYYLKRKMDGLERSVEIIPEVEIYNFEPWDLPDKSIVKSDSEWFFFCARGKKYPHGSQNRRATKIGYWKATGKERNVKSGSEVIGTKRTLVFHIGRAPKGGRTEWLMHEYCMIGVSLDALVICRLRRNTE

SEQ ID NO: 2939 - protein, 142 aa, Arabidopsis thaliana
  G1361,NAC domain
LPAGVKFDPTDQEVLEHLEGKVRDDAKKLHPLIDEFIRTIDGENGICYTHPEKLPGVNKDGTVRHFFHRPSKAYTTGTRKRRKVHTDSDVGGETRWHKTGKTRPVLAGGRVRGYKKILVLYTNYGKQKKPEKTNWVMHQYHL

SEQ ID NO: 2940 - protein, 60 aa, Arabidopsis thaliana
  G1363,CAAT domain
EPIFVNAKQYQAILRRRERRAKLEAQNKLIKVRKPYLHESRHLHALKRVRGSGGRFLNTK

SEQ ID NO: 2941 - protein, 90 aa, Arabidopsis thaliana
  G1364,CAAT domain
REQDRFLPIANISRIMKRGLPANGKIAKDAKEIVQECVSEFISFVTSEASDKCQREKRKTINGDDLLWAMATLGFEDYMEPLKVYLMRYR

SEQ ID NO: 2942 - protein, 68 aa, Arabidopsis thaliana
  G1380,AP2 domain
EPRYRGVRKRPWGRFAAEIRDPLKKSRVWLGTFDSAVDAARAYDTAARNLRGPKAKTNFPIDCSPSSP

SEQ ID NO: 2943 - protein, 57 aa, Arabidopsis thaliana
  G1382,1st WRKY domain
ADDGYNWRKYGQKHVKGSEFPRSYYKCTHPNCEVKKLFERSHDGQITDIIYKGTHDH

SEQ ID NO: 2944 - protein, 53 aa, Arabidopsis thaliana
  G1382,2nd WRKY domain
RWRKYGQKVVRGNPNPRSYYKCTAHGCPVRKHVERASHDPKAVITTYEGKHDH

SEQ ID NO: 2945 - protein, 68 aa, Arabidopsis thaliana
  G1384,AP2 domain
AKLYRGVRQRHWGKWVAEIRLPRNRTRLWLGTFDTAEEAALAYDRAAFKLRGDSARLNFPALRYQTGS

SEQ ID NO: 2946 - protein, 68 aa, Arabidopsis thaliana
  G1387,AP2 domain
SKKFRGVRQRQWGSWVSEIRHPLLKRRVWLGTFDTAETAARAYDQAAVLMNGQSAKTNFPVIKSNGSN

SEQ ID NO: 2947 - protein, 58 aa, Arabidopsis thaliana
  G1389,TEO domain
KDRHSKVFTSKGPRDRRVRLSAHTAIQFYDVQDRLGYDRPSKAVDWLIKKAKTAIDKL

SEQ ID NO: 2948 - protein, 9 aa, Arabidopsis thaliana
  G1399,AT-hook domain, domain in aa coordinates: 86-94
KKKRGRPRK

SEQ ID NO: 2949 - protein, 68 aa, Arabidopsis thaliana
  G1411,AP2 domain
RRHYRGVRQRPWGKWAAEIRDPKKAARVWLGTFETAESAALAYDEAALKFKGSKAKLNFPERVQLGSN

SEQ ID NO: 2950 - protein, 150 aa, Arabidopsis thaliana
  G1412,NAC domain
SLPPGFRFYPTDEELLVQYLCRKVAGYHFSLQVIGDIDLYKFDPWDLPSKALFGEKEWYFFSPRDRKYPNGSRPNRVAGSGYWKATGTDKIITADGRRVGIKKALVFYAGKAPKGTKTNWIMHEYRLIEHSRSHGSSKLDDWVLCRIYKK

SEQ ID NO: 2951 - protein, 58 aa, Arabidopsis thaliana
  G1417,WRKY domain
NDGCQWRKYGQKMAKGNPCPRAYYRCTMAVGCPVRKQVQRCAEDTTILTTTYEGNHNH

SEQ ID NO: 2952 - protein, 69 aa, Arabidopsis thaliana
  G1419,AP2 domain
QRHYRGVRRRPWGKYAAEIRDPNKKGVRVWLGTFDTAMEAARGYDKAAFKLRGSKAILNFPLEAGKHED

SEQ ID NO: 2953 - protein, 60 aa, Arabidopsis thaliana
  G1420,WRKY domain
DDGYRWRKYGQKAVKNSPYPRSYYRCTTVGCGVKKRVERSSDDPSIVMTTYEGQHTHPFP

SEQ ID NO: 2954 - protein, 63 aa, Arabidopsis thaliana
  G1421,AP2 domain
TRKFRGVRQRPWGKWAAEIRDPSRRVRVWLGTFDTAEEAAIVYDNAAIQLRGPNAELNFPPPP

SEQ ID NO: 2955 - protein, 57 aa, Arabidopsis thaliana
  G1423,MADS domain
GTKRKIAIETIQKRDSLRVTCTKRREGLYSKASQLCLLSDAQIAILATPPSSESNVS

SEQ ID NO: 2956 - protein, 154 aa, Arabidopsis thaliana
  G1425,NAC domain
GFRFHPTDEELVIHYLKRKADSVPLPVAIIADVDLYKFDPWELPAKASFGEQEWYFFSPRDRKYPNGARPNRAATSGYWKATGTDKPVISTGGGGSKKVGVKKALVFYSGKPPKGVKSDWIMHEYRLTDNKPTHICDFGNKKNSLRLDDWVLCR

SEQ ID NO: 2957 - protein, 49 aa, Arabidopsis thaliana
  G1435,GARP domain
WTPQLHKRFVDVVAHLGIKNAVPKTIMQLMNVEGLTRENVASHLQKYRL

SEQ ID NO: 2958 - protein, 85 aa, Arabidopsis thaliana
  G1444,GRF-like domain
PVPLSDLYFNRSPTATARYFRGGYKDGGDDFGSLQLSLPPPSQISDRLIQRDLIKKKEEVKALDDDNGDVDVKSRTDASGSKNVN

SEQ ID NO: 2959 - protein, 405 aa, Arabidopsis thaliana; identical to SEQ ID NO: 986
  G1446,MISC domain

SEQ ID NO: 2960 - protein, 6 aa, Arabidopsis thaliana
  G1449,1st IAA domain
WPPIKS

SEQ ID NO: 2961 - protein, 34 aa, Arabidopsis thaliana
  G1449,2nd IAA domain
FVKVYMEGVPIGRKLDLCVFSGYESLLENLSHMF

SEQ ID NO: 2962 - protein, 31 aa, Arabidopsis thaliana
  G1449,3rd IAA domain
VLTYEDKDGDWMMVGDIPWDMFLETVRRLKI

SEQ ID NO: 2963 - protein, 336 aa, Arabidopsis thaliana
  G1451,ARF domain
ELWHACAGPLVSLPSSGSRVVYFPQGHSEQVAATTNKEVDGHIPNYPSLPPQLICQLHNVTMHADVETDEVYAQMTLQPLTPEEQKETFVPIELGIPSKQPSNYFCKTLTASDTSTHGGFSVPRRAAEKVFPPLDYTLQPPAQELIARDLHDVEWKFRHIFRGQPKRHLLTTGWSVFVSAKRLVAGDSVIFIRNEKNQLFLGIRHATRPQTIVPSSVLSSDSMHIGLLAAAAHASATNSCFTVFFHPRASQSEFVIQLSKYIKAVFHTRISVGMRFRMLFETEESSVRRYMGTITGISDLDSVRWPNSHWRSVKVGWDESTAGERQPRVSLWEIEP

SEQ ID NO: 2964 - protein, 142 aa, Arabidopsis thaliana
  G1452,NAC domain
GFRFSPTDVELISYYLRRKIDGDENSVAVIAEVEIYKFEPWDLPEESKLKSENEWFYFCARGRKYPHGSQSRRATQLGYWKATGKERSVKSGNQVVGTKRTLVFHIGRAPRGERTEWIMHEYCIHGAPQDALVVCRLRKNAD

SEQ ID NO: 2965 - protein, 148 aa, Arabidopsis thaliana
  G1453,NAC domain
PPGFRFHPTDEELVGYYLKKKIASQRIDLDVIREIDLYKIEPWDLQERCRIGYEEQTEWYFFSHRDKKYPTGTRTNRATVAGFWKATGRDKAVYLNSKLIGMRKTLVFYRGRAPNGQKSDWIIHEYYSLESHQNSPPQEEGWVVCRAF

SEQ ID NO: 2966 - protein, 260 aa, Arabidopsis thaliana
  G1462,NAC domain
ELLYSEDEVIISRYLKGMVVNGDSWPDHFIEDANVFTKNPDKVFNSERPRFVIVKPRTEACGKTDGCDSGCWRIIGRDKLIKSEETGKILGFKKILKFCLKRKPIDYKRSWVMEEYRLTNNLNWKQDHVICKIRFMFEAEISFLLSKHFYTTSESVLENELLPSYGYYLSNTQEEDEFYLDAIMTSEGNEWPSYVTNNVYCLHPLELVDLQDRMFNDYGTCIFANKTCGETDKCDGGYWKILHGDKLIKSNFGKVIGFKK

SEQ ID NO: 2967 - protein, 148 aa, Arabidopsis thaliana
  G1463,NAC domain
PLFLGRFSFVMADTLLNAEDEVIISRYLKPMIVNRVSWPDLFIEDADVFNKDPYVKFHAEIPSFVIVKPRTKACGKTDGCDSGCWRIIGRDKLIKSEETGKILGFKKILKFCLKWKPREYKRSLVMEEYRLTNNFNWKQDHVICKIRL

SEQ ID NO: 2968 - protein, 65 aa, Arabidopsis thaliana
  G1465,NAC domain
KTDRCINGGYWKILHRDRLIKSKSGIVIGFKKVFKFHETEKERYFCGGEDVKVTWTLEEYRLSVK

SEQ ID NO: 2969 - protein, 267 aa, Arabidopsis thaliana
  G1466,PMR domain
GFGRDKVNGRYKVVRMSFAFWRVRQEEPVVECGVLDVDTGEWRKLSPPPYVVNVGSKSVCVNGSIYWLHIQTVYRILALDLHKQEFHKVPVPPTQITVDTQMVNLEDRLVLAITRVSPEWILEVWGMDTYKEKWSKTYSISLDHRVVSWRRQKRWFTPVAVSKQANLVFYDNKKRLFKYYPVKDEIRCLSLDICVLSPYVENLVPLPLKPSHPHPTPKNSDFEMRISRCRLFSTPGSWISKILKWNVMTLEILFTSLAIVGYICLPL

SEQ ID NO: 2970 - protein, 21 aa, Arabidopsis thaliana
  G1468,1st Z-C2H2 domain
CKACKKVFTSHQALGGHRASH

SEQ ID NO: 2971 - protein, 21 aa, Arabidopsis thaliana
  G1468,2nd Z-C2H2 domain
CTICHRVFSSGQALGGHKRCH

SEQ ID NO: 2972 - protein, 22 aa, Arabidopsis thaliana
  G1471,Z-C2H2 domain
CYLCKRAFPTPHALGGHGTTHK

SEQ ID NO: 2973 - protein, 24 aa, Arabidopsis thaliana
  G1472,Z-C2H2 domain
CRFCKRNFKSCFALGGHMKCHKKE

SEQ ID NO: 2974 - protein, 28 aa, Arabidopsis thaliana
  G1474,Z-C2H2 domain
CSFCRREFKSAQALGGHMNVHRRDRARL

SEQ ID NO: 2975 - protein, 21 aa, Arabidopsis thaliana
  G1476,Z-C2H2 domain
CTFCKRGFTNAQALGGHMNIH

SEQ ID NO: 2976 - protein, 45 aa, Arabidopsis thaliana
  G1478,Z-CO-like domain
CELCGENATVYCEADAAFLCRKCDRWVHSANFLARRHLRRVICTT

SEQ ID NO: 2977 - protein, 24 aa, Arabidopsis thaliana
  G1480,1st Z-CO-like domain
CDSCKSATAALYCRPDAAFLCLSC

SEQ ID NO: 2978 - protein, 25 aa, Arabidopsis thaliana
  G1480,2nd Z-CO-like domain
MCEVCEQAPAHVTCKADAAALCVTC

SEQ ID NO: 2979 - protein, 23 aa, Arabidopsis thaliana
  G1481,1st Z-CO-like domain
CDLCNGVARMYCESDQASLCWDC

SEQ ID NO: 2980 - protein, 27 aa, Arabidopsis thaliana
  G1481,2nd Z-CO-like domain
CSACQSLTPWKATGLRLGPTFSVCESC

SEQ ID NO: 2981 - protein, 59 aa, Arabidopsis thaliana
  G1482,Z-CO-like domain
CDVCDKEEASVFCTADEASLCGGCDHQVHHANKLASKHLRFSLLYPSSSNTSSPLCDIC

SEQ ID NO: 2982 - protein, 50 aa, Arabidopsis thaliana
  G1483,Z-CO-like domain
CCSDEAVLCKPCDIKVHEANKLFQRHHRVALQKDAASATTASGAPLCDIC

SEQ ID NO: 2983 - protein, 26 aa, Arabidopsis thaliana
  G1488,GATA/Zn domain
CLHCATDKTPQWRTGPMGPKTLCNAC

SEQ ID NO: 2984 - protein, 48 aa, Arabidopsis thaliana
  G1493,GARP domain
WSVELHQQFVAAVNQLGVEKAVPKKILELMNVPGLTRENVASHLQKYR

SEQ ID NO: 2985 - protein, 58 aa, Arabidopsis thaliana
  G1494,HLH/MYC domain
RRSRAAEVHNLSERRRRDRINERMKALQELIPHCSKTDKASILDEAIDYLKSLQLQLQ

SEQ ID NO: 2986 - protein, 59 aa, Arabidopsis thaliana
  G1496,HLH/MYC domain
RRGQATDRHSLAERARREKISKKMKYLQDIVPGCNKVTGKAGMLDEIINYVQCLQRQVE

SEQ ID NO: 2987 - protein, 58 aa, Arabidopsis thaliana
  G1499,HLH/MYC domain
NVRISDDPQSVAARHRRERISERIRILQRLVPGGTKMDTASMLDEAIRYVKFLKRQIR

SEQ ID NO: 2988 - protein, 14 aa, Arabidopsis thaliana
  G1504,GATA/Zn domain
CTHCETTTTPQWRE

SEQ ID NO: 2989 - protein, 27 aa, Arabidopsis thaliana
  G1506,GATA/Zn domain
CYHCGVTSTPLWRNGPPEKPVLCNACG

SEQ ID NO: 2990 - protein, 34 aa, Arabidopsis thaliana
  G1510,GATA/Zn domain
RVCSDCNTTKTPLWRSGPRGPKSLCNACGIRQRK

SEQ ID NO: 2991 - protein, 55 aa, Arabidopsis thaliana
  G1512,RING/C3HC4 domain
SGCFDCNICLDTAHDPVVTLCGHLFCWPCIYKWLHVQLSSVSVDQHQNNCPVCKS

SEQ ID NO: 2992 - protein, 38 aa, Arabidopsis thaliana
  G1517,RING/C3HC4 domain
CFICREPFLDPVVTKCKHYFCEHCALKHHTKNKKCFVC

SEQ ID NO: 2993 - protein, 38 aa, Arabidopsis thaliana
  G1519,RING/C3HC4 domain
CTLCLSTRQHPTATPCGHVFCWSCIMEWCNEKQECPLC

SEQ ID NO: 2994 - protein, 42 aa, Arabidopsis thaliana
  G1521,RING/C3HC4 domain
CPICLENLTERRSAAVITVCKHGYCLACIRKWSSFKRNCPLC

SEQ ID NO: 2995 - protein, 298 aa, Arabidopsis thaliana
  G1526,1st SWI/SNF domain
LLCELRPYQKQALHWMTQLEKGNCTDEAATMLHPCWEAYCLADKRELVVYLNSFTGDATIHFPSTLQMARGGILADAMGLGKTVMTISLLLAHSWKAASTGFLCPNYEGDKVISSSVDDLTSPPVKATKFLGFDKRLLEQKSVLQNGGNLIVCPMTLLGQWKTEIEMHAKPGSLSVYVHYGQSRPKDAKLLSQSDVVITTYGVLTSEFSQENSADHEGIYAVRWFRIVLDEAHTIKNSKSQISLAAAALVADRRWCLTGTPIQNNLEDLYSLLRFLRIEPWGTWAWWNKLVQKPFEEG

SEQ ID NO: 2996 - protein, 40 aa, Arabidopsis thaliana
  G1526,2nd SWI/SNF domain
CPICLEALEDAVLTPCAHRLCRECLLASWRNSTSGLCPVC

SEQ ID NO: 2997 - protein, 84 aa, Arabidopsis thaliana
  G1526,3rd SWI/SNF domain
DLLQIPLSRNNFSFVRLDGTLSQQQREKVLKEFSEDGSILVLLMSLKAGGVGINLTAASNAFVMDPWWNPAVEEQAVMRIHRIG

SEQ ID NO: 2998 - protein, 37 aa, Arabidopsis thaliana
  G1531,RING/C3HC4 domain
HPYMCDTSVRHSNCFKQFRRKTIKKRLYPKTLHCPLC

SEQ ID NO: 2999 - protein, 61 aa, Arabidopsis thaliana
  G1535,HB domain
PAKKKRYHRHTNRQIQEMEALFKENPHPDDKQRKRLSAELGLKPRQVKFWFQNRRTQMKAQ

SEQ ID NO: 3000 - protein, 61 aa, Arabidopsis thaliana
  G1537,HB domain
RWNPTKDQITLLENLYKEGIRTPSADQIQQITGRLRAYGHIEGKNVFYWFQNHKARQRQKQ

SEQ ID NO: 3001 - protein, 61 aa, Arabidopsis thaliana
  G1538,HB domain
IGGMLRKRKLTDEQVNMLEYSFGNEHKLESGRKEKIAGELGLDPRQVAVWFQNRRARWKNK

SEQ ID NO: 3002 - protein, 61 aa, Arabidopsis thaliana
  G1539,HB domain
RWNPTPDQLRVLEELYRQGTRTPSADHIQQITAQLRRYGKIEGKNVFYWFQNHKARERQKR

SEQ ID NO: 3003 - protein, 64 aa, Arabidopsis thaliana
  G1540,HB domain
STRWTPTTEQIKILKELYYNNAIRSPTADQIQKITARLRQFGKIEGKNVFYWFQNHKARERQKK

SEQ ID NO: 3004 - protein, 61 aa, Arabidopsis thaliana
  G1543,HB domain
APPRKKLRLTREQSRLLEDSFRQNHTLNPKQKEVLAKHLMLRPRQIEVWFQNRRARSKLKQ

SEQ ID NO: 3005 - protein, 64 aa, Arabidopsis thaliana
  G1545,HB domain
NEGNGWFRKRKLSDEQVRMLEISFEDDHKLESERKDRLASELGLDPRQVAVWFQNRRARWKNKR

SEQ ID NO: 3006 - protein, 61 aa, Arabidopsis thaliana
  G1549,HB domain
MTSEQLKFLERSFQEEIKLNPDRKMKLNPDRKMKLSKELGLQPRQIAVWFQNRKARWKNKQ

SEQ ID NO: 3007 - protein, 50 aa, Arabidopsis thaliana
  G1554,GARP domain
WSPDLHRRFVQALQMLGGSQVATPKQIRELMKVDGLTNDEVKSHLQKYRL

SEQ ID NO: 3008 - protein, 49 aa, Arabidopsis thaliana
  G1556,GARP domain
WTDDLDIRFIQVIEKLGGEESATPKRILSLMGVRDLTISHVKSHLQMYR

SEQ ID NO: 3009 - protein, 49 aa, Arabidopsis thaliana
  G1557,GARP domain
WNSDLHNSFVQAVEQLGGENRATPKMVLQLMDVRGLTISHVKSHLQMYR

SEQ ID NO: 3010 - protein, 92 aa, Arabidopsis thaliana
  G1560,HS domain
PFLTKTYDLVEDSRTNHVVSWSKSNNSFIVWDPQAFSVTLLPRFFKHNNFSSFVRQLNTYGFRKVNPDRWEFANEGFLRGQKHLLKNIRRRK

SEQ ID NO: 3011 - protein, 61 aa, Arabidopsis thaliana
  G1585,HB domain
RWNPKPEQIRILESIFNSGTINPPREEIQRIRIRLQEYGQIGDANVFYWFQNRKSRAKHKL

SEQ ID NO: 3012 - protein, 61 aa, Arabidopsis thaliana
  G1587,HB domain
RWNPTPEQITTLEELYRSGTRTPTTEQIQQIASKLRKYGRIEGKNVFYWFQNHKARERLKR

SEQ ID NO: 3013 - protein, 61 aa, Arabidopsis thaliana
  G1591,HB domain
RWCPTPEQLMILEEMYRSGIRTPNAVQIQQITAHLAFYGRIEGKNVFYWFQNHKARDRQKL

SEQ ID NO: 3014 - protein, 64 aa, Arabidopsis thaliana
  G1593,HB domain
NAWRPQRGLPEKAVSVLRSWLFEHFLHPYPRDLDKVMLAKQTGLTKSQVSNWFINARVRMWKPL

SEQ ID NO: 3015 - protein, 20 aa, Arabidopsis thaliana
  G1594,HB domain
SENMPFAMMDDSSGSFFTEE

SEQ ID NO: 3016 - protein, 51 aa, Arabidopsis thaliana
  G1634,1st MYB-related domain
SSWTKEENKKFERALAVYADDTPDRWFKVAAMIPGKTISDVMRQYSKLEED

SEQ ID NO: 3017 - protein, 49 aa, Arabidopsis thaliana
  G1634,2nd MYB-related domain
VPWTEEEHRRFLLGLLKYGKGDWRNISRNFVGSKTPTQVASHAQKYYQR

SEQ ID NO: 3018 - protein, 47 aa, Arabidopsis thaliana
  G1635,MYB-related domain
ERWTDEEHKKFVEALKLYGRAWRRIEEHVGSKTAVQIRSHAQKFFSK

SEQ ID NO: 3019 - protein, 49 aa, Arabidopsis thaliana
  G1637,MYB-related domain
KPWTEEEHRNFLIGLNKLGKGDWRGIAKSFVSTRTPTQVASHAQKYFIR

SEQ ID NO: 3020 - protein, 51 aa, Arabidopsis thaliana
  G1638,1st MYB-related domain
TKWTAEENKKFENALAFYDKDTPDRWSRVAAMLPGKTVGDVIKQYRELEED

SEQ ID NO: 3021 - protein, 49 aa, Arabidopsis thaliana
  G1638,2nd MYB-related domain
VPWTEEEHRQFLMGLKKYGKGDWRNIARNFVTTRTPTQVASHAQKYFIR

SEQ ID NO: 3022 - protein, 102 aa, Arabidopsis thaliana
  G1640,MYB-(R1)R2R3 domain
RGRWTAEEDEILTKYIQTNGEGSWRSLPKKAGLLRCGKSCRLRWINYLRRDLKRGNITSDEEEIIVKLHSLLGNRWSLIATHLPGRTDNEIKNYWNSHLSRK

SEQ ID NO: 3023 - protein, 51 aa, Arabidopsis thaliana
  G1641,1st MYB-related domain
ATWTAAENKAFENALAVYDDNTPDRWQKVAAVIPGKTVSDVIRQYNDLEAD

SEQ ID NO: 3024 - protein, 49 aa, Arabidopsis thaliana
  G1641,2nd MYB-related domain
VPWTEEEHKLFLMGLKKYGKGDWRNISRNFVITRTPTQVASHAQKYFIR

SEQ ID NO: 3025 - protein, 121 aa, Arabidopsis thaliana
  G1645,MYB-(R1)R2R3 domain
SSKPSVLGRGHWRPAEDVKLKELVSIYGPQNWNLIAEKLQGRSGKSCRLRWFNQLDPRINRRAFTEEEEERLMQAHRLYGNKWAMIARLFPGRTDNSVKNHWHVVMARKYREHSSAYRRRK

SEQ ID NO: 3026 - protein, 97 aa, Arabidopsis thaliana
  G1646,CAAT domain
QEIEQVNDFKNHQLPLARIKKIMKADEDVRMISAEAPILFAKACELFILELTIRSWLHAEENKRRTLQKNDIAAAITRTDIFDFLVDIVPREEIKEE

SEQ ID NO: 3027 - protein, 58 aa, Arabidopsis thaliana
  G1649,HLH/MYC domain
KRKRSTEVHKLYERKRRDEFNKKMRALQDLLPNCYKDDKASLLDEAIKYMRTLQLQVQ

SEQ ID NO: 3028 - protein, 58 aa, Arabidopsis thaliana
  G1650,HLH/MYC domain
KRSRAAIMHKLSERRRRQKINEMMKALQELLPRCTKTDRSSMLDDVIEYVKSLQSQIQ

SEQ ID NO: 3029 - protein, 58 aa, Arabidopsis thaliana
  G1652,HLH/MYC domain
RSQSNAQDHILAERKRREKLTQRFVALSALIPGLKKMDKASVLGDAIKHIKYLQESVK

SEQ ID NO: 3030 - protein, 58 aa, Arabidopsis thaliana
  G1655,HLH/MYC domain
GNCKSRKGLTETNRIKLPAVERKLKILGRLVPGCRKVSVPNLLDEATDYIAALEMQVR

SEQ ID NO: 3031 - protein, 115 aa, Arabidopsis thaliana
  G1660,DBP domain
TKASLQTSKSVSEARATAWEEAEKAKHMARFRREEMKIQAWENHQKAKSEAEMKKTEVKVERIKGRAQDRLMKKLATIERKAEEKRAAAEAKKDHQAAKTEKQAEQIRRTGKVPS

SEQ ID NO: 3032 - protein, 26 aa, Arabidopsis thaliana
  G1662,1st DBP domain
PQTPKEPMEFLSRSWSLSTSEISKAL

SEQ ID NO: 3033 - protein, 36 aa, Arabidopsis thaliana
  G1662,2nd DBP domain
TKRVCVYINKKSQVMIKLKSKHVGGAFSKKIKCVVY

SEQ ID NO: 3034 - protein, 58 aa, Arabidopsis thaliana
  G1666,HLH/MYC domain
RLPREDLSHVVAERRRREKLNEKFITLRSMVPFVTKMDKVSILGDTIAYVNHLRKRVH

SEQ ID NO: 3035 - protein, 9 aa, Arabidopsis thaliana
  G1667,AT-hook domain
KRPRGRPAG

SEQ ID NO: 3036 - protein, 154 aa, Arabidopsis thaliana
  G1672,NAC domain
VGLPAGVKFDPTDQELIEHLEAKVKGKEENKKWSSSHPLIDEFIPTIDGEDGICYTHPQKLPGVTRDGLSKHFFHKPSRAYTTGTRKRRKIIQTDHDSELTGSSETRWHKTGKTRPVMINGQQRGCKKILVLYTNFGKNRRPEKTNWVMHQYHL

SEQ ID NO: 3037 - protein, 165 aa, Arabidopsis thaliana
  G1677,NAC domain
DDVVLPGFRFHPTDEELVSFYLKRKVLHKSLPFDLIKKVDIYKYDPWDLPKLAAMGEKEWYFYCPRDRKYRNSTRPNRVTGGGFWKATGTDRPIYSLDSTRCIGLKKSLVFYRGRAAKGVKTDWMMHEFRLPSLSDSHHSSYPNYNNKKQHLNNNNNSKELPSND

SEQ ID NO: 3038 - protein, 42 aa, Arabidopsis thaliana
  G1700,RING/C3H2C3 domain
EMLPVVIYKESFIVKDSQCSVCLGDYQAEEKLQQMPSCGHTF

SEQ ID NO: 3039 - protein, 33 aa, Arabidopsis thaliana
  G1706,RING/C3H2C3 domain
DCAVCLCEFSEDDKLRLLPNCSHAFHIDCIDTW

SEQ ID NO: 3040 - protein, 41 aa, Arabidopsis thaliana
  G1718,RING/C3H2C3 domain
CVICLEEWKSEETVKEMPCKHRFHGGCIEKWLGFHGSCPVC

SEQ ID NO: 3041 - protein, 42 aa, Arabidopsis thaliana
  G1730,RING/C3H2C3 domain
CAICLSEFSDEDTVRLITVCRHPFHSNCIDLWFELHKTCPVC

SEQ ID NO: 3042 - protein, 43 aa, Arabidopsis thaliana
  G1743,RING/C3H2C3 domain
CAVCLYEFEGEQEIRWLRNCRHIFHRSCLDRWMDHDQKTCPLC

SEQ ID NO: 3043 - protein, 69 aa, Arabidopsis thaliana
  G1749,AP2 domain
EKKHKGVRKKPSGKWAAEIWDPSLKVRRWLGTFPTAEMAAKAYNDAAAEFVGRRSARRGTKNGEEASTK

SEQ ID NO: 3044 - protein, 63 aa, Arabidopsis thaliana
  G1750,AP2 domain
QKKYRGVRQRPWGKWAAEIRDPEQRRRIWLGTFATAEEAAIVYDNAAIKLRGPDALTNFTVQP

SEQ ID NO: 3045 - protein, 69 aa, Arabidopsis thaliana
  G1752,AP2 domain
ERSYRGVRKRPWGKFAAEIRDSTRNGIRVWLGTFDKAEEAALAYDQAAFATKGSLATLNFPVEVVRESL

SEQ ID NO: 3046 - protein, 69 aa, Arabidopsis thaliana
  G1753,AP2 domain
HPLYRGVRQRKNSNKWVSEIREPRKPNRIWLGTFSTPEMAAIAYDVAALALKGSQAELNFPNSVSSLPA

SEQ ID NO: 3047 - protein, 63 aa, Arabidopsis thaliana
  G1755,AP2 domain
ICDYTGVRQRTWGKWVAEIREPGRGAKLWLGTFSSSYEAALAYDEASKAIYGQSARLNLPLLP

SEQ ID NO: 3048 - protein, 63 aa, Arabidopsis thaliana
  G1756,WRKY domain
LLSDAWAWRKYGQKPIKGSPYPRSYYRCSSSKGCLARKQVERNPQNPEKFTITYTNEHNHELP

SEQ ID NO: 3049 - protein, 57 aa, Arabidopsis thaliana
  G1758,WRKY domain
DDGYKWRKYGKKPITGSPFPRHYHKCSSPDCNVKKKIERDTNNPDYILTTYEGRHNH

SEQ ID NO: 3050 - protein, 56 aa, Arabidopsis thaliana
  G1759,MADS domain
GRKKLEIKRIENKSSRQVTFSKRRNGLIEKARQLSVLCDASVALLVVSASGKLYSF

SEQ ID NO: 3051 - protein, 121 aa, Arabidopsis thaliana
  G1765,NAC domain
PGFRFHPTDEELLGYYLRRKVENKTIKLELIKQIDIYKYDPWDLPRVSSVGEKEWYFFCMRGRKYRNSVRPNRVTGSGFWKATGIDKPVYSNLDCVGLKKSLVYYLGSAGKGTKTDWMMHE

SEQ ID NO: 3052 - protein, 66 aa, Arabidopsis thaliana
  G1767,1st SCR domain
VLKFQEVSPWATFGHVAANGAILEAVDGEAKIHIVDISSTFCTQWPTLLEALATRSDDTPHLRLTT

SEQ ID NO: 3053 - protein, 96 aa, Arabidopsis thaliana
  G1767,2nd SCR domain
INCVGAMHGIASRGSPRDAVISSFRRLRPRIVTVVEEEADLVGEEEGGFDDEFLRGFGECLRWFRVCFESWEESFPRTSNERLMLERAAGRAIVDL

SEQ ID NO: 3054 - protein, 76 aa, Arabidopsis thaliana
  G1767,3rd SCR domain
CEPSDSTERRETARKWSRRMRNSGFGAVGYSDEVADDVRALLRRYKEGVWSMVQCPDAAGIFLCWRDQPVVWASAW

SEQ ID NO: 3055 - protein, 54 aa, Arabidopsis thaliana
  G1772,RING/C3HC4 domain
CDVCMEDLPGDHMTRMDCGHCFCNNCWTEHFTVQINEGQSKRIRCMAHQCNAIC

SEQ ID NO: 3056 - protein, 46 aa, Arabidopsis thaliana
  G1773,RING/C3HC4 domain
CGICFESYTRKEIARVSCGHPYCKTCWTGYITTKIEDGPGCLRVKC

SEQ ID NO: 3057 - protein, 124 aa, Arabidopsis thaliana
  G1777,RING/C3HC4 domain
CDICVEDVPGYQLTRMDCGHSFCNNCWTGHFTVKINEGQSKRIICMAHKCNAICDEDVVRALVSKSQPDLAEKFDRFLLESYIEDNKMVKWCPSTPHCGNAIRVEDDELCEVECSCGLQFCFSC

SEQ ID NO: 3058 - protein, 50 aa, Arabidopsis thaliana
  G1779,GATA/Zn domain
NGYNNDCVIRICSDCNTTKTPLWRSGPRGPKSLCNACGIRQRKARRAAMA

SEQ ID NO: 3059 - protein, 90 aa, Arabidopsis thaliana
  G1781,CAAT domain
KEQDRFLPIANVGRIMKKVLPGNGKISKDAKETVQECVSEFISFVTGEASDKCQREKRKTINGDDIIWAITTLGFEDYVAPLKVYLCKYR

SEQ ID NO: 3060 - protein, 60 aa, Arabidopsis thaliana
  G1782,CAAT domain
EPIFVNAKQYHAILRRRKHRAKLEAQNKLIKCRKPYLHESRHLHALKRARGSGGRFLNTK

SEQ ID NO: 3061 - protein, 189 aa, Arabidopsis thaliana
  G1784,PMR domain
SCDGLVCFYDTTRAVEVMNPATTMFIELPLSRIQQLCIYKPNPEVELEPVQDPNPVLDPVMTCSQIGVGKDSVSGSYKLVWMYNTSPATPPTCEVLDLDGKKWRFVNTTSLDHHQILCDQRPVFANGSLYWLTGDEEGYATTQTKLIVLDLHTEMFQVIQTPPFITRDASGDKIGLCNLDGRLCISELK

SEQ ID NO: 3062 - protein, 101 aa, Arabidopsis thaliana
  G1785,MYB-(R1)R2R3 domain
DKVNWTESEDIKLKEIMALGPKNKWTKVAKKFEGRTGKQCRERWYNHARPNIKKTAWSEEEDQILIEAHKVLGTKWVEIAQQLPGRSDNNIKNHWNTTKRR

SEQ ID NO: 3063 - protein, 51 aa, Arabidopsis thaliana
  G1789,MYB-related domain
GSWTVKQNKAFERALAVYDQDTPDRWHNVARAVGGKTPEEAKRQYDLLVRD

SEQ ID NO: 3064 - protein, 65 aa, Arabidopsis thaliana
  G1791,AP2 domain
NEMKYRGVRKRPWGKYAAEIRDSARHGARVWLGTFNTAEDAARAYDRAAFGMRGQRAILNFPHEY

SEQ ID NO: 3065 - protein, 77 aa, Arabidopsis thaliana
  G1793,1st AP2 domain
TSIYRGVTRHRWTGRYEAHLWDNSCRREGQSRKGRQVYLGGYDKEDKAARSYDLAALKYWGPSTTTNFPITNYEKEV

SEQ ID NO: 3066 - protein, 69 aa, Arabidopsis thaliana
  G1793,2nd AP2 domain
ASMYRGVTRHHQHGRWQARIGRVAGNKDLYLGTFSTEEEAAEAYDIAAIKFRGLNAVTNFEINRYDVKA

SEQ ID NO: 3067 - protein, 68 aa, Arabidopsis thaliana
  G1794,AP2 domain
RRRYRGVRQRPWGKWAAEIRDPFKAARVWLGTFDNAESAARAYDEAALRFRGNKAKLNFPENVKLVRP

SEQ ID NO: 3068 - protein, 68 aa, Arabidopsis thaliana
  G1796,AP2 domain
TTRYRGVRRRPWGRYAAEIRDPMSKERRWLGTFDTAEQAACAYDSAARAFRGAKARTNFTYPTAVIMP

SEQ ID NO: 3069 - protein, 57 aa, Arabidopsis thaliana
  G1797,MADS domain
MVRGKIEIKKIENVTSRQVTFSKRRSGLFKKAHELSVLCDAQVAAMIFSQKGRLYEF

SEQ ID NO: 3070 - protein, 57 aa, Arabidopsis thaliana
  G1798,MADS domain
MVRGKIEIKKIENVTSRQVTFSKRRSGLFKKAHELSVLCDAQVAAIVFSQSGRLHEY

SEQ ID NO: 3071 - protein, 51 aa, Arabidopsis thaliana
  G1804,bZIP domain
RRQRRMIKNRESAARSRARKQAYTVELEAELNQLKEENAQLKHALAELERK

SEQ ID NO: 3072 - protein, 61 aa, Arabidopsis thaliana
  G1806,bZIP domain
RTLRRLAQNREAARKSRLRKKAYVQQLENSRIRLAQLEEELKRARQQGSLVERGVSADHTH

SEQ ID NO: 3073 - protein, 61 aa, Arabidopsis thaliana
  G1808,bZIP domain
RKRKRMESNRESAKRSRMRKQSHIDNLREQVNRLDLENRELGNRLRLVLHQLQRVNSDNNR

SEQ ID NO: 3074 - protein, 14 aa, Arabidopsis thaliana
  G1809,bZIP domain
KMLINTRPKTDDNH

SEQ ID NO: 3075 - protein, 106 aa, Arabidopsis thaliana
  G1815,MYB-(R1)R2R3 domain
RGHWRISEDTQLMELVSVYGPQNWNHIAESMQGRTGKSCRLRWFNQLDPRINKRAFSDEEEERLLAAHRAFGNKWAMIAKLFNGRTDNALKNHWHVLMARKMRQQS

SEQ ID NO: 3076 - protein, 45 aa, Arabidopsis thaliana
  G1816,MYB-related domain
INMTEQEEDLIFRMYRLVGDRWDLIAGRVPGRQPEEIERYWIMRN

SEQ ID NO: 3077 - protein, 93 aa, Arabidopsis thaliana
  G1818,CAAT domain
KGMEGDLNVKNHEFPISRIKRIMKFDPDVSMIAAEAPNLLSKACEMFVMDLTMRSWLHAQESNRLTIRKSDVDAVVSQTVIFDFLRDDVPKDE

SEQ ID NO: 3078 - protein, 97 aa, Arabidopsis thaliana
  G1819,CAAT domain
QMGNATDVKHHAFPLTRIKKIMKSNPEVNMVTAEAPVLISKACEMLILDLTMRSWLHTVEGGRQTLKRSDTLTRSDISAATTRSFKFTFLGDVVPRD

SEQ ID NO: 3079 - protein, 64 aa, Arabidopsis thaliana
  G1820,CAAT domain
VHMVSAEAPIIFAKACEMFIVDLTMRSWLKAEENKRHTLQKSDISNAVASSFTYDFLLDVVPKD

SEQ ID NO: 3080 - protein, 90 aa, Arabidopsis thaliana
  G1821,CAAT domain
REQDRFMPIANVIRIMRRILPAHAKISDDSKETIQECVSEYISFITGEANERCQREQRKTITAEDVLWAMSKLGFDDYIEPLTLYLHRYR

SEQ ID NO: 3081 - protein, 48 aa, Arabidopsis thaliana
  G1823,GARP domain
WSIELHQQFVNAVNKLGIDKAVPKRILELMNVPGLSRENVASHLQKFR

SEQ ID NO: 3082 - protein, 49 aa, Arabidopsis thaliana
  G1825,GARP domain
WTPDLHLSFVRAVQRLGGPDRATPKLVLEMMNLKGLSIAHVKSHLQMYR

SEQ ID NO: 3083 - protein, 21 aa, Arabidopsis thaliana
  G1832,1st Z-C2H2 domain
CTECGKQFGSLKALFGHMRCH

SEQ ID NO: 3084 - protein, 17 aa, Arabidopsis thaliana
  G1832,2nd Z-C2H2 domain
CDGCKKVFGSHQALGGH

SEQ ID NO: 3085 - protein, 21 aa, Arabidopsis thaliana
  G1832,3rd Z-C2H2 domain
CNICSRVFSSGQALGGHMRCH

SEQ ID NO: 3086 - protein, 73 aa, Arabidopsis thaliana
  G1835,GATA/Zn domain
EQYPLRKCMHCEVTKTPQWRLGPMGPKTLCNACGVRYKSGRLFPEYRPAASPTFTPALHSNSHKKVAEMRNKR

SEQ ID NO: 3087 - protein, 87 aa, Arabidopsis thaliana
  G1836,CAAT domain
KEMEGNLDFKNHDLPITRIKKIMKYDPDVTMIASEAPILLSKACEMFIMDLTMRSWLHAQESKRVTLQKSNVDAAVAQTVIFDFLLD

SEQ ID NO: 3088 - protein, 53 aa, Arabidopsis thaliana
  G1837,1st BZIPT2 domain
MGIVASKGDSNTPLLNLCKERKELIKAARDARYHLARSHLLYFKSLLDFSKAL

SEQ ID NO: 3089 - protein, 110 aa, Arabidopsis thaliana
  G1837,2nd BZIPT2 domain
LSMTLEKLYMWEKKLHAEVTAEEKLRVAYEKAYKILNNLDQNGAESSELYEAETLVKLHLSKVNVSVRAVESISMRIHKIRDEELSFQVIEIINGFKTMWRFLAKCHHKQ

SEQ ID NO: 3090 - protein, 75 aa, Arabidopsis thaliana
  G1838,1st AP2 domain
SIYRGVTRHRWTGRYEAHLWDNSCRREGQARKGRQVYLGGYDKEDRAARAYDLAALKYWGSTATTNFPVSSYSKE

SEQ ID NO: 3091 - protein, 71 aa, Arabidopsis thaliana
  G1838,2nd AP2 domain
GASIYRGVTRHHQQGRWQARIGRVAGNKDLYLGTFATEEEAAEAYDIAAIKFRGINAVTNFEMNRYDIEAV

SEQ ID NO: 3092 - protein, 65 aa, Arabidopsis thaliana
  G1839,AP2 domain
EKKYKGVRKKPSGKWAAEIWDPRSKSRRWLGTFLTAEMAAQSYNDAAAEYRARRGKTNGEGIKRR

SEQ ID NO: 3093 - protein, 68 aa, Arabidopsis thaliana
  G1840,AP2 domain
EKKHKGVRKKPSGKWSAEIWDPSTRTRRWLGTFPTAEMAADAYDEAAAALVEKRSARRGSKKGEGSIH

SEQ ID NO: 3094 - protein, 68 aa, Arabidopsis thaliana
  G1841,AP2 domain
KRRYRGVRQRPWGKWAAEIRDPHRAARVWLGTFDTAEAAARAYDEAALRFRGNKAKLNFPEDVRILPP

SEQ ID NO: 3095 - protein, 56 aa, Arabidopsis thaliana
  G1842,MADS domain
GRRKVEIKRIENKSSRQVTFSKRRKGLIEKARQLSILCESSIAVVAVSGSGKLYDS

SEQ ID NO: 3096 - protein, 56 aa, Arabidopsis thaliana
  G1843,MADS domain
GRRKVEIKRIENKSSRQVTFCKRRNGLMEKARQLSILCESSVALIIISATGRLYSF

SEQ ID NO: 3097 - protein, 56 aa, Arabidopsis thaliana
  G1844,MADS domain
GRRRVEIKRIENKSSRQVTFCKRRNGLMEKARQLSILCGSSVALFIVSSTGKLYNS

SEQ ID NO: 3098 - protein, 68 aa, Arabidopsis thaliana
  G1846,AP2 domain
QPVYRGVRMRSWGKWVSEIREPRKKSRIWLGTFPTAEMAMRAHDVAAMSIKGTSAILNFPELSKLLPR

SEQ ID NO: 3099 - protein, 92 aa, Arabidopsis thaliana
  G1850,HS domain
PFLTKTYQLVEDPVYDELISWNEDGTTFIVWRPAEFARDLLPKYFKHNNFSSFVRQLNTYGFRKVVPDRWEFSNDCFKRGEKILLRDIQRRK

SEQ ID NO: 3100 - protein, 501 aa, Arabidopsis thaliana
  G1852,AKR domain
AHMPCEDPRRNSQLSREMNFYRERHCPLPEETPLCLIPPPSGYKIPVPWPESLHKIWHANMPYNKIADRKGHQGWMKREGEYFTFPGGGTMFPGGAGQYIEKLAQYIPLNGGTLRTALDMGCGVASFGGTLLSQGILALSFAPRDSHKSQIQFALERGVPAFVAMLGTRRLPFPAYSFDLMHCSRCLIPFTAYNATYFIEVDRLLRPGGYLVISGPPVQWPKQDKEWADLQAVARALCYELIAVDGNTVIWKKPVGDSCLPSQNEFGLELCDESVPPSDAWYFKLKRCVTRPSSVKGEHALGTISKWPERLTKVPSRAIVMKNGLDVFEADARRWARRVAYYRDSLNLKLKSPTVRNVMDMNAFFGGFAATLASDPVWVMNVIPARKPLTLDVIYDRGLIGVYHDWCEPFSTYPRTYDFIHVSGIESLIKRQDSSKSRCSLVDLMVEMDRILRPEGKVVIRDSPEVLDKVARMAHAVRWSSSIHEKEPESHGREKILIATK

SEQ ID NO: 3101 - protein, 512 aa, Arabidopsis thaliana
  G1855,AKR domain
EYTPCEDRQRGRRFDRNMMKYRERHCPVKDELLYCLIPPPPNYKIPFKWPQSRDYAWYDNIPHKELSVEKAVQNWIQVEGDRFRFPGGGTMFPRGADAYIDDIARLIPLTDGGIRTAIDTGCGVASFGAYLLKRDIMAVSFAPRDTHEAQVQFALERGVPAIIGIMGSRRLPYPARAFDLAHCSRCLIPWFKNDGLYLMEVDRVLRPGGYWILSGPPINWKQYWRGWERTEEDLKKEQDSIEDVAKSLCWKKVTEKGDLSIWQKPLNHIECKKLKQNNKSPPICSSDNADSAWYKDLETCITPLPETNNPDDSAGGALEDWPDRAFAVPPRIIRGTIPEMNAEKFREDNEVWKERIAHYKKIVPELSHGRFRNIMDMNAFLGGFAASMLKYPSWVMNVVPVDAEKQTLGVIYERGLIGTYQDWCEGFSTYPRTYDMIHAGGLFSLYEHRCDLTLILLEMDRILRPEGTVVLRDNVETLNKVEKIVKGMKWKSQIVDHEKGPFNPEKILVAVK

SEQ ID NO: 3102 - protein, 112 aa, Arabidopsis thaliana
  G1863,GRF-like domain
FFSWAQWQELELQALIYRYMLAGAAVPQELLLPIKKSLLHLSPSYFLHHPLQHLPHYQPAWYLGRAAMDPEPGRCRRTDGKKWRCSRDVFAGHKYCERHMHRGRNRSRKPVE

SEQ ID NO: 3103 - protein, 118 aa, Arabidopsis thaliana
  G1865,GRF-like domain
PFTESQWEELENQALVFKYLAANMPVPPHLLFLIKRPFLFSSSSSSSSSSSFFSPTLSPHFGWNVYEMGMGRKIDAEPGRCRRTDGKKWRCSKEAYPDSKYCERHMHRGKNRSSSRKP

SEQ ID NO: 3104 - protein, 107 aa, Arabidopsis thaliana
  G1868,GRF-like domain
PFTLTQWAELEQQALIYKYITANVPVPSSLLISIKKSFYPYGSLPPSSFGWGTFHLGFAGGNMDPEPGRCRRTDGKKWRCSRDAVPDQKYCERHINRGRHRSRKPVE

SEQ ID NO: 3105 - protein, 21 aa, Arabidopsis thaliana
  G1880,1st Z-C2H2 domain
CEICNQGFQRDQNLQMHRRRH

SEQ ID NO: 3106 - protein, 29 aa, Arabidopsis thaliana
  G1880,2nd Z-C2H2 domain
CPEPTCLHHNPCHALGDLVGIKKHFRRKH

SEQ ID NO: 3107 - protein, 29 aa, Arabidopsis thaliana
  G1884,Z-Dof domain
CPRCDSVNTKFCYYNNYSLSQPRHYCKNC

SEQ ID NO: 3108 - protein, 46 aa, Arabidopsis thaliana
  G1888,Z-CO-like domain
CAVCDKEEASVFCCADEAALCNGCDRHVHFANKLAGKHLRFSLTSP

SEQ ID NO: 3109 - protein, 113 aa, Arabidopsis thaliana
  G1893,Z-C2H2 domain
IHKHQEPTANHHEYYFMETTETSSNSNFLDQCQDSYRHDVTVDLHLGLPNLGDGGSSSSDVVLDSTDHQEGHHDHHQDQGLEVTMASDHDDEHGGLQRGNHLHHFWIPTPSQI

SEQ ID NO: 3110 - protein, 43 aa, Arabidopsis thaliana
  G1895,Z-Dof domain
CPRCNSADTKFCYYNNYNVNQPRHFCRKCQRYWTAGGSMRIVP

SEQ ID NO: 3111 - protein, 29 aa, Arabidopsis thaliana
  G1897,Z-Dof domain
CPRCESTNTKFCYYNNYNFSQPRHFCKSC

SEQ ID NO: 3112 - protein, 53 aa, Arabidopsis thaliana
  G1900,Z-Dof domain
LPCPRCNSMETKFCYYNNYNVNQPRHFCKACQRYWTSGGTMRSVPIGAGRRKN

SEQ ID NO: 3113 - protein, 29 aa, Arabidopsis thaliana
  G1902,Z-Dof domain
CPRCDSPNTKFCYYNNYNLSQPRHFCKSC

SEQ ID NO: 3114 - protein, 47 aa, Arabidopsis thaliana
  G1903,Z-Dof domain
CPRCESANTKFCYYNNYNVNQPRYFCRNCQRYWTAGGSMRNVPVGSG

SEQ ID NO: 3115 - protein, 29 aa, Arabidopsis thaliana
  G1909,Z-Dof domain
CPRCDSSNTKFCYYNNYNLTQPRHFCKGC

SEQ ID NO: 3116 - protein, 51 aa, Arabidopsis thaliana
  G1911,MYB-related domain
GSWTAKQNKAFEQALATYDQDTPNRWQNVAKVVGGKTTEEVKRHYELLVQD

SEQ ID NO: 3117 - protein, 27 aa, Arabidopsis thaliana
  G1917,GATA/Zn domain
CANCDTTSTPLWRNGPRGPKSLCNACG

SEQ ID NO: 3118 - protein, 74 aa, Arabidopsis thaliana
  G1919,RING/C3HC4 domain
CWRCRLESHRPVSCNKASDWLCSATMKISDESFSLYPTKTKTVTCPHCLCSLESDTKMPQFLTCVCRLRFCSRC

SEQ ID NO: 3119 - protein, 172 aa, Arabidopsis thaliana
  G1927,NAC domain
APGFRFHPTDEELVVYYLKRKICCKKLRVNAIGVVDVYKVDPSELPGLSMLKTGDRQWFFFTPRNRKYPNAARSSRGTATGYWKATGKDRVIEYNSRSVGLKKTLVFYRGRAPNGERTDWVMHEYTMDEEELGRCKNAKEYYALYKLYKKSGAGPKNGEQYGAPFQEEEWVD

SEQ ID NO: 3120 - protein, 21 aa, Arabidopsis thaliana
  G1928,1st Z-C2H2 domain
CEICNKGFQRDQNLQLHRRGH

SEQ ID NO: 3121 - protein, 21 aa, Arabidopsis thaliana
  G1928,2nd Z-C2H2 domain
CDKCSKKYAVQSDCKAHSKTC

SEQ ID NO: 3122 - protein, 23 aa, Arabidopsis thaliana
  G1929,Z-CO-like domain
CELCDGDASVFCEADSAFLCRKC

SEQ ID NO: 3123 - protein, 66 aa, Arabidopsis thaliana
  G1930 AP2 domain
SSRFKGVVPQPNGRWGAQIYEKHQRVWLGTFNEEDEAARAYDVAAHRFRGRDAVTNFKDTTFEEEV

SEQ ID NO: 3124 - protein, 95 aa, Arabidopsis thaliana
  G1930 B3 domain
AELLFEKTVTPSDVGKLNRLVIPKHQAEKHFPLPLGNNNVSVKGMLLNFEDVNGKVWRFRYSYWNSSQSYVLTKGWSRFVKEKRLCAGDLISFKR

SEQ ID NO: 3125 - protein, 63 aa, Arabidopsis thaliana
  G1932,AP2 domain
EVHYRGVRKRPWGRYAAEIRDPWKKTRVWLGTFDTPEEAALAYDGAARFLRGIKAKTNFPSPL

SEQ ID NO: 3126 - protein, 57 aa, Arabidopsis thaliana
  G1935,MADS domain
MGRVKLELKRIEKSTNRQITFSKRKKGLIKKAYELSTLCDIDLALLMFSPSDRLCLF

SEQ ID NO: 3127 - protein, 66 aa, Arabidopsis thaliana
  G1936,PCF domain
KKKPNKDRHLKVEGRGRRVRLPPLCAARIYQLTKELGHKSDGETLEWLLQHAEPSILSATVNGIKP

SEQ ID NO: 3128 - protein, 70 aa, Arabidopsis thaliana
  G1938,PCF domain
KRSSNKDRHTKVEGRGRRIRMPALCAARIFQLTRELGHKSDGETIQWLLQQAEPSIIAATGSGTIPASAL

SEQ ID NO: 3129 - protein, 9 aa, Arabidopsis thaliana
  G1944,AT-hook domain
KKKRGRPRK

SEQ ID NO: 3130 - protein, 92 aa, Arabidopsis thaliana
  G1946,HS domain
PFLSKTYDMVDDHNTDSIVSWSANNNSFIVWKPPEFARDLLPKNFKHNNFSSFVRQLNTYGFRKVDPDRWEFANEGFLRGQKHLLQSITRRK

SEQ ID NO: 3131 - protein, 92 aa, Arabidopsis thaliana
  G1947,HS domain
AFLTKTYNIVEDSSTNNIVSWSRDNNSFIVWEPETFALICLPRCFKHNNFSSFVRQLNTYGFKKIDTERWEFANEHFLKGERHLLKNIKRRK

SEQ ID NO: 3132 - protein, 366 aa, Arabidopsis thaliana; identical to SEQ ID NO: 1292
  G1948,AKR domain

SEQ ID NO: 3133 - protein, 164 aa, Arabidopsis thaliana
  G1950,AKR domain
LLSSSDEAKTVINSKDDEGWAPLHSAASIGNAELVEVLLTRGADVNAKNNGGRTALHYAASKGRLEIAQLLLTHGAKINITDKVGCTPLHRAASVGKLEVCEFLIEEGAEIDATDKMGQTALMHSVICDDKQVAFLLIRHGADVDVEDKEGYTVLGRATNEFRP

SEQ ID NO: 3134 - protein, 60 aa, Arabidopsis thaliana
  G1954,HLH/MYC domain
EVESQRMTHIAVERNRRKQMNEHLRVLRSLMPGSYVQRGDQASIIGGAIEFVRELEQLLQ

SEQ ID NO: 3135 - protein, 92 aa, Arabidopsis thaliana
  G1957,ABI3/VP-1 domain
KEHMFDKVVTPSDVGKLNRLVIPKQHAERYFPLDSSNNQNGTLLNFQDRNGKMWRFRYSYWNSSQSYVMTKGWSRFVKEKKLDAGDIVSFQR

SEQ ID NO: 3136 - protein, 49 aa, Arabidopsis thaliana
  G1958,GARP domain
WTPELHEAFVEAVNSLGGSERATPKGVLKIMKVEGLTIYHVKSHLQKYR

SEQ ID NO: 3137 - protein, 29 aa, Arabidopsis thaliana
  G1965,Z-Dof domain
CARCDSDNTKFCYYNNYSEFQPRYFCKNC

SEQ ID NO: 3138 - protein, 21 aa, Arabidopsis thaliana
  G1968,1st Z-C2H2 domain
NPKKNKRFVDHRQIMALKQQQ

SEQ ID NO: 3139 - protein, 23 aa, Arabidopsis thaliana
  G1968,2nd Z-C2H2 domain
DSCADTNRTIKIHSKSPMVKKAN

SEQ ID NO: 3140 - protein, 77 aa, Arabidopsis thaliana
  G1983,Z-C3H domain
DSDSDDPYASDHFRMFEFKIRRCTRSRSHDWTDCPFAHPGEKARRRDPRRFQYSGEVCPEFRRGGDCSRGDDCEFAH

SEQ ID NO: 3141 - protein, 21 aa, Arabidopsis thaliana
  G1985,Z-C2H2 domain
CSFCIRGFSNAQALGGHMNIH

SEQ ID NO: 3142 - protein, 21 aa, Arabidopsis thaliana
  G1990,1st Z-C2H2 domain
CKTCDRTFPSFQALGGHRASH

SEQ ID NO: 3143 - protein, 23 aa, Arabidopsis thaliana
  G1990,2nd Z-C2H2 domain
HECGICGAEFTSGQALGGHMRRH

SEQ ID NO: 3144 - protein, 21 aa, Arabidopsis thaliana
  G1993,Z-C2H2 domain
CEFCERGFSNAQALGGHMNIH

SEQ ID NO: 3145 - protein, 21 aa, Arabidopsis thaliana
  G1995,Z-C2H2 domain
CHYCFRNFPTSQALGGHQNAH

SEQ ID NO: 3146 - protein, 67 aa, Arabidopsis thaliana
  G1998,Z-CO-like domain
CDHCATSQALIYCKSDLAKLCLNCDVHVHSANPLSHRHIRSLICEKCFSQPAAIRCLDEKVSYCQGC

SEQ ID NO: 3147 - protein, 41 aa, Arabidopsis thaliana
  G1999,Z-CO-like domain
CELCLNKHAVWYCASDDAFLCHVCDESVHSANHVATKHERV

SEQ ID NO: 3148 - protein, 105 aa, Arabidopsis thaliana
  G2007,MYB-(R1)R2R3 domain
KGPWTAEEDKKLINFILTNGHCCWRALPKLAGLRRCGKSCRLRWTNYLRPDLKRGLLSDAEEQLVIDLHALLGNRWSKIAARLPGRTDNEIKNHWNTHIKKKLLK

SEQ ID NO: 3149 - protein, 75 aa, Arabidopsis thaliana
  G2010,SBP domain
LCQVDRCTADMKEAKLYHRRHKVCEVHAKASSVFLSGLNQRFCQQCSRFHDLQEFDEAKRSCRRRLAGHNERRRK

SEQ ID NO: 3150 - protein, 92 aa, Arabidopsis thaliana
  G2011,HS domain
PFLSKTFDLVDDPTLDPVISWGLTGASFVVWDPLEFARIILPRNFKHNNFSSFVRQLNTYGFRKIDTDKWEFANEAFLRGKKHLLKNIHRRR

SEQ ID NO: 3151 - protein, 101 aa, Arabidopsis thaliana
  G2030,AKR domain
DGLTPLHCAAVSNSIKILKVFSHKTPSSFDILTQPHNETVFHLAVRHKNLKAFKFMAQKVHLEKLLYKPDKYGNTVLHTAASLGSTSLAEYIINETKIHTK

SEQ ID NO: 3152 - protein, 202 aa, Arabidopsis thaliana
  G2035,AKR domain
AGETAVYISAAENLEDIFRYLIRFSSLETVKIRSKSDMNAFHVAAKRGHLGIVKELLRLWPELCRICDASNTSPLYAAAVQDHLEIVNAMLDVDPSCAMIVRKNGKTSLHTAGRYGLLRIVKALIEKDAAIVGVKDKKGQTALHMAVKGRSLEVVEEILQADYTILNERDRKGNTALHIATRKARPQITSLLLTFTAIEVNA

SEQ ID NO: 3153 - protein, 237 aa, Arabidopsis thaliana
  G2041,1st SWI/SNF domain
LKRKLHLHQKKAFEFLWKNLAGSVVPAMMDPSSDKIGGCVVSHTPGAGKTFLIIAFLASYLKIFPGKRPLVLAPKTTLYTWYKEFIKWEIPVPVHLLHGRRTYCMSKEKTIQFEGIPKPSQDVMHVLDCLDKIQKWHAQPSVLVMGYTSFLTLMREDSKFAHRKYMAKVLRESPGLLVLDEGHNPRSTKSRLRKALMKVDTDLRILLSGTLFQNNFCEYFNTLCLARPKFVHEVLVE

SEQ ID NO: 3154 - protein, 86 aa, Arabidopsis thaliana
  G2041,2nd SWI/SNF domain
ELFENVFRWKRGRELLTLTGDLELFERGRVIDKFEEPGGQSRVLLASITACAEGISLTAASRVIMLDSEWNPSKTKQAIARAFRPG

SEQ ID NO: 3155 - protein, 152 aa, Arabidopsis thaliana
  G2051,NAC domain
PPGFRFYPTDEELVGYYLHRRNEGLEIELEIIPLMDLYKFDPWELPEKSFLPNRDMEWFFFCHRDRKYQNGSRINRATKSGYWKATGKDRKIVCHSSSSSSSSSITGCRKTLVFYMGRAPFGGRTEWVMHEYRLFDNDTSQGSLNFKGDFAL

SEQ ID NO: 3156 - protein, 152 aa, Arabidopsis thaliana
  G2052,NAC domain
PPGFRFHPTDEELIEYYLKRKVEGLEIELEVIPVIDLYSFDPWELPDKSFLPNRDMEWYFFCSRDKKYPNGFRTNRGTKAGYWKATGKDRKITSRSSSIIGYRKTLVFYKGRAPLGDRSNWIMHEYRLCDDDTSQGSQNLKGAFVLCRVAMK

SEQ ID NO: 3157 - protein, 147 aa, Arabidopsis thaliana
  G2053,NAC domain
GLRFRPTDKEIVVDYLRPKNSDRDTSHVDRVISTVTIRSFDPWELPCQSRIKLKDESWCFFSPKENKYGRGDQQIRKTKSGYWKITGKPKPILRNRQEIGEKKVLMFYMSKELGGSKSDWVMHEYHAFSPTQMMMTYTICKVMFKGD

SEQ ID NO: 3158 - protein, 58 aa, Arabidopsis thaliana
  G2057,TEO domain
KDRHSKVCTAKGPRDRRVRLSAHTAIQFYDVQDRLGFDRPSKAVDWLIKKAKTSIDEL

SEQ ID NO: 3159 - protein, 68 aa, Arabidopsis thaliana
  G2059,AP2 domain
TKLYRGVRQRHWGKWVAEIRLPRNRTRVWLGTFETAEQAAMAYDTAAYILRGEFAHLNFPDLKHQLKS

SEQ ID NO: 3160 - protein, 60 aa, Arabidopsis thaliana
  G2060,WRKY domain
DGCQWRKYGQKTAKTNPLPRAYYRCSMSSNCPVRKQVQRCGEEETSAFMTTYEGNHDHPL

SEQ ID NO: 3161 - protein, 57 aa, Arabidopsis thaliana
  G2063,MADS domain
KGKQKINIKKIEKDEGRSVTFSKRLNGIYTKISELSILCGVEVAFIGYSCSGKPYTF

SEQ ID NO: 3162 - protein, 63 aa, Arabidopsis thaliana
  G2067,AP2 domain
IKKYKGVRMRSWGSWVTEIRAPNQKTRIWLGSYSTAEAAARAYDAALLCLKGPKANLNFPNIT

SEQ ID NO: 3163 - protein, 93 aa, Arabidopsis thaliana
  G2070,bZIP domain
VPVDDKKRRRTISNRESAKRSRMKKKKRFEELTEEVNRLNIRNQELKNRLANVVSCGNFISRENNRLKTESVCLEIRLLELYRFLVAMQSPIS

SEQ ID NO: 3164 - protein, 52 aa, Arabidopsis thaliana
  G2071,bZIP domain
LEKVVERRQKRMIKNRESAARSRARKQAYTLELEAEIESLKLVNQDLQKKQA

SEQ ID NO: 3165 - protein, 60 aa, Arabidopsis thaliana
  G2072,bZIP domain
QNAHRARLRRLEYISDLERTIQVLQVEGCEMSSAIHYLDQQLLMLSMENRALKQRMDSLA

SEQ ID NO: 3166 - protein, 132 aa, Arabidopsis thaliana
  G2084,RING/C3HC4 domain
ELESVSEWEDVRCVICMEPPHNAVLLQCSSFSKGCRAYMCDTSARHSNCFKQYRRSNSSSRCSGKTLHCPYCRGEVQGTMKSTCARRFMNARPRCCTVDKCDFSGTYAQLKNHLKTEHPGFTPPKLDPWEQH

SEQ ID NO: 3167 - protein, 28 aa, Arabidopsis thaliana
  G2085,GATA/Zn domain
CTHCGISSKCTPMMRRGPSGPRTLCNAC

SEQ ID NO: 3168 - protein, 26 aa, Arabidopsis thaliana
  G2094,GATA/Zn domain
CAICGTSKTPLWRGGPAGPKSLCNAC

SEQ ID NO: 3169 - protein, 54 aa, Arabidopsis thaliana
  G2105,TH domain
VRSRLDHKFKEANQKGPLWDEVSRIMSEEHGYTRSGKKCREKFENLYKYYKKTK

SEQ ID NO: 3170 - protein, 84 aa, Arabidopsis thaliana
  G2106,1st AP2 domain
SSVHRGVTRHRWTGRYEAHLWDKNSWNETQTKKGRQVYLGAYDEEDAAARAYDLAALKYWGRDTILNFPVNFLGILLCNYEEDI

SEQ ID NO: 3171 - protein, 69 aa, Arabidopsis thaliana
  G2106,2nd AP2 domain
VSKYRGVAKHHHNGRWEARIGRVFGNKYLYLGTYATQEEAAIAYDIAAIEYRGLNAVTNFDISRYLKLP

SEQ ID NO: 3172 - protein, 68 aa, Arabidopsis thaliana
  G2107,AP2 domain
HPIYRGVRRRDGDKWVCEVREPIHQRRVWLGTYPTADMAARAHDVAVLALRGRSACLNFSDSAWRLPV

SEQ ID NO: 3173 - protein, 68 aa, Arabidopsis thaliana
  G2108,AP2 domain
EGKYLGVRRRPWGRYAAEIRNPFTKERHWLGTFDTAEEAAFAYDVAARSISGSLATTNFFYTENTSLE

SEQ ID NO: 3174 - protein, 57 aa, Arabidopsis thaliana
  G2109,MADS domain
MGRVKLKIKRLESTSNRQVTYTKRKNGILKKAKELSILCDIDIVLLMFSPTGRATAF

SEQ ID NO: 3175 - protein, 60 aa, Arabidopsis thaliana
  G2110,WRKY domain
NDGCQWRKYGQKIAKGNPCPRAYYRCTIAASCPVRKQVQRCSEDMSILISTYEGTHNHPL

SEQ ID NO: 3176 - protein, 57 aa, Arabidopsis thaliana
  G2111,MADS domain
MTRKKLNLSYITNESMRKATFNKRKKGLVKKIHELSVLCGIEACAVIYSPFNSNPEV

SEQ ID NO: 3177 - protein, 68 aa, Arabidopsis thaliana
  G2113,AP2 domain
AARAYDKRAIEFRGAKAKTNFPCYNINAHCLSLTQSLSQSSTVESSFPNLNLGSDSVSSRFPFPKIQV

SEQ ID NO: 3178 - protein, 75 aa, Arabidopsis thaliana
  G2114,1st AP2 domain
TSQYRGVTRHRWTGRYEAHLWDNSCKKEGQTRRGRQVYLGGYDEEEKAARAYDLAALKYWGPTTHLNFPLSNYEK

SEQ ID NO: 3179 - protein, 71 aa, Arabidopsis thaliana
  G2114,2nd AP2 domain
ASVYRGVTRHHQHGRWQARIGRVAGNKDLYLGTFSTQEEAAEAYDIAAIKFRGLNAVTNFDINRYDVKRIC

SEQ ID NO: 3180 - protein, 67 aa, Arabidopsis thaliana
  G2115,AP2 domain
IKKYKGVRMRSWGSWVSEIRAPNQKTRIWLGSYSTAEAAARAYDVALLCLKGPQANLNFPTSSSSHH

SEQ ID NO: 3181 - protein, 61 aa, Arabidopsis thaliana
  G2116,bZIP domain
KRAKRILANRQSAARSKERKARYIQELERKVQSLQTEATTLSAQLTLYQRDTNGLANENTE

SEQ ID NO: 3182 - protein, 61 aa, Arabidopsis thaliana
  G2117,bZIP domain
ERKRRRKVSNRESARRSRMRKQRHMEELWSMLVQLINKNKSLVDELSQARECYEKVIEENM

SEQ ID NO: 3183 - protein, 11 aa, Arabidopsis thaliana
  G2123,GF14 domain
VKGDYFRYMAE

SEQ ID NO: 3184 - protein, 58 aa, Arabidopsis thaliana
  G2124,TEO domain
KDRHSKVCTLRGLRDRRVRLSVPTAIQLYDLQERLGVDQPSKAVDWLLDAAKEEIDEL

SEQ ID NO: 3185 - protein, 70 aa, Arabidopsis thaliana
  G2129,bZIP domain
ERKKKRKLSNRESAKRSREKKQKHLEEMSIQLNQLKIQNQELKNQLRYVLYHCQRTKMENDRLLMEHRIL

SEQ ID NO: 3186 - protein, 69 aa, Arabidopsis thaliana
  G2130,AP2 domain
KPKKYRGVRQRPWGKFAAEIRDPSSRTRIWLGTFVTAEEAAIAYDRAAIHLKGPKALTNFLTPPTPTPV

SEQ ID NO: 3187 - protein, 72 aa, Arabidopsis thaliana
  G2131,1st AP2 domain
SSPYRGVTRHRWTGRYEAHLWDKNSWNDTQTKKGRQVYLGAYDEEEAAARAYDLAALKYWGRDTLLNFPLPS

SEQ ID NO: 3188 - protein, 72 aa, Arabidopsis thaliana
  G2131,2nd AP2 domain
SGFSRGVSKYRGVARHHHNGRWEARIGRVFGNKYLYLGTYATQEEAAIAYDIAAIEYRGLNAVTNFDVSRYL

SEQ ID NO: 3189 - protein, 68 aa, Arabidopsis thaliana
  G2132,AP2 domain
SSGFKGVRRRPWGKFAAEIRNPFEKKRKWLGTFPTEEEAAEAYQKSKREFDERLGLVKQEKDLVDLTK

SEQ ID NO: 3190 - protein, 58 aa, Arabidopsis thaliana
  G2136,MADS domain
GRQKIEIKEIMLETRRQVTFSKRRSGLFKKAAELSVLCGAQIGIITFSRCDRIYSFGN

SEQ ID NO: 3191 - protein, 60 aa, Arabidopsis thaliana
  G2137,WRKY domain
TKKMDLEMFLGVQGKRCVDITSKARKRGAERSPSMEREIGLSLSLEKKQKQEESKEAVQS

SEQ ID NO: 3192 - protein, 73 aa, Arabidopsis thaliana
  G2138,AP2 domain
EKKYRGVRQRPWGKWVAEIRCGRGACKGRRDRLWLGTFNTAEEAALAYDNASIKLIGPHAPTNFGLPAENQED

SEQ ID NO: 3193 - protein, 58 aa, Arabidopsis thaliana
  G2140,HLH/MYC domain
KALAASKSHSEAERRRRERINNHLAKLRSILPNTTKTDKASLLAEVIQHVKELKRETS

SEQ ID NO: 3194 - protein, 59 aa, Arabidopsis thaliana
  G2141,HLH/MYC domain
RRGQATNSHSLAERVRREKISERMKFLQDLVPGCNKVTGKAVMLDEIINYVQSLQRQVE

SEQ ID NO: 3195 - protein, 59 aa, Arabidopsis thaliana
  G2142,HLH/MYC domain
KASAIRSKHSVTEQRRRSKINERFQILRELIPNSEQKRDTASFLLEVIDYVQYLQEKVQ

SEQ ID NO: 3196 - protein, 58 aa, Arabidopsis thaliana; identical to SEQ ID NO: 2850
  G2143,HLH/MYC domain

SEQ ID NO: 3197 - protein, 59 aa, Arabidopsis thaliana
  G2144,HLH/MYC domain
RRGQATDSHSLAERARREKINARMKLLQELVPGCDKIQGTALVLDEIINHVQSLQRQVE

SEQ ID NO: 3198 - protein, 58 aa, Arabidopsis thaliana
  G2145,HLH/MYC domain
TKGTATDPQSLYARKRREKINERLKTLQNLVPNGTKVDISTMLEEAVHYVKFLQLQIK

SEQ ID NO: 3199 - protein, 58 aa, Arabidopsis thaliana
  G2146,HLH/MYC domain
LAAAIRGSGGSGRRRKLSAVGNRVRVLGGLVPGCRRTALPELLDETADYIAALEMQVR

SEQ ID NO: 3200 - protein, 58 aa, Arabidopsis thaliana
  G2147,HLH/MYC domain
RRGRAAAIHNESERRRRDRINQRMRTLQKLLPTASKADKVSILDDVIEHLKQLQAQVQ

SEQ ID NO: 3201 - protein, 59 aa, Arabidopsis thaliana
  G2150,HLH/MYC domain
RRGQATDSHSLAERARREKISERMTLLQDLVPGCNRITGKAVMLDEIINYVQSLQRQVE

SEQ ID NO: 3202 - protein, 9 aa, Arabidopsis thaliana
  G2153 AT-hook domain
RRPRGRPAG

SEQ ID NO: 3203 - protein, 152 aa, Arabidopsis thaliana
  G2153 2nd conserved domain
GSKNKPKPPIFVTRDSPNALKSHVMEIASGTDVIETLATFARRRQRGICILSGNGTVANVTLRQPSTAAVAAAPGGAAVLALQGRFEILSLTGSFLPGPAPPGSTGLTIYLAGGQGQVVGGSVVGPLMAAGPVMLIAATFSNATYERLPLEE

SEQ ID NO: 3204 - protein, 9 aa, Arabidopsis thaliana
  G2155,AT-hook domain
GRPRGRPRG

SEQ ID NO: 3205 - protein, 9 aa, Arabidopsis thaliana
  G2156 AT-hook domain
KRPRGRPPG

SEQ ID NO: 3206 - protein, 153 aa, Arabidopsis thaliana
  G2156 2nd conserved domain
GSKNKPKPPVIVTRDSPNVLRSHVLEVSSGADIVESVTTYARRRGRGVSILSGNGTVANVSLRQPATTAAHGANGGTGGVVALHGRFEILSLTGTVLPPPAPPGSGGLSIFLSGVQGQVIGGNVVAPLVASGPVILMAASFSNATFERLPLED

SEQ ID NO: 3207 - protein, 9 aa, Arabidopsis thaliana
  G2157 AT-hook domain
RRPRGRPPG

SEQ ID NO: 3208 - protein, 145 aa, Arabidopsis thaliana
  G2157 2nd conserved domain
GSKNKPKSPVVVTKESPNSLQSHVLEIATGADVAESLNAFARRRGRGVSVLSGSGLVTNVTLRQPAASGGVVSLRGQFEILSMCGAFLPTSGSPAAAAGLTIYLAGAQGQVVGGGVAGPLIASGPVIVIAATFCNATYERLPIEE

SEQ ID NO: 3209 - protein, 131 aa, Arabidopsis thaliana
  G2184,NAC domain
APGFRFHPTDEELVMYYLKRKICRKRLRVNVIGVVDVYKMDPEELPGQSMLKTGDRQWFYFTPRSRKYPNAARSNRGTENGYWKATGKDRVIEYNSRSVGLKKTLVFYRGRAPSGERTDWVMHEYTMDEDE

SEQ ID NO: 3210 - protein, 101 aa, Arabidopsis thaliana
  G2192,bZIP-NIN domain
YFTGSLKDAAKSLGVCPTTMKRICRQHGISRWPSRKIKKVNRSITKLKRVIESVQGTDGGLDLTSMAVSSIPWTHGQTSAQPLNSPNGSKPPELPNTNNSP

SEQ ID NO: 3211 - protein, 48 aa, Arabidopsis thaliana
  G2207,1st bZIP-NIN domain
AGLPGRVFLGKLPEWTPDVRFFKSEEYPRVHHAQDCDVRGTLAIPVFE

SEQ ID NO: 3212 - protein, 82 aa, Arabidopsis thaliana
  G2207,2nd bZIP-NIN domain
MMAEKKRTKADKTITLDVLRQYFAGSLKDAAKNIGVCPTTLKRICRQHGIQRWPSRKIKKVGHSLQKIQRVIDSVQGVSGPL

SEQ ID NO: 3213 - protein, 50 aa, Arabidopsis thaliana
  G2213,bZIP-NIN domain
FFDRPIMKAAKELNVGLTVLKKRCRELGIYRWPHRKLKSLNSLIKNLKNV

SEQ ID NO: 3214 - protein, 97 aa, Arabidopsis thaliana
  G2215,bZIP-NIN domain
QAAIALNVGLTLLKRRCRELGIRRWPHRKLMSLNTLISNVKELQKMEGEENAEKLQDALEMLEKEKRTIEDLPDLEFKDKTKRLRQACFKANHKRKK

SEQ ID NO: 3215 - protein, 42 aa, Arabidopsis thaliana
  G2226,RING/C3H2C3 domain
CSVCLSKFQGDSEINKLKCGHLFHKTCLEKWIDYWNITCPLC

SEQ ID NO: 3216 - protein, 41 aa, Arabidopsis thaliana
  G2227,RING/C3H2C3 domain
CAVCTEIFETETEAREMPCKHLFHDDCIVPWLSIRNSCPVC

SEQ ID NO: 3217 - protein, 42 aa, Arabidopsis thaliana
  G2239,RING/C3H2C3 domain
CAICLNEFEDDETLRLLPKCDHVFHPHCIDAWLEAHVTCPVC

SEQ ID NO: 3218 - protein, 44 aa, Arabidopsis thaliana
  G2251,RING/C3H2C3 domain
CAVCLYDFENDDEIRRLTNCRHIFHRGCLDRWMMGYNQMTCPLC

SEQ ID NO: 3219 - protein, 42 aa, Arabidopsis thaliana
  G2269,RING/C3H2C3 domain
CSICLCEYMEEEMLRMMPECKHYFHVYCLDAWLKLNGSCPVC

SEQ ID NO: 3220 - protein, 59 aa, Arabidopsis thaliana
  G2290,WRKY domain
EDGYRWRKYGQKAVKNSPFPRSYYRCTNSRCTVKKRVERSSDDPSIVITTYEGQHCHQT

SEQ ID NO: 3221 - protein, 68 aa, Arabidopsis thaliana
  G2291,AP2 domain
TGGFMGVRKRPWGRWSAEIRDRIGRCRHWLGTFDTAEEAARAYDAAARRLRGTKAKTNFVIPPLFPKE

SEQ ID NO: 3222 - protein, 64 aa, Arabidopsis thaliana
  G2294,AP2 domain
MKKYKGVRMRSWGSWVSEIRAPNQKTRIWLGSYSTAEAAARAYDAALLCLKGSSANNLNFPEIS

SEQ ID NO: 3223 - protein, 57 aa, Arabidopsis thaliana
  G2295,MADS domain
MVPKVVDLQRIANDKTRITTYKKRKASLYKKAQEFSTLCGVETCLIVYGPTKATDVV

SEQ ID NO: 3224 - protein, 61 aa, Arabidopsis thaliana
  G2296,WRKY domain
IDGFIWRKYGQKTIKTSPHQRWYYRCAYAKDQNCDATKRVQKIQDNPPVYRNTYVGQHACE

SEQ ID NO: 3225 - protein, 67 aa, Arabidopsis thaliana
  G2298,AP2 domain
SPKYTGVRKRKWGKWVAEIRLPNSRDRIWLGSFDSAEKAARAFDAALYCLRGPGARFNFPDNPPEIP

SEQ ID NO: 3226 - protein, 49 aa, Arabidopsis thaliana
  G2311,MYB-related domain
LKWTAEEEEALLAGIRKHGPGKWKNILRDPEFADQLIHRSNIDLKDKWR

SEQ ID NO: 3227 - protein, 49 aa, Arabidopsis thaliana
  G2313,MYB-related domain
NPWTEEEHRLFLQGLKKYGEGASTLTSTNFVKTKTPRQVSSHAQYYKRQ

SEQ ID NO: 3228 - protein, 47 aa, Arabidopsis thaliana
  G2317,MYB-related domain
EKWSEEEHDRFLEAIKLYGRGWRQIQEHIGTKTAVQIRSHAQKFFSK

SEQ ID NO: 3229 - protein, 47 aa, Arabidopsis thaliana
  G2319,MYB-related domain
ESWTEEEHDKFLEALQLFDRDWKKIEDFVGSKTVIQIRSHAQKYFLK

SEQ ID NO: 3230 - protein, 113 aa, Arabidopsis thaliana
  G2334,GRF-like domain
FFSWAQWQELELQALIYRYMLAGASVPQELLLPIKKSLLHQSPMHFLHHPLQHSFPHHQPSWYWGRGAMDPEPGRCKRTDGKKWRCSRDVVAGHKYCDRHIHRGRNRSRKPVE

SEQ ID NO: 3231 - protein, 107 aa, Arabidopsis thaliana
  G2340,MYB-(R1)R2R3 domain
KGAWTQEEDQKLIAYVQRHGEGGWRTLPDKAGLKRCGKSCRLRWANYLRPDIKRGEFSQDEEDSIINLHAIHGNKWSAIARKIPRRTDNEIKNHWNTHIKKCLVKKG

SEQ ID NO: 3232 - protein, 103 aa, Arabidopsis thaliana
  G2343,MYB-(R1)R2R3 domain
RGLWSPEEDEKLIRYITTHGYGCWSEVPEKAGLQRCGKSCRLRWINYLRPDIRRGRFSPEEEKLIISLHGVVGNRWAHIASHLPGRTDNEIKNYWNSWIKKKI

SEQ ID NO: 3233 - protein, 60 aa, Arabidopsis thaliana
  G2344,CAAT domain
EPVFVNAKQYHGILRRRQSRARLESQNKVIKSRKPYLHESRHLHAIRRPRGCGGRFLNAK

SEQ ID NO: 3234 - protein, 90 aa, Arabidopsis thaliana
  G2345,CAAT domain
REQDRFLPIANISRIMKRGLPLNGKIAKDAKETMQECVSEFISFVTSEASDKCQREKRKTINGDDLLWAMATLGFEDYIDPLKVYLMRYR

SEQ ID NO: 3235 - protein, 77 aa, Arabidopsis thaliana
  G2346,SBP domain
CQVEGCRMDLSNVKAYYSRHKVCCIHSKSSKVIVSGLHQRFCQQCSRFHQLSEFDLEKRSCRRRLACHNERRRKPQP

SEQ ID NO: 3236 - protein, 77 aa, Arabidopsis thaliana
  G2347,SBP domain
SRLCQVDRCTVNLTEAKQYYRRHRVCEVHAKASAATVAGVRQRFCQQCSRFHELPEFDEAKRSCRRRLAGHNERRRK

SEQ ID NO: 3237 - protein, 96 aa, Arabidopsis thaliana
  G2348,SBP domain
LPKKKRVRGGSGVARCQVPDCEADISELKGYHKRHRVCLRCATASFVVLDGENKRYCQQCGKFHLLPDFDEGKRSCRRKLERHNNRRKRKPVDKGG

SEQ ID NO: 3238 - protein, 103 aa, Arabidopsis thaliana
  G2371,ABI3/VP-1 domain
RESLFEKSLTPSDVGKLNRLVIPKQHAEKYFPLNNNNNNGGSGDDVATTEKGMLLSFEDESGKCWKFRYSYWNSSQSYVLTKGWSRYVKDKHLDAGDVVFFQR

SEQ ID NO: 3239 - protein, 361 aa, Arabidopsis thaliana
  G2372,ARF domain
PTIWRACAGASVQIPVLHSRVYYFPQGHVEHCCPLLSTLPSSTSPVPCIITSIQLLADPVTDEVFAHLILQPMTQQQFTPTNYSRFGRFDGDVDDNNKVTTFAKILTPSDANNGGGFSVPRFCADSVFPLLNFQIDPPVQKLYVTDIHGAVWDFRHIYRGTPRRHLLTTGWSKFVNSKKLIAGDSVVFMRKSADEMFIGVRRTPISSSDGGSSYYGGDEYNGYYSQSSVAKEDDGSPKKTFRRSGNGKLTAEAVTDAINRASQGLPFEVVFYPAAGWSEFVVRAEDVESSMSMYWTPGTRVKMAMETEDSSRITWFQGIVSSTYQETGPWRGSPWKQLQITWDEPEILQNVKRVNPWQVEI

SEQ ID NO: 3240 - protein, 61 aa, Arabidopsis thaliana
  G2373,TH domain
GGSGVGDVARAILGFTEAYEKAETAKLKLMAELEKERMKFAKEMELQRMQFLKTQLEITQN

SEQ ID NO: 3241 - protein, 98 aa, Arabidopsis thaliana
  G2375,TH domain
QWSIEETKELLAIREELDQTFMETKRNKLLWEVVAAKMADKGFVRSAEQCKSKWKNLVTRYKACETTEPDAIRQQFPFYNEIQSIFEARMQRMLWSEA

SEQ ID NO: 3242 - protein, 92 aa, Arabidopsis thaliana
  G2379,1st TH domain
GREDWWSEEATATLVEAWGNRYVKLNHGNLRQNDWKDVADAVNSRHGDNSRKKTDLQCKNRVDTLKKKYKTEKAKLSPSTWRFYNRLDVLIG

SEQ ID NO: 3243 - protein, 60 aa, Arabidopsis thaliana
  G2379,2nd TH domain
GSTCRELATAILKFGEVYERIEGKKQQMMIELEKQRMEVTKEVELKRMNMLMEMQLEIEK

SEQ ID NO: 3244 - protein, 88 aa, Arabidopsis thaliana
  G2382,1st TH domain
WREQEAFVLLEVWGDRFLQLGRRSLRNEDWNEVAEKVSEELRMEKSETQCRRMIDDLKRKYRKEKIKVEKSGLGSSKWSFFNKLDMLL

SEQ ID NO: 3245 - protein, 88 aa, Arabidopsis thaliana
  G2382,2nd TH domain
MLADSVERFGKVYEKMEKSKKEQMKELEKMRADFQRDLELQKKQIVDRAQSEIARLREEEENHHGGGDDDESEDEEMENDSDVNLSDE

SEQ ID NO: 3246 - protein, 61 aa, Arabidopsis thaliana
  G2383,TEO domain
KKRDRHSKICTAQGPRDRRMRLSLQIARKFFDLQDMLGFDKASKTIEWLFSKSKTSIKQLK

SEQ ID NO: 3247 - protein, 41 aa, Arabidopsis thaliana
  G2394,RING/C3H2C3 domain
CCICLTRYGDDEQVRELPCSHVFHVDCVDKWLKINATCPLC

SEQ ID NO: 3248 - protein, 41 aa, Arabidopsis thaliana
  G2404,RING/C3H2C3 domain
CIICQDEYEAKDEVGELRCGHRFHIDCVNQWLVRKNSCPVC

SEQ ID NO: 3249 - protein, 51 aa, Arabidopsis thaliana
  G2417,GARP domain
RWTPELHEVFVDAVNQLGGSNEATPKGVLKHMKVEGLTIFHVKSHLQKYRT

SEQ ID NO: 3250 - protein, 103 aa, Arabidopsis thaliana
  G2423,MYB-(R1)R2R3 domain
KRGPWTAEEDFKLMNYIATNGEGRWNSLSRCAGLQRTGKSCRLRWLNYLRPDVRRGNITLEEQLLILELHSRWGNRWSKIAQYLPGRTDNEIKNYWRTRVQKH

SEQ ID NO: 3251 - protein, 108 aa, Arabidopsis thaliana
  G2425,MYB-(R1)R2R3 domain
LRKGEWTAEEDRKLVVYINEHGLGEWGSLPKRAGLQRCGKSCRLRWLNYLRPGIKRGKFTPQEEEEIIKYHALLGNRWAAIAKQMPNRTDNDIKNHWNSCLKKRLAKK

SEQ ID NO: 3252 - protein, 54 aa, Arabidopsis thaliana
  G2430,GARP domain
WTEELHQKFLEAIEIIGGIEKANPKVLVECLQEMRIEGITRSNVASHLQKHRIN

SEQ ID NO: 3253 - protein, 43 aa, Arabidopsis thaliana
  G2432,Z-Dof domain
CPRCKSMETKFCYFNNYNVNQPRHFCKGCQRYWTAGGALRNVP

SEQ ID NO: 3254 - protein, 96 aa, Arabidopsis thaliana
  G2436,Z-CO-like domain
CDTCRSAACTVYCEADSAYLCTTCDARVHAANRVASRHERVRVCQSCESAPAAFLCKADAASLCTACDAEIHSANPLARRHQRVPILPLSANSCSS

SEQ ID NO: 3255 - protein, 67 aa, Arabidopsis thaliana
  G2443,Z-CO-like domain
CDTCRSNACTVYCHADSAYLCMSCDAQVHSANRVASRHKRVRVCESCERAPAAFLCEADDASLCTAC

SEQ ID NO: 3256 - protein, 52 aa, Arabidopsis thaliana
  G2452,1st MYB-related domain
ATWTAEENKRFEKALAYLDDKDNLESWSKIADLIPGKTVADVIKRYKELEDD

SEQ ID NO: 3257 - protein, 49 aa, Arabidopsis thaliana
  G2452,2nd MYB-related domain
VPWTEDEHLRFLMGLKKYGKGDWRNIAKSFVTTRTPTQVASHAQKYFLR

SEQ ID NO: 3258 - protein, 40 aa, Arabidopsis thaliana
  G2453,1st YABBY domain
ICHVQCGFCTTILLVSVPFTSLSMVVTVRCGHCTSLLSVN

SEQ ID NO: 3259 - protein, 47 aa, Arabidopsis thaliana
  G2453,2nd YABBY domain
KPPEKRQRAPSAYNCFIKEEIRRLKAQNPSMAHKEAFSLAAKNWAHF

SEQ ID NO: 3260 - protein, 39 aa, Arabidopsis thaliana
  G2455,1st YABBY domain
VCYVHCSFCTTILAVSVPYASLFTLVTVRCGHCTNLLSL

SEQ ID NO: 3261 - protein, 48 aa, Arabidopsis thaliana
  G2455,2nd YABBY domain
RPPEKRQRVPSAYNRFIKEEIQRIKACNPEISHREAFSTAAKNWAHFP

SEQ ID NO: 3262 - protein, 39 aa, Arabidopsis thaliana
  G2456,1st YABBY domain
LCYVHCSFCDTVLAVSVPPSSLFKTVTVRCGHCSNLLSV

SEQ ID NO: 3263 - protein, 48 aa, Arabidopsis thaliana
  G2456,2nd YABBY domain
RPPEKRQRVPSAYNRFIKEEIQRIKAGNPDISHREAFSAAAKNWAHFP

SEQ ID NO: 3264 - protein, 39 aa, Arabidopsis thaliana
  G2457,1st YABBY domain
LYYVRCSICNTILAVGIPLKRMLDTVTVKCGHCGNLSFL

SEQ ID NO: 3265 - protein, 48 aa, Arabidopsis thaliana
  G2457,2nd YABBY domain
KPPEKKQRLPSAYNRFMRDEIQRIKSANPEIPHREAFSAAAKNWAKYI

SEQ ID NO: 3266 - protein, 39 aa, Arabidopsis thaliana
  G2459,1st YABBY domain
LCYIPCNFCNIILAVNVPCSSLFDIVTVRCGHCTNLWSV

SEQ ID NO: 3267 - protein, 48 aa, Arabidopsis thaliana
  G2459,2nd YABBY domain
RPPEKRQRVPSAYNQFIKEEIQRIKANNPDISHREAFSTAAKNWAHFP

SEQ ID NO: 3268 - protein, 51 aa, Arabidopsis thaliana
  G2465,GARP domain
CWSPELHRRFLNALQQLGGSHVATPKQIRDHMKVDGLTNDEVKSHLQKYRL

SEQ ID NO: 3269 - protein, 92 aa, Arabidopsis thaliana
  G2467,HS domain
PFLTKTFEMVGDPNTNHIVSWNRGGISFVVWDPHSFSATILPLYFKHNNFSSFVRQLNTYGFRKIEAERWEFMNEGFLMGQRDLLKSIKRRT

SEQ ID NO: 3270 - protein, 15 aa, Arabidopsis thaliana
  G2492,1st ENBP domain
CMFCSSTCNCRACLR

SEQ ID NO: 3271 - protein, 245 aa, Arabidopsis thaliana
  G2492,2nd ENBP domain
LPRHAEEFLCSLPLKHYTHPVNGPLNLAVKLPQNCLKPDMGPKTYVASGFAQELGRGDSVTKLHCDMSDAVNILTHISEVPNMQPGIGNLKKKHAEQDLKELYSSVANKEEMMEILENSRQQVQNVETDDGALWDIFRREDIPKLESYIEKHHKEFRHLYCCPVSQVVHPIHDQNFYLTRYHIMKLKEEYGIEPWTFNRKLGDAVLIPVGCPHQVRNLKSCNKVALDFVSPENVSECLRLTKQYR

SEQ ID NO: 3272 - protein, 129 aa, Arabidopsis thaliana
  G2505,NAC domain
VPPGFRFHPTDEELLHYYLKKKISYQKFEMEVIREVDLNKLEPWDLQERCKIGSTPQNEWYFFSHKDRKYPTGSRTNRATHAGFWKATGRDKCIRNSYKKIGMRKTLVFYKGRAPHGQKTDWIMHEYRL

SEQ ID NO: 3273 - protein, 68 aa, Arabidopsis thaliana
  G2509,AP2 domain
KRHYRGVRQRPWGKWAAEIRDPQKAARVWLGTFETAEAAALAYDNAALKFKGSKAKLNFPERAQLASN

SEQ ID NO: 3274 - protein, 68 aa, Arabidopsis thaliana
  G2510,AP2 domain
HPVYHGVRKRRWGKWVSEIREPRKKSRIWLGSFPVPEMAAKAYDVAAFCLKGRKAQLNFPEEIEDLPR

SEQ ID NO: 3275 - protein, 69 aa, Arabidopsis thaliana
  G2512,AP2 domain
EKSYRGVRKRPWGKFAAEIRDSTRKGIRVWLGTFDTAEAAALAYDQAAFALKGSLAVLNFPADVVEESL

SEQ ID NO: 3276 - protein, 68 aa, Arabidopsis thaliana
  G2513,AP2 domain
HPVYRGIRRRNGDKWVCEVREPTHQRRIWLGTYPTADMAARAHDVAVLALRGRSACLNFADSAWRLPV

SEQ ID NO: 3277 - protein, 67 aa, Arabidopsis thaliana
  G2514,AP2 domain
DPVYRGIRCRSGKWVSEIREPRKTTRIWLGTYPMAEMAAAAYDVAAMALKGREAVLNFPGSVGSYPV

SEQ ID NO: 3278 - protein, 57 aa, Arabidopsis thaliana
  G2515,MADS domain
MGRGRVQLRRIENKIRRQVTFSKRRTGLVKKAQEISVLCDAEVALIVFSPKGKLFEY

SEQ ID NO: 3279 - protein, 61 aa, Arabidopsis thaliana
  G2517,WRKY domain
LDDGYKWRKYGQKPVKDSPFPRNYYRCTTTWCDVKKRVERSFSDPSSVITTYEGQHTHPRP

SEQ ID NO: 3280 - protein, 59 aa, Arabidopsis thaliana
  G2520,HLH/MYC domain
RRGQATDSHSLAERARREKISERMKILQDLVPGCNKVIGKALVLDEIINYIQSLQRQVE

SEQ ID NO: 3281 - protein, 9 aa, Arabidopsis thaliana
  G2522,1st AT-hook domain, domain in aa coordinates: 101-109
KRKRGRPRK

SEQ ID NO: 3282 - protein, 45 aa, Arabidopsis thaliana
  G2522,2nd domain
SASGAVSTATLLQPAPSHGTIIYEGLFELISLSTSYLNTTDNDYP

SEQ ID NO: 3283 - protein, 113 aa, Arabidopsis thaliana
  G2525,DBP domain
KTVGRWLKDRKEKKKEETRTQNAQVHAAVSVAAVASAVAAVAAATAASSPGKNEQMARIDMAMASAAALVAAQCVEAAEIMGADRDHLTSVVSSAVNVKSHDDIVTLTAAAAT

SEQ ID NO: 3284 - protein, 161 aa, Arabidopsis thaliana
  G2531,NAC domain
TCPSCGHKLHHHQDDQVGSIKDLPSLPAGVKFDPSDKEILMHLEAKVSSDKRKLHPLIDEFIPTLEGENGICYTHPEKLPGVSKDGQVRHFFHRPSKAYTTGTRKRRKVSTDEEGHETRWHKTGKTRPVLSQSGETGFKKILVLYTNYGRQKKPEKTNWVM

SEQ ID NO: 3285 - protein, 104 aa, Arabidopsis thaliana
  G2535,NAC domain
VPPGFRFHPTEEELLKYYLRKKISNIKIDLDVIPDIDLNKLEPWDIQEMCKIGTTPQNDWYFYSHKDKKYPTGTRTNRATTVGFWKATGRDKTIYTNGDRIGMR

SEQ ID NO: 3286 - protein, 131 aa, Arabidopsis thaliana
  G2536,NAC domain
LSVGFRFYPTEVELLTYYLRIQLGGGNATIHSLIPILDVFSVEPTQLPNLAGERCRGDAEQWIFFVPRQEREARGGRPSRTTGSGYWKATGSPGPVFSPDNRVIGVKKTMVFYTGKAPTGRKTKWKMNEYK

SEQ ID NO: 3287 - protein, 125 aa, Arabidopsis thaliana
  G2539,NAC domain
PGYRFVPKDQELIFHYLKPFSQGNKCSLLNVPIHRVNIYESNPQHLSEKYEKGNDKDWFYISERTKTGKAGRSNKRVDNGGYWSATVAAQKINAGNGIVGYKTSLEYYVGKQSNSVKGDWLMQEY

SEQ ID NO: 3288 - protein, 61 aa, Arabidopsis thaliana
  G2543,HB domain
RKKKRYHRHTAQQIQRLESSFKECPHPDEKQRNQLSRELGLAPRQIKFWFQNRRTQLKAQH

SEQ ID NO: 3289 - protein, 64 aa, Arabidopsis thaliana
  G2550,HB domain
PAWRPQRGLPENSVSILRAWLFEHFLHPYPKESEKIMLSKQTGLSKNQVANWFINARVRLWKPM

SEQ ID NO: 3290 - protein, 58 aa, Arabidopsis thaliana
  G2552,HLH/MYC domain
KTKTDRSRTLISERRRRGRMKDKLYALRSLVPNITKMDKASIVGDAVLYVQELQSQAK

SEQ ID NO: 3291 - protein, 59 aa, Arabidopsis thaliana
  G2555,HLH/MYC domain
KRGCATHPRSIAERVRRTRISDRIRRLQELVPNMDKQTNTADMLEEAVEYVKALQSQIQ

SEQ ID NO: 3292 - protein, 58 aa, Arabidopsis thaliana
  G2557,HLH/MYC domain
NVKISTDPQTVAARQRRERISEKIRVLQTLVPGGTKMDTASMLDEAANYLKFLRAQVK

SEQ ID NO: 3293 - protein, 111 aa, Arabidopsis thaliana
  G2559,DBP domain
RLEQDKRISLIKAWEEAEKSKVENKAQKKISSVGAWENSKKASVEAELKKIEEQLNKKKAHYTEQMKNKIAQIHKEAEEKRAMTEAKRGEDVLKAEEMAAKYRATGTAPTK

SEQ ID NO: 3294 - protein, 50 aa, Arabidopsis thaliana
  G2565,GARP domain
WTPELHEAFVEAINQLGGSERATPKAVLKLINSPGLTVYHVKSHLQKYRT

SEQ ID NO: 3295 - protein, 367 aa, Arabidopsis thaliana
  G2567,ARF domain
PQLWHACAGGMVRMPPMNSKVFYFPQGHAENAYDCVDFGNLPIPPMVLCRVLAIKYMADAESDEVFAKLRLIPLKDDEYVDHEYGDGEDSNGFESNSEKTPSFAKTLTQSDANNGGGFSVPRYCAETIFPRLDYNAEPPVQTILAKDVHGDVWKFRHIYRGTPRRHLLTTGWSNFVNQKKLVAGDSIVFMRAENGDLCVGIRRAKRGGIGNGPEYSAGWNPIGGSCGYSSLLREDESNSLRRSNCSLADRKGKVTAESVIEAATLAISGRPFEVVYYPRASTSEFCVKALDARAAMRIPWCSGMRFKMAFETEDSSRISWFMGTVSAVNVSDPIRWPNSPWRLLQVAWDEPDLLQNVKRVNPWLVEL

SEQ ID NO: 3296 - protein, 49 aa, Arabidopsis thaliana
  G2570,GARP domain
WTDSLHDLFLQAIRHIGLDKAVPKKILAFMSVPYLTRENVASHLQKYRI

SEQ ID NO: 3297 - protein, 68 aa, Arabidopsis thaliana
  G2571,AP2 domain
KKLYRGVRQRHWGKWVAEIRLPQNRMRVWLGTYDTAEAAAYAYDRAAYKLRGEYARLNFPNLKDPSEL

SEQ ID NO: 3298 - protein, 60 aa, Arabidopsis thaliana
  G2574,WRKY domain
TMNDGCQWRKYGQKIAKGNPCPRAYYRCTVAPGCPVRKQVQRCADDMSILITTYEGTHSH

SEQ ID NO: 3299 - protein, 56 aa, Arabidopsis thaliana
  G2575,WRKY domain
DGYRWRKYGQKAVKNSPYPRSYYRCTTQKCNVKKRVERSFQDPSIVITTYEGKHNH

SEQ ID NO: 3300 - protein, 68 aa, Arabidopsis thaliana
  G2579,AP2 domain
PGRFLGVRRRPWGRYAAEIRDPTTKERHWLGTFDTAHEAALAYDRAALSMRGTQARTNFVYTPTDVHT

SEQ ID NO: 3301 - protein, 68 aa, Arabidopsis thaliana
  G2583,AP2 domain
SRKFRGVRQRQWGSWVSEIRHPLLKRRVWLGTFETAEAAARAYDQAALLMNGQNAKTNFPVVKSEEGS

SEQ ID NO: 3302 - protein, 60 aa, Arabidopsis thaliana
  G2585,WRKY domain
ESSTPIYHDGFLWRKYGQKQIKESEYQRSYYKCAYTKDQNCEAKKQVQKIQHNPPLYSTT

SEQ ID NO: 3303 - protein, 58 aa, Arabidopsis thaliana
  G2587,WRKY domain
NDGFTWRKYGQKTIKASAHKRCYYRCTYAKDQNCNATKRVQKIKDNPPVYRTTYLGKH

SEQ ID NO: 3304 - protein, 57 aa, Arabidopsis thaliana
  G2589,MADS domain
MRTKTKLVLIPDRHFRRATFRKRNAGIRKKLHELTTLCDIKACAVIYSPFENPTVWP

SEQ ID NO: 3305 - protein, 56 aa, Arabidopsis thaliana
  G2590,MADS domain
RSKIKLSLIANKTSRRTTFRKRKGGITNKLHELTTLCGVKACAVISSPYENPVVWP

SEQ ID NO: 3306 - protein, 311 aa, Arabidopsis thaliana
  G2592,TUBBY domain
PGPRDGIIQCYIKRDKSNMTYHLYLSLSPAILVESGKFLLSAKRSRRATYTEYVISMDADNISRSSSTYIGKLKSNFLGTKFIVYDTAPAYNSSQILSPPNRSRSFNSKKVSPKVPSGSYNIAQVTYELNLLGTRGPRRMNCIMHSIPSLALEPGGTVPSQPEFLQRSLDESFRSIGSSKIVNHSGDFTRPKEEEGKVRPLVLKTKPPRWLQPLRCWCLNFKGRVTVASVKNFQLMSAATVQPGSGSDGGALATRPSLSPQQPEQSNHDKIILHFGKVGKDMFTMDYRYPLSAFQAFAISLSTFDTKLACE

SEQ ID NO: 3307 - protein, 286 aa, Arabidopsis thaliana
  G2603,TUBBY domain
PGPRDSLVQCFIKRNRITQSYHLYLGLTNSLTDDGKFLLAACKLKHTTCTDYIISLRSDDMSRRSQAYVGKVRSNFLGTKFTVFDGNLLPSTGAAKLRKSRSYNPAKVSAKVPLGSYPVAHITYELNVLGSRGPRKMQCLMDTIPTSTMEPQGVASEPSEFPLLGTRSTLSRSQSKPLRSSSSHLKETPLVLSNKTPRWHEQLRCWCLNFHGRVTVASVKNFQLVAAGASCGSGTGMSPERQSERIILQFGKVGKDMFTMDYGYPISAFQAFAICLSSFETRIACE

SEQ ID NO: 3308 - protein, 31 aa, Arabidopsis thaliana
  G2604,1st Z-LSDlike domain
QLVCSGCRNLLMYPVGATSVCCAVCNAVTAV

SEQ ID NO: 3309 - protein, 31 aa, Arabidopsis thaliana
  G2604,2nd Z-LSDlike domain
QLVCGGCHTLLMYIRGATSVQCSCCHTVNLA

SEQ ID NO: 3310 - protein, 61 aa, Arabidopsis thaliana
  G2616,HB domain
RWTPTTTQLQILENIYKEGSGTPNPRRIKEITMELSEHGQIMEKNVYHWFQNRRARSKRKQ

SEQ ID NO: 3311 - protein, 21 aa, Arabidopsis thaliana
  G2617,Z-C2H2 domain
SFCGREFKSAQALGGHMNVHR

SEQ ID NO: 3312 - protein, 70 aa, Arabidopsis thaliana
  G2628,bZIP domain
EKRLRRMASNRESARRTRMRERMMKEGLQMQVKQLMAYNQFLYNKYISLLEYNHQILQENSQLKETVSSF

SEQ ID NO: 3313 - protein, 89 aa, Arabidopsis thaliana
  G2631,CAAT domain
KEDASLPKATMTKIIKEMLPADVRVARDAQDLLIECCVEFINLISSESNEVCNKEDKRTIAPEHVLKALQVLGFGEYVEEVYAAYEQHK

SEQ ID NO: 3314 - protein, 58 aa, Arabidopsis thaliana
  G2632,CAAT domain
EPVFVNAKQYQAILRRRQARAKAELEKKLIKSRKPYLHESRHQHAMRRPRGTGGRFAK

SEQ ID NO: 3315 - protein, 66 aa, Arabidopsis thaliana
  G2633,1st SCR domain
MHILYEVCPYFKFGYMSANGAIAEAMKEENRVHIIDFQIGQGSQWVTLIQAFAARPGGPPRIRITG

SEQ ID NO: 3316 - protein, 89 aa, Arabidopsis thaliana
  G2633,2nd SCR domain
FVLHHMPDESVSTENHRDRLLRMVKSLSPKVVTLVEQESNTNTAAFFPRFMETMNYYAAMFESIDVTLPRDHKQRINVEQHCLARDVVN

SEQ ID NO: 3317 - protein, 73 aa, Arabidopsis thaliana
  G2633,3rd SCR domain
CEGADRVERHELLGKWRSRFGMAGFTPYPLSPLVNSTIKSLLRNYSDKYRLEERDGALYLGWMHRDLVASCAW

SEQ ID NO: 3318 - protein, 133 aa, Arabidopsis thaliana
  G2636,NAC domain
FEDESLMPPGFRFHPTDEELITYYLLKKVLDSNFSCAAISQVDLNKSEPWELPEKAKMGEKEWYFFTLRDRKYPTGLRTNRATEAGYWKATGKDREIKSSKTKSLLGMKKTLVFYKGRAPKGEKSCWVMHEYR

SEQ ID NO: 3319 - protein, 54 aa, Arabidopsis thaliana
  G2639,SRS domain
GSGGPSCQDCGNQSKKDCSHMRCRTCCKSRGLDCPTHVKSTWVPAAKRRERQQQ

SEQ ID NO: 3320 - protein, 44 aa, Arabidopsis thaliana
  G2640,SRS domain
DCGNQAKKDCSHMRCRTCCKSRGFECSTHVRSTWVPAAKRRERQ

SEQ ID NO: 3321 - protein, 44 aa, Arabidopsis thaliana
  G2649,SRS domain
CQDCGNQAKKECKQRRCRTCCKSRGFDCSTHVKSTWVSAARRRE

SEQ ID NO: 3322 - protein, 58 aa, Arabidopsis thaliana
  G2650,TEO domain
KDRHSKVCTVRGLRDRRIRLSVMTAIQVYDLQERLGLSQPSKVIDWLLEVAKNDVDLL

SEQ ID NO: 3323 - protein, 60 aa, Arabidopsis thaliana
  G2655,HLH/MYC domain
EIENQRMTHIAVERNRRKQMNEYLAVLRSLMPPYYAQRGDQASIVGGAINYLKELEHHLQ

SEQ ID NO: 3324 - protein, 58 aa, Arabidopsis thaliana
  G2661,HLH/MYC domain
TSTLSTDPQSVAARDRRHRISDRFKILQSMVPGGAKMDTVSMLDEAISYVKFLKAQIW

SEQ ID NO: 3325 - protein, 71 aa, Arabidopsis thaliana
  G2679,CPP domain
LYCECFASGSYCNGCNCVNCHNKLENESSRQVAISGILERNPDAFKPKIAGSPHGMKDLQENVQQVLLIGK

SEQ ID NO: 3326 - protein, 115 aa, Arabidopsis thaliana
  G2682,CPP domain
KGCRCKQSKCLKLYCDCFASGVVCTDCDCVDCHNNSEKCDAREAAMVNVLGRNPNAFSEKALGSLTDNQAAPDTKPGLLSRGCKCKRTRCLKKYCECFQANLLCSDNCKCINCKN

SEQ ID NO: 3327 - protein, 52 aa, Arabidopsis thaliana
  G2686,WRKY domain
QRCYYRCAYAKDQNCYATKRVQMIQDSPPVYRTTYLGQHTCKAFGVHDNTYG

SEQ ID NO: 3328 - protein, 63 aa, Arabidopsis thaliana
  G2690,1st AP2 domain
TTKFKGVVQQQNGHWGAQIYADHRRIWLGTFKSAHEAAAAYDSASIKLRSFDANSHRNFPWSD

SEQ ID NO: 3329 - protein, 100 aa, Arabidopsis thaliana
  G2690,2nd AP2 domain
CTQLFQKELTPSDVGKLNRLVIPKKYAVKYMPFISDDQSEKETSEGVEDVEVVFYDRAMRQWKFRYCYWRSSQSFVFTRGWNGFVKEKNLKEKDIIVFYT

SEQ ID NO: 3330 - protein, 69 aa, Arabidopsis thaliana
  G2691,AP2 domain
FKYPVGVRPRPSGKFAAEILNPFTKTKKWLGTYETPAEAEKAYVDKKVEYDALASSGSAVSSSVVTVTS

SEQ ID NO: 3331 - protein, 446 aa, Arabidopsis thaliana; identical to SEQ ID NO: 1642
  G2694,OTHER domain

SEQ ID NO: 3332 - protein, 66 aa, Arabidopsis thaliana
  G2699,1st SCR domain
LAAFVDLTPWHRFGFIAANAAILTAVEGYSTVHIVDLSLTHCMQIPTLIDAMASRLNKPPPLLKLT

SEQ ID NO: 3333 - protein, 91 aa, Arabidopsis thaliana
  G2699,2nd SCR domain
MMLRYIPEEPLTSSSSSLRTVFLKQLRSLNPRIVTLIEEDVDLTSENLVNRLKSAFNYFWIPFDTTDTFMSEQRRWYEAEISWKIENVVAK

SEQ ID NO: 3334 - protein, 75 aa, Arabidopsis thaliana
  G2699,3rd SCR domain
KEGAERVERTETKRRWIERMREAEFGGVRVKEDAVADVKAMLEEHAVGWGMKKEDDDESLVLTWKGHSVVFATVW

SEQ ID NO: 3335 - protein, 51 aa, Arabidopsis thaliana
  G2701,1st MYB-related domain
GSWTKEENKMFERALAIYAEDSPDRWFKVASMIPGKTVFDVMKQYSKLEED

SEQ ID NO: 3336 - protein, 49 aa, Arabidopsis thaliana
  G2701,2nd MYB-related domain
VPWTEEEHRRFLLGLLKYGKGDWRNISRNFVVSKTPTQVASHAQKYYQR

SEQ ID NO: 3337 - protein, 101 aa, Arabidopsis thaliana
  G2702,MYB-(R1)R2R3 domain
RKGLWSPDEDEKLIRYMLTNGQGCWSDIARNAGLLRCGKSCRLRWINYLRPDLKRGSFSPQEEDLIFHLHSILGNRWSQIATRLPGRTDNEIKNFWNSTLK

SEQ ID NO: 3338 - protein, 323 aa, Arabidopsis thaliana
  G2713,TUBBY domain
PGPRDAMIQCFIKRDKSKLTFHLFLCLSPALLVENGKFLLSAKRTRRTTRTEYIISMDADNISRSSNSYLGKLRSNFLGTKFLVYDTQPPPNTSSSALITDRTSRSRFHSRRVSPKVPSGSYNIAQITYELNVLGTRGPRRMHCIMNSIPISSLEPGGSVPNQPEKLVPAPYSLDDSFRSNISFSKSSFDHRSLDFSSSRFSEMGISCDDNEEEASFRPLILKNKQPRWHEQLQCWCLNFRGRVTVASVKNFQLVAARQPQPQGTGAAAAPTSAPAHPEQDKVILQFGKVGKDMFTMDYRYPLSAFQAFAICLSSFDTKLACE

SEQ ID NO: 3339 - protein, 49 aa, Arabidopsis thaliana
  G2717,MYB-related domain
QKWTQEEESALKSGVIKHGPGKWRTILKDPEFSGVLYLRSNVDLKDKWR

SEQ ID NO: 3340 - protein, 45 aa, Arabidopsis thaliana
  G2718,MYB-related domain
IAMAQEEEDLICRMYKLVGERWDLIAGRIPGRTAEEIERFWVMKN

SEQ ID NO: 3341 - protein, 99 aa, Arabidopsis thaliana
  G2719,MYB-(R1)R2R3 domain
KGPWSTEEDAVLTKLVRKLGPRNWSLIARGIPGRSGKSCRLRWCNQLDPCLKRKPFSDEEDRMIISAHAVHGNKWAVIAKLLTGRTDNAIKNHWNSTLR

SEQ ID NO: 3342 - protein, 51 aa, Arabidopsis thaliana
  G2723,MYB-related domain
SSWTSKQNKMFERALAVYDKDTPDRWQNVAKAVGSKSAEEVKRHYDILVED

SEQ ID NO: 3343 - protein, 107 aa, Arabidopsis thaliana
  G2724,MYB-(R1)R2R3 domain
RGPWTVEEDMKLVSYISLHGEGRWNSLSRSAGLNRTGKSCRLRWLNYLRPDIRRGDISLQEQFIILELHSRWGNRWSKIAQHLPGRTDNEIKNYWRTRVQKHAKLLK

SEQ ID NO: 3344 - protein, 49 aa, Arabidopsis thaliana; identical to SEQ ID NO: 2957
  G2741,GARP domain

SEQ ID NO: 3345 - protein, 49 aa, Arabidopsis thaliana
  G2743,GARP domain
WSQELHRRFLNALKQLGGPHVATPKQIRDIMKVDGLTNDEVKSHLQKYR

SEQ ID NO: 3346 - protein, 95 aa, Arabidopsis thaliana
  G2747,ABI3/VP-1 domain
REHMFDKVVTPSDVGKLNRLVIPKQHAERYFPLDNSTTNDSNKGLLLNFEDRSGNSWRFRYSYWNSSQSYVMTKGWSRFVKDKKLDAGDIVSFQR

SEQ ID NO: 3347 - protein, 196 aa, Arabidopsis thaliana
  G2754,1st SWI/SNF domain
TGGQLKSYQLKGVKWLISLWQNGLNGILADQMGLGKTIQTIGFLSHLKGNGLDGPYLVIAPLSTLSNWFNEIARFTPSINAIIYHGDKNQRDELRRKHMPKTVGPKFPIVITSYEVAMNDAKRILRHYPWKYVVIDEGHRLKNHKCKLLRELKHLKMDNKLLLTGTPLQNNLSELWSLLNFILPDIFTSHDEFESW

SEQ ID NO: 3348 - protein, 85 aa, Arabidopsis thaliana
  G2754,2nd SWI/SNF domain
DIMDYYFSEKGFEVCRIDGSVKLDERRRQIKDFSDEKSSCSIFLLSTRAGGLGINLTAADTCILYDSDWNPQMDLQAMDRCHRIG

SEQ ID NO: 3349 - protein, 89 aa, Arabidopsis thaliana
  G2757,1st TH domain
WTDEETAALVNAYKDKWFALRRGNLRAADWDDVAAAVSSSSTVGGPPKSAIQCRHKIEKLRKRYRGEKQRALNRPGKFSSSWDLFPILD

SEQ ID NO: 3350 - protein, 87 aa, Arabidopsis thaliana
  G2757,2nd TH domain
KHEQMNAAAEVESDPIDEVVSSVKMLTEMFVRVENSKMEMMREMEKSRMEMELKHCQMMLESQQQIIGAFAEALSEKKSTNARRPVS

SEQ ID NO: 3351 - protein, 61 aa, Arabidopsis thaliana
  G2763,HLH/MYC domain
GSIRSKKQRATVLRLKAKGLPAVQRKVKVLSRLVPGCRKQSLPVVLEETTDYIAAMEMQIR

SEQ ID NO: 3352 - protein, 58 aa, Arabidopsis thaliana
  G2765,HLH/MYC domain
KALAASKSHSEAERRRRERINTHLAKLRSILPNTTKTDKASLLAEVIQHMKELKRQTS

SEQ ID NO: 3353 - protein, 59 aa, Arabidopsis thaliana
  G2766,HLH/MYC domain
KRGFATHPRSIAERERRTRISGKLKKLQELVPNMDKQTSYADMLDLAVEHIKGLQHQVE

SEQ ID NO: 3354 - protein, 59 aa, Arabidopsis thaliana
  G2768,DBP domain
ELPPELKCPLCKEVMKDAALTSKCCYKSFCDKCIRDHIISKSMCVCGRSDVLADDLLPN

SEQ ID NO: 3355 - protein, 58 aa, Arabidopsis thaliana
  G2771,HLH/MYC domain
KRSRAADMHNLSERRRRERINERMKTLQELLPRCRKTDKVSMLEDVIEYVKSLQLQIQ

SEQ ID NO: 3356 - protein, 58 aa, Arabidopsis thaliana
  G2774,HLH/MYC domain
RPRLETLSPLPSFKVRKEKLGDRITALQQLVSPFGKTDTASVLNEAVEYIKFLQEQVT

SEQ ID NO: 3357 - protein, 58 aa, Arabidopsis thaliana
  G2776,HLH/MYC domain
RNQSNAQDHIIAERKRREKLTQRFVALSALVPGLKKMDKASVLGDALKHIKYLQERVG

SEQ ID NO: 3358 - protein, 59 aa, Arabidopsis thaliana
  G2777,HLH/MYC domain
KLNTPRSKHSATEQRRRSKINDRFQMLRQLIPNSDQKRDKASFLLEVIEYIQFLQEKAD

SEQ ID NO: 3359 - protein, 59 aa, Arabidopsis thaliana
  G2779,HLH/MYC domain
RRGQATDSHSLAERVRRGKINERLRCLQDMVPGCYKAMGMATMLDEIINYVQSLQNQVE

SEQ ID NO: 3360 - protein, 62 aa, Arabidopsis thaliana
  G2783,1st ACBF-like domain
TLWIGDLQYWMDENFLYGCFAHTGEMVSAKVIRNKQTGQVEGYGFIEFASHAAAERVLQTFN

SEQ ID NO: 3361 - protein, 85 aa, Arabidopsis thaliana
  G2783,2nd ACBF-like domain
DSPDYTIFVGDLAADVTDYILLETFRASYPSVKGAKVVIDRVTGRTKGYGFVRFSDESEQIRAMTEMNGVPCSTRPMRIGPAASK

SEQ ID NO: 3362 - protein, 57 aa, Arabidopsis thaliana
  G2783,3rd ACBF-like domain
TVFVGGLDASVTDDHLKNVFSQYGEIVHVKIPAGKRCGFVQFSEKSCAEEALRMLNG

SEQ ID NO: 3363 - protein, 122 aa, Arabidopsis thaliana
  G2784,DBP domain
KRKEEVRLQRAEVHAAVSLAGLAAALAAVASENAGKDGGNGRPSTRETAVASAAAVVAAQCAQMAETMGANRDQLSTMIGSAMTGTSVSEILTLTASATTSLRGAATLKARRGCKINRLNGS

SEQ ID NO: 3364 - protein, 9 aa, Arabidopsis thaliana
  G2789 AT-hook domain
RRPRGRPAG

SEQ ID NO: 3365 - protein, 142 aa, Arabidopsis thaliana
  G2789 2nd conserved domain
GSKNKPKAPIIVTRDSANAFRCHVMEITNACDVMESLAVFARRRQRGVCVLTGNGAVTNVTVRQPGGGVVSLHGRFEILSLSGSFLPPPAPPAASGLKVYLAGGQGQVIGGSVVGPLTASSPVVVMAASFGNASYERLPLEE

SEQ ID NO: 3366 - protein, 58 aa, Arabidopsis thaliana
  G2790,HLH/MYC domain
GKRNQEKSSVGIAKVRKERLGERIAALQQLVSPYGKTDAASVLHEAMGYIKFLQDQIQ

SEQ ID NO: 3367 - protein, 58 aa, Arabidopsis thaliana
  G2791,HLH/MYC domain
RRGQATDPHSIAERLRRERIAERMKSLQELVPNTNKTDKASMLDEIIEYVRFLQLQVK

SEQ ID NO: 3368 - protein, 149 aa, Arabidopsis thaliana
  G2802,NAC domain
LPAGVKFDPTDQELIEHLEAKVLAKDFKSHPLIDEFIPTIEGEDGICYTHPEKLPGVTRDGLSRHFFHRPSKAYTTGTRKRRKIQTECDNNLQGSSSSGETRWHKTGKTRPVMVNGKQKGCKKILVLYTNFGKNRKPEKTNWVMHQYHL

SEQ ID NO: 3369 - protein, 168 aa, Arabidopsis thaliana
  G2805,NAC domain
MKSRREQSIEEAIVANYLKMMIDNVNVWPRHFLRSEDVYCKNPWTLFVTRDPIILHFGRYFFVNRSVNSGLTDGCEYGCWRIIGRDRVIKSVTTGKILGLKKVYKFCETDRKPKSVFKFLEKEKRRVRDRRIWAMEEYRFASTWKQDYVICKIRRLYPQPFDYMLAQH

SEQ ID NO: 3370 - protein, 21 aa, Arabidopsis thaliana
  G2826,Z-C2H2 domain
CQYCCREFGNSQALGGHQNAH

SEQ ID NO: 3371 - protein, 22 aa, Arabidopsis thaliana
  G2830,Z-C2H2 domain
CPRCNGVFDTSQKFAAHMLSHY

SEQ ID NO: 3372 - protein, 21 aa, Arabidopsis thaliana
  G2832,1st Z-C2H2 domain
CKYCYKTFPSGKALGGHIRIH

SEQ ID NO: 3373 - protein, 21 aa, Arabidopsis thaliana
  G2832,2nd Z-C2H2 domain
CRECGRVFVSLKALRGHMACH

SEQ ID NO: 3374 - protein, 21 aa, Arabidopsis thaliana
  G2832,3rd Z-C2H2 domain
CPICFRMFKSGQALGGHKRSH

SEQ ID NO: 3375 - protein, 21 aa, Arabidopsis thaliana
  G2834,1st Z-C2H2 domain
CTICGKGFKRDANLRMHMRGH

SEQ ID NO: 3376 - protein, 22 aa, Arabidopsis thaliana
  G2834,2nd Z-C2H2 domain
CSRCHTKKFSVIADLKTHEKHC

SEQ ID NO: 3377 - protein, 21 aa, Arabidopsis thaliana
  G2837,Z-C2H2 domain
CHICGRGFGSWKAVFGHMRAH

SEQ ID NO: 3378 - protein, 21 aa, Arabidopsis thaliana
  G2838,Z-C2H2 domain
CHYCFRNFPTSQALGGHQNAH

SEQ ID NO: 3379 - protein, 27 aa, Arabidopsis thaliana
  G2839,1st Z-C2H2 domain
KRVFRCKTCLKEFSSFQALGGHRASHK

SEQ ID NO: 3380 - protein, 29 aa, Arabidopsis thaliana
  G2839,2nd Z-C2H2 domain
HPCPICGVEFPMGQALGGHMRRHRSEKAS

SEQ ID NO: 3381 - protein, 58 aa, Arabidopsis thaliana
  G2846,HLH/MYC domain
KPRVTTPSPLPTFKVRKENLRDQITSLQQLVSPFGKTDTASVLQEAIEYIKFLHDQVT

SEQ ID NO: 3382 - protein, 58 aa, Arabidopsis thaliana
  G2847,HLH/MYC domain
KPKLQVPSSQSTLKVRKEKLGGRIASLHQLVSPFGKTDTASVLSEAIGYIRFLHSQIE

SEQ ID NO: 3383 - protein, 57 aa, Arabidopsis thaliana
  G2850,HLH/MYC domain
PRVESRSSCPPFKVRKEKLGDRIAALQQLVSPFGKTDTASVLMEAIGYIKFLQSQIE

SEQ ID NO: 3384 - protein, 58 aa, Arabidopsis thaliana
  G2851,HLH/MYC domain
PRLQPSPSSQSTLKVRKEKLGGRIAALHQLVSPFGKTDTASVLSEAIGYIRFLQSQIE

SEQ ID NO: 3385 - protein, 141 aa, Arabidopsis thaliana
  G2854,ACBF-like domain
KVIRNKQNGYSEGYGFIEFVNHATAERNLQTYNGAPMPSSEQAFRLNWAQLGAGERRQAEGPEHTVFVGDLAPDVTDHMLTETFKAVYSSVKGAKVVNDRTTGRSKGYGFVRFADESEQIRAMTEMNGQYCSSRPMRTGPA

SEQ ID NO: 3386 - protein, 59 aa, Arabidopsis thaliana
  G2859,HLH/MYC domain
RRGQATDSHSIAERVRRGKINERLKCLQDIVPGCYKTMGMATMLDEIINYVQSLQNQVE

SEQ ID NO: 3387 - protein, 66 aa, Arabidopsis thaliana
  G2865,HLH/MYC domain
TKKEKKLLHRNIERQRRQEMAILFASLRSQLPLKYIKALSSQGKRAMSDHVNGAVSFIKDTQTRIK

SEQ ID NO: 3388 - protein, 17 aa, Arabidopsis thaliana
  G2866,1st IAA domain
YVKVNMEGVPIGRKIDL

SEQ ID NO: 3389 - protein, 30 aa, Arabidopsis thaliana
  G2866,2nd IAA domain
YADKEGDWMMVGDVPWEMFLSSVRRLKISR

SEQ ID NO: 3390 - protein, 384 aa, Arabidopsis thaliana
  G2869,ARF domain
EQLWKLCAGPLCDIPKLGEKVYYFPQGHIELVSSLSLYSFSLLSLSLSLSLSLSLSLSLSLSPFSLFSLFSLSPLSLSLSLSLLLSHVEASTREELNELQPICDFPSKLQCRVIAIQLKVENNSDETYAEITLMPDTTQVVIPTQNQNQFRPLVNSFTKVLTASDTSVHGGFSVPKKHAIECLPPLDMSQPLPTQEILAIDLHGNQWRFRHIYRGTAQRHLLTIGWNAFTTSKKLVEGDVIVFVRGETGELRVGIRRAGHQQGNIPSSIVSIESMRHGIIASAKHAFDNQCMFIVVYKPRSSQFIVSYDKFLDVVNNKFNVGSRFTMRFEGDDFSERRSFGTIIGVSDFSPHWKCSEWRSLEVQWDEFASFPRPNQVSPWDIEH

SEQ ID NO: 3391 - protein, 49 aa, Arabidopsis thaliana
  G2884,GARP domain
WDEELHQNFLNAVDFLGLERAVPKKILDVMKVDYISRENVASHLQKFRL

SEQ ID NO: 3392 - protein, 48 aa, Arabidopsis thaliana
  G2885,GARP domain
WSQELHQKFVSAVQQLGLDKAVPKKILDLMSIEGLTRENVASHLQKYR

SEQ ID NO: 3393 - protein, 177 aa, Arabidopsis thaliana
  G2887,NAC domain
TQLAPGFRFHPTDVELVRYYLKRKILGKKLLVDAIAEVDIYKFEPPDLPDMSFIRSGDLKWHFFCPREKKYASGVRANRATECGYWKTTGKERPVLCNSEVVGKIKTLVYHFGKSPRGERTDWVMHEYRLDDKVLTQMNVPQDTYVVCVLFKKDGPGPRNGAQYGAPFKEEDWSDEE

SEQ ID NO: 3394 - protein, 21 aa, Arabidopsis thaliana
  G2888,1st Z-C2H2 domain
CEICNQGFQRDQNLQMHRRRH

SEQ ID NO: 3395 - protein, 21 aa, Arabidopsis thaliana
  G2888,2nd Z-C2H2 domain
CERCSKGYAVQSDYKAHLKTC

SEQ ID NO: 3396 - protein, 102 aa, Arabidopsis thaliana
  G2893,MYB-(R1)R2R3 domain
RKGPWTLEEDTLLTNYISHNGEGRWNLLAKSSGLKRAGKSCRLRWLNYLKPDIKRGNLTPQEQLLILELHSKWGNRWSKISKYLPGRTDNDIKNYWRTRVQK

SEQ ID NO: 3397 - protein, 73 aa, Arabidopsis thaliana
  G2898,HMG domain
QTKMPKKPATAFFFFLDDFRKQYQEENPDVKSMREIGKTCGEKWKTMTYEEKVKYYDIATEKREEFHRAMTEY

SEQ ID NO: 3398 - protein, 109 aa, Arabidopsis thaliana
  G2907,1st PCGL domain
ELDVGQILSEARHRWLRPPEICEILQNYQRFQISTEPPTTPSSGSVFMFDRKVLRYFRKDGHNWRKKKDGKTVKEAHERLKAGSVDVLHCYYAHGQDNENFQRRSYWLL

SEQ ID NO: 3399 - protein, 70 aa, Arabidopsis thaliana
  G2907,2nd PCGL domain
AAAIRIQNKFRGYKGRKDYLITRQRIIKIQAHVRGYQFRKNYRKIIWSVGVLEKVILRWRRKGAGLRGFK

SEQ ID NO: 3400 - protein, 85 aa, Arabidopsis thaliana
  G2913,ARID domain
VFWDTLRRFHSIMSTKFMIPVIGGKELDLHVLYVEVTRRGGYEKVVVEKKWREVGGVFRFSATTTSASFVLRKHYLNLLFHYEQV

SEQ ID NO: 3401 - protein, 64 aa, Arabidopsis thaliana
  G2930,HLH/MYC domain
SGAAKKQDHNAKERLRRMRLHASYLTLGTLLPDHSSSSSKKKWSAPSIIDNVITYIPKLQNEVG

SEQ ID NO: 3402 - protein, 61 aa, Arabidopsis thaliana
  G2933,HLH/MYC domain
PVVVKKLNHNASERDRRKKINTLFSSLRSCLPASDQSKKLSIPETVSKSLKYIPELQQQVK

SEQ ID NO: 3403 - protein, 61 aa, Arabidopsis thaliana
  G2934,HLH/MYC domain
NKKKKKLLHRDIERQRRQEMATLFATLRTHLPLKYIKGKRAVSDHVNGAVNFIKDTEARIK

SEQ ID NO: 3404 - protein, 17 aa, Arabidopsis thaliana
  G2958,1st IAA domain
YVKVALDGAAYLRKVDL

SEQ ID NO: 3405 - protein, 30 aa, Arabidopsis thaliana
  G2958,2nd IAA domain
YEDKDGDLMLVGDVPWMMFVESCKRMRLMK

SEQ ID NO: 3406 - protein, 23 aa, Arabidopsis thaliana
  G2964,1st Z-C3H domain
PCTKFFSTSGCPFGDNCHFLHYV

SEQ ID NO: 3407 - protein, 35 aa, Arabidopsis thaliana
  G2964,2nd Z-C3H domain
HPGSNYKTKICDRYSKGNCTYGDRCHFAHGESELR

SEQ ID NO: 3408 - protein, 23 aa, Arabidopsis thaliana
  G2967,1st Z-C2H2 domain
CEECGKGFRYEKYFKNHRSMMHL

SEQ ID NO: 3409 - protein, 28 aa, Arabidopsis thaliana
  G2967,2nd Z-C2H2 domain
HRCRLCNKIFSSYQALGGHQTFHRMSKC

SEQ ID NO: 3410 - protein, 23 aa, Arabidopsis thaliana
  G2969,Z-C2H2 domain
CNSCGEIFPKINLLENHIAIKHA

SEQ ID NO: 3411 - protein, 25 aa, Arabidopsis thaliana
  G2972,1st Z-C2H2 domain
CKTCGRKFGTLKGVYGHQRMHSGNH

SEQ ID NO: 3412 - protein, 21 aa, Arabidopsis thaliana
  G2972,2nd Z-C2H2 domain
CSICEKSFVCSQALGSHQRLH

SEQ ID NO: 3413 - protein, 18 aa, Arabidopsis thaliana
  G2972,3rd Z-C2H2 domain
CGKSFVCSQALGGHQTLH

SEQ ID NO: 3414 - protein, 20 aa, Arabidopsis thaliana
  G2979,E2F domain
VRRLYDIANVFASMNLIEKT

SEQ ID NO: 3415 - protein, 19 aa, Arabidopsis thaliana
  G2981,E2F domain
RRRVYDALNVLMAMDIISK

SEQ ID NO: 3416 - protein, 18 aa, Arabidopsis thaliana
  G2982,E2F domain
RRVYDALNVFMALDIIAR

SEQ ID NO: 3417 - protein, 61 aa, Arabidopsis thaliana
  G2983,HB domain
RWNPTQEQIGILEMLYKGGMRTPNAQQIEHITLQLGKYGKIEGKNVFYWFQNHKARERQKQ

SEQ ID NO: 3418 - protein, 56 aa, Arabidopsis thaliana
  G2989 ZF domain
VTYKECLKNHAAAIGGHALDGCGEFMPSPSSTPSDPTSLKCAACGCHRNFHRRETD

SEQ ID NO: 3419 - protein, 64 aa, Arabidopsis thaliana
  G2989 HB domain
RKRFRTKFSSNQKEKMHEFADRIGWKIQKRDEDEVRDFCREIGVDKGVLKVWMHNNKNSFKFSG

SEQ ID NO: 3420 - protein, 56 aa, Arabidopsis thaliana
  G2990 ZF domain
FTYKECLKNHAAALGGHALDGCGEFMPSPSSISSDPTSLKCAACGCHRNFHRRDPD

SEQ ID NO: 3421 - protein, 64 aa, Arabidopsis thaliana
  G2990 HB domain
RKRFRTKFSQFQKEKMHEFAERVGWKMQKRDEDDVRDFCRQIGVDKSVLKVWMHNNKNTFNRRD

SEQ ID NO: 3422 - protein, 56 aa, Arabidopsis thaliana
  G2991 ZF domain
ATYKECLKNHAAGIGGHALDGCGEFMPSPSFNSNDPASLTCAACGCHRNFHRREED

SEQ ID NO: 3423 - protein, 64 aa, Arabidopsis thaliana
  G2991 HB domain
RKRFRTKFSQYQKEKMFEFSERVGWRMPKADDVVVKEFCREIGVDKSVFKVWMHNNKISGRSGA

SEQ ID NO: 3424 - protein, 56 aa, Arabidopsis thaliana
  G2992 ZF domain
VCYKECLKNHAANLGGHALDGCGEFMPSPTATSTDPSSLRCAACGCHRNFHRRDPS

SEQ ID NO: 3425 - protein, 64 aa, Arabidopsis thaliana
  G2992 HB domain
RKRTRTKFTPEQKIKMRAFAEKAGWKINGCDEKSVREFCNEVGIERGVLKVWMHNNKYSLLNGK

SEQ ID NO: 3426 - protein, 54 aa, Arabidopsis thaliana
  G2993 ZF domain
IKYKECLKNHAATMGGNAIDGCGEFMPSGEEGSIEALTCSVCNCHRNFHRRETE

SEQ ID NO: 3427 - protein, 64 aa, Arabidopsis thaliana
  G2993 HB domain
KKRFRTKFTQEQKEKMISFAERVGWKIQRQEESVVQQLCQEIGIRRRVLKVWMHNNKQNLSKKS

SEQ ID NO: 3428 - protein, 54 aa, Arabidopsis thaliana
  G2994 ZF domain
IKYKECLKNHAAAMGGNATDGCGEFMPSGEDGSIEALTCSACNCHRNFHRKEVE

SEQ ID NO: 3429 - protein, 64 aa, Arabidopsis thaliana
  G2994 HB domain
KKRFRTKFTPEQKEKMLSFAEKVGWKIQRQEDCVVQRFCEEIGVKRRVLKVWMHNNKIHFSKKN

SEQ ID NO: 3430 - protein, 54 aa, Arabidopsis thaliana
  G2996 ZF domain
FRFRECLKNQAVNIGGHAVDGCGEFMPAGIEGTIDALKCAACGCHRNFHRKELP

SEQ ID NO: 3431 - protein, 64 aa, Arabidopsis thaliana
  G2996 HB domain
RKRHRTKFTAEQKERMLALAERIGWRIQRQDDEVIQRFCQETGVPRQVLKVWLHNNKHTLGKSP

SEQ ID NO: 3432 - protein, 54 aa, Arabidopsis thaliana
  G2997 ZF domain
IRYRECLKNHAVNIGGHAVDGCCEFMPSGEDGTLDALKCAACGCHRNFHRKETE

SEQ ID NO: 3433 - protein, 64 aa, Arabidopsis thaliana
  G2997 HB domain
TKRFRTKFTAEQKEKMLAFAERLGWRIQKHDDVAVEQFCAETGVRRQVLKIWMHNNKNSLGKKP

SEQ ID NO: 3434 - protein, 54 aa, Arabidopsis thaliana
  G2998 ZF domain
VRYRECLKNHAASVGGSVHDGCGEFMPSGEEGTIEALRCAACDCHRNFHRKEMD

SEQ ID NO: 3435 - protein, 64 aa, Arabidopsis thaliana
  G2998 HB domain
KKRFRTKFTTDQKERMMDFAEKLGWRMNKQDEEELKRFCGEIGVKRQVFKVWMHNNKNNAKKPP

SEQ ID NO: 3436 - protein, 54 aa, Arabidopsis thaliana
  G2999 ZF domain
ARYRECQKNHAASSGGHVVDGCGEFMSSGEEGTVESLLCAACDCHRSFHRKEID

SEQ ID NO: 3437 - protein, 64 aa, Arabidopsis thaliana
  G2999 HB domain
KKRFRTKFNEEQKEKMMEFAEKIGWRMTKLEDDEVNRFCREIKVKRQVFKVWMHNNKQAAKKKD

SEQ ID NO: 3438 - protein, 54 aa, Arabidopsis thaliana
  G3000 ZF domain
AKYRECQKNHAASTGGHVVDGCCEFMAGGEEGTLGALKCAACNCHRSFHRKEVY

SEQ ID NO: 3439 - protein, 64 aa, Arabidopsis thaliana
  G3000 HB domain
KKRVRTKINEEQKEKMKEFAERLGWRMQKKDEEEIDKFCRMVNLRRQVFKVWMHNNKQAMKRNN

SEQ ID NO: 3440 - protein, 49 aa, Arabidopsis thaliana
  G3002 ZF domain
CVYRECMRNHAAKLGSYAIDGCREYSQPSTGDLCVACGCHRSYHRRIDV

SEQ ID NO: 3441 - protein, 63 aa, Arabidopsis thaliana
  G3002 HB domain
QRRRKSKFTAEQREAMKDYAAKLGWTLKDKRALREEIRVFCEGIGVTRYHFKTWVNNNKKFYH

SEQ ID NO: 3442 - protein, 150 aa, Arabidopsis thaliana
  G3003,Z-C2H2 domain
WIPAPEQILIGFTHFSCHVCFKTFNRYNNLQMHMWGHGSQYRKGPESLKGTQPRAMLGIPCYCCVEGCRNNIDHPRSKPLKDFRTLQTHYKRKHGHKPFSCRLCGKLLAVKGDWRTHEKNCGKRWVCVCGSDFKHKRSLKDHVKAFGSGH

SEQ ID NO: 3443 - protein, 266 aa, Arabidopsis thaliana
  G3008,EIL domain
LSPMDDEEEEISYDDLKRRMWKDRNLMEKKLKQQKRHSNDVVSFTTHRAEASRRKKMARSQDSVLKYMMKIMEVCKAKGFVYGIVPEKGKPITGSSDSLRRWWKENVQFDQNAPDAITDYLALAAAAAAAELIDKSSSSSSLLHMLQELQDTTLGSLLSALMQHCMPPQRRFPLEKGIAPPWWPTGTELWWGEQGAAHEHGAPPYRKPHDLRKSWKVSVLAAVIKHMSPNLGRVRRLARQSKSLQDKMMAKETDTWSRVLNQEEAL

SEQ ID NO: 3444 - protein, 58 aa, Arabidopsis thaliana
  G3017,HLH/MYC domain
ATTSPKDPQSLAAKNRRERISERLKVLQELVPNGTKVDLVTMLEKAIGYVKFLQVQVK

SEQ ID NO: 3445 - protein, 58 aa, Arabidopsis thaliana
  G3021,HLH/MYC domain
DGIRILERPDKEGGNEEGGIEERLRELKKLLPGGEEMNVEEMLSEIGNYIKCLELQTI

SEQ ID NO: 3446 - protein, 49 aa, Arabidopsis thaliana
  G3032,GARP domain
WTNRLQLVFDDAVVRLGGLFSATPKAINELISEEGLTGDQIRSHLQVLR

SEQ ID NO: 3447 - protein, 59 aa, Arabidopsis thaliana
  G3044,HLH/MYC domain
RRGQATNSHSLAERVRREKISERMKFLQDLVPGCDKVTGKAVMLDEIINYVQSLQCQIE

SEQ ID NO: 3448 - protein, 20 aa, Arabidopsis thaliana
  G3054,1st Z-C3H domain
CFKFRAGTCPYSASSCHFAH

SEQ ID NO: 3449 - protein, 20 aa, Arabidopsis thaliana
  G3054,2nd Z-C3H domain
CNKWQTTGYCPFGSHCHFAH

SEQ ID NO: 3450 - protein, 19 aa, Arabidopsis thaliana
  G3055,1st Z-C3H domain
CCKFRAGTCPYITNCNFAH

SEQ ID NO: 3451 - protein, 20 aa, Arabidopsis thaliana
  G3055,2nd Z-C3H domain
CKKFYTEEGCPYGESCTFLH

SEQ ID NO: 3452 - protein, 22 aa, Arabidopsis thaliana
  G3055,3rd Z-C3H domain
CNKWEITGYCPFGAKCHFAHGA

SEQ ID NO: 3453 - protein, 69 aa, Arabidopsis thaliana
  G3059,Z-C3H domain
NQGMTKTELCNKWQETGTCPYGDHCQFAHGIKELRPVIRHPRYKTEVCRMVLAGDNCPYGHRCHFRHSL

SEQ ID NO: 3454 - protein, 20 aa, Arabidopsis thaliana
  G3060,1st Z-C3H domain
CTKFFSTSGCPFGENCHFLH

SEQ ID NO: 3455 - protein, 19 aa, Arabidopsis thaliana
  G3060,2nd Z-C3H domain
CERFSKGNCTFGDRCHFAH

SEQ ID NO: 3456 - protein, 18 aa, Arabidopsis thaliana
  G3061,1st Z-C2H2 domain
CNKGFQREQNLQLHKRGH

SEQ ID NO: 3457 - protein, 20 aa, Arabidopsis thaliana
  G3061,2nd Z-C2H2 domain
CDCGTLFSRKDSFISHRSFC

SEQ ID NO: 3458 - protein, 22 aa, Arabidopsis thaliana
  G3067,Z-C2H2 domain
CHKCGEKFSKLEAAEAHHLTKH

SEQ ID NO: 3459 - protein, 22 aa, Arabidopsis thaliana
  G3070,Z-C2H2 domain
CQKCHERVRDLDAFEAHYLSNH

SEQ ID NO: 3460 - protein, 84 aa, Arabidopsis thaliana
  G3074,CAAT domain
KKLDTRFPAARIKKIMQADEDVGKIALAVPVLVSKSLELFLQDLCDRTYEITLERGAKTVSSLHLKHCVERYNVFDFLREVVSK

SEQ ID NO: 3461 - protein, 82 aa, Arabidopsis thaliana
  G3075,CAAT domain
PMNRIRRIMRSDNSAPQIMQDAVFLVNKATEMFIERFSEEAYDSSVKDKKKFIHYKHLSSVVSNDQRYEFLADSVPEKLKAE

SEQ ID NO: 3462 - protein, 31 aa, Arabidopsis thaliana
  G3076,1st bZIP-ZW2 domain
FFGSVWLNPLENACSWLTGWKPSMVFRMVDR

SEQ ID NO: 3463 - protein, 28 aa, Arabidopsis thaliana
  G3076,2nd bZIP-ZW2 domain
ADCVRLKTLKGILDILTPPQCVEFLAAA

SEQ ID NO: 3464 - protein, 31 aa, Arabidopsis thaliana
  G3083,1st bZIP-ZW2 domain
VMASPWASALERSLQWVGGWRPTTLFHLVYT

SEQ ID NO: 3465 - protein, 28 aa, Arabidopsis thaliana
  G3083,2nd bZIP-ZW2 domain
TDDLRLRTITRVVEVLSPLQQAEFLVAA

SEQ ID NO: 3466 - protein, 17 aa, Arabidopsis thaliana
  G3084,1st IAA domain
YVKVTMDGLVVGRKVCV

SEQ ID NO: 3467 - protein, 30 aa, Arabidopsis thaliana
  G3084,2nd IAA domain
YRDEEGLWRNAGDVPWNEFIESVERLRITR

SEQ ID NO: 3468 - protein, 59 aa, Arabidopsis thaliana
  G3086,HLH/MYC domain
KRGCATHPRSIAERVRRTKISERMRKLQDLVPNMDTQTNTADMLDLAVQYIKDLQEQVK

SEQ ID NO: 3469 - protein, 98 aa, Arabidopsis thaliana
  G3091,PLATZ domain
PPWLKPLLKEQFFVHCKFHGDSHKSECNMYCLDCTNGPLCSLCLAHHKDHRTIQIRRSSYHDVIRVNEIQKYLDIGGIQTYVINSAKVVFLNERPQPR

SEQ ID NO: 3470 - protein, 137 aa, Arabidopsis thaliana
  G3094,PLATZ domain
PAWLEVLLKDKFFNACLDHEDDKKNEKNILCIDCCLTICPHCLSSHTSHRLLQIRRYVYRDVLRVEDGSKLMDCSLIQPYTTNSSKVVFINERPQSRQFRGSGNICITCDRSLQSPYLFCCLSCKISDVIMRQRGLS

SEQ ID NO: 3471 - protein, 136 aa, Arabidopsis thaliana
  G3095,PLATZ domain
NPPPWLIPMLRANYFIPCSIHAASNKSECNMFCLDCSSEAFCSYCLLNHRNHRVLQIRRSSYHNVVRVNEIQKYIDISCVQTYIINSARIVFLNERPQPRIGKGVTNTCEICCRSLLDSFRFCSLGCKLGGMKRDP

SEQ ID NO: 3472 - protein, 42 aa, Arabidopsis thaliana
  G3111,RING/C3H2C3 domain
CAICLAEFSAGDELRVLPQCGHGFHVACIDTWLGSHSSCPSC

SEQ ID NO: 3473 - protein, 65 aa, Oryza sativa
  G3380,AP2 domain
ETTKYRGVRRRPSGKFAAEIRDSSRQSVRVWLGTFDTAEEAARAYDRAAYAMRGHLAVLNFPAEA

SEQ ID NO: 3474 - protein, 65 aa, Oryza sativa
  G3381,AP2 domain
LVAKYRGVRRRPWGKFAAEIRDSSRHGVRVWLGTFDTAEEAARAYDRSAYSMRGANAVLNFPADA

SEQ ID NO: 3475 - protein, 65 aa, Oryza sativa
  G3383,AP2 domain
TATKYRGVRRRPWGKFAAEIRDPERGGARVWLGTFDTAEEAARAYDRAAYAQRGAAAVLNFPAAA

SEQ ID NO: 3476 - protein, 64 aa, Oryza sativa
  G3388 AP2 domain
SSRYKGVVPQPNGRWGAQIYERHARVWLGTFPDEEAAARAYDVAALRYRGRDAATNFPGAAASA

SEQ ID NO: 3477 - protein, 94 aa, Oryza sativa
  G3388 B3 domain
LFEKAVTPSDVGKLNRLVVPKQHAEKHFPLRRAASSDSASAAATGKGVLLNFEDGEGKVWRFRYSYWNSSQSYVLTKGWSRFVREKGLRAGDTI

SEQ ID NO: 3478 - protein, 66 aa, Oryza sativa
  G3389 AP2 domain
SSRYKGVVPQPNGRWGAQIYERHARVWLGTFPDEEAAARAYDVAALRFRGRDAVTNRAPAAEGASA

SEQ ID NO: 3479 - protein, 90 aa, Oryza sativa
  G3389 B3 domain
LFEKAVTPSDVGKLNRLVVPKQQAERHFPFPLRRHSSDAAGKGVLLNFEDGDGKVWRFRYSYWNSSQSYVLTKGWSRFVREKGLRPGDTV

SEQ ID NO: 3480 - protein, 70 aa, Oryza sativa
  G3391 AP2 domain
SSKFKGVVPQPNGRWGAQIYERHQRVWLGTFAGEDDAARAYDVAAQRFRGRDAVTNFRPLAEADPDAAAE

SEQ ID NO: 3481 - protein, 86 aa, Oryza sativa
  G3391 B3 domain
LFDKTVTPSDVGKLNRLVIPKQHAEKHFPLQLPSAGGESKGVLLNFEDAAGKVWRFRYSYWNSSQSYVLTKGWSRFVKEKGLHADG

SEQ ID NO: 3482 - protein, 45 aa, Oryza sativa
  G3393,MYB-related domain
VHFTEEEEDLVFRMHRLVGNRWELIAGRIPGRTAKEVEMFWAVKH

SEQ ID NO: 3483 - protein, 89 aa, Oryza sativa
  G3394,CAAT domain
RQDRFLPIANISRIMKKAIPANGKIAKDAKETVQECVSEFISFITSEASDKCQREKRKTINGDDLLWAMATLGFEDYIEPLKVYLQKYR

SEQ ID NO: 3484 - protein, 90 aa, Oryza sativa
  G3395,CAAT domain
REQDRFLPIANISRIMKKAVPANGKIAKDAKETLQECVSEFISFVTSEASDKCQKEKRKTINGEDLLFAMGTLGFEEYVDPLKIYLHKYR

SEQ ID NO: 3485 - protein, 90 aa, Oryza sativa
  G3396,CAAT domain
KEQDRFLPIANIGRIMRRAVPENGKIAKDSKESVQECVSEFISFITSEASDKCLKEKRKTINGDDLIWSMGTLGFEDYVEPLKLYLRLYR

SEQ ID NO: 3486 - protein, 90 aa, Oryza sativa
  G3397,CAAT domain
REQDRFLPIANVSRIMKKALPANAKISKDAKETVQECVSEFISFITGEASDKCQREKRKTINGDDLLWAMTTLGFEDYVDPLKHYLHKFR

SEQ ID NO: 3487 - protein, 90 aa, Oryza sativa
  G3398,CAAT domain
REQDRFLPIANVSRIMKRALPANAKISKDAKETVQECVSEFISFITGEASDKCQREKRKTINGDDLLWAMTTLGFEDYIDPLKLYLHKFR

SEQ ID NO: 3488 - protein, 9 aa, Oryza sativa
  G3399 AT-hook domain
RRPRGRPPG

SEQ ID NO: 3489 - protein, 147 aa, Oryza sativa
  G3399 2nd conserved domain
GSKNKPKPPIIVTRDSPNALHSHVLEVAGGADVVDCVAEYARRRGRGVCVLSGGGAVVNVALRQPGASPPGSMVATLRGRFEILSLTGTVLPPPAPPGASGLTVFLSGGQGQVIGGSVVGPLVAAGPVVLMAASFANAVYERLPLEG

SEQ ID NO: 3490 - protein, 9 aa, Oryza sativa
  G3400 AT-hook domain
RRPRGRPLG

SEQ ID NO: 3491 - protein, 147 aa, Oryza sativa
  G3400 2nd conserved domain
GSKNKPKPPIIVTRDSPNAFHSHVLEVAAGTDIVECVCEFARRRGRGVSVLSGGGAVANVALRQPGASPPGSLVATMRGQFEILSLTGTVLPPPAPPSASGLTVFLSGGQGQVVGGSVAGQLIAAGPVFLMAASFANAVYERLPLDG

SEQ ID NO: 3492 - protein, 9 aa, Oryza sativa
  G3401 AT-hook domain
RRPRGRPPG

SEQ ID NO: 3493 - protein, 144 aa, Oryza sativa
  G3401 2nd conserved domain
GSKNKPKPPIFVTRDSPNALRSHVMEVAGGADVAESIAHFARRRQRGVCVLSGAGTVTDVALRQPAAPSAVVALRGRFEILSLTGTFLPGPAPPGSTGLTVYLAGGQGQVVGGSVVGTLTAAGPVMVIASTFANATYERLPLDQ

SEQ ID NO: 3494 - protein, 9 aa, Oryza sativa
  G3407 AT-hook domain
RRPRGRPPG

SEQ ID NO: 3495 - protein, 150 aa, Oryza sativa
  G3407 2nd conserved domain
GSKNKPKPPVIITRESANALRAHILEVAAGCDVFEALTAYARRRQRGVCVLSAAGTVANVTLRQPQSAQPGPASPAVATLHGRFEILSLAGSFLPPPAPPGATSLAAFLAGGQGQVVGGSVAGALIAAGPVVVVAASFSNVAYERLPLED

SEQ ID NO: 3496 - protein, 9 aa, Oryza sativa
  G3408 AT-hook domain
KKRRGRPPG

SEQ ID NO: 3497 - protein, 158 aa, Oryza sativa
  G3408 2nd conserved domain
GSKNKPKPPVVITREAEPAAAMRPHVIEIPGGRDVAEALARFSSRRNLGICVLAGTGAVANVSLRHPSPGVPGSAPAAIVFHGRYEILSLSATFLPPAMSSVAPQAAVAAAGLSISLAGPHGQIVGGAVAGPLYAATTVVVVAAAFTNPTFHRLPADD

SEQ ID NO: 3498 - protein, 85 aa, Oryza sativa
  G3429,CAAT domain
ELPMANLVRLIKKVLPGKAKIGGAAKGLTHDCAVEFVGFVGDEASEKAKAEHRRTVAPEDYLGSFGDLGFDRYVDPMDAYIHGYR

SEQ ID NO: 3499 - protein, 45 aa, Zea mays
  G3431,MYB-related domain
VDFTEAEEDLVSRMHRLVGNRWEIIAGRIPGRTAEEVEMFWSKKY

SEQ ID NO: 3500 - protein, 66 aa, Zea mays
  G3432 AP2 domain
SSRYKGVVPQPNGRWGAQIYERHQRVWLGTFAGEADAARAYDVAAQRFRGRDAVTNFRPLADADPD

SEQ ID NO: 3501 - protein, 88 aa, Zea mays
  G3432 B3 domain
LFDKTVTPSDVGKLNRLVIPKQHAEKHFPLQLPSAGGESKGVLLNLEDAAGKVWRFRYSYWNSSQSYVLTKGWSRFVKEKGLQAGDVV

SEQ ID NO: 3502 - protein, 90 aa, Zea mays
  G3434,CAAT domain
REQDRFLPIANISRIMKKAVPANGKIAKDAKETLQECVSEFISFVTSEASDKCQKEKRKTINGDDLLWAMATLGFEEYVEPLKIYLQKYK

SEQ ID NO: 3503 - protein, 90 aa, Zea mays
  G3435,CAAT domain
REQDRFLPIANVSRIMKKALPANAKISKDAKETVQECVSEFISFITGEASDKCQREKRKTINGDDLLWAMTTLGFEDYVEPLKHYLHKFR

SEQ ID NO: 3504 - protein, 90 aa, Zea mays
  G3436,CAAT domain
REQDRFLPIANVSRIMKKALPANAKISKDAKETVQECVSEFISFITGEASDKCQREKRKTINGDDLLWAMTTLGFEDYVEPLKLYLHKFR

SEQ ID NO: 3505 - protein, 90 aa, Zea mays
  G3437,CAAT domain
KEQDRFLPIANVSRIMKRSLPANAKISKEAKETVQECVSEFISFVTGEASDKCQREKRKTINGDDLLWAMTTLGFEAYVAPLKSYLNRYR

SEQ ID NO: 3506 - protein, 45 aa, Zea mays; identical to SEQ ID NO: 3499
  G3444,MYB-related domain

SEQ ID NO: 3507 - protein, 45 aa, Glycine max
  G3445,MYB-related domain
VEFSEAEEILIAMVYNLVGERWSLIAGRIPGRTAEEIEKYWTSRF

SEQ ID NO: 3508 - protein, 45 aa, Glycine max; identical to SEQ ID NO: 3507
  G3446,MYB-related domain

SEQ ID NO: 3509 - protein, 45 aa, Glycine max; identical to SEQ ID NO: 3507
  G3447,MYB-related domain

SEQ ID NO: 3510 - protein, 45 aa, Glycine max
  G3448,MYB-related domain
VEFSEDEETLIIRMYKLVGERWSIIAGRIPGRTAEEIEKYWTSRF

SEQ ID NO: 3511 - protein, 45 aa, Glycine max
  G3449,MYB-related domain
VEFSEDEETLIIRMYKLVGERWSLIAGRIPGRTAEEIEKYWTSRF

SEQ ID NO: 3512 - protein, 45 aa, Glycine max
  G3450,MYB-related domain
IHMSEQEEDLIRRMYKLVGDKWNLIAGRIPGRKAEEIERFWIMRH

SEQ ID NO: 3513 - protein, 62 aa, Glycine max
  G3451 AP2 domain
SSKYKGVVPQPNGRWGAQIYEKHQRVWLGTFNEEDEAARAYDIAAQRFRGKDAVTNFKPLAG

SEQ ID NO: 3514 - protein, 100 aa, Glycine max
  G3451 B3 domain
LFEKAVTPSDVGKLNRLVIPKQHAEKHFPLQSSNGVSATTIAAVTATPTAAKGVLLNFEDVGGKVWRFRYSYWNSSQSYVLTKGWSRFVKEKNLKAGDTV

SEQ ID NO: 3515 - protein, 66 aa, Glycine max
  G3452 AP2 domain
SSKYKGVVPQPNGRWGAQIYEKHQRVWLGTFNEEDEAARAYDIAALRFRGPDAVTNFKPPAASDDA

SEQ ID NO: 3516 - protein, 96 aa, Glycine max
  G3452 B3 domain
LFEKTVTPSDVGKLNRLVIPKQHAEKHFPLSGSGDESSPCVAGASAAKGMLLNFEDVGGKVWRFRYSYWNSSQSYVLTKGWSRFVKEKNLRAGDAV

SEQ ID NO: 3517 - protein, 66 aa, Glycine max
  G3453 AP2 domain
SSKYKGVVPQPNGRWGAQIYEKHQRVWLGTFNEEDEAVRAYDIVAHRFRGRDAVTNFKPLAGADDA

SEQ ID NO: 3518 - protein, 96 aa, Glycine max
  G3453 B3 domain
LVEKTVTPSDVGKLNRLVIPKQHAEKHFPLSGSGGGALPCMAAAAGAKGMLLNFEDVGGKVWRFRYSYWNSSQSYVLTKGWSRFVKEKNLRAGDAV

SEQ ID NO: 3519 - protein, 70 aa, Glycine max
  G3455 AP2 domain
SSKYKGVVPQPNGRWGSQIYEKHQRVWLGTFNEEDEAARAYDVAVQRFRGKDAVTNFKPLSGTDDDDGES

SEQ ID NO: 3520 - protein, 100 aa, Glycine max
  G3455 B3 domain
REQLFQKAVTPSDVGKLNRLVIPKQHAEKHFPLQSAANGVSATATAAKGVLLNFEDVGGKVWRFRYSYWNSSQSYVLTKGWSRFVKEKNLKAGDTVCFQR

SEQ ID NO: 3521 - protein, 9 aa, Glycine max
  G3456 AT-hook domain
RRPRGRPPG

SEQ ID NO: 3522 - protein, 144 aa, Glycine max
  G3456 2nd conserved domain
GSRNKPKPPIFVTRDSPNALRSHVMEIAVGADIADCVAQFARRRQRGVSILSGSGTVVNVNLRQPTAPGAVMALHGRFDILSLTGSFLPGPSPPGATGLTIYLAGGQGQIVGGGVVGPLVAAGPVLVMAATFSNATYERLPLED

SEQ ID NO: 3523 - protein, 9 aa, Glycine max
  G3459 AT-hook domain
RRPRGRPPG

SEQ ID NO: 3524 - protein, 144 aa, Glycine max
  G3459 2nd conserved domain
GSKNKPKPPVIITRESANTLRAHILEVGSGSDVFDCVTAYARRRQRGICVLSGSGTVTNVSLRQPAAAGAVVTLHGRFEILSLSGSFLPPPAPPGATSLTIYLAGGQGQVVGGNVIGELTAAGPVIVIAASFTNVAYERLPLEE

SEQ ID NO: 3525 - protein, 9 aa, Glycine max
  G3460 AT-hook domain
RRPRGRPSG

SEQ ID NO: 3526 - protein, 144 aa, Glycine max
  G3460 2nd conserved domain
GSKNKPKPPVIITRESANTLRAHILEVGSGSDVFDCVTAYARRRQRGICVLSGSGTVTNVSLRQPAAAGAVVRLHGRFEILSLSGSFLPPPAPPGATSLTIYLAGGQGQVVGGNVVGELTAAGPVIVIAASFTNVAYERLPLEE

SEQ ID NO: 3527 - protein, 90 aa, Glycine max
  G3470,CAAT domain
REQDRYLPIANISRIMKKALPPNGKIAKDAKDTMQECVSEFISFITSEASEKCQKEKRKTINGDDLLWAMATLGFEDYIEPLKVYLARYR

SEQ ID NO: 3528 - protein, 90 aa, Glycine max; identical to SEQ ID NO: 3527
  G3471,CAAT domain

SEQ ID NO: 3529 - protein, 90 aa, Glycine max
  G3472,CAAT domain
REQDRFLPIANVSRIMKKALPANAKISKEAKETVQECVSEFISFITGEASDKCQKEKRKTINGDDLLWAMTTLGFEEYVEPLKVYLHKYR

SEQ ID NO: 3530 - protein, 91 aa, Glycine max
  G3473,CAAT domain
REQDRFLPIANVSRIMKKALPANAKISKDAKETVQECVSEFISFHSPGGLAGECQKEKRKTINGDDLLWAMTTLGFEEYVEPLKVYLHKYR

SEQ ID NO: 3531 - protein, 90 aa, Glycine max
  G3474,CAAT domain
REQDRFLPIANVSRIMKKALPANAKISKEAKETVQECVSEFISFITGEASDKCQKEKRKTINGDDLLWAMTTLGFEDYVDPLKIYLHKYR

SEQ ID NO: 3532 - protein, 90 aa, Glycine max
  G3475,CAAT domain
REQDRFLPIANVSRIMKKALPANAKISKDAKETVQECVSEFISFITGEASDKCQREKRKTINGDDLLWAMTTLGFEDYVEPLKGYLQRFR

SEQ ID NO: 3533 - protein, 90 aa, Glycine max
  G3476,CAAT domain
REQDRFLPIANVSRIMKKALPANAKISKDAKETVQECVSEFISFITGEASDKCQREKRKTINGDDLLWAMTTLGFEEYVEPLKIYLQRFR

SEQ ID NO: 3534 - protein, 90 aa, Glycine max; identical to SEQ ID NO: 3532
  G3478,CAAT domain

SEQ ID NO: 3535 - protein, 56 aa, Oryza sativa
  G3479,MADS domain
GRGKIVIRRIDNSTSRQVTFSKRRNGIFKKAKELAILCDAEVGLVIFSSTGRLYEY

SEQ ID NO: 3536 - protein, 56 aa, Oryza sativa
  G3480,MADS domain
GRGKIVIRRIDNSTSRQVTFSKRRNGIFKKAKELAILCDAEVGLMIFSSTGRLYEY

SEQ ID NO: 3537 - protein, 56 aa, Oryza sativa
  G3481,MADS domain
GRGKIVIRRIDNSTSRQVTFSKRRNGLLKKAKELSILCDAEVGLVVFSSTGRLYEF

SEQ ID NO: 3538 - protein, 56 aa, Oryza sativa
  G3482,MADS domain
RGKGCWSKGEEGQEEKIKIKERMEERKRCSVSRESSFCTSDTHAIGIFLAHFRTTQ

SEQ ID NO: 3539 - protein, 56 aa, Oryza sativa
  G3483,MADS domain
GRGKIEIKRIDNATSRQVTFSKRRSGLFKKARELSILCDAEVGLLVFSSTSRLYDF

SEQ ID NO: 3540 - protein, 56 aa, Glycine max
  G3484,MADS domain
GRGKIAIRRIDNSTSRQVTFSKRRNGLLKKARELSILCDAEVGLMVFSSTGKLYDY

SEQ ID NO: 3541 - protein, 56 aa, Glycine max
  G3485,MADS domain
GRGKIVIRRIDNSTSRQVTFSKRRNGLLKKAKELAILCDAEVGVMIFSSTGKLYDF

SEQ ID NO: 3542 - protein, 56 aa, Zea mays
  G3487,MADS domain
GRGKIEIKRIDNATSRQVTFSKRRGGLFKKAKELAILCDAEVGLVVFSSTGRLYHF

SEQ ID NO: 3543 - protein, 56 aa, Zea mays
  G3488,MADS domain
GRGKIVIRRIDNSTSRQVTFSKRRNGIFKKARELAILCDAEVGLVIFSSTGRLYEY

SEQ ID NO: 3544 - protein, 56 aa, Zea mays; identical to SEQ ID NO: 3535
  G3489,MADS domain

SEQ ID NO: 3545 - protein, 61 aa, Zea mays
  G3490,HB domain
PHRAKKLRLSKEQSRLLEESFRLNHTLTPKQKEALAVKLKLRPRQVEVWFQNRRARTKLKQ

SEQ ID NO: 3546 - protein, 103 aa, Oryza sativa
  G3503,MYB-(R1)R2R3 domain
KGAWTKEEDDRLIAYIKAHGEGCWRSLPKAAGLLRCGKSCRLRWINYLRPDLKRGNFTEEEDELIIKLHSLLGNKWSLIAGRLPGRTDNEIKNYWNTHIRRKL

SEQ ID NO: 3547 - protein, 103 aa, Oryza sativa
  G3504,MYB-(R1)R2R3 domain
KGAWTKEEDERLVAYIRAHGEGCWRSLPKAAGLLRCGKSCRLRWINYLRPDLKRGNFTADEDDLIIKLHSLLGNKWSLIAARLPGRTDNEIKNYWNTHIRRKL

SEQ ID NO: 3548 - protein, 103 aa, Oryza sativa
  G3505,MYB-(R1)R2R3 domain
KGAWTKEEDQRLIAYIRAHGEGCWRSLPKAAGLLRCGKSCRLRWMNYLRPDLKRGNFTDDEDELIIRLHSLLGNKWSLIAGQLPGRTDNEIKNYWNTHIKRKL

SEQ ID NO: 3549 - protein, 103 aa, Oryza sativa
  G3506,MYB-(R1)R2R3 domain
KGAWTKEEDQRLIAYIKAHGEGCWRSLPKAAGLLRCGKSCRLRWMNYLRPDLKRGNFTDDDDELIIKLHALLGNKWSLIAGQLPGRTDNEIKNYWNTHIKRKL

SEQ ID NO: 3550 - protein, 103 aa, Oryza sativa
  G3507,MYB-(R1)R2R3 domain
KGAWTKEEDQRLIAHINQHGEGCWRSLPKAAGLLRCGKSCRLRWINYLRPDLKRGNFTDEEDELIIKLHELLGNKWSLIAGRLPGRTDNEIKNYWNTHIKRKL

SEQ ID NO: 3551 - protein, 103 aa, Oryza sativa
  G3508,MYB-(R1)R2R3 domain
KGAWTKEEDQRLIAYIKANGEGCWRSLPKAAGLLRCGKSCRLRWINYLRPDLKRGNFTEEEDEFIIKLHELLGNKWSLIAGRLPGRTDNEIKNYWNTHIKRKL

SEQ ID NO: 3552 - protein, 103 aa, Solanum lycopersicum
  G3509,MYB-(R1)R2R3 domain
KGAWTKEEDERLISYIRAHGEGCWRSLPKAAGLLRCGKSCRLRWINYLRPDLKRGNFTEEEDELIIKLHSLLGNKWSLIAGRLPGRTDNEIKNYWNTHIRRKL

SEQ ID NO: 3553 - protein, 61 aa, Oryza sativa
  G3510,HB domain
PHRPKKLRLSKEQSRLLEESFRLNHTLTPKQKEALAIKLKLRPRQVEVWFQNRRARTKLKQ

SEQ ID NO: 3554 - protein, 65 aa, Oryza sativa
  G3515,AP2 domain
SSSSYRGVRKRPWGKFAAEIRDPERGGARVWLGTFDTAEEAARAYDRAAFAMKGATAMLNFPGDH

SEQ ID NO: 3555 - protein, 65 aa, Zea mays
  G3516,AP2 domain
KEGKYRGVRKRPWGKFAAEIRDPERGGSRVWLGTFDTAEEAARAYDRAAFAMKGATAVLNFPASG

SEQ ID NO: 3556 - protein, 65 aa, Zea mays
  G3517,AP2 domain
EPTKYRGVRRRPWGKYAAEIRDSSRHGVRIWLGTFDTAEEAARAYDRSANSMRGANAVLNFPEDA

SEQ ID NO: 3557 - protein, 65 aa, Glycine max
  G3518,AP2 domain
VEVRYRGIRRRPWGKFAAEIRDPTRKGTRIWLGTFDTAEQAARAYDAAAFHFRGHRAILNFPNEY

SEQ ID NO: 3558 - protein, 65 aa, Glycine max
  G3519,AP2 domain
CEVRYRGIRRRPWGKFAAEIRDPTRKGTRIWLGTFDTAEQAARAYDAAAFHFRGHRAILNFPNEY

SEQ ID NO: 3559 - protein, 65 aa, Glycine max
  G3520,AP2 domain
EEPRYRGVRRRPWGKFAAEIRDPARHGARVWLGTFLTAEEAARAYDRAAYEMRGALAVLNFPNEY

SEQ ID NO: 3560 - protein, 61 aa, Glycine max
  G3524,HB domain
GEPPRKKLRLTKEQSRLLEESFRQNHTLNPKQKESLAMQLKLRPRQVEVWFQNRRARSKLK

SEQ ID NO: 3561 - protein, 105 aa, Glycine max
  G3527,MYB-(R1)R2R3 domain
NKGAWTKEEDDRLISYIRAHGEGCWRSLPKAAGLLRCGKSCRLRWINYLRPDLKRGNFTEEEDELIIKLHSLLGNKWSLIAGRLPGRTDNEIKNYWNTHIRRKLL

SEQ ID NO: 3562 - protein, 105 aa, Glycine max; identical to SEQ ID NO: 3561
  G3528,MYB-(R1)R2R3 domain

SEQ ID NO: 3563 - protein, 103 aa, Glycine max
  G3529,MYB-(R1)R2R3 domain
KGAWTKEEDHRLISYIRAHGEGCWRSLPKAAGLLRCGKSCRLRWINYLRPDLKRGNFSLEEDQLIIKLHSLLGNKWSLIAGRLPGRTDNEIKNYWNTHIRRKL

SEQ ID NO: 3564 - protein, 103 aa, Zea mays
  G3531,MYB-(R1)R2R3 domain
KGAWTKEEDDRLVAYIKAHGEGCWRSLPKAAGLVRCGKSCRLRWINYLRPDLKRGNFTEEEDELIIKLHSLLGNKWSLIAGRLPGRTDNEIKNYWNTHIRRKL

SEQ ID NO: 3565 - protein, 103 aa, Zea mays
  G3532,MYB-(R1)R2R3 domain
KGAWTKEEDERLVAHIRAHGEGCWRSLPKAAGLLRCGKSCRLRWINYLRPDLKRGNFTEEEDELIVKLHSVLGNKWSLIAGRLPGRTDNEIKNYWNTHIRRKL

SEQ ID NO: 3566 - protein, 103 aa, Zea mays; identical to SEQ ID NO: 3565
  G3533,MYB-(R1)R2R3 domain

SEQ ID NO: 3567 - protein, 103 aa, Zea mays
  G3534,MYB-(R1)R2R3 domain
RGAWTKEEDERLVAYVRAHGEGCWRSLPRAAGLLRCGKSCRLRWINYLRPDLKRGNFTADEDDLIVKLHSLLGNKWSLIAARLPGRTDNEIKNYWNTHVRRKL

SEQ ID NO: 3568 - protein, 97 aa, Oryza sativa
  G3542,CAAT domain
EEIEQTTDFKNHSLPLARIKKIMKADEDVRMISAEAPVVFAKACEVFILELTLRSWMHTEENKRRTLQKNDIAAAITRTDIYDFLVDIVPRDEMKEE

SEQ ID NO: 3569 - protein, 99 aa, Oryza sativa
  G3543,CAAT domain
QEAERASASDFKNHQLPLARIKKIMKADEDVRMISAEAPVLFAKACELFILELTIRSWLHAEENKRRTLQRNDVAAAIARTDVFDFLVDIVPREEAKEE

SEQ ID NO: 3570 - protein, 97 aa, Oryza sativa
  G3544,CAAT domain
VDIEQTTDFKNHSLPLARIKKIMKADEDVRMISAEAPVIFAKACEIFILELTLRSWMHTEENKRRTLQKNDIAAAITRTDMYDFLVDIVPRDDLKEE

SEQ ID NO: 3571 - protein, 101 aa, Oryza sativa
  G3545,CAAT domain
EVEQMTEFKLPNLPLARIKKIMKADEDVKMIAGEAPALFAKACEMFILDMTLRSWQHTEEGRRRTLQRSDVEAVIKKTDIFDFLVDIITDDKMKDDGMGSQ

SEQ ID NO: 3572 - protein, 98 aa, Oryza sativa
  G3546,CAAT domain
REIEHTTDFKNHNLPLARIKKIMKADEDVRMIAAEAPVVFARACEMFILELTHRGWAHAEENKRRTLQKSDIAAAIARTEVFDFLVDIVPRDEAKDAE

SEQ ID NO: 3573 - protein, 97 aa, Glycine max
  G3547,CAAT domain
QEIEKVTDFKNHSLPLARIKKIMKADEDVRMISAEAPVIFARACEMFILELTLRSWNHTEENKRRTLQKNDIAAAITRTDIFDFLVDIVPREDLKDE

SEQ ID NO: 3574 - protein, 97 aa, Glycine max; identical to SEQ ID NO: 3573
  G3547,CAAT domain

SEQ ID NO: 3575 - protein, 97 aa, Glycine max
  G3548,CAAT domain
QEIEQTIDFKNHSLPLARIKKIMKADEDVRMISAEAPVIFAKACEMFILELTLRSWIHTEENKRRTLQKNDIAAAISRNDVFDFLVDIIPRDELKEE

SEQ ID NO: 3576 - protein, 97 aa, Glycine max; identical to SEQ ID NO: 3575
  G3549,CAAT domain

SEQ ID NO: 3577 - protein, 97 aa, Glycine max; identical to SEQ ID NO: 3575
  G3550,CAAT domain

SEQ ID NO: 3578 - protein, 101 aa, Zea mays
  G3551,CAAT domain
TEIEATTDFKNHNLPLARIKKIMKADEDVRMISAEAPVVFAKACEIFILELTLRSWMHTEVNKRRTLQKNDIAAAITRTDIYDFLVDIVPRDEMKEDGIGL

SEQ ID NO: 3579 - protein, 97 aa, Zea mays
  G3552,CAAT domain
TEIEATTDFKNHNLPLARIKKIMKADEDVRMISAEAPVVFAKACEIFILELTLRSWMHTEENKRRTLQKNDIAAAITRTDIYDFLVDIVPRDEMKED

SEQ ID NO: 3580 - protein, 97 aa, Solanum lycopersicum
  G3553,CAAT domain
QEIEHVTDFKNHSLPLARIKKIMKADEDVRMISAEAPVVFARACEMFILELTLRAWNHTEENKRRTLQKNDIAAAITRTDIFDFLVDIVPREDLKDE

SEQ ID NO: 3581 - protein, 97 aa, Solanum lycopersicum; identical to SEQ ID NO: 3580
  G3554,CAAT domain

SEQ ID NO: 3582 - protein, 97 aa, Solanum lycopersicum
  G3555,CAAT domain
QEIEQVNDFKNHQLPLARIKKIMKADEDVRMISAEAPVLFAKACELFILELTIRSWLHAEENKRRTLQKNDIAAAITRTDIFDFLVDIVPRDEIKDE

SEQ ID NO: 3583 - protein, 9 aa, Oryza sativa
  G3556 AT-hook domain
RRPRGRPPG

SEQ ID NO: 3584 - protein, 144 aa, Oryza sativa
  G3556 2nd conserved domain
GSKNKPKPPVVVTRESPNAMRSHVLEIASGADIVEAIAGFSRRRQRGVSVLSGSGAVTNVTLRQPAGTGAAAVALRGRFEILSMSGAFLPAPAPPGATGLAVYLAGGQGQVVGGSVMGELIASGPVMVIAATFGNATYERLPLD

SEQ ID NO: 3585 - protein, 66 aa, Glycine max
  G3643,AP2 domain
TNNKLKGVRRRKWGKWVSEIRVPGTQERLWLGTYATPEAAAVAHDVAVYCLSRPSSLDKLNFPETL

SEQ ID NO: 3586 - protein, 71 aa, Oryza sativa
  G3644,AP2 domain
ERCRYRGVRRRRWGKWVSEIRVPGTRERLWLGSYATPEAAAVAHDTAVYFLRGGAGDGGGGGATLNFPERA

SEQ ID NO: 3587 - protein, 66 aa, Brassica rapa subsp. Pekinensis
  G3645,AP2 domain
TQSKYKGIRRRKWGKWVSEIRVPGTRDRLWLGSFSTAEGAAVAHDVAFYCLHQPNSLESLNFPHLL

SEQ ID NO: 3588 - protein, 68 aa, Brassica oleracea
  G3646,AP2 domain
HQAKYKGIRRRKWGKWVSEIRVPATRERLWLGSFSTAEGAAVAHDVAFYCLHRPSSLDNEAFNFPHLL

SEQ ID NO: 3589 - protein, 66 aa, Zinnia elegans
  G3647,AP2 domain
SQKTYKGVRCRRWGKWVSEIRVPGSRERLWLGTYSTPEGAAVAHDVASYCLKGNTSFHKLNIPSML

SEQ ID NO: 3590 - protein, 73 aa, Oryza sativa
  G3649,AP2 domain
EMMRYRGVRRRRWGKWVSEIRVPGTRERLWLGSYATAEAAAVAHDAAVCLLRLGGGRRAAAGGGGGLNFPARA

SEQ ID NO: 3591 - protein, 65 aa, Zea mays
  G3650,AP2 domain
RRCRYRGVRRRAWGKWVSEIRVPGTRERLWLGSYAAPEAAAVAHDAAACLLRGCAGRRLNFPGRA

SEQ ID NO: 3592 - protein, 71 aa, Oryza sativa
  G3651,AP2 domain
ERCRYRGVRRRRWGKWVSEIRVPGTRERLWLGSYATPEAAAVAHDTAVYFLRGGAGDGGGGGATAQLPGAR

SEQ ID NO: 3593 - protein, 63 aa, Oryza sativa
  G3657,AP2 domain
VRPYKGVRMRSWGSWVSEIRAPHQKRRIWLGSYATPEAAARAYDAALLCLKGSDAVLNFPSSA

SEQ ID NO: 3594 - protein, 65 aa, Brassica oleracea
  G3659,AP2 domain
KGKHYRGVRQRPWGKFAAEIRDPAKNGARVWLGTFETAEDAALAYDRAAFRMRGSRALLNFPLRV

SEQ ID NO: 3595 - protein, 65 aa, Brassica oleracea
  G3660,AP2 domain
KGKHYRGVRQRPWGKFAAEIRDPAKKGAREWLGTFETAEDAALAYDRAAFRMRGSRALLNFPLRV

SEQ ID NO: 3596 - protein, 65 aa, Zea mays
  G3661,AP2 domain
RGKHYRGVRQRPWGKFAAEIRDPARNGARVWLGTYDTAEDAALAYDRAAYRMRGSRALLNFPLRI

SEQ ID NO: 3597 - protein, 54 aa, Oryza sativa
  G3674 ZF domain
ARYRECLKNHAVGIGGHAVDGCGEFMASGEEGSIDALRCAACGCHRNFHRKESE

SEQ ID NO: 3598 - protein, 64 aa, Oryza sativa
  G3674 HB domain
KKRFRTKFTQEQKDKMLAFAERLGWRIQKHDEAAVQQFCEEVCVKRHVLKVWMHNNKHTLGKKA

SEQ ID NO: 3599 - protein, 50 aa, Zea mays
  G3676 ZF domain
ARYHECLRNHAAALGGHVVDGCGEFMPGDGDSLKCAACGCHRSFHRKDDA

SEQ ID NO: 3600 - protein, 64 aa, Zea mays
  G3676 HB domain
RKRFRTKFTPEQKEQMLAFAERLGWRLQKQDDALVQHFCDQVGVRRQVFKVWMHNNKHTGRRQQ

SEQ ID NO: 3601 - protein, 56 aa, Zea mays
  G3680 ZF domain
PLYRECLKNHAASLGGHAVDGCGEFMPSPGANPADPTSLKCAACGCHRNFHRRTLE

SEQ ID NO: 3602 - protein, 64 aa, Zea mays
  G3680 HB domain
RKRFRTKFTAEQKQRMQELSERLGWRLQKRDEAIVDEWCRDIGVGKGVFKVWMHNNKHNFLGGH

SEQ ID NO: 3603 - protein, 56 aa, Zea mays
  G3681 ZF domain
PLYRECLKNHAASLGGHAVDGCGEFMPSPGANPADPTSLKCAACGCHRNFHRRTVE

SEQ ID NO: 3604 - protein, 64 aa, Zea mays
  G3681 HB domain
RKRFRTKFTAEQKQRMQELSERLGWRLQKRDEAVVDEWCRDMGVGKGVFKVWMHNNKHNFLGGH

SEQ ID NO: 3605 - protein, 54 aa, Oryza sativa
  G3683 ZF domain
ARYRECLKNHAAAIGGSATDGCGEFMPGGEEGSLDALRCSACGCHRNFHRKELD

SEQ ID NO: 3606 - protein, 64 aa, Oryza sativa
  G3683 HB domain
RKRFRTKFTAEQKARMLGFAEEVGWRLQKLEDAVVQRFCQEVGVKRRVLKVWMHNNKHTLARRH

SEQ ID NO: 3607 - protein, 53 aa, Oryza sativa
  G3685 ZF domain
VRYHECLRNHAAAMGGHVVDGCREFMPMPGDAADALKCAACGCHRSFHRKDDG

SEQ ID NO: 3608 - protein, 64 aa, Oryza sativa
  G3685 HB domain
RKRFRTKFTPEQKEQMLAFAERVGWRMQKQDEALVEQFCAQVGVRRQVFKVWMHNNKSSIGSSS

SEQ ID NO: 3609 - protein, 51 aa, Oryza sativa
  G3686 ZF domain
CRYHECLRNHAAASGGHVVDGCGEFMPASTEEPLACAACGCHRSFHRRDPS

SEQ ID NO: 3610 - protein, 64 aa, Oryza sativa
  G3686 HB domain
RRRSRTTFTREQKEQMLAFAERVGWRIQRQEEATVEHFCAQVGVRRQALKVWMHNNKHSFKQKQ

SEQ ID NO: 3611 - protein, 53 aa, Oryza sativa
  G3690 ZF domain
WRYRECLKNHAARMGAHVLDGCGEFMSSPGDGAAALACAACGCHRSFHRREPA

SEQ ID NO: 3612 - protein, 64 aa, Oryza sativa
  G3690 HB domain
KKRFRTKFTAEQKERMREFAHRVGWRIHKPDAAAVDAFCAQVGVSRRVLKVWMHNNKHLAKTPP

SEQ ID NO: 3613 - protein, 65 aa, Glycine max
  G3717,AP2 domain
KGKHYRGVRQRPWGKFAAEIRDPAKNGARVWLGTFETAEDAALAYDRAAYRMRGSRALLNFPLRV

SEQ ID NO: 3614 - protein, 65 aa, Glycine max
  G3718,AP2 domain
KGKHYRGVRQRPWGKFAAEIRDPAKNGARVWLGTFETAEDAALAYDRAAYRMRGSRALLNFPLRI

SEQ ID NO: 3615 - protein, 57 aa, Zea mays
  G3719,WRKY domain
DDGFKWRKYGKKTVKSSPNPRNYYRCSAEGCGVKKRVERDSDDPRYVVTTYDGVHNH

SEQ ID NO: 3616 - protein, 57 aa, Zea mays
  G3720,WRKY domain
DDGYKWRKYGKKSVKNSPNPRNYYRCSTEGCNVKKRVERDKDDPSYVVTTYEGMHNH

SEQ ID NO: 3617 - protein, 57 aa, Oryza sativa
  G3721,WRKY domain
DDGFKWRKYGKKAVKNSPNPRNYYRCSTEGCNVKKRVERDREDHRYVITTYDGVHNH

SEQ ID NO: 3618 - protein, 57 aa, Zea mays
  G3722,WRKY domain
DDGYKWRKYGKKSVKNSPNPRNYYRCSTEGCNVKKRVERDRDDPRYVVTMYEGVHNH

SEQ ID NO: 3619 - protein, 57 aa, Glycine max
  G3723,WRKY domain
DDGYKWRKYGKKTVKSSPNPRNYYKCSGEGCDVKKRVERDRDDSNYVLTTYDGVHNH

SEQ ID NO: 3620 - protein, 57 aa, Glycine max
  G3724,WRKY domain
DDGYKWRKYGKKSVKSSPNLRNYYKCSSGGCSVKKRVERDRDDYSYVITTYEGVHNH

SEQ ID NO: 3621 - protein, 57 aa, Oryza sativa
  G3725,WRKY domain
DDGYKWRKYGKKSVKNSPNPRNYYRCSTEGCNVKKRVERDKNDPRYVVTMYEGIHNH

SEQ ID NO: 3622 - protein, 57 aa, Oryza sativa
  G3726,WRKY domain
DDGYKWRKYGKKSVKNSPNPRNYYRCSTEGCNVKKRVERDKDDPSYVVTTYEGTHNH

SEQ ID NO: 3623 - protein, 57 aa, Zea mays
  G3727,WRKY domain
DDGFKWRKYGKKAVKSSPNPRNYYRCSSEGCGVKKRVERDRDDPRYVITTYDGVHNH

SEQ ID NO: 3624 - protein, 57 aa, Zea mays
  G3728,WRKY domain
DDGFKWRKYGKKAVKNSPNPRNYYRCSSEGCGVKKRVERDRDDPRYVITTYDGVHNH

SEQ ID NO: 3625 - protein, 57 aa, Oryza sativa
  G3729,WRKY domain
DDGYRWRKYGKKMVKNSPNPRNYYRCSSEGCRVKKRVERARDDARFVVTTYDGVHNH

SEQ ID NO: 3626 - protein, 57 aa, Oryza sativa
  G3730,WRKY domain
DDGFKWRKYGKKAVKSSPNPRNYYRCSAAGCGVKKRVERDGDDPRYVVTTYDGVHNH

SEQ ID NO: 3627 - protein, 65 aa, Oryza sativa
  G3737,AP2 domain
AASKYRGVRRRPWGKFAAEIRDPERGGSRVWLGTFDTAEEAARAYDRAAFAMKGAMAVLNFPGRT

SEQ ID NO: 3628 - protein, 65 aa, Zea mays
  G3739,AP2 domain
EPTKYRGVRRRPWGKYAAEIRDSSRHGVRIWLGTFDTAEEAARAYDRSAYSMRGANAVLNFPEDA

SEQ ID NO: 3629 - protein, 59 aa, Oryza sativa
  G3742,HLH/MYC domain
KRGCATHPRSIAERVRRTRISERIRKLQELVPNMEKQTNTADMLDLAVDYIKELQKQVK

SEQ ID NO: 3630 - protein, 59 aa, Oryza sativa
  G3744,HLH/MYC domain
KRGCATHPRSIAERVRRTRISERIRKLQELVPNMDKQTNTADMLDLAVDYIKDLQKQVK

SEQ ID NO: 3631 - protein, 59 aa, Oryza sativa
  G3746,HLH/MYC domain
KRGCATHPRSIAERERRTRISKRLKKLQDLVPNMDKQTNTSDMLDIAVTYIKELQGQVE

SEQ ID NO: 3632 - protein, 58 aa, Oryza sativa
  G3750,HLH/MYC domain
RRGQATDPHSIAERLRRERIAERMRALQELVPNTNKTDRAAMLDEILDYVKFLRLQVK

SEQ ID NO: 3633 - protein, 59 aa, Zea mays
  G3755,HLH/MYC domain
KRGCATHPRSIAERVRRTKISERIRKLQELVPNMDKQTNTSDMLDLAVDYIKDLQKQVK

SEQ ID NO: 3634 - protein, 58 aa, Zea mays
  G3760,HLH/MYC domain
RRGQATDPHSIAERLRRERIAERMKALQELVPNANKTDKASMLDEIVDYVKFLQLQVK

SEQ ID NO: 3635 - protein, 59 aa, Glycine max
  G3765,HLH/MYC domain
KRGFATHPRSIAERVRRTRISERIRKLQELVPTMDKQTSTAEMLDLALDYIKDLQKQFK

SEQ ID NO: 3636 - protein, 59 aa, Glycine max
  G3766,HLH/MYC domain
KRGCATHPRSIAERVRRTRISERMRKLQELVPHMDKQTNTADMLDLAVEYIKDLQKQFK

SEQ ID NO: 3637 - protein, 59 aa, Glycine max
  G3767,HLH/MYC domain
KRGCATHPRSIAERVRRTKISERMRKLQDLVPNMDKQTNTADMLDLAVDYIKDLQKQVQ

SEQ ID NO: 3638 - protein, 59 aa, Glycine max; identical to SEQ ID NO: 3637
  G3768,HLH/MYC domain

SEQ ID NO: 3639 - protein, 59 aa, Glycine max
  G3769,HLH/MYC domain
KRGCATHPRSIAERVRRTKISERMRKLQDLVPNMDKQTNTADMLDLAVEYIKDLQNQVQ

SEQ ID NO: 3640 - protein, 59 aa, Glycine max
  G3771,HLH/MYC domain
KRGCATHPRSIAERVRRTRISDRIRKLQELVPNMDKQTNTADMLDEAVAYVKFLQKQIE

SEQ ID NO: 3641 - protein, 65 aa, Zea mays
  G3794,AP2 domain
EPTKYRGVRRRPSGKFAAEIRDSSRQSVRMWLGTFDTAEEAARAYDRAAYAMRGQIAVLNFPAEA

SEQ ID NO: 3642 - protein, 57 aa, Glycine max
  G3803,WRKY domain
DDGYKWRKYGKKTVKNNPNPRNYYKCSGEGCNVKKRVERDRDDSNYVLTTYDGVHNH

SEQ ID NO: 3643 - protein, 57 aa, Zea mays; identical to SEQ ID NO: 3624
  G3804,WRKY domain

SEQ ID NO: 3644 - protein, 66 aa, Glycine max
  G3810,1st SCR domain
QKLFFELFPFLKVAFVLTNQAIIEAMEGEKVIHIIDLNAAEAAQWIALLRVLSAHPEGPPHLRITG

SEQ ID NO: 3645 - protein, 70 aa, Glycine max
  G3810,2nd SCR domain
FLNALWGLSPKVMVVTEQDCNHNGPTLMDRLLEALYSYAALFDCLESTVSRTSLERLRVEKMLFGEEIKN

SEQ ID NO: 3646 - protein, 74 aa, Glycine max
  G3810,3rd SCR domain
CEGSERKERHEKLEKWFQRFDLAGFGNVPLSYFGMVQARRFLQSYGCEGYRMRDENGCVLICWEDRPMYSISAW

SEQ ID NO: 3647 - protein, 66 aa, Glycine max
  G3811,1st SCR domain
QKLFFELLPFLKFSYILTNQAIVEAMEGEKMVHIVDLYGAGPAQWISLLQVLSARPEGPPHLRITG

SEQ ID NO: 3648 - protein, 70 aa, Glycine max
  G3811,2nd SCR domain
FLNALWGLSPKVMVVTEQDFNHNCLTMMERLAEALFSYAAYFDCLESTVSRASMDRLKLEKMLFGEEIKN

SEQ ID NO: 3649 - protein, 74 aa, Glycine max
  G3811,3rd SCR domain
CEGCERKERHEKMDRWIQRLDLSGFANVPISYYGMLQGRRFLQTYGCEGYKMREECGRVMICWQERSLFSITAW

SEQ ID NO: 3650 - protein, 66 aa, Oryza sativa
  G3813,1st SCR domain
RRHFLDLCPFLRLAGAAANQSILEAMESEKIVHVIDLGGADATQWLELLHLLAARPEGPPHLRLTS

SEQ ID NO: 3651 - protein, 70 aa, Oryza sativa
  G3813,2nd SCR domain
FLGALWGLSPKVMVVAEQEASHNAAGLTERFVEALNYYAALFDCLEVGAARGSVERARVERWLLGEEIKN

SEQ ID NO: 3652 - protein, 74 aa, Oryza sativa
  G3813,3rd SCR domain
CDGGERRERHERLERWARRLEGAGFGRVPLSYYALLQARRVAQGLGCDGFKVREEKGNFFLCWQDRALFSVSAW

SEQ ID NO: 3653 - protein, 68 aa, Oryza sativa
  G3814,1st SCR domain
RRHMFDVLPFLKLAYLTTNHAILEAMEGERFVHVVDFSGPAANPVQWIALFHAFRGRREGPPHLRITA

SEQ ID NO: 3654 - protein, 69 aa, Oryza sativa
  G3814,2nd SCR domain
FLSAVRSLSPKIMVMTEQEANHNGGAFQERFDEALNYYASLFDCLQRSAAAAAERARVERVLLGEEIRG

SEQ ID NO: 3655 - protein, 77 aa, Oryza sativa
  G3814,3rd SCR domain
CEGAERVERHERARQWAARMEAAGMERVGLSYSGAMEARKLLQSCGWAGPYEVRHDAGGHGFFFCWHKRPLYAVTAW

SEQ ID NO: 3656 - protein, 66 aa, Solanum lycopersicum
  G3824,1st SCR domain
RKMFFEIFPFLKVAFVVTNQAIIEAMEGEKMVHIVDLNAAEPLQWRALLQDLSARPEGPPHLRITG

SEQ ID NO: 3657 - protein, 70 aa, Solanum lycopersicum
  G3824,2nd SCR domain
FLNALWGLSPKVMVVTEQDANHNGTTLMERLSESLHFYAALFDCLESTLPRTSLERLKVEKMLLGEEIRN

SEQ ID NO: 3658 - protein, 74 aa, Solanum lycopersicum
  G3824,3rd SCR domain
CEGIERKERHEKLEKWFQRFDTSGFGNVPLSYYAMLQARRLLQSYSCEGYKIKEDNGCVVICWQDRPLFSVSSW

SEQ ID NO: 3659 - protein, 70 aa, Oryza sativa
  G3827,1st SCR domain
DVESLRGLSLKVMVVTEQEVSHNAAGLTERFVEALNYYAALFDCLEVGGARGSVERTRVERWLLGEEIKN

SEQ ID NO: 3660 - protein, 67 aa, Oryza sativa
  G3827,2nd SCR domain
CDGGERRERHERLEGAGFGRVPLSYYALLQARRVAQGLGCDGFKVREEKGNFFLCWQDRALFSVSAW

SEQ ID NO: 3661 - protein, 90 aa, Oryza sativa
  G3835,CAAT domain
NGQDNLLPIANVGRIMKDGLPPQAKISKRAKETIQECATEFISFVTGEASERCRRERRKTVNGDDVCHAMRSLGLDHYADAMHRYLQRYR

SEQ ID NO: 3662 - protein, 90 aa, Glycine max
  G3837,CAAT domain
KEQDRLLPIANVGRIMKQILPPNAKISKEAKETMQECVSEFISFVTGEASDKCHKEKRKTVNGDDICWALATLGFDDYSEPLKRYLHKYR

SEQ ID NO: 3663 - protein, 90 aa, Zea mays
  G3839,CAAT domain
REQDRLMPVANVSRIMRQVLPPYAKISDDAKEVIQECVSEFISFVTGEANERCHTERRKTVTSEDIVWAMSRLGFDDYVAPLGAFLQRMR

SEQ ID NO: 3664 - protein, 90 aa, Zea mays; identical to SEQ ID NO: 3663
  G3839,CAAT domain

SEQ ID NO: 3665 - protein, 65 aa, Solanum lycopersicum
  G3841,AP2 domain
KGRHYRGVRQRPWGKFAAEIRDPAKNGARVWLGTYETAEEAAIAYDKAAYRMRGSKAHLNFPHRI

SEQ ID NO: 3666 - protein, 65 aa, Solanum lycopersicum
  G3843,AP2 domain
KAKHYRGVRVRPWGKFAAEIRDPAKNGARVWLGTYETAEDAALAYDKAAFRMRGSRALLNFPLRI

SEQ ID NO: 3667 - protein, 65 aa, Medicago truncatula; identical to SEQ ID NO: 3613
  G3844,AP2 domain

SEQ ID NO: 3668 - protein, 65 aa, Nicotiana tabacum
  G3845,AP2 domain
RGRHYRGVRRRPWGKFAAEIRDPAKNGARVWLGTYETDEEAAIAYDKAAYRMRGSKAHLNFPHRI

SEQ ID NO: 3669 - protein, 65 aa, Nicotiana tabacum
  G3846,AP2 domain
KGRHYRGVRQRPWGKFAAEIRDPAKNGARVWLGTYETAEEAALAYDKAAYRMRGSKALLNFPHRI

SEQ ID NO: 3670 - protein, 65 aa, Oryza sativa
  G3848,AP2 domain
RGKHYRGVRQRPWGKFAAEIRDPAKNGARVWLGTFDTAEDAALAYDRAAYRMRGSRALLNFPLRI

SEQ ID NO: 3671 - protein, 66 aa, Solanum lycopersicum
  G3852,AP2 domain
PKGRHYRGVRQRPWGKFAAEIRDPAKNGARVWLGTYESAEEAALAYGKAAFRMRGTKALLNFPHRI

SEQ ID NO: 3672 - protein, 65 aa, Zea mays
  G3856,AP2 domain
RGKHYRGVRQRPWGKFAAEIRDPAKNGARVWLGTYDSAEDAAVAYDRAAYRMRGSRALLNFPLRI

SEQ ID NO: 3673 - protein, 65 aa, Solanum tuberosum; identical to SEQ ID NO: 3665
  G3857,AP2 domain

SEQ ID NO: 3674 - protein, 65 aa, Solanum tuberosum
  G3858,AP2 domain
KGRHYRGVRQRPWGKFAAEIRDPAKNGARVWLGTYESAEEAALAYDIAAFRMRGTKALLNFPHRI

SEQ ID NO: 3675 - protein, 65 aa, Triticum aestivum
  G3864,AP2 domain
RGKHFRGVRQRPWGKFAAEIRDPAKNGARVWLGTFDSAEDAAVAYDRAAYRMRGSRALLNFPLRI

SEQ ID NO: 3676 - protein, 65 aa, Triticum aestivum; identical to SEQ ID NO: 3675
  G3865,AP2 domain

SEQ ID NO: 3677 - protein, 97 aa, Zea mays
  G3866,CAAT domain
REQDRFLPIANISRIMKKAIPANGKTIPANGKIAKDAKETVQECVSEFISFITSEASDKCQREKRKTINGDDLLWAMATLGFEDYIEPLKVYLQKYR

SEQ ID NO: 3678 - protein, 90 aa, Glycine max
  G3873,CAAT domain
REQDRFLPIANISRIMKKALPPNGKIAKDAKETVQECVSEFISFVTSEASDKCQREKRKTINGDDLLWAMTTLGFEEYIDPLKVYLAAYR

SEQ ID NO: 3679 - protein, 90 aa, Glycine max
  G3874,CAAT domain
REQDRYLPIANISRIMKKALPANGKIAKDAKETVQECVSEFISFITSEASDKCQREKRKTINGDDLLWAMATLGFEDYMDPLKIYLTRYR

SEQ ID NO: 3680 - protein, 90 aa, Glycine max
  G3875,CAAT domain
REQDRYLPIANISRIMKKALPANGKIAKDAKETVQECVSEFISFITSEASDKCQREKRKTINGDDLLWAMATLGFEDYIDPLKIYLTRYR

SEQ ID NO: 3681 - protein, 90 aa, Zea mays
  G3876,CAAT domain
REQDRFLPIANISRIMKKAIPANGKIAKDAKETVQECVSEFISFITSEASDKCQREKRKTINGDDLLWAMATLGFEDYIEPLKVYLQKYR

SEQ ID NO: 3682 - protein, 97 aa, Gossypium raimondii; identical to SEQ ID NO: 2706
  G3883,CAAT domain

SEQ ID NO: 3683 - protein, 97 aa, Nicotiana benthamiana
  G3884,CAAT domain
QEIEQVNDFKNHQLPLARIKKIMKADEDVRMISAEAPILFAKACELFILELTIRSWLHAEENKRRTLQKNDIAAAITRTDIFDFLVDIVPRDEIKEE

SEQ ID NO: 3684 - protein, 97 aa, Solanum tuberosum; identical to SEQ ID NO: 3582
  G3885,CAAT domain

SEQ ID NO: 3685 - protein, 97 aa, Glycine max
  G3886,CAAT domain
QEIEHVNDFKNHQLPLARIKKIMKADEDVRMISAEAPILFAKACELFILELTIRSWLHAEENKRRTLQKNDIAAAITRTDIFDFLVDIVPRDEIKDD

SEQ ID NO: 3686 - protein, 99 aa, Zea mays; identical to SEQ ID NO: 3569
  G3889,CAAT domain

SEQ ID NO: 3687 - protein, 97 aa, Solanum tuberosum; identical to SEQ ID NO: 3580
  G3892,CAAT domain

SEQ ID NO: 3688 - protein, 97 aa, Solanum tuberosum; identical to SEQ ID NO: 3580
  G3893,CAAT domain

SEQ ID NO: 3689 - protein, 97 aa, Solanum lycopersicum; identical to SEQ ID NO: 3580
  G3894,CAAT domain

SEQ ID NO: 3690 - protein, 97 aa, Medicago truncatula; identical to SEQ ID NO: 3573
  G3896,CAAT domain

SEQ ID NO: 3691 - protein, 97 aa, Daucus carota
  G3899,CAAT domain
QEIGQTPDFKNHSLPLARIKKIMKADEDVRMISSEAPVIFAKACEMFILELTMRSWLLTEENKRRTLQKNDIAAAISRTDIFDFLVDIIPRDELKEE

SEQ ID NO: 3692 - protein, 97 aa, Daucus carota
  G3900,CAAT domain
QEIEQTTDFKNHSLPLARIKKIMKADEDVRMISSEAPVVFAKACEMFIMDLTMRSWSHTEENKRRTLQKNDIAAAVSRTDVFDFLVDIIPKDEMKED

SEQ ID NO: 3693 - protein, 93 aa, Gossypium arboreum
  G3907,CAAT domain
HEIEQTTDFKNHSLPLARIKKIMKADEDVRMISAEAPVIFAKACEMFVLELTLRSWIHTEENKRRTLQKNDIAAAISRTDVFDFLVDIIPGTE

SEQ ID NO: 3694 - protein, 98 aa, Zea mays
  G3909,CAAT domain
REIEATTDFKNHNLPLARIKKIMKADEDVRMIAAEAPVVFSRACEMFILELTHRGWAHAEENKRRTLQKSDIAAAVARTEVFDFLVDIVPRDEAKDAD

SEQ ID NO: 3695 - protein, 98 aa, Zea mays
  G3911,CAAT domain
REIEATTDFKNHNLPLARIKKIMKADEDVRMIAAEAPVVFARACEMFILELTHRGWAHAEENKRRTLQKSDIAAAIARTEVFDFLVDIVPRDDGKDAD

SEQ ID NO: 3696 - protein, 91 aa, Oryza sativa
  G3917,1st TH domain
GAGGNRWPRQETLALLKIRSDMDAAFRDATLKGPLWEEVSRKLAEEGYRRSAKKCKEKFENVHKYYKRTKESRAGRNDGKTYRFFTQLEAL

SEQ ID NO: 3697 - protein, 94 aa, Oryza sativa
  G3917,2nd TH domain
SSRWPKAEVHALIQLRSNLDNRYQEAGPKGPLWEEISAGMRRLGYSRSSKRCKEKWENINKYFKKVKESNKKRPEDSKTCPYFHQLDALYRNKA

SEQ ID NO: 3698 - protein, 60 aa, Glycine max
  G3920,CAAT domain
EPVYVNAKQYHGILRRRQSRAKAEIEKKVIKNRKPYLHESRHLHAMRRARGNGGRFLNTK

SEQ ID NO: 3699 - protein, 60 aa, Zea mays
  G3921,CAAT domain
EPIYVNAKQYHAILRRRQTRAKLEAQNKMVKGRKPYLHESRHRHAMKRARGSGGRFLNTK

SEQ ID NO: 3700 - protein, 60 aa, Oryza sativa
  G3924,CAAT domain
EPVYVNAKQYHGILRRRQSRAKAELEKKVVKSRKPYLHESRHQHAMRRARGTGGRFLNTK

SEQ ID NO: 3701 - protein, 60 aa, Oryza sativa
  G3925,CAAT domain
EPIYVNAKQYHAILRRRQLRAKLEAENKLVKNRKPYLHESRHQHAMKRARGTGGRFLNTK

SEQ ID NO: 3702 - protein, 59 aa, Oryza sativa
  G3926,CAAT domain
EPIFVNAKQYNAILRRRQTRAKLEAQNKAVKGRKPYLHESRHHHAMKRARGSGGRFLTK

SEQ ID NO: 3703 - protein, 45 aa, Arabidopsis thaliana
  G3930,MYB-related domain
INMTEQEEDLIFRMYRLVGDRWDLIARRVVGREAKEIERYWIMRN

SEQ ID NO: 3704 - protein, 89 aa, Zea mays
  G3931,CAAT domain
EQDRLLPIANVGRIMKQILPPNAKISKEAKETMQECVSEFIGFVTGEASDKCHKEKRKTVNGDDLCWAFGALGFDDYVDPMRGYLHKYR

SEQ ID NO: 3705 - protein, 90 aa, Zea mays
  G3937,CAAT domain
REQDRLMPIANVIRIMRRVLPAHAKISDDAKETIQECVSEYISFITGEANERCQREQRKTITAEDVLWAMSRLGFDDYVEPLGAYLHRYR

SEQ ID NO: 3706 - protein, 90 aa, Oryza sativa
  G3939,CAAT domain
REQDRLMPIANVIRIMRRVLPAHAKISDDAKETIQECVSEYISFITGEANERCQREQRKTITAEDVLWAMSRLGFDDYVEPLGVYLHRYR

SEQ ID NO: 3707 - protein, 89 aa, Oryza sativa
  G3940,CAAT domain
KEDVSLPKSTMFKIIKEMLPPDVRVARDAQDLLVECCVEFINLLSSESNEVCSREDKKTIAPEHVLRALQDLGFREYIEEVQAAYEHHK

SEQ ID NO: 3708 - protein, 1173 aa, Arabidopsis thaliana; identical to SEQ ID NO: 2242
  G3967,VAR domain

SEQ ID NO: 3709 - protein, 90 aa, Saccharomyces cerevisiae
  G3969,CAAT domain
REQDRWLPINNVARLMKNTLPPSAKVSKDAKECMQECVSELISFVTSEASDRCAADKRKTINGEDILISLHALGFENYAEVLKIYLAKYR

SEQ ID NO: 3710 - protein, 56 aa, Glycine max; identical to SEQ ID NO: 3541
  G3980,MADS domain

SEQ ID NO: 3711 - protein, 56 aa, Glycine max; identical to SEQ ID NO: 3541
  G3981,MADS domain

SEQ ID NO: 3712 - protein, 42 aa, Zea mays
  G4000,Z-CO-like domain
CELCGGAAAVHCAADSAFLCLRCDAKVHGANFLASRHVRRRL

SEQ ID NO: 3713 - protein, 46 aa, Glycine max
  G4004,Z-CO-like domain
CELCHQLASLYCPSDSAFLCFHCDAAVHAANFLVARHLRRLLCSKC

SEQ ID NO: 3714 - protein, 46 aa, Glycine max
  G4005,Z-CO-like domain
CELCDQQASLYCPSDSAFLCSDCDAAVHAANFLVARHLRRLLCSKC

SEQ ID NO: 3715 - protein, 46 aa, Citrus sinensis
  G4007,Z-CO-like domain
CELCSQEAALHCASDEAFLCFDCDDRVHKANFLVARHVRQTLCSQC

SEQ ID NO: 3716 - protein, 46 aa, Populus trichocarpa
  G4009,Z-CO-like domain
CELCKGEAGVYCDSDAAYLCFDCDSNVHNANFLVARHIRRVICSGC

SEQ ID NO: 3717 - protein, 42 aa, Oryza sativa
  G4011,Z-CO-like domain
CALCGAAAAVHCEADAAFLCAACDAKVHGANFLASRHHRRRV

SEQ ID NO: 3718 - protein, 42 aa, Oryza sativa
  G4012,Z-CO-like domain
CELCGGVAAVHCAADSAFLCLVCDDKVHGANFLASRHRRRRL

SEQ ID NO: 3719 - protein, 101 aa, Glycine max
  G4218,MYB-(R1)R2R3 domain
KGPWSAEEDRILTGLVERYGPRNWSLISRYIKGRSGKSCRLRWCNQLSPAVEHRPFSAQEDDTIIAAHAQYGNRWATIARLLPGRTDNAVKNHWNSTLKRR

SEQ ID NO: 3720 - protein, 101 aa, Glycine max
  G4219,MYB-(R1)R2R3 domain
KGPWSAQEDRILTRLVEQYGPRNWSLISRYIKGRSGKSCRLRWCNQLSPTVEHRPFSTQEDETIIAAHARYGNRWATIARLLPGRTDNAVKNHWNSTLKRR

SEQ ID NO: 3721 - protein, 101 aa, Glycine max
  G4220,MYB-(R1)R2R3 domain
KGPWSPEEDEALRALVQAHGPRNWSVISKSIPGRSGKSCRLRWCNQLSPQVAHRPFSQEEDEAIIMAHAKFGNKWATIARLLNGRTDNAVKNHWNSTLKRK

SEQ ID NO: 3722 - protein, 102 aa, Glycine max
  G4221,MYB-(R1)R2R3 domain
KGPWSPEEDEALRRLVQAHGPRNWSVISKSVPGRSGKSCRLRWCNQLSPQVAHRPFSPDEDEAIVRAHARFGNKWATIARLLNNGRTDNAVKNHWNSTLKRK

SEQ ID NO: 3723 - protein, 101 aa, Glycine max
  G4222,MYB-(R1)R2R3 domain
KGPWSPEEDEALQKLVEKHGPRNWSLISKSIPGRSGKSCRLRWCNQLSPQVEHRAFTAEEDDTIIRAHARFGNKWATIARLLHGRTDNAIKNHWNSTLKRK

SEQ ID NO: 3724 - protein, 101 aa, Glycine max
  G4223,MYB-(R1)R2R3 domain
KGPWSPEEDEALQKLVEKHGPRNWSLISKSIPGRSGKSCRLRWCNQLSPQVEHRAFTHEEDDTIIRAHARFGNKWATIARLLHGRTDNAIKNHWNSTLKRK

SEQ ID NO: 3725 - protein, 101 aa, Glycine max
  G4224,MYB-(R1)R2R3 domain
KGPWSPEEDEALRRLVQTYGPRNWSVISKSIPGRSGKSCRLRWCNQLSPEVERRPFTAEEDEAILKAHARFGNKWATIARFLNGRTDNAIKNHWNSTLKRK

SEQ ID NO: 3726 - protein, 101 aa, Glycine max
  G4225,MYB-(R1)R2R3 domain
KGPWSAKEDRILTGLVEAHGPRNWASISRHIKGRSGKSCRLRWCNQLSPTVEHRPFSTREDEVILHAHARFGNKWATIARMLPGRTDNAVKNHWNATLKRR

SEQ ID NO: 3727 - protein, 101 aa, Zea mays
  G4226,MYB-(R1)R2R3 domain
KGPWSPEEDEALRRLVERHGARNWTAIGRGIPGRSGKSCRLRWCNQLSPQVERRPFTPEEDAAILAAHARLGNRWAAIARLLPGRTDNAVKNHWNSSLKRK

SEQ ID NO: 3728 - protein, 101 aa, Zea mays
  G4227,MYB-(R1)R2R3 domain
KGSWSPEEDALLTRLVEQHGPHRWSLISAPIPGRSGKSCRLRWCNQLSPDVHHRPFTPHEDALILAAHARYGNKWATIARLLPGRTDNSIKNHWNSNLRRC

SEQ ID NO: 3729 - protein, 101 aa, Zea mays
  G4228,MYB-(R1)R2R3 domain
KGPWSPEEDEALQRLVARHGARNWSLISRSIPGRSGKSCRLRWCNQLSPQVEHRPFTAEEDDTILRAHARFGNKWATIARLLSGRTDNAIKNHWNSTLKRK

SEQ ID NO: 3730 - protein, 101 aa, Zea mays
  G4229,MYB-(R1)R2R3 domain
KGPWSPEEDEALQRLVRRHGARNWSLISRSVPGRSGKSCRLRWCNQLSPRVEHRPFTPDEDDAILRAHARFGNKWATIARLLSGRTDNAIKNHWNSTLKRE

SEQ ID NO: 3731 - protein, 101 aa, Zea mays
  G4230,MYB-(R1)R2R3 domain
RGPWSPEEDDALRRLVERHGARNWTAIGREIPGRSGKSCRLRWCNQLSPQVERRPFTAEEDAAIVRAHARLGNRWAAIARLLPGRTDNAVKNHWNCSLKRK

SEQ ID NO: 3732 - protein, 101 aa, Zea mays
  G4231,MYB-(R1)R2R3 domain
RGPWSPEEDEALRRLVERHGARNWTAIGRGVPGRSGKSCRLRWCNQLGRGGARRPFTADEDAAIARAHARLGNRWAAIARLLPGRTDNAVKNHWNCSLKRK

SEQ ID NO: 3733 - protein, 93 aa, Zea mays
  G4232,MYB-(R1)R2R3 domain
RGPWSPEEDDALRRLVERHGARNWTAIGREIPGRSGKSCPLRWCNQLSPQVERPPFTPEEDAAILAAHARLGNRWAAIARLLPGRTDNAVKNH

SEQ ID NO: 3734 - protein, 101 aa, Oryza sativa
  G4234,MYB-(R1)R2R3 domain
KGPWSPEEDEALQRLVGRHGARNWSLISKSIPGRSGKSCRLRWCNQLSPQVEHRPFTPEEDDTILRAHARFGNKWATIARLLAGRTDNAIKNHWNSTLKRK

SEQ ID NO: 3735 - protein, 101 aa, Oryza sativa
  G4235,MYB-(R1)R2R3 domain
RGPWSPEEDEALRRLVERHGARNWTAIGREIPGRSGKSCRLRWCNQLSPQVERRPFTAEEDATILRAHARLGNRWAAIARLLQGRTDNAVKNHWNCSLKRK

SEQ ID NO: 3736 - protein, 101 aa, Oryza sativa
  G4236,MYB-(R1)R2R3 domain
KGSWSPEEDEQLRGAVARHGPRNWTAISEEVPGRSGKSCRLRWCNQLSPGVHRRPFTPDEDALIVAAHAKYGNKWATIARLLDGRTDNSVKNHWNSSLRRN

SEQ ID NO: 3737 - protein, 101 aa, Oryza sativa
  G4237,MYB-(R1)R2R3 domain
KGSWRAEEDALLTRLVAQHGPHRWSIISGAIPGRSGKSCRLRWCNQLSPAVQHRPFTPQEDALLAAAHARHGNKWATIARLLPGRTDNSVKNHWNSNLRRC

SEQ ID NO: 3738 - protein, 101 aa, Oryza sativa
  G4238,MYB-(R1)R2R3 domain
KGPWSPEEDEALRRLVERHGARNWTAIGRGIPGRSGKSCRLRWCNQLSPQVERRPFTAEEDAAILRAHARLGNRWAAIARLLPGRTDNAVKNHWNSSLKRK

SEQ ID NO: 3739 - protein, 77 aa, Zea mays
  G4253,CAAT domain
PAARIKKIMQADEDVGKIALAVPVLVSRSLELFLQDLIDRTYEITLQSGAKTLNSFHLKQCVKRYSSFDFLTEVVSK

SEQ ID NO: 3740 - protein, 77 aa, Zea mays
  G4254,CAAT domain
PAARIKKIMQADEDVGKIALAVPVLVSRALELFLQDLIDRTYEITLQSGAKTLNSFHLKQCVKRYSSFDFLTEVVSK

SEQ ID NO: 3741 - protein, 77 aa, Zea mays
  G4255,CAAT domain
PAPRIKKIMQTDEDVGKIAQAVPVLVSKALELFLQDLCDRTYDITIRKGVKTVGSSHLKQCIQTYNVYDFLREVVSK

SEQ ID NO: 3742 - protein, 97 aa, Zea mays
  G4256,CAAT domain
DEIKQANDFKIHTLPLARIKKIMKADEDVRMISAEAPVVFAKACEVFILELTLRSWMHTEENKRRTLQKNDIAAAITRTDIYDFLVDIIPRDEMKEE

SEQ ID NO: 3743 - protein, 97 aa, Zea mays
  G4257,CAAT domain
TEIEATADFRNHNLPLARIKKIMKADEDVRMISAEAPVVFAKACEIFILELTLRSWMHTEENKRRTLQKNDIAAAITRTDIYDFLVDIVPRDEMKDD

SEQ ID NO: 3744 - protein, 98 aa, Zea mays
  G4258,CAAT domain
REIEATTDFKNHNLPLARIKKIMKADEDVRMIAAEAPVVFARACEMFILELTHRGWAHAEENKRRTLQKSDIAAAVARTEVFDFLVDIVPRDEARDAD

SEQ ID NO: 3745 - protein, 98 aa, Zea mays; identical to SEQ ID NO: 3744
  G4258,CAAT domain

SEQ ID NO: 3746 - protein, 99 aa, Zea mays; identical to SEQ ID NO: 3569
  G4259,CAAT domain

SEQ ID NO: 3747 - protein, 60 aa, Zea mays
  G4261,CAAT domain
EPVYVNAKQYHGILRRRQSRAKAELEKKVVKARKPYLHESRHQHAMRRARGNGGRFLNTK

SEQ ID NO: 3748 - protein, 60 aa, Zea mays
  G4262,CAAT domain
EPIYVNAKQYHAILRRRQLRAKLEAENKLVKSRKPYLHESRHLHAMKRARGTGGRFLNTK

SEQ ID NO: 3749 - protein, 60 aa, Zea mays; identical to SEQ ID NO: 3748
  G4263,CAAT domain

SEQ ID NO: 3750 - protein, 60 aa, Zea mays
  G4264,CAAT domain
EPIYVNAKQYHAILRRRQTRAKLEAQNKMVKNRKPYLHESRHRHAMKRARGSGGRFLNTK

SEQ ID NO: 3751 - protein, 60 aa, Zea mays
  G4265,CAAT domain
EPIYVNAKQYHAILRRRQTRAKLEAQNKMVKGRKPYLHESRHRHAMKRARGSGGRFPHTK

SEQ ID NO: 3752 - protein, 60 aa, Zea mays
  G4267,CAAT domain
EPVYVNAKQYNAILRRRQSRAKAESERKLVKGRKPYLHESRHQHALKRARGAGGRFLNSK

SEQ ID NO: 3753 - protein, 60 aa, Zea mays
  G4268,CAAT domain
EPVYVNAKQYNAILRRRQSRAKAESERKLIKGRKPYLHESRHQHALKRARGAGGRFLNSK

SEQ ID NO: 3754 - protein, 60 aa, Zea mays
  G4269,CAAT domain
EPIYVNPKQYHGILRRRQLRAKLEAQNKLVRARKPYLHESRHLHAMKRARGSGGRFLNTK

SEQ ID NO: 3755 - protein, 61 aa, Zea mays
  G4270,CAAT domain
EAPIYVNAKQYDAIMRRRCARAKAERENRLVKGRKPYLHESRHQHALRRPRGSGGRFLNTK

SEQ ID NO: 3756 - protein, 97 aa, Zea mays
  G4272,CAAT domain
REQDRFLPIANVSRIMKKALPANAKISKDAKETVQECVSEFISFITGEASDKCQREKRKTINGDDLLWAMTTLGFEDYVEPLKHYLHKFREIEGERA

SEQ ID NO: 3757 - protein, 90 aa, Zea mays
  G4273,CAAT domain
KEQDRLLPIANVGRIMKQILPPNAKISKEAKETMQECVSEFISFVTGEASDKCHKEKRKTVNGDDVCCAFGALGFDDYVDPMRRYLHKYR

SEQ ID NO: 3758 - protein, 89 aa, Zea mays
  G4275,CAAT domain
KEDVSLPKSTMVKIIKEMLPPDVRVARDAQDLLVECCVEFINLLSSESNEVCSREEKKTIAPEHVIKALSDLGFREYIEEVYAAYEQHK

SEQ ID NO: 3759 - protein, 90 aa, Zea mays
  G4276,CAAT domain
REQDMFLPITNITRIMKKAVPANAKITKDAKEIMQYCVSEFIFFVTSEAREKSKKEERKRINVDDLLWSVDTAGFEYVELLRICLQKYRE

SEQ ID NO: 3760 - protein, 68 aa, Oryza sativa
  G4294,AP2 domain
KKKFRGVRQRHWGSWVSEIRHPLLKRRVWLGTFETAEEAARAYDEAAILMSGRNAKTNFPVARNATGE

SEQ ID NO: 3761 - protein, 42 aa, Zea mays
  G4297,Z-CO-like domain
CELCGGAAAVHCAADSAFLCPRCDAKVHGANFLASRHVRRRL

SEQ ID NO: 3762 - protein, 42 aa, Oryza sativa
  G4298,Z-CO-like domain
CELCGGVAAVHCAADSAFLCLVCDDKVHGANFLASRHPRRRW

SEQ ID NO: 3763 - protein, 46 aa, Solanum lycopersicum
  G4299,Z-CO-like domain
CELCNDQAALFCPSDSAFLCFHCDAKVHQANFLVARHLRLTLCSHC

SEQ ID NO: 3764 - protein, 9 aa, Glycine max
  G4340,1st IAA domain
TELRLGLPD

SEQ ID NO: 3765 - protein, 13 aa, Glycine max
  G4340,2nd IAA domain
QVVGWPPVCSYRK

SEQ ID NO: 3766 - protein, 17 aa, Glycine max
  G4340,3rd IAA domain
YVKVSMDGAPFLRKIDL

SEQ ID NO: 3767 - protein, 34 aa, Glycine max
  G4340,4th IAA domain
YEDKDGDWMLVGDVPWEMFMESCKRLRIMKRSDA

SEQ ID NO: 3768 - protein, 9 aa, Glycine max
  G4346,1st IAA domain
TELRLGLPG

SEQ ID NO: 3769 - protein, 13 aa, Glycine max
  G4346,2nd IAA domain
QVVGWPPVCSYRK

SEQ ID NO: 3770 - protein, 17 aa, Glycine max
  G4346,3rd IAA domain
YVKVSMDGAPFLRKIDL

SEQ ID NO: 3771 - protein, 34 aa, Glycine max
  G4346,4th IAA domain
YEDKDGDWMLVGDVPWEMFIESCKRLRIMKRSDA

SEQ ID NO: 3772 - protein, 9 aa, Populus trichocarpa
  G4347,1st IAA domain
TELRLGLPG

SEQ ID NO: 3773 - protein, 13 aa, Populus trichocarpa
  G4347,2nd IAA domain
QVVGWPPVCSYRK

SEQ ID NO: 3774 - protein, 16 aa, Populus trichocarpa
  G4347,3rd IAA domain
YVKVSMDGAPFLRKID

SEQ ID NO: 3775 - protein, 35 aa, Populus trichocarpa
  G4347,4th IAA domain
YEDKDGDWMLVGDVPWEMFFESCKRLRIMKSSEAK

SEQ ID NO: 3776 - protein, 10 aa, Populus trichocarpa
  G4348,1st IAA domain
ITELRLGPPG

SEQ ID NO: 3777 - protein, 13 aa, Populus trichocarpa
  G4348,2nd IAA domain
QVVGWPPVCSYRK

SEQ ID NO: 3778 - protein, 17 aa, Populus trichocarpa
  G4348,3rd IAA domain
YVKVSMDGAPFLRKVDL

SEQ ID NO: 3779 - protein, 34 aa, Populus trichocarpa
  G4348,4th IAA domain
YEDKDGDWMLVGDVPWEMFIESCKRLRIMKRSEA

SEQ ID NO: 3780 - protein, 9 aa, Vitis vinifera
  G4349,1st IAA domain
TELRLGLPG

SEQ ID NO: 3781 - protein, 13 aa, Vitis vinifera
  G4349,2nd IAA domain
QVVGWPPVCSYRR

SEQ ID NO: 3782 - protein, 17 aa, Vitis vinifera
  G4349,3rd IAA domain
YVKVSMDGAPFLRKIDL

SEQ ID NO: 3783 - protein, 34 aa, Vitis vinifera
  G4349,4th IAA domain
YEDKDGDWMLVGDVPWEMFIESCKRLRIKKKSET

SEQ ID NO: 3784 - protein, 9 aa, Gossypium hirsutum
  G4350,1st IAA domain
TELRLGLPG

SEQ ID NO: 3785 - protein, 13 aa, Gossypium hirsutum
  G4350,2nd IAA domain
QVVGWPPVCSYRK

SEQ ID NO: 3786 - protein, 17 aa, Gossypium hirsutum
  G4350,3rd IAA domain
YVKVSMDGAPFLRKIDL

SEQ ID NO: 3787 - protein, 34 aa, Gossypium hirsutum
  G4350,4th IAA domain
YEDKDGDWMLAGDVPWEMFIESCKRLRIMKKADA

SEQ ID NO: 3788 - protein, 103 aa, Zea mays
  G4637,MYB-(R1)R2R3 domain
KGAWTKEEDQRLVAYIKAHGEGCWRSLPKAAGLLRCGKSCRLRWINYLRPDLKRGNFTEEEDDLIIKFHELFGNKWSLIAGRLPGRTDNEIKNYWNTHIKRKL

SEQ ID NO: 3789 - protein, 103 aa, Zea mays
  G4638,MYB-(R1)R2R3 domain
KGAWTKEEDQRLVAYIKAHGEGCWRSLPKAAGLLRCGKSCRLRWINYLRPDLKRGNFTQEEDDVIIKLHQVLGNKWSLIAAQLPGRTDNEIKNYWNTHIKRKL

SEQ ID NO: 3790 - protein, 103 aa, Glycine max
  G4639,MYB-(R1)R2R3 domain
KGAWTKEEDHRLISYIRAHGEGCWRSLPKAAGLLRCGKSCRLRWINYLRPDLKRGNFTLEEDQLIIKLHSLLGNKWSLIARRLPGRTDNEIKNYWNTHIRRKL

SEQ ID NO: 3791 - protein, 103 aa, Zea mays
  G4640,MYB-(R1)R2R3 domain
KGAWTKEEDQRLIAYIRAHGEGSWRSLPKAAGLLRCGKSCRLRWMNYLRPDLKRGNFTGDDDELIIKLHALLGNKWSLIAGQLPGRTDNEIKNYWNTHIKRKL

SEQ ID NO: 3792 - DNA, 1055 bp, Artificial Sequence; identical to SEQ ID NO: 49
  P1 (35S::G19)

SEQ ID NO: 3793 - DNA, 1438 bp, Artificial Sequence
  P3 (35S::G201)
atcctacaacggtcgtctaccacagtttctcagtcagtttcatattcagatgcatcagagttctcatcaagagatctatcagtctattgccttaaactcgacgacattctgttttttttttcttttcttattttttctttttcttatttcttacctataggttgtatgtaaatctatatcaaaaaaagaagaaaaacaagatgtcaagaaagccatgttgtgtgggagaaggactgaagaaaggagcatggactgccgaagaagacaagaaactcatctcttacattcatgaacacggtgaaggaggctggcgtgacattccccaaaaagctggtatatatgtgctttattattatgtatatattttaaaacactttttacatatatataactataattgttgtttttatgacaaatgatggtgtttaggactaaaacgatgtggaaagagttgtagattgcgatgggctaactatttgaaacctgacatcaagagaggagagtttagctatgaggaggaacagattatcatcatgctacacgcttctcgcggcaacaagtaaaatcctagcttgccgaaatccatataaataagggtatatataattaacacattattaaagtttatatatatgttttacttaaaaggtggtcagtcatagcgagacatttgcccaaaagaacagataacgagattaagaactactggaacacgcatctcaaaaagctcctgatcgataagggaatcgatcccgtgacccacaagccacttgcctatgactcaaacccggatgagcaatcgcaatcgggttccatctctccaaagtctcttcctccttcaagctccaaaaatgtaccggagataaccagcagtgacgagacaccgaaatatgatgcttccttgagctccaagaaacgttgttttaagagatcgagttctacatcaaaactgttaaacaaagttgcagctagggcttcttccatgggaactatactaggcgcctccatcgaaggaaccttgatcagctctacaccgttgtcttcatgtctaaatgatgacttttctgaaacaagtcaatttcagatggaagaatttgatccattctatcagtcatctgaacacataattgatcatatgaaagaagatatcagcatcaacaattccgaatacgatttctcgcagtttctcgagcagtttagtaacaacgaaggggaagaagctgacaatactggaggaggatataaccaagatcttcttatgtctgatgtctcatcaacaagcgttgatgaagacgagatgatgcaaaacataactggttggtcaaattatctccttgaccattccgatttcaattatgacacgagccaagattacgacgacaagaacttcatatgatccgttgattgcttaccggactagagttgaccggttaatgtc

SEQ ID NO: 3794 - DNA, 1472 bp, Artificial Sequence
  P4 (35S::G202)
cctatatcttgagttttgtgagaggttaattatatgaaattttacgcattattgttcatctatatcgaaaaacaatgtcaagaaagccatgttgcgtcggagaaggcttgaagaaaggagcatggaccaccgaggaggacaagaaactcatctcttacatccacgaccacggcgagggaggctggcgcgacattccccaaaaagctggtttatacaaatctatacatacactcatttttgtacttgttgtagaaaattgttctgataaacatattgtgtctgattagggttgaaacggtgtggaaagagttgtagactgcgatggaccaactaccttaaacctgagatcaaaagaggcgagtttagttcagaggaagagcagattatcatcatgcttcatgcttctcgtggcaacaagtacgtttctatgtttctatgtgtgtgcgtggaccctcgaatgtgaaatgaatttcatgaaaaagttttcatataatatttattatgtagacataatcatcattttaatcttggtctccgatctatcttattttctttaggtggtcggtcatagcgagacatttacctagaagaacagacaacgagatcaagaactactggaacacgcatctcaaaaaacgtttgatggaacagggtattgatcccgtgactcacaagccactggcttctagttccaaccctacggtcgatgagaatttgaattccccaaatgcctctagttccgacaagcaatactcccgatcgagctcaatgccttttctgtctcgtcctcctccatccagttgcaacatggtttccaaggtctccgagcttagcagcaatgatgggacaccgattcaaggcagttccttgagttgcaagaaacgtttcaagaaatcaagttctacatcaaggctcttgaacaaagttgcggctaaggccacttccatcaaagatatattgtcggcttccatggaaggtagcttgagtgctactacaatatcacatgcaagcttttttaatggcttcactgagcagattcgcaatgaagaggatagttctaacacatccctgacaaatactcttgctgaatttgatcccttctccccatcatcgttgtaccccgaacatgagatcaatgctacttctgatctcaacatggaccaagattacgatttttcacaatttttcgaaaaattcggaggagataaccacaatgaggagaacagtatgaatgatctccttatgtccgatgtttcccaagaagtctcatcaactagcgttgatgatcaagacaatatggtaggaaacttcgagggatggtcaaattatcttcttgaccataccaattttatgtatgacaccgactcagactcgcttgaaaagcatttcatatgagtcttcatatccaaacagaaaggtttcaaactattcgacgacttaaaataatggttctgtacccaaggttagtcgat

SEQ ID NO: 3795 - DNA, 1828 bp, Artificial Sequence
  P10 (35S::G214)
gtgatggagacaaattcgtctggagaagatctggttattaagactcggaagccatatacgataacaaagcaacgtgaaaggtggactgaggaagaacataatagattcattgaagctttgaggctttatggtagagcatggcagaagattgaagaacatgtagcaacaaaaactgctgtccagataagaagtcacgctcagaaatttttctccaaggtagagaaagaggctgaagctaaaggtgtagctatgggtcaagcgctagacatagctattcctcctccacggcctaagcgtaaaccaaacaatccttatcctcgaaagacgggaagtggaacgatccttatgtcaaaaacgggtgtgaatgatggaaaagagtcccttggatcagaaaaagtgtcgcatcctgagatggccaatgaagatcgacaacaatcaaagcctgaagagaaaactctgcaggaagacaactgttcagattgtttcactcatcagtatctctctgctgcatcctccatgaataaaagttgtatagagacatcaaacgcaagcactttccgcgagttcttgccttcacgggaagagggaagtcagaataacagggtaagaaaggagtcaaactcagatttgaatgcaaaatctctggaaaacggtaatgagcaaggacctcagacttatccgatgcatatccctgtgctagtgccattggggagctcaataacaagttctctatcacatcctccttcagagccagatagtcatccccacacagttgcaggagattatcagtcgtttcctaatcatataatgtcaacccttttacaaacaccggctctttatactgccgcaactttcgcctcatcattttggcctcccgattctagtggtggctcacctgttccagggaactcacctccgaatctggctgccatggccgcagccactgttgcagctgctagtgcttggtgggctgccaatggattattacctttatgtgctcctcttagttcaggtggtttcactagtcatcctccatctacttttggaccatcatgtgatgtagagtacacaaaagcaagcactttacaacatggttctgtgcagagccgagagcaagaacactccgaggcatcaaaggctcgatcttcactggactcagaggatgttgaaaataagagtaaaccagtttgtcatgagcagccttctgcaacacctgagagtgatgcaaagggttcagatggagcaggagacagaaaacaagttgaccggtcctcgtgtggctcaaacactccgtcgagtagtgatgatgttgaggcggatgcatcagaaaggcaagaggatggcaccaatggtgaggtgaaagaaacgaatgaagacactaataaacctcaaacttcagagtccaatgcacgccgcagtagaatcagctccaatataaccgatccatggaagtctgtgtctgacgagggtcgaattgccttccaagctctcttctccagagaggtattgccgcaaagttttacatatcgagaagaacacagagaggaagaacaacaacaacaagaacaaagatatccaatggcacttgatcttaacttcacagctcagttaacaccagttgatgatcaagaggagaagagaaacacaggatttcttggaatcggattagatgcttcaaagctaatgagtagaggaagaacaggttttaaaccatacaaaagatgttccatggaagccaaagaaagtagaatcctcaacaacaatcctatcattcatgtggaacagaaagatcccaaacggatgcggttggaaactcaagcttccacat

SEQ ID NO: 3796 - DNA, 1209 bp, Artificial Sequence; identical to SEQ ID NO: 199
  P14 (35S::G229)

SEQ ID NO: 3797 - DNA, 916 bp, Artificial Sequence; identical to SEQ ID NO: 203
  P15 (35S::G231)

SEQ ID NO: 3798 - DNA, 845 bp, Artificial Sequence
  P16 (35S::G233)
cagcaatcacaaatcaaagagatgggaagagctccatgctgtgagaagatggggttgaagagaggaccatggacacctgaagaagatcaaatcttggtctcttttatcctcaaccatggacatagtaactggcgagccctccctaagcaagctggtcttttgagatgtggaaaaagctgtagacttaggtggatgaactatttaaagcctgatattaaacgtggcaatttcaccaaagaagaggaagatgctatcatcagcttacaccaaatacttggcaatagatggtcagcgattgcagcaaaactgcctggaagaaccgataacgagatcaagaacgtatggcacactcacttgaagaagagactcgaagattatcaaccagctaaacctaagaccagcaacaaagagaagggtactaaaccaaaatctgaatccgtaataacgagctcgaacagtactagaagcgaatcggagctatcagattcatcaaacccttctggagaaagcttattttcgacatcgccttcgacaagtgaggtttcttcgatgacactcataagccacgacggctatagcaacgagattaatatggataacaaaccgggagatatcagtactatcgatcaagaatgtgtttctttcgaaacttttggtgcggatatcgatgaaagcttctggaaagagacactgtatagccaagatgaacacaactacgtatcgaatgacctagaagtggctggtttagttgagatacaacaagagtttcaaaacttgggctccgctaataatgagatgatttttgacagtgagatggacttctggttcgatgtattggctagaac

SEQ ID NO: 3799 - DNA, 1125 bp, Artificial Sequence
  P17 (35S::G237)
agagaaatggcgaagacgaaatatggagagagacataggaaagggttatggtcacctgaagaagacgagaagctaaggagcttcatcctctcttatggccattcttgctggaccactgttcccatcaaagctggtctctctttcatcttcttctttattagtttttagtttctcaaactgagtcaactttgataattgttgttgggatttaatttgatagggttacaaaggaatgggaagagctgcagattaagatggattaattacctaagaccagggttaaagagggatatgattagtgcagaagaagaagagactatcttgacgtttcattcttccttgggtaacaagtaagtgtatctctaagacctaaccctattgttttagcagatgctagttatagagagactaatgatttaggtgtaattaggtggtcgcaaatagctaaattcttaccgggaagaacagacaatgagataaagaactattggcactctcatttgaaaaagaaatggctcaagtctcagagcttacaagatgcaaaatctatttcccctccttcgtcttcatcatcatcacttgttgcttgtggaaaaagaaatccggaaaccttgatctcgaatcacgtgttctccttccagagacttctagagaacaaatcttcatctccctcacaagaaagcaacggaaataacagccatcaatgttcttctgctcctgagattccaaggcttttcttctctgaatggctttcttcttcatatccccacaccgattattcctctgagtttaccgactctaagcacagtcaagctccaaatgtcgaagagactctctcagcttatgaagaaatgggtgatgttgatcagttccattacaacgaaatgatgatcaacaacagcaactggactcttaacgacattgtgtttggttccaaatgtaagaagcaggagcatcatatttatagagaggcttcagattgtaattcttctgctgaattcttttctccatcaacaacgacgtaaattgcgtttattgtaatgtaaatcaaatttctaaggcaaaaccggaaaaaaaatgttttgttttttgttttgtcttaaatgctttgacaccaataaggca

SEQ ID NO: 3800 - DNA, 795 bp, Artificial Sequence; identical to SEQ ID NO: 281
  Artificial sequence
  P22 (35S::G343)

SEQ ID NO: 3801 - DNA, 825 bp, Artificial Sequence; identical to SEQ ID NO: 285
  P23 (35S::G346)

SEQ ID NO: 3802 - DNA, 922 bp, Artificial Sequence; identical to SEQ ID NO: 299
  P25 (35S::G361)

SEQ ID NO: 3803 - DNA, 2372 bp, Artificial Sequence
  P27 (35S::G384)
cttctccacaagtaagggaaccagaaaaccagggaagaatccgagcaagctagggtttcattgtgtgcacaaaatgggatatacaggcagaagaaaatcgagataaatcaactaaatgatttggataatcatcttgaagatttgaaggatttcgagactaagtccggcgcagaagtcaccatggagaatcctttagaagaagagcttcaagatcctaatcagcgtcccaacaaaaagaagcgttaccaccgtcacacacaacgccagattcaagagctagagtcgttcttcaaggaatgtcctcatccagacgataagcaaagaaaggagctgagtcgcgagctaagcttagaacctcttcaagtcaagttctggttccaaaacaaacgcactcaaatgaaggcacaacatgagaggcacgagaaccagatactgaagtcagaaaatgacaagctccgagcagagaacaataggtacaaggatgctctaagcaacgcaacatgcccaaactgtggtggtccggcagctataggagaaatgtccttcgacgaacagcatttaaggatcgaaaatgctcgtttacgcgaagagattgacagaatctctgccatagctgctaaatacgtagggaagcctttaatggctaattcctcttctttccctcagctctcttcttcacaccacattccctcgcgctcgcttgatcttgaagttgggaactttgggaacaataacaatagccacactggtttcgttggggaaatgtttggaagcagcgacattttgaggtcggtttcgataccttctgaggctgataagcctatgattgttgagttagctgttgcagcaatggaagagcttgtgagaatggctcaaactggtgatcccttatgggtttcaagcgataattctgttgagattctcaatgaagaagagtattttaggacgtttcctagaggaattggaccgaaacctatcggtttgagatcagaagcttcaagagagtctactgttgttatcatgaatcatatcaatctcattgagattctaatggatgtgaatcaatggtctagtgtgttctgcgggattgtatcaagagcattgactctagaagttctctcaactggcgtacgagggaactacaatggggcattgcaagtgatgacagcagagttccaagtcccatcgccgcttgtccctactcgtgagaactactttgtaaggtactgtaaacagcacagtgacggtatttgggcggttgtggatgtctctttggacagcctaagaccaagtccgatcactagaagcagaagaagaccctctggttgtctgattcaagaattgcagaatggttactccaaggtgacatgggtagagcatattgaggtggatgatagatcggttcacaacatgtataaaccgttggttaataccggtttagctttcggtgcaaaacgttgggtggctacacttgaccgccaatgtgagcggctcgccagttccatggccagcaacattccggcttgtgatctttccgtgataacgagtcctgaggggagaaagagcatgctgaaactagcggagagaatggtgatgagcttctgtaccggagtcggcgcgtcaaccgccgatgcctggactacattgtcgaccacaggatccgacgacgttcgggtcatgacccgaaagagcatggatgatccgggaagacctccaggcatcgttctcagcgccgctacttctttctggatccctgtagctccaaaacgagtgttcgattttctcagagatgaaaactcaagaagcgagtgggatatactttccaatggaggcttggttcaagaaatggctcatatcgcaaatggtcgtgatcctgggaatagtgtctccttgcttcgagtcaatagtgggaactcagggcagagcaacatgttgatcttacaagaaagttgtacggacgcatcagggtcctatgtgatatacgcaccagttgatataatagctatgaacgttgtcctgagtggtggtgatccggattatgtcgctttgttaccatccggattcgctattttgccggatggctctgctagaggaggaggaggtagtgctaatgccagtgctggagccggagttgaaggaggaggagaggggaataatcttgaagtggttactactactgggagttgtggcggttcactactcacagttgcgtttcagatacttgttgactctgttcctaccgctaaactctctctcggttcagttgctacagtcaatagtctgatcaaatgcactgtcgagcggattaaagccgctctggcctgcgacggagcctaatcgatgttttcggaaggtaagagtgaaaggggagg

SEQ ID NO: 3804 - DNA, 1379 bp, Artificial Sequence; identical to SEQ ID NO: 349
  P29 (35S::G428)

SEQ ID NO: 3805 - DNA, 716 bp, Artificial Sequence
  P30 (35S::G435)
gatgtcattgtatgtcttctatagtatatgttaaacttatatcactagaaacttatcttagttatgaatacaaagtttgtgttaattttgtttgcttatcttttacatagaacaccatcaatgttttaagtatgagtgcgtgtgtgtatatatacacatccttagccacaacgttgtacatagctcacaacaaaagaaaaaacaaaaaagaagagaaaaatggagaattctcagagtcagggtaaaaacaagaagaagaggctaacacaagatcaagttagacaactggagaagtgcttcactatgaacaagaagcttgagccagatctgaaacttcaactgtcgaaccagcttggtctacctcaaagacaagtcgctgtctggttccaaaacaagcgagccaggttcaagactcagtctcttgaggtccaacactgcactcttcagtccaagcacgaagcagctctctccgacaaggcaaagttagagcatcaagtgcagtttctccaagatgagctgaagagagcaaggaatcagcttgctctgttcacaaatcaagattctcctgttgataattctaatcttggttcttgtgatgaagatcatgatgatcaagtggtggtattcgacgagctttacgcttgctttgttagcaatggacatggatcttcatcaacctcatgggtctgattctgtttcgacgcagacaagattcc

SEQ ID NO: 3806 - DNA, 1169 bp, Artificial Sequence; identical to SEQ ID NO: 371
  P39 (35S::G456)

SEQ ID NO: 3807 - DNA, 732 bp, Artificial Sequence
  P40 (35S::G461)
atggcaaaggaaggtctagcactcgagatcacagagcttcgattgggtcttccaggagataattatagcgaaatatcagtatgcggatcgagtaagaagaataagagggtgctctcggatatgatgacctcatcagcgttagatactgagaatgaaaacagcgtcgtttcatcagttgaagatgaatcactgccggttgtgaagagtcaagcggtgggatggccacctgtgtgttcttacaggagaaagaagaacaatgaggaagcatcgaaagctataggctacgtgaaagtgagcatggatggtgtgccatacatgaggaagattgaccttggttcgagcaacagttatattaatctagtcacggttcttgagaatctcttcggctgtcttggcataggagtggcgaaggagggtaagaagtgtgaatacattattatatacgaagacaaggatagagactggatgctcgtcggagatgtaccttggcagatgtttaaagaatcatgcaagaggctgaggatcgtgaagagatcagatgcaactggttttggtctccagcaagattaatcatactagctagtgttgatcatctttaattaaccataaagtttgaaaaccgttgagtaattttttttcattataatcatttttcaaattgtaaaatttatatgataatgatgatatatacgttttcttcaaatgtatttccttactggtcgtatcatactt

SEQ ID NO: 3808 - DNA, 989 bp, Artificial Sequence
  P42 (35S::G464)
ctctgctggtatcattggagtctagggttttgttattgacatgcgtggtgtgtcagaattggaggtggggaagagtaatcttccggcggagagtgagctggaattgggattagggctcagcctcggtggtggcgcgtggaaagagcgtgggaggattcttactgctaaggattttccttccgttgggtctaaacgctctgctgaatcttcctctcaccaaggagcttctcctcctcgttcaagtcaagtggtaggatggccaccaattgggttacacaggatgaacagtttggttaataaccaagctatgaaggcagcaagagcggaagaaggagacggggagaagaaagttgtgaagaatggtgagctcaaagatgtgtcaatgaaggtgaatccgaaagttcagggcttagggtttgttaaggtgaatatggatggagttggtataggcagaaaagtggatatgagagctcattcgtcttacgaaaacttggctcagacgcttgaggaaatgttctttggaatgacaggtactacttgtcgagaaacggttaaacctttaaggcttttagatggatcatcagactttgtactcacttatgaagataaggggattggatgcttgttggagatgttccatggagaatgtttatcaactcggtgaaaaggcttcggatcatgggaacctcagaagctagtggactagctccaagacgtcaagagcagaaggatagacaaagaaacaaccctgtttagcttcccttccaaagctggcattgtttatgtattgtttgaggtttgcaatttactcgatactttttgaagaaagtattttggagaatatggataaaagcatgcagaagcttagatatgatttgaatccggttttcggatatggttttgcttaggtcattcaattcgtagttttccagtttgtttcttctttggctgtgtaccaattatctatgttctgtgagagaaagctcttg

SEQ ID NO: 3809 - DNA, 2580 bp, Artificial Sequence; identical to SEQ ID NO: 381
  P44 (35S::G470)

SEQ ID NO: 3810 - DNA, 624 bp, Artificial Sequence; identical to SEQ ID NO: 383
  Artificial sequence
  P45 (35S::G475)

SEQ ID NO: 3811 - DNA, 831 bp, Artificial Sequence
  P46 (35S::G481)
agcgtttcgtagaaaaattcgatttctctaaagccctaaaactaaaacgactatccccaattccaagttctagggtttccatcttccccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaataccaaatccttaaattaa

SEQ ID NO: 3812 - DNA, 1034 bp, Artificial Sequence
  P47 (35S::G482)
acacttaacaattcacaccttctctttttactcttcctaaaaccctaaatttcctcgcttcagtcttcccactcaagtcaaccaccaattgaattcgatttcgaatcattgatggaaatgatttgaaaaaagagtaaagtttatttttttattccttgtaattttcagaaatgggggattccgacagggattccggtggagggcaaaacgggaacaaccagaacggacagtcctccttgtctccaagagagcaagacaggttcttgccgatcgctaacgtcagccggatcatgaagaaggccttgcccgccaacgccaagatctctaaagatgccaaagagacgatgcaggagtgtgtctccgagttcatcagcttcgtcaccggagaagcatctgataagtgtcagaaggagaagaggaagacgatcaacggagacgatttgctctgggctatgactactctaggttttgaggattatgttgagccattgaaagtttacttgcagaggtttagggagatcgaaggggagaggactggactagggaggccacagactggtggtgaggtcggagagcatcagagagatgctgtcggagatggcggtgggttctacggtggtggtggtgggatgcagtatcaccaacatcatcagtttcttcaccagcagaaccatatgtatggagccacaggtggcggtagcgacagtggaggtggagctgcctccggtaggacaaggacttaacaaagattggtgaagtggatctctctctgtatatagatacataaatacatgtatacacatgcctatttttacgacccatataaggtatctatcatgtgatagaacgaacattggtgttggtgatgtaaaatcagatgtgcattaagggtttagattttgaggctgtgtaaaagaagatcaagtgtgctttgttggacaataggattcactaacgaatctgcttcattggatcttgtatgtaactaaagccattgtattgaatgcaaatgttttcatttgggatgctttaaa

SEQ ID NO: 3813 - DNA, 553 bp, Artificial Sequence
  P48 (35S::G483)
tgggctaaccaaatgcaagagatcgagcataccactgatttcaagaaccacacccttcccctagcccgcatcaagaagatcatgaaagctgatgaagatgtgaggatgatctctgcggaggctcctgtgatttttgccaaggcctgtgagatgttcattttggagctcactctacgtgcttggatccacaccgaggagaacaagaggaggaccttgcagaagaacgacatcgccgctgccatttccaggaccgacgtgtttgatttccttgtggacataatcccgagggacgagctgaaagaagaaggtttaggcgtgaccaaagggaccataccatcggtggtgggttccccgccatactattacttgcaacaacaggggatgatgcaacactggccccaggagtaacaccctgatgagtcttaaaacttttcccctttcgtttgtttggttgtatcgtagtaaggtagctctgctctgctgggaaccatttctattgtgttctgtaatgacatgttagtatatccccagtctatatctatggcaatgcagt

SEQ ID NO: 3814 - DNA, 991 bp, Artificial Sequence
  P49 (35S::G484)
cgactctgctagagaagacgaaggagagagaaaatccctccgattatattccgtacaatccgatcgatttcccggcgccagatctcaccgcgactcgtctactttccgatttggttcgtgttgactcagttacgattaaactatggatccaatggatatagtcggcaaatccaaggaagacgcttctcttccaaaagctacgatgactaaaattataaaggagatgttaccaccagatgttcgtgttgcaagagatgctcaagatcttctcattgaatgttgtgtagagtttataaatcttgtatcttcagaatctaatgatgtttgtaacaaagaggataaacggacgattgctcctgagcatgttctcaaggcattacaggttcttggttttggagaatacattgaagaagtctatgctgcgtatgagcaacataagtatgaaacaatgcaggacacacagaggagcgtgaaatggaaccctggagctcaaatgactgaggaggaagcagcagctgagcaacaacgtatgtttgcagaagcacgtgcaagaatgaatggaggtgtttcggttcctcaacctgaacatccagaaactgaccagagaagtccgcaaagctaactgaaaccgtaagggtaagtgttaggcaagaaaaaacaacatccttttaacattcccttgtaagttgcaaatgcgtatgttctctgtttatatgctcttagtatgatatatgttagttagtgtttcacgatctaaaaacacttgtgattcagatgtaattagtaagcattccttgttttgtgtttactttgtgtcttgactaagcatggtgggtcaggtctacacaaagcatctgattcgatgacttacaggaatcttaatgtttgtagattggataaatttggtgattggtgtaattgtttttccataaacacaatgcaatcattgtttagtgttgttaacatttgccctgtgattctgacgcgaacc

SEQ ID NO: 3815 - DNA, 479 bp, Artificial Sequence
  P50 (35S::G486)
agcgagagctgatagattcactgaaacaaaagagaaaaatgacagacgaagatagattgttgccaatagccaatgtagggagacttatgaagcaaatcctaccatcaaatgcaaagatctcaaaagaagcaaaacaaacagttcaagaatgtgcaacagagttcataagctttgttacatgcgaagcatcagagaagtgccacagggagaatcggaagacggtgaatggagacgacatctggtgggctctcagcactctcggcctcgataactatgctgacgccgtgggtaggcatcttcacaagtaccgtgaagccgagagagaaagaactgagcacaacaaaggtagcaatgatagtgggaatgagaaagaaaccaacactagaagtgatgtacagaaccaatcgacaaaatttattagagttgttgagaagggaagcagctcctcggcccgttgaactagacatctaagttctggc

SEQ ID NO: 3816 - DNA, 732 bp, Artificial Sequence
  P51 (35S::G489)
ctggtagtgaatggatcaacaagaccatggacagtctggagctatgaactatggcacaaacccataccaaaccaacccgatgagcaccactgctgctactgtagcaggaggtgcggcacaaccaggccagctggcgttccaccagatccatcagcagcagcagcagcaacagctggcacagcagcttcaagcattttgggagaaccaattcaaagagattgagaagactaccgatttcaagaaccacagccttccccttgcgagaatcaagaaaatcatgaaagcggatgaagatgtccgtatgatctcggctgaggcgccggtcgtgtttgcaagggcctgtgagatgttcatcctggagctgacactcaggtcgtggaaccacactgaggagaataagaggcggacgttgcagaagaacgatattgctgctgctgtgactagaaccgatatttttgatttccttgtggatattgttccccgggaggatctccgagatgaagtcttgggaagtattccgaggggcactgtcccggaagctgctgctgctggttacccgtatggatacttgcctgcaggaactgctccaataggaaatccgggaatggttatgggtaatcccggtggtgcgtatccacctaatccttatatgggtcaaccaatgtggcaacaacaggcacctgaccaacctgaccaggaaaattagcaagaaactgtgagtcttccagcttc

SEQ ID NO: 3817 - DNA, 1179 bp, Artificial Sequence; identical to SEQ ID NO: 421
  P56 (35S::G525)

SEQ ID NO: 3818 - DNA, 890 bp, Artificial Sequence; identical to SEQ ID NO: 427
  P59 (35S::G545)

SEQ ID NO: 3819 - DNA, 2012 bp, Artificial Sequence
  P73 (35S::G578)
atgcatagtttgaatgaaacagtaattcctgatgttgattacatgcagtctgatagagggcatatgcatgctgctgcctctgattccagtgatcgatcaaaggataagttggatcaaaaggtgatagattcatctctgtggatcaactagcatctgtgtatattacgcatatgcataatctgttttgtttccttttcgttttgatccatagacccttcgtaggcttgctcaaaatcgtgaggcagcaagaaaaagcagattgaggaagaaggtatgtatattttgcttttgttcttgttttgatttttcttatatattcctcttatttccttgtaatatctctagaagaatatctatctgtcattaccttaagcatgttattgtttcctccataggcgtatgttcagcagctggagaatagtcgattaaagctgactcaacttgagcaggagctgcaaagagcaagacagcaggtttattaactttcttatttgttttgattctgatatgtatgtctttataaagaagataaaaggctgaagctacttcaacttataactaacagtcagttacgagttagtactagtcttgggttagctgaagtagaggaggtaacagaattatgggtcatccatagtttagttgggtaaaagtagctggtaactctctcgaaataggtccttctggtctgtttattcggatgttgatggcatacagagaatttctattctggttcttatcagattctttgtcatgactcatgacagtgtatttgtcacttaaggatatatatttttcaattttagggagttttcatctcaagttcaggagaccaagctcattctactggtggcaatggtgggttgtttcttctctgttagttttgagattgatccttttgatttgaaatttctatgtgagataagtgcatatatacatatatgttgatgaattggtgatagcataagtcatctcatggcaatatgcttacacttgttagagttaatggtttcaagagtcagtgatgatctggatgggaaattaaagtcatggtgatgtcaaaactgaagtttcttatagtttgcgctggtgttagcttaggtctgcaagggtttgttcttgatctagtatacttgcctttctgcaggggctttggcatttgatgcagaacactcacgatggcttgaagaaaagaacaggcaaatgaacgagctgagatctgccctgaatgctcatgcaggtgatactgagctccggataattgtggatggagtgatggctcactatgaggagcttttcaggattaagagcaatgcagctaagaatgatgtcttccacttgttatctggaatgtggaaaacaccagctgagcgatgtttcttgtggcttggcgggttccgctcatccgaacttctcaaggtaagctctttccaagtccatagagagattttgatgaacagccaacttaatgagtcgcagtgttttcacaacagcttcttgcgaatcagctagagcccatgacagaacgacaggtaatgggcatcaatagcttgcagcagacgtcgcagcaggcagaagatgctttatctcaagggatggagagtttacagcaatccctagctgatactttatccagtggaactcttggttccagttcatcggataatgtcgcgagctacatgggtcagatggccatggcaatggggcagttaggcaccctcgaaggattcatacgccaggtactttagaaatgtggatgttatcgagatataccatatcttttcatcgtcacaaagagataaatattttattttatatatgaatccgtctgttatggagttcatagggcatttcttggtggcaggctgataacttgaggctgcaaacactacaacagatgcttcgagtattaacaacacgtcagtcagctcgtgctcttcttgctatacacgattattcatctcgattacgtgctcttagttccttgtggcttgcccggccaagagagtgaa

SEQ ID NO: 3820 - DNA, 1240 bp, Artificial Sequence; identical to SEQ ID NO: 469
  P77 (35S::G591)

SEQ ID NO: 3821 - DNA, 720 bp, Artificial Sequence; identical to SEQ ID NO: 481
  P79 (35S::G602)

SEQ ID NO: 3822 - DNA, 1263 bp, Artificial Sequence; identical to SEQ ID NO: 483
  P80 (35S::G605)

SEQ ID NO: 3823 - DNA, 1358 bp, Artificial Sequence
  P83 (35S::G629)
ttaactcttcagctctcaaattcttcatgaatatctctgcttatcggatcaagtgagagcaaatgcaatttttaagagccagctattggatctataactgaagaggatatatatagagatgatgagttcttcttctccaacacaacttgcatctttaagagacatgggaatctatgagccatttcaacaaattgtcggttggggaaatgttttcaaatctgatatcaatgatcatagtcccaatactgctacttcctctattattcaggttgatcctagaattgatgatcacaacaacaacatcaagataaattatgattcttctcataaccagatcgaagcagaacaaccttctagtaatgataatcaagatgatgatggcaggattcatgataagatgaaacggcgtttagcgcagaaccgagaagcggctcgcaaaagtcgtttgagaaagaaggcttatgttcagcagttagaggaaagccggttaaagttatcgcagttagagcaagaactcgaaaaggttaagcagcagggccatttaggaccatctgggagtattaacacagggattgcatcatttgagatggaatattcacactggctacaagaacaaagcagaagagttagcgaactacgaacagcgcttcaatctcatataagcgacatagaactcaagatgctagtagagagttgcttgaaccattacgctaatcttttccgaatgaaatccgatgcagcaaaagccgatgttttctacttgatatcgggaatgtggcgaacttcaaccgaaagattcttccaatggattggagggtttcgtccatccgaacttttaaacgttgtgatgccttatcttcaaccattaacggatcaacaaatcttggaagtgagaaacctccaacaatcatcacaacaagcagaggatgctctgtctcaagggattgataaacttcaacagagtttagctgaaagcattgtgattgatgcggttatcgagtccacgcattatcccactcacatggctgcagctatagagaatcttcaagcattagaaggatttgtgaatcaagcagatcatctgaggcaacaaactttgcaacaaatggcgaagatcttaacgacaagacaatcggctcgaggtttactagctttaggagagtatcttcatagacttcgtgctcttagttctctttgggcagctcgtccacaagaaccaacttaaaagaggaacttattaaaactttaaaaacaagaaacagcagaatcaaaagtcttgaagaagcatactcatcacaaagcttggaaggatgttttaaaaaagatctttgttaattaagtagagtgagattctcttg

SEQ ID NO: 3824 - DNA, 631 bp, Artificial Sequence
  Artificial sequence
  P84 (35S::G630)
gagagaaattgaccatgcagccaaattatgatagctcaagtcttaacaacatgcaacaacaagactacttcaacttgaacaactactacaacaacttaaacccttcaaccaataacaacaacctcaatatcctccaataccctcaaattcaagaactcaacctacaatctccggtaagcaacaactccacaacttccgatgacgcaactgaagaaatcttcgtcatcaacgagaggaagcaaagacgtatggtatctaacagagagtcagcaagaagatcaagaatgagaaagcaaagacacttagatgagcttctctcacaggttgcttggcttcgaagcgagaaccaccagcttttagataagcttaaccaagtctccgacaacaatgatcttgttattcaagagaactcgagtcttaaagaagaaaacttggagcttcgtcaggttatcacatccatgaagaagcttggaggaggcatacatgacaaatattcttctccgtcgtctatggatgaattggatcaagacttttcttctatcacagatgatccaagaactcatcatccatcatgagttgttctgatcgagaaaaacattacttcaagtttctgcctctaatcttatctatt

SEQ ID NO: 3825 - DNA, 928 bp, Artificial Sequence; identical to SEQ ID NO: 521
  P91 (35S::G653)

SEQ ID NO: 3826 - DNA, 1033 bp, Artificial Sequence; identical to SEQ ID NO: 525
  P97 (35S::G663)

SEQ ID NO: 3827 - DNA, 1087 bp, Artificial Sequence; identical to SEQ ID NO: 527
  P98 (35S::G664)

SEQ ID NO: 3828 - DNA, 1209 bp, Artificial Sequence
  P100 (35S::G666)
gtgtactaagggtagtgtgactcattaccacctaaagtagtttcaattttcttctatttttcttggcaaagagttatagtgggaaacaaagggagtggttaataaagaattaattagttaattaagggagttcaagatcataatggtgaggcctccttgttgtgacaaaggaggagtgaagaaagggccatggactcctgaagaagatatcattttagtcacttacatccaagaacatggtcctggtaattggagagctgttcctaccaatactgggctgcttagatgcagtaagagttgtagacttagatggacaaactatttaaggccaggaatcaaaagaggcaatttcacagaacatgaagaaaagatgattgttcatctccaagccctcttaggaaatagatgggctgcaattgcgtcatatcttccacaaaggacagacaatgacattaagaactattggaacactcatttgaagaagaaactcaacaaagtcaatcaagattctcatcaagaacttgaccgttcctcgctctcatcttcaccatcgtcttcttctgctaattccaactcaaacatctcaagaggccaatgggaaaggcgacttcaaaccgatatccacttggcgaaaaaggctctctctgaggctttatctcctgccgttgcaccaatcattacatctacagtgacaacaacgtcttcctctgctgaatcaagacgctctacttcctcagctagcgggtttcttaggacgcaagaaacatctacaacttatgcctcaagcaccgaaaatatcgcgaaattgctcaaagggtgggtgaaaaactcgccgaagactcaaaactccgcggatcaaatcgcttctacagaggtaaaagaagtgatcaagagtgatgatgggaaggagtgtgcaggggcatttcagtcattttctgagtttgatcactcatatcaacaggctggtgtttcacctgatcatgagaccaaaccagacataactggatgctgcagtaaccaaagtcaatggtctttgtttgagaagtggttgtttgaggattctggtggacagattggtgatattctattggatgaaaacactaatttcttctgaagagtttgctttaatcacatggttctaattttaggatcctcatctctattttttttttgggttttccaaattaactcgcttagattatcgtgaga

SEQ ID NO: 3829 - DNA, 1247 bp, Artificial Sequence
  P101 (35S::G668)
ccaacatctctcctccacttcttcagacaaaaccaaacccatttggactttctttgtcttaaccctaagatttccaaaggttttccaacaaacccgcaacgattagcttttgttctaatatctcatcaaaaccctttcaaaaggtgaaaacagaatgggaagaccaccttgctgtgaaaagattggagtgaagaaagggccatggacaccagaggaagacatcatcttggtttcttacatccaagaacatggtcctggaaactggagatctgtcccaacacacacaggtttaagatgtagcaagagctgcagattgagatggactaattatcttcgacccggtattaagcgtggaaattttactgagcatgaagagaagacaattgttcatcttcaagcccttttaggcaacagatgggcagccatagcatcataccttccagaaaggacagacaatgatataaagaactattggaacactcacttgaagaagaagctcaaaaagattaatgaatctggtgaagaagataatgatggtgtctcttcatcaaacactagttcacaaaagaaccatcaaagcactaacaaaggtcaatgggaaagaagacttcagacagacattaacatggcaaaacaagctctttgtgaggccttgtctttagacaaaccatcatccactctttcatcatcttcatcattaccgacaccagtaatcacacaacaaaacatccgtaacttctcatcagctttgcttgaccgttgttatgatccatcctcttcttcttcatctaccacaaccaccactacaagcaacactactaatccatacccatcaggggtatatgcgtcaagtgctgagaacatcgcccggttgcttcaagatttcatgaaagacacacccaaggctttaactttatcatcttcatctccggtttcagagactggaccactcactgctgcagtctcggaagaaggtggagaagggtttgaacaatctttcttcagcttcaattcaatggacgaaactcaaaacttgactcaggagacaagcttcttccatgatcaagtgatcaaaccggaaataacaatggaccaagatcatggtctaatatcacaagggtctctgtctttgtttgagaaatggttatttgatgagcaaagccacgagatggttggtatggcactagcaggacaagaagggatgttctagttctagaagactgtctagaactaacaaagtgggatct

SEQ ID NO: 3830 - DNA, 891 bp, Artificial Sequence
  P102 (35S::G669)
gtaccaaccacacaaccacaagagagagaaaagtgagaatgggaaagagagcaactactagtgtgaggagagaagagttaaacagaggagcttggactgatcatgaagacaagatccttagagattacatcaccactcacggcgaaggcaaatggagcactctccctaaccaagctggtctcaagaggtgtggcaaaagctgtagacttcggtggaagaactacctaagaccggggataaagcgcggtaacatctcatctgatgaagaagaactcataatccgtctccataatcttcttggaaacagatggtcgttgatagctgggaggcttccaggccgaacagacaatgaaataaagaatcattggaactcaaacctccgcaaaagacttcccaaaactcaaaccaagcaaccaaaacgtataaaacattcgacgaacaacgagaataatgtatgtgttatacgtacaaaggcgattaggtgctcaaagactcttctcttctcggatctctctcttcagaagaagagtagtactagtccactacctctgaaagaacaagagatggatcaaggtggatcttcgttgatgggagatctcgaattcgatttcgataggatccattcggagtttcacttcccggatttgatggattttgatggtttggactgtggaaacgttacatctcttgtttcatctaacgagattttgggagagttggttcctgctcaaggtaatctcgatctcaatagacctttcacttcttgtcatcatcgtggcgacgatgaagattggctccgagacttcacttgttgagcctatattgcaaaaacctacgttaatacatatttctctatacggacaaaagtatatctgtatttgtctgaacgct

SEQ ID NO: 3831 - DNA, 1228 bp, Artificial Sequence
  P105 (35S::G676)
cgtctatcattcaaagaaacaaaaagaatgagaaagaaagtaagtagtagtggtgacgaaggaaacaatgagtacaagaaaggtttgtggacagtagaagaagacaaaatcctcatggattatgtcaaagctcatggcaaaggtcactggaatcgtattgccaaaaagactggtctctttcctctctatctctctctctaatcgtattgacataatttatgaattctttgtcacatgattttcttttacgaatggtttaaagttaaggttctatatattatatatgttattttagatttaacttttaatctatgttaatagagtccatatatcgcaaaagcaacttgaatcaggatatttatctagggtcacctttttgttgtttttatttttatgaattaaggtcctcagttaaataattgtatatgtgtgttaggtttaaagagatgtggaaagagttgtagattgaggtggatgaattatctcagccctaatgtgaaaagaggcaatttcaccgagcaagaagaggatcttatcattaggctccacaagttgcttggtaataggtataacttcatttgctcaaaattagtttctctactcaattaatcataaaaacagctatttctatccattttgtatcaagttaaataatcataaatattcgtgattgtcttcacaaacttgcttggtaacacatgtttttattctcaaaatttcaatacattatatttcacatgataattatattgtttatctgtgtgtttaattaggtggtctttaattgctaaaagagtgccgggtcgaacggataatcaagtgaagaactattggaacacgcatcttagtaagaaactcggaatcaaagatcagaaaaccaaacagagcaatggtgatattgtttatcaaatcaatctcccgaatcctaccgaaacatcagaagaaacgaaaatctcgaatattgtcgataacaataatatcctcggagatgaaattcaagaagatcatcaaggaagtaactacttgagttcactttgggttcatgaggatgagtttgagcttagcacactcaccaacatgatggactttatagatggacactgtttttgatgtgttttctgcttttgttattttagtattcgtttatgttttgttattttcaaagctgatcaaacactaatacatcaacagtcttagattaaaagttgttgatgtggtagtgtatgat

SEQ ID NO: 3832 - DNA, 649 bp, Artificial Sequence
  P108 (35S::G682)
tcgacccacgcgtccgctctctcagagtactctcttagtttctttcttcttcttctttgtaatacggtgccgtttgacatggataaccatcgcaggactaagcaacccaagaccaactccatcgttacttcttcttctgaaggtaagctgaaaacttaaacaccttcgttttctcatttttccatgtttttttatacttatctatatataatgagaaatctgaattttggtgatgacaaggaacagaagtgagtagtcttgagtgggaagttgtgaacatgagtcaagaagaagaagatttggtctctcgaatgcataagcttgtcggtgacaggtttgatcttttaactaataatgaatactatttcgtaggaaaataatttaattgtaacaccatagtaaaagctgaattttgtgtgttattatttgatgaaaggtgggaactgatagctgggaggatcccaggaagaaccgctggagaaattgagaggttttgggtcatgaaaaattgaaaagtgatcaatatatctctatagtttcactgattgtttcgattatattccgttgtattttaaatttaccaactctgttataagaagaaaactttcttaaatcccaaaccatttaactaaaaaaaaaaaaaaagggc

SEQ ID NO: 3833 - DNA, 925 bp, Artificial Sequence; identical to SEQ ID NO: 553
  P111 (35S::G714)

SEQ ID NO: 3834 - DNA, 834 bp, Artificial Sequence; identical to SEQ ID NO: 567
  P120 (35S::G732)

SEQ ID NO: 3835 - DNA, 1003 bp, Artificial Sequence
  P121 (35S::G735)
caaaagagaaaagatggaaaaagttttctccgacgaagaaatctccggtaaccatcactggtcggttaatggaatgacgtcgttgaatcgcagtgcttccgaatgggcattcaatcgtttcatacaagaatcctccgccgctgcagacgacggagaatctacgacggcgtgtggtgtttccgtctcctctcctcctaatgttcctgtagattcagaggaatacagagcatttctcaagagtaaacttaatcttgcttgtgctgctgtcgccatgaaaaggggaactttcatcaaacctcaggatacttctggtagatctgacaatggtggagccaatgaatcagaacaagcctctcttgcttcttccaaagctacaccaatgatgagcagtgctataacaagtggatctgagctctctggtgatgaagaagaagctgatggtgaaactaatatgaaccctactaatgttaaacgcgttaaaaggatgctctctaatagagaatcagctagacggtccagaagaagaaagcaagcacacttgagtgagctagagacacaagtttcacagcttcgtgtagagaattcaaaactcatgaagggtctcactgatgtaactcaaacattcaatgatgcatctgtagaaaacagagttttaaaagccaatattgagacactacgagcaaaggtgaaaatggctgaagagacagtgaagagactcactggctttaacccaatgttccacaatatgcctcagattgtttcaactgtctctcttccttcagagacatcaaattctccagacactacaagcagccaagtgactacaccagagatcattagctcggggaacaaaggcaaggccttgatagggtgcaagatgaacagaacagcttcgatgcgtagtgttgagagcttggaacatctgcagaaacgtattcgaagcgttggggatcagtagctgttaaagaagaatcttgatttgtaacattaatcttaagacata

SEQ ID NO: 3836 - DNA, 1283 bp, Artificial Sequence; identical to SEQ ID NO: 597
  P128 (35S::G782)

SEQ ID NO: 3837 - DNA, 1027 bp, Artificial Sequence; identical to SEQ ID NO: 599
  P129 (35S::G783)

SEQ ID NO: 3838 - DNA, 1420 bp, Artificial Sequence; identical to SEQ ID NO: 605
  P131 (35S::G793)

SEQ ID NO: 3839 - DNA, 923 bp, Artificial Sequence; identical to SEQ ID NO: 607
  P132 (35S::G798)

SEQ ID NO: 3840 - DNA, 1673 bp, Artificial Sequence; identical to SEQ ID NO: 669
  P138 (35S::G903)

SEQ ID NO: 3841 - DNA, 480 bp, Artificial Sequence; identical to SEQ ID NO: 677
  P141 (35S::G911)

SEQ ID NO: 3842 - DNA, 1486 bp, Artificial Sequence
  P143 (35S::G928)
cccaggaaaggtaaaagagacggagacgaaccaaaacaaggaagaaagaagaagatcttacatacgaagatcactctctgattcactctgagagacaaactggtttactttggttctgtttgacaaaaggagacatgcaaaaataaatctctatcccttgtttttcttcttcgcttcatcgattactcaaagaggttgttggttgtgagaataattagcttgttaaggaagacgttatgatgcatcagatgttgaataagaaagattcagctactcattccactttgccataccttaatactagcatctcttggggagtggttccaactgattccgttgctaatcgtcgcggtcctgctgaatcactaagcttgaaggttgattcaagacctgggcatatacaaactacaaagcaaatcagttttcaggaccaagattcatcttcaacacagtccactggtcaatcttatactgaagttgctagtagtggtgatgataatccttccagacaaatctccttttcggctaaatcaggatctgaaataactcaacggaaggggtttgcaagtaatcctaaacaaggctcgatgactggatttccgaatattcactttgctcctgcacaggctaatttctcatttcactatgctgatccacattatggtggtttattagctgcaacttacctaccacaggcaccaacatgcaatcctcaaatggtgagtatgattcctggtcgtgttcctttaccagcagagctcacagaaactgatccagtctttgtcaatgcgaagcaataccacgcaattatgaggaggagacagcaacgtgctaagcttgaggctcaaaacaaactaatcagagcccgtaagccctatcttcatgagtctcgacatgttcatgctcttaaaaggccaagaggatctggtggaagattcctaaacaccaaaaaacttcttcaagaatccgaacaggctgctgctagagaacaagaacaggacaagttaggccaacaggtaaacagaaagaccaacatgtctagattcgaagctcatatgctgcagaacaacaaagaccgcagctcaaccacttctggctcagacatcacctctgtttccgacggtgctgatatctttggacacactgaattccagttttcaggtttcccaactccgataaaccgagccatgcttgttcatggtcagtctaatgacatgcatggaggtggagacatgcaccatttctctgtccatatctgagacagtggatcttggtgctgtgttcatgttcccaccaagaaggggaagtcatccttggctactactagttctttcgcttgttgtaacttcagtgtttttatttcatattatgtctgtgttagacatcacaagaacgaccaagatcttcactttgaaacactctattaccttttcatcttctgttaccatggatctcttgtctaaactagtgatatgattcttctgat

SEQ ID NO: 3843 - DNA, 1221 bp, Artificial Sequence; identical to SEQ ID NO: 721
  P144 (35S::G964)

SEQ ID NO: 3844 - DNA, 1073 bp, Artificial Sequence
  P145 (35S::G994)
tgggtgtagctaattactttcacgattttcaaatccaataaagttttaatttgatgaagctttttttaaaccatataatataaataatgggtggtcgtaaaccatgttgtgatgaggttggattaagaaagggtccatggacagtggaagaagatgggaaactagttgatttcttaagggcacgtggcaactgcggtggtggtggaggaggatggtgctggagagacgtgccaaaactggcggggctaaggaggtgtggcaaaagttgccgtctccggtggactaattatctccggccagatctcaagagaggtctttttactgaagaagaaatccaactagtcattgatcttcatgctcgccttggcaataggtttttatattttcaattttgttaccaatttcattatataaaaacgagctattacactactttgacaattatgaccctcctagttaaaccaatatgttagatttgatgatttctatttctaatgttgaaaatattctaatgcattatatataatttggttatagatggtcgaagattgcagtggagttaccaggaagaacagacaacgatatcaaaaattattggaacactcatataaagaggaagcttataagaatgggtattgatccaaacacacatcgtcgatttgaccaacaaaaagtcaacgaggaggaaacgatattggtcaacgatccaaagcctctgtctgagaccgaggtatctgttgctttgaagaatgacacgtcagcagtgttatcaggaaatctaaaccaattggctgacgtggacggtgatgatcagccgtggagctttctaatggaaaatgacgaaggaggaggtggcgacgccgccggagagcttacgatgctattgtccggtgacattacgtcatcatgttcttcttcgtcatctttgtggatgaagtatggagaattcggatacgaagatttagaacttggatgtttcgatgtttagagattcaagtatgtttaattaggccgtaggttgattaatcataaggttcattgacttcattctagaattgtgtagttggaccagt

SEQ ID NO: 3845 - DNA, 1082 bp, Artificial Sequence; identical to SEQ ID NO: 749
  P146 (35S::G996)

SEQ ID NO: 3846 - DNA, 2185 bp, Artificial Sequence
  P148 (35S::G1038)
gtgtcgtcgtttcataataaaacgcaaacaaaaacccactcccactttctcctttccaaaaaaagaactctcgccactttctctgctctttttctttctctctctctttcttgttttcgccggcgatcatggagaaaagcggcttctctcccgtcggtctaagggttcttgtcgtagacgatgatccaacttggctcaagattctcgagaaaatgctcaagaagtgttcttacgaaggtctctttcttcttcttctatcttatgttttccccaacagttggatttactaaaatatctccttactttcctatgttgcagtaacgacctgtggattagctagagaggctttgaggttgctgagggagcgtaaagatggatatgatatcgtgatcagcgatgtgaacatgcctgacatggatggtttcaagcttcttgagcatgttggtcttgaattagacctccctgtaataagtgagaagaaagatcttgacttgttgtgtaataaatgaaaaaggttattgatttttgtgtgttttgcgttgtagtgatgtcggtggacggcgaaacaagccgagtgatgaagggagtgcaacacggagcttgtgattacctcttgaagccgataagaatgaaggagttaaagattatatggcaacatgttctgagaaagaagcttcaagaagtgagagatatcgaaggctgtggatacgaaggaggagcggattggatcactcgatacgatgaagcacattttcttggaggtggtgaagatgtttcttttgggaaaaagagaaaagactttgactttgagaagaagcttcttcaagatgagagtgatccatcatcttcttcttccaagaaagctagagttgtttggtcttttgagcttcatcataagtttgtcaacgccgttaaccaaatcggatgcgatcacagtaagtacgttggcgactttggtttcttatcatgtccccttgcctccctttattatcatgtcttcatagagccgtgaaattttttccggtctcttgtttggcagaagctggtcccaagaagatattggatctcatgaatgttccatggctcactagagaaaatgttgcaagccaccttcaggtaaaaactttaccttgtcatcatcattattcagaacaagtgttagattaagcttttcgtcactttttttttgttctgtttttgtagaaatatagactttacctgagcagattagagaaaggaaaggagctcaagtgttattcaggtggcgtgaagaatgcggattcatctccaaaagatgtcgaagtgaattcaggctaccaaagccctgggaggagcagctatgtattctctggaggaaattctctgatccaaaaagcaacagagattgatccaaagccacttgcttcagcttctttgtctgacctcaacaccgatgtgatcatgcctccgaaaacaaaaaagacgcgtataggatttgatcctcccatttcctcctctgcgtttgactctctgcttccttggaatgatgttccagaggtccttgaatcgaagccggttctgtatgagaatagctttctccagcaacaaccattgccaagtcaaagttcctatgttgcaaattctgcaccatctctcatggaggaggaaatgaagcctccttatgagacaccagcaggaggcagtagtgtgaatgcagatgagtttctcatgccacaagacaagatccctactgtaacccttcaagatttggatccctctgccatgaagctgcaggagttcaacacagaggcgattctgagaagcttgaactgggaacttccagaatcacatcattctgtttctttagacactgacttagacttgacttggcttcaaggcgagcgttttcttgcaaacaccggactccagtttcaagattacagtagtagcccatcactcctatctgagctcccagcccaccttaattggtatggaaatgagcggctgcctgaccctgacgagtattccttcatggtagaccaaggtttattcatatcttaaccttgttccaataacttcttttcgtatattggttggtgtaatgcagaaagattttgtgggtatacctgaaaataatcttgctttcccaagaaccttccatgatcggatgcattgtacaataatccacgagtgtcgtaggctaatt

SEQ ID NO: 3847 - DNA, 958 bp, Artificial Sequence
  P149 (35S::G1048)
gaccatggcggaggaatttggaagcatagatttactcggagatgaagatttcttcttcgatttcgatccttcaatcgtaattgattctcttccggcggaggattttcttcagtcttcaccggattcatggatcggagaaatcgagaatcaattgatgaacgatgagaatcatcaagaggagagttttgtggaattggatcagcaatcggtttcagatttcatagcggatctactcgttgattatccaactagcgattctggctccgttgatttggcggctgataaagttctaaccgtcgattctcccgccgccgctgatgattccgggaaggagaattcggatttggttgttgagaagaagtctaatgattctggtagcgagattcatgatgatgatgacgaagaaggagacgatgatgctgtggctaaaaaacgaagaaggagagtaagaaatagagatgcggcggttagatcgagagagaggaagaaggaatatgtacaagatttagagaagaagagtaagtatctcgaaagagaatgcttgagactaggacgtatgcttgagtgcttcgttgctgaaaaccagtctctacgttactgtttgcaaaagggtaatggcaataatactaccatgatgtcgaagcaggagtctgctgtgctcttgttggaatccctgctgttgggttccctgctttggcttctgggagtaaacttcatttgcctattcccttatatgtcccacacaaagtgttgcctcctacgtccagaaccagaaaagctggttctaaacgggctcgggagtagtagcaaaccgtcttataccggcgttagtcggagatgtaagggttcgaggcctaggatgaaataccaaatcttaacccttgcggcgtgacaacgccttttttaactgcttcttttgcgcattttgagttgtagatgagtgtcttttagttttctc

SEQ ID NO: 3848 - DNA, 1305 bp, Artificial Sequence
  P163 (35S::G4)
aaagaatcgaatatttattatttcgccccgaagattctatttctgatcatttacacccctaaaaagagtagagctttcgtgaagccaccatgtgtggaggagctataatctccgatttcatacctccgccgaggtccctccgcgtcactaacgagtttatctggccggatctgaaaaacaaagtgaaagcttcaaagaagagatcgaataagcgatccgatttcttcgatcttgacgatgatttcgaagctgatttccaagggtttaaggatgactcggcttttgactgcgaagacgatgatgatgtcttcgtcaatgttaagcctttcgtcttcaccgcaactactaagcccgtagcttccgctttcgtctccactgtaggttcagcatatgccaagaaaactgtagagtccgctgagcaagctgagaaatcttctaagaggaagaggaagaatcaataccgagggattaggcagcgtccttggggaaaatgggctgcggagatccgtgatccgagaaaaggctcccgagaatggcttggaacattcgacactgctgaggaagcagcaagagcttatgatgctgcagcacgcagaatccgtggcacgaaagctaaggtgaattttcccgaggagaagaaccctagcgtcgtatcccagaaacgtcctagtgctaagactaataatcttcagaaatcagtggctaaaccaaacaaaagcgtaactttggttcagcagccaacacatctgagtcagcagtactgcaacaactcctttgacaactcttttggtgatatgagtttcatggaagagaagcctcagatgtacaacaatcagtttgggttaacaaactcgttcgatgctggaggtaacaatggataccagtatttcagttccgatcagggcagtaactccttcgactgttctgagttcgggtggagtgatcacggccctaaaacacccgagatctcttcaatgcttgtcaataacaacgaagcatcatttgttgaagaaaccaatgcagccaagaagctcaaaccaaactctgatgagtcagacgatctgatggcataccttgacaacgccttgtgggacaccccactagaagtggaagccatgcttggcgcagatgctggtgctgtgactcaggaagaggaaaacccagtggagctatggagcttagatgagatcaatttcatgctggaaggagacttttgaagtgatcgatggttccttagtttgtaaataaagctgtgttggattttgctgttgggggatggtacaagtcacacctcaagctctatgc

SEQ ID NO: 3849 - DNA, 1228 bp, Artificial Sequence
  P164 (35S::G5)
cttagattttagtgaatcgagggtgaaatttttgattccctcttttcggatctacacagaggttgcttatttcaaaccttttagatccatttttttttaattttctcggaaaaatccctgtttctttacttttttataagtctcaggttcaattttttcggattcaaatttttattttaaatggcagctgctatgaatttgtacacttgtagcagatcgtttcaagactctggtggtgaactcatggacgcgcttgtaccttttatcaaaagcgtttccgattctccttcttcttcttctgcagcgtctgcgtctgcgtttcttcacccctctgcgttttctctccctcctctccccggttattacccggattcaacgttcttgacccaaccgttttcatacgggtcggatcttcaacaaaccgggtcattaatcggactcaacaacctctcttcttctcagatccaccagatccagtctcagatccatcatcctcttcctccgacgcatcacaacaacaacaactctttctcgaatcttctcagcccaaagccgttactgatgaagcaatctggagtcgctggatcttgtttcgcttacggttcaggtgttccttcgaagccgacgaagctttacagaggtgtgaggcaacgtcactggggaaaatgggtggctgagatccgtttgccgagaaatcggactcgtctctggcttgggacttttgacacggcggaggaagctgcgttggcctatgataaggcggcgtacaagctgcgcggcgatttcgcccggcttaacttccctaacctacgtcataacggatttcacatcggaggcgatttcggtgaatataaacctcttcactcctcagtcgacgctaagcttgaagctatttgtaaaagcatggcggagactcagaaacaggacaaatcgacgaaatcatcgaagaaacgtgagaagaaggtttcgtcgccagatctatcggagaaagtgaaggcggaggagaattcggtttcgatcggtggatctccaccggtgacggagtttgaagagtccaccgctggatcttcgccgttgtcggacttgacgttcgctgacccggaggagccgccgcagtggaacgagacgttctcgttggagaagtatccgtcgtacgagatcgattgggattcgattctagcttaggggcaaaataggaaattcagccgcttgcaatggagtttttgtg

SEQ ID NO: 3850 - DNA, 684 bp, Artificial Sequence
  P165 (35S::G7)
gaatcataaacgagccagaatattatcccccgggttacaacttgtctaccaccgcaatttcaaacatggtgtctatgctgactaatgttgtctctggtgagaccgaaccctcggcatctgcgacatggacgatgggtcataagagagaaagagaagagttttctttgcctcctcaaccattgattaccggttcagctgtgactaaagaatgtgaaagctcaatgtccttggagaggccaaaaaaatatagaggagtaaggcaacgaccatggggaaaatgggcggcggagattcgagacccacacaaggcgacacgtgtatggcttgggacattcgagacagccgaggccgccgcaagagcctatgatgcggcagcacttcgctttagaggaagcaaagcaaagcttaatttccccgaaaatgttggaactcagacgattcaacgaaattctcatttcttgcaaaactcaatgcaaccttctctaacatacatcgatcaatgtccaactctattatcttactctcgatgtatggagcaacaacaaccattagtaggcatgttgcagccaacagaagaggaaaatcactttttcgaaaaaccatggaccgaatatgatcaatacaattactcctcttttggttaactaacatatcgtcaacgctttgtatttctacttattcgat

SEQ ID NO: 3851 - DNA, 1246 bp, Artificial Sequence
  P167 (35S::G9)
gtgtttcttctttctgctaaaaggttataatttttgtttcttggtttggtgagaatcttcaagaaactgaaacaaagaaaatggattctagttgcatagacgagataagttcctccacttcagaatctttctccgccaccaccgccaagaagctctctcctcctcccgcggcggcgttacgcctctaccggatgggaagcggcgggagcagcgtcgtgttggatcccgagaacggcctagagacggagtcacgaaagctaccatcttcaaaatacaaaggtgttgttcctcagcctaacggaagatggggagctcagatctacgagaagcaccaacgagtatggctcgggactttcaacgagcaagaagaagctgctcgttcctacgacatcgcagcttgtagattccgtggccgcgacgccgtcgtcaacttcaagaacgttctggaagacggcgatttagcttttcttgaagctcactcaaaggccgagatcgtcgacatgttgagaaaacacacttacgccgacgagcttgaacagaacaataaacggcagttgtttctctccgtcgacgctaacggaaaacgtaacggatcgagtactactcaaaacgacaaagttttaaagacgtgtgaagttcttttcgagaaggctgttacacctagcgacgttgggaagctaaaccgtctcgtgatacctaaacaacacgccgagaaacactttccgttaccgtcaccgtcaccggcagtgactaaaggagttttgatcaacttcgaagacgttaacggtaaagtgtggaggttccgttactcatactggaacagtagtcaaagttacgtgttgaccaagggatggagtcgattcgtcaaggagaagaatcttcgagccggtgatgttgttactttcgagagatcgaccggactagagcggcagttatatattgattggaaagttcggtctggtccgagagaaaacccggttcaggtggtggttcggcttttcggagttgatatctttaatgtgaccaccgtgaagccaaacgacgtcgtggccgtttgcggtggaaagagatctcgagatgttgatgatatgtttgcgttacggtgttccaagaagcaggcgataatcaatgctttgtgacatatttccttttccgattttatgctttcgttttttaatttttttttttgtcaagttgtgtaggttgtgattcatgctaggttgtatttaggaaaagagataagacc

SEQ ID NO: 3852 - DNA, 1650 bp, Artificial Sequence; identical to SEQ ID NO: 51
  P171 (35S::G20)

SEQ ID NO: 3853 - DNA, 881 bp, Artificial Sequence; identical to SEQ ID NO: 63
  P173 (35S::G27)

SEQ ID NO: 3854 - DNA, 964 bp, Artificial Sequence; identical to SEQ ID NO: 1
  P174 (35S::G28)

SEQ ID NO: 3855 - DNA, 1440 bp, Artificial Sequence; identical to SEQ ID NO: 69
  Artificial sequence
  P179 (35S::G38)

SEQ ID NO: 3856 - DNA, 909 bp, Artificial Sequence; identical to SEQ ID NO: 71
  P181 (35S::G43)

SEQ ID NO: 3857 - DNA, 997 bp, Artificial Sequence; identical to SEQ ID NO: 73
  P182 (35S::G44)

SEQ ID NO: 3858 - DNA, 780 bp, Artificial Sequence
  P183 (35S::G156)
aggaagagggagccactcataagaggaagaagagagagatgggtagagggaagatagagataaagaagatagagaatcagacggcgaggcaagtgaccttctccaagagaagaactggtcttataaagaagactcgtgagctctctattctctgtgacgctcacatcggtctcatcgtcttctcagccaccggaaagctttccgagttctgctccgaacagaacaggatgcctcaactcattgaccgatacttgcataccaacggattgcgacttcctgatcatcatgacgaccaggagcaattgcaccatgagatggaactactaagaagagagacatgtaaccttgagcttcgtctgcgtccattccatggacatgacttagcctccattcctcctaatgagcttgacggactcgagagacagctagaacattctgtcctcaaagtccgtgagcgtaagaggaggatgctagaagaagataacaacaacatgtaccgttggcttcatgagcatcgtgcagcgatggagtttcaacaagctgggatagataccaaaccaggggagtatcaacagtttatagagcagcttcagtgctataaaccaggggagtatcagcagtttctagagcagcagcaacaacaaccaaacagcgttcttcagcttgctacacttccttctgagattgatcctacttacaatctccagcttgctcagcctaatcttcaaaacgatccaacggcccagaatgattaatacaattctcaatagatatctactc

SEQ ID NO: 3859 - DNA, 883 bp, Artificial Sequence; identical to SEQ ID NO: 119
  P184 (35S::G157)

SEQ ID NO: 3860 - DNA, 808 bp, Artificial Sequence
  P191 (35S::G180)
gtaattacgatctacaacaagtgacatcgtcgtcgacgacgattcaagagaatatgaacttcctcgttccttttgaagaaaccaatgtcttaacctttttctcttcttcttcttcctcttctctttcttctccttctttccccattcacaactcttcctccactactactactcatgcacctctagggttttctaataatcttcagggtggaggacccttgggatcaaaggtggttaatgatgatcaggagaattttggaggtggaactaacaatgatgctcattctaattcttggtggagatcaaatagtggaagtggagatatgaagaacaaagtgaagataaggaggaaactaagagagccaagattctgtttccaaaccaaaagcgatgttgatgttcttgacgatggctacaaatggcgtaaatatggtcagaaagtcgtcaagaacagccttcaccccaggagttattacagatgcacacacaacaactgtagggtgaaaaagagagtggagcgactatcggaagattgtagaatggtgattactacttacgaaggtcgtcacaaccacattccctctgatgactccacttctcctgaccatgattgtctctcttccttttaacatctctttctatatatctatatatagacagttatatgtgcacatatagatgtgtgatatattgcatatttgatattgcatgtgtttttcaagagtatgtcatcagatgttatgcatatattcttgacttgttgcttatagtatacatatgtaataatatatattgacattggtagttc

SEQ ID NO: 3861 - DNA, 1191 bp, Artificial Sequence; identical to SEQ ID NO: 153
  P194 (35S::G188)

SEQ ID NO: 3862 - DNA, 1171 bp, Artificial Sequence; identical to SEQ ID NO: 159
  P196 (35S::G192)

SEQ ID NO: 3863 - DNA, 1099 bp, Artificial Sequence
  P197 (35S::G194)
gccatttgatagattgtttccggtaaagctcagcgagagaagaagaagaacaacaatggagtttacagatttctcaaagacgagtttttactacccgtcgtcacaaagcgtttgggatttcggagatttagcggcggcggagaggcattctttagggttcatggagttattaagttctcagcagcatcaagactttgctactgtttctcctcattccttccttctccaaacgtctcaaccgcaaacgcaaacgcaaccatcggcgaagctgtcttcaagtatcattcaagctccaccgtcagagcaattagtgacgtcaaaggtggagtctttgtgttcggatcatttgttgataaacccaccggcgactcctaactcgtcatcgatttcgtctgcttcaagcgaggctctaaatgaagagaaaccgaaaacagaagacaatgaagaagaaggaggtgaagatcaacaagagaagagtcatactaagaaacagttgaaagcaaagaagaataatcagaagagacagagagaggcaagagtcgcattcatgacaaagagtgaagttgatcatctcgaagatggttatcgctggcgaaaatatggtcaaaaagctgtcaaaaacagtccttttcccaggagttactaccgttgcacaacggcttcatgtaacgtgaagaagagagtggagagatcattcagagatccaagcactgtggttacaacctacgaaggtcaacacactcacattagtccactcacgtctcgtcctatttccactggaggtttcttcggatcgtcaggagctgcttcgagtctcggtaatggttgctttgggtttcctattgatggctccacgttaatctctcctcagttccaacagcttgtccaataccatcaccaacagcagcaacaagaactcatgtcttgttttggaggagtcaacgagtaccttaatagccacgctaatgagtatggtgatgataatcgtgtgaagaagagtcgagttttggttaaagataatggacttctgcaagatgttgttccgtctcatatgttgaaggaagagtagtagtatatatatagtcttatagttttaatc

SEQ ID NO: 3864 - DNA, 1061 bp, Artificial Sequence
  P201 (35S::G234)
acagaggccgctatcaagaacaagactaagaacaagacttcactaggagtacaagtatgggaagagcaccgtgttgtgacaaagcaaacgtgaagaaagggccttggtctcctgaggaagatgcaaaactcaaatcttacattgaaaatagtggcaccggaggcaattggatcgctttgcctcaaaagattggtttaaagagatgtggaaagagttgcaggctgaggtggcttaactatcttagaccaaacatcaaacatggtggcttctctgaggaagaagaaaacatcatttgtagcctttaccttacaattggtagcaggtggtctataatcgctgctcaattgccgggacgaacagacaacgatataaaaaactattggaacacgaggctcaagaagaaactcattaacaaacaacgcaaggagcttcaagaagcttgtatggagcagcaagagatgatggtgatgatgaagagacaacaccaacaacaacaaatccaaacttcttttatgatgagacaagaccaaacaatgttcacatggccactacatcatcataatgttcaagttccagctcttttcagaatcaaaccaactcgttttgcgaccaagaagatgttaagccagtgctcatcaagaacatggtcaagatcgaagatcaagaactggagaaaacaaacctcatcatcatcaagattcaatgacaacgcttttgatcatctctctttctctcaactcttgttagatcctaatcataaccacttaggatcaggagagggtttctccatgaactctatcttgagcgccaacacaaactctccattgcttaacacaagtaatgataatcagtggttcgggaatttccaggccgaaaccgtaaacttgttctcaggagcctccacaagtacttcggcagatcaaagcactataagttgggaagacataagctctcttgtttattctgattcaaagcaatttttttaattataataatatattattcttaagatgaaacgtacatcattattattaattgggggtacgtaacgtatatatgga

SEQ ID NO: 3865 - DNA, 727 bp, Artificial Sequence
  P204 (35S::G249)
cgacatggagaaaagagaaagtagtggtgggtctggatcaggagatgcagaggtgagaaaagggccatggacgatggaagaagatttgattctcatcaattatatcgccaatcatggtgaaggtgtttggaactctctcgccaaatctgcaggactaaaacgcaccgggaaaagttgccggctccggtggctgaactacctccgacctgatgcgcgacggggaaatatcacaccagaagaacagctcaccatcatggaacttcatgcaaaatggggaaataggtggtcaaaaattgcaaagcatttaccaggaagaaccgacaatgagataaagaatttttggaggactaagatccagaaatacatcatcaagagcggagaaacgacgaccgttggatcacaaagctccgagtttataaaccatcatgcgacaacgagccatgtcatgaatgatactcaagaaaccatggatatgtattctccaacgacgtcgtatcaacatgccagcaatattaatcagcagcttaattatggtaattatgtgcctgaatccggttcgatcatgatgccattatctgttgatcagtccgaacaaaactattggagcgtcgatgatctttggcccatgaatatatataatggtaattaataaataagttcgttaaaacttatatatatttacggtccaaagagggttctatataaacagagtactgtatgggattgc

SEQ ID NO: 3866 - DNA, 1391 bp, Artificial Sequence; identical to SEQ ID NO: 225
  P205 (35S::G254)

SEQ ID NO: 3867 - DNA, 1749 bp, Artificial Sequence
  P206 (35S::G261)
attttgggcttctgattttgatcgaaacttactgatagtaagttctttgagtcctccttaactgtagtttctgtgtactgaagttattgaattgaaagtttttatcttttttggttattgaaactttcatagtttgatcaaaagagtctcttgctctgtttttggctctgtttttgtgagtgtgattgtaagctttgttgtgagtagattgaatcaaggagtgtgagagttgttaaaagtgttttcagagatggatgagaataatcatggagtttcatcaagctcacttccacctttcctcaccaaaacatatgagatggttgatgattcttcatccgattctatcgtctcttggagtcagagcaataagagtttcatcgtttggaatccgccggagttttctagagatcttcttccgagattcttcaagcacaataacttctctagctttatccgccagcttaacacatatgtaagtgttttcatgctttgtttaaaagtattgactaaatcaatcatcttcttagtggaatttgtttttgtgtgtagggttttagaaaagctgatcctgagcaatgggaatttgcggaatgatgattttgtgagaggtcaacctcatcttatgaagaacattcatagacgcaaaccagttcatagccactctttaccgaatcttcaagctcagttaaacccgttgacggattcagaacgagtgagaatgaataatcagattgagagattgacaaaagagaaagaaggattgcttgaagagttacataaacaagacgaggaacgagaagtgtttgagatgcaagtgaaagaacttaaagaacgattacaacacatggagaagcgtcagaaaacaatggtttcgtttgtttctcaagtattggaaaagccagggcttgctttgaacctatcgccgtgtgttcccgaaacaaacgagaggaaaagaaggttccctaggatcgagttctttcccgatgaaccgatgttggaagagaacaaaacttgtgttgttgtgagagaggaaggttctacaagcccttcttcacacacaagagagcatcaagtggaacagttagagtcatcgatagcgatttgggagaatcttgtatcggattcttgtgagagtatgttacaatcaagaagtatgatgacacttgatgtggatgaatcatctacttttccagagagccctcctctttcttgcatacagttaagtgtcgattcacgtctcaaatctcctccttctccaaggatcatcgatatgaactgtgagcccgatggttcgaaagaacagaacactgttgctgctcctcctcctcctccagtagcaggagcgaatgatggcttctggcagcagtttttctcagagaatcctggctcaaccgagcaacgggaagttcaattagagaggaaagacgataaagataaagccggagtacgtactgagaaatgttggtggaattcgagaaatgttaatgcaattacagaacagcttggacatctgacttcttcagagagaagttgatatgtcaaagattaaatttctagtctgttttagttacttgtaaaatagggtttctcagttttattgttttcgattacagtacttaggtatggttcagctgtttatttatcacttgtatgatctttcacagttcattgtagcagacttcaatggtaatgataagctagagcttatggatagtattcataaaatgagattgaccttcaacaaaaaaa

SEQ ID NO: 3868 - DNA, 1104 bp, Artificial Sequence; identical to SEQ ID NO: 237
  P207 (35S::G263)

SEQ ID NO: 3869 - DNA, 1379 bp, Artificial Sequence; identical to SEQ ID NO: 245
  P209 (35S::G271)

SEQ ID NO: 3870 - DNA, 2330 bp, Artificial Sequence; identical to SEQ ID NO: 247
  P211 (35S::G274)

SEQ ID NO: 3871 - DNA, 1350 bp, Artificial Sequence; identical to SEQ ID NO: 257
  P219 (35S::G291)

SEQ ID NO: 3872 - DNA, 1764 bp, Artificial Sequence; identical to SEQ ID NO: 261
  P224 (35S::G307)

SEQ ID NO: 3873 - DNA, 1951 bp, Artificial Sequence; identical to SEQ ID NO: 263
  P225 (35S::G308)

SEQ ID NO: 3874 - DNA, 1558 bp, Artificial Sequence; identical to SEQ ID NO: 277
  P229 (35S::G326)

SEQ ID NO: 3875 - DNA, 927 bp, Artificial Sequence
  P245 (35S::G371)
ttttttgggtagtgtaagttttaaattcaagatcgatcatgctaagtatatacacaacaattctgttataatctatattgatcttcatattttgatgatatttcttgtttctatgaagtatcattgattttataaatctctaattggaattagactttagtatttactatttacttatttaggtgaaatctcattaaataaacaacgactggtcaagtgaatggttgtttgtcttgtatgttttagtaaaatggagattgagaaggatgaggacgacacaacattggttgattctggaggagacttcgactgcaacatatgtttggatcaggttcgagacccggtcgtgactttatgtggccacctgttttgttggccctgcattcacaagtggacttatgcgtccaacaattcaagacaacgagtcgatcaatacgatcataagagggaaccaccaaaatgtccggtatgcaaatctgatgtctccgaggctacgcttgtcccgatctacggacgaggacagaaagctccccagtccggttcaaatgtaccgagcagaccaactggtccggtttatgacttaagaggagttggtcaacgtttaggagaaggggagagtcaacgttacatgtatagaatgcctgatccggtgatgggtgtggtatgcgaaatggtataccggagactatttggagagtcttcgagcaacatggcaccttaccgcgatatgaatgtccggtctaggcgacgggcaatgcaggctgaggagtcattaagcagagtctacttgtttctactttgcttcatgtttatgtgtctatttctcttctaattataatatatatgtgtatataatataccaattggaatgagtatgcatatatgtaataacaatttgtatatttttaagagtcttgaatcgttgaa

SEQ ID NO: 3876 - DNA, 726 bp, Artificial Sequence; identical to SEQ ID NO: 319
  P247 (35S::G378)

SEQ ID NO: 3877 - DNA, 2216 bp, Artificial Sequence
  P248 (35S::G385)
tagggtttgctttcagtttccggagtataagaaaagatgttcgagccaaatatgctgcttgcggctatgaacaacgcagacagcaataaccacaactacaaccacgaagacaacaataatgaaggatttcttcgggacgatgaattcgacagtccgaatactaaatcgggaagtgagaatcaagaaggaggatcaggaaacgaccaagatcctcttcatcctaacaagaagaaacgatatcatcgacacacccaacttcagatccaggagatggaagcgttcttcaaagagtgtcctcacccagatgacaagcaaaggaaacagctaagccgtgaattgaatttggaacctcttcaggtcaaattctggttccaaaacaaacgtacccaaatgaagaatcatcacgagcggcatgagaactcacatcttcgggcggagaacgaaaagcttcgaaacgacaacctaagatatcgagaggctcttgcaaatgcttcgtgtcctaattgtggtggtccaacagctatcggagaaatgtcattcgacgaacaccaactccgtctcgaaaatgctcgattaagggaagagatcgaccgtatatccgcaatcgcagctaaatacgtaggcaagccagtctcaaactatccacttatgtctcctcctcctcttcctccacgtccactagaactcgccatgggaaatattggaggagaagcttatggaaacaatccaaacgatctccttaagtccatcactgcaccaacagaatctgacaaacctgtcatcatcgacttatccgtggctgcaatggaagagctcatgaggatggttcaagtagacgagcctctgtggaagagtttggctttagacgaagaagaatatgcaaggacctttcctagagggatcggacctagaccggctggatatagatcagaagcttcgcgagaaagcgcggttgtgatcatgaatcatgttaacatcgttgagattctcatggatgtgaatcaatggtcgacgattttcgcggggatggtttctagagcaatgacattagcggttttatcgacaggagttgcaggaaactataatggagctcttcaagtgatgagcgcagagtttcaagttccatctccattagtcccaacacgtgaaacctatttcgcacgttactgtaaacaacaaggagatggttcgtgggcggttgtcgatatttcgttggatagtctccaaccaaatcccccggctagatgcaggcggcgagcttcaggatgtttgattcaagaattgccaaatggatattctaaggtgacttgggtggagcatgtggaagttgatgacagaggagttcataacttatacaaacacatggttagtactggtcatgccttcggtgctaaacgctgggtagccattcttgaccgccaatgcgagcggttagctagtgtcatggctacaaacatttcctctggagaagttggcgtgataaccaaccaagaagggaggaggagtatgctgaaattggcagagcggatggttataagcttttgtgcaggagtgagtgcttcaaccgctcacacgtggactacattgtccggtacaggagctgaagatgttagagtgatgactaggaagagtgtggatgatccaggaaggtctcctggtattgttcttagtgcagccacttctttttggatccctgttcctccaaagcgagtctttgacttcctcagagacgagaattcaagaaatgagtgggatattctgtctaatggaggagttgtgcaagaaatggcacatattgctaacgggagggataccggaaactgtgtttctcttcttcgggtaaatagtgcaaactctagccagagcaatatgctgatcctacaagagagctgcattgatcctacagcttcctttgtgatctatgctccagtcgatattgtagctatgaacatagtgcttaatggaggtgatccagactatgtggctctgcttccatcaggttttgctattcttcctgatggtaatgccaatagtggagcccctggaggagatggagggtcgctcttgactgttgcttttcagattctggttgactcagttcctacggctaagctgtctcttggctctgttgcaactgtcaataatctaatagcttgcactgttgagagaatcaaagcttcaatgtcttgtgagactgcttgaaaaccatccattag

SEQ ID NO: 3878 - DNA, 2987 bp, Artificial Sequence
  P249 (35S::G391)
ctcctctctcgccattgccctctggcgttttctgtcttgagctaaagaaataacaaataaaccgaaaaaaataaaaatagaaacttttttttttgtttatttgttctttctccaaaactccttttttttctcaccattatctcatgaacgtgagtggaggctctctgagtagagagagcctacccttgaaaataacctagggatttctccaattttcaagctttacccattcaaaagaatcgtccttttttcctatttctgactttgagctatgatgatggtccattcgatgagcagagatatgatgaacagagagtcgccggataaagggttagattccggcaagtatgtgaggtacacgccggagcaagtggaagctctcgagagagtttacactgagtgtcctaagccaagttctctaagaagacaacaactcatacgtgaatgtccgattctctctaacatcgagcctaagcagatcaaagtttggtttcagaaccgcagatgtcgtgagaagcagaggaaagaagctgctcgtcttcaaacagtgaacagaaaactcaatgccatgaacaaactcttgatggaagagaatgatcgtttgcagaagcaagtttctaacttggtctatgagaatggccacatgaaacatcaacttcacactgcttctgggacgaccacagacaacagctgtgagtctgtggtcgtgagtggtcagcaacatcaacagcaaaacccaaatcctcagcatcagcaacgtgatgctaacaacccagcaggactcctttctatagcagaggaggccctagcagagttcctttccaaggctacaggaactgctgttgactgggttcagatgattgggatgaagcctggtccggattctattggcatagtcgctatttcgcgcaactgcagcggaattgcagcacgtgcctgcggcctcgtgagtttagaacccatgaaggttgctgaaattctcaaagatcgtccatcttggctccgagattgtcgaagtgtggatactctgagtgtgatacctgctggaaacggtgggacgatcgagcttatttacacgcagatgtatgctcctacgactttagcagcagctcgtgacttttggacgctgagatatagcacatgtttggaagatggaagctatgtggtttgtgaaaggtcgcttacttctgcaactggtggccccactgggccaccttcttcaaactttgtgagagctgaaatgaaaccaagcgggtttctcatccgtccttgcgatggtggtggttccattctccacattgttgatcatgttgatctggatgcctggagtgtccctgaagtcatgaggcctctctatgaatcatcgaagattcttgctcagaaaatgactgttgctgctttgagacatgtaagacaaattgcacaagaaacaagtggagaagttcagtatggtggagggcgccaacctgcggttttaagaaccttcagtcaaagactctgtcggggtttcaatgatgctgttaatggttttgtggatgatggatggtcaccaatgggtagcgatggtgcagaggatgttactgtaatgataaacttgtcccctgggaagtttggtgggtctcagtacggtaattcattccttccaagctttggtagtggcgtgctttgtgccaaggcatctatgttgcttcagaacgttccacccgctgtgctggttcgattccttagagaacaccgatctgaatgggctgattatggcgtggatgcttatgctgctgcatcgctcagagcaagtccttttgctgttccttgtgctagagctggggggttcccaagtaaccaagtcattcttcctcttgcgcagacagttgaacatgaagagtcacttgaggtggttagacttgaaggtcacgcttactcacccgaagacatgggtttagctcgggatatgtatttgctacagctttgtagcggtgttgatgaaaatgtggttggaggttgtgcacagcttgtatttgcccctatcgatgaatcatttgctgatgatgcacctttgcttccttccggtttccgcatcatacctcttgaacagaaatctactccgaacggtgcatctgcaaaccgtaccctggatttagcctcagctttagaaggatccacacgtcaagctggtgaagccgacccaaatggctgtaactttaggtcggtactaaccatagcattccagttcacatttgataaccattcaagagacagtgttgcttcaatggcacgtcagtacgtgcgaagcatagtaggatcgattcagagggttgctctagccattgctcctcgtcctggctccaatatcagtccaatatctgttcccacttcccctgaagctctcactctggtccgttggatctcccggagttacagccttcacactggtgcagatctctttggatctgattctcaaaccagtggtgacacgttgctgcatcaactctggaatcactctgatgcaatcttgtgctgctccctcaaaacaaacgcttcaccggttttcacattcgcaaaccaaaccggtttagacatgctggaaacgactcttgtagcccttcaagacataatgctagacaagacccttgacgaacctggtcgtaaagctctttgctctgagttccccaagatcatgcaacagggctatgctcatctgccggcaggagtatgtgcgtcaagcatgggaaggatggtatcttacgagcaggcaacggtgtggaaagttcttgaagacgatgaatcaaaccactgcttagctttcatgttcgtgaattggtcgttcgtttgaagaataataagaaataagaagaccagattttactccatttttcccttggtagggaggttatttatgtaagatattaaagttaggtgccactatgctccaaagtcttttgaaattcgaggaccaatatgtaatatgacgaatgtctgatcttgtatgg

SEQ ID NO: 3879 - DNA, 1507 bp, Artificial Sequence; identical to SEQ ID NO: 359
  P258 (35S::G440)

SEQ ID NO: 3880 - DNA, 1218 bp, Artificial Sequence; identical to SEQ ID NO: 385
  P268 (35S::G477)

SEQ ID NO: 3881 - DNA, 2073 bp, Artificial Sequence
  P273 (35S::G505)
ccatccattatattaacctatttatcttcttcttcaaaacatttgagtctccttagggttttttctctctcaaacaaaagctttagatctttcttcttaatggacattccgtattaccactacgaccatggcggagacagccaatatcttccaccgggtttcaggtttcatcccacggacgaagagctcatcactcattaccttctccgcaaagtcctcgacggttgcttctcaagccgtgccatcgcagaagttgatctcaacaagtgtgagccttggcaacttcccggtaagaaaatacaaaactaacttacttgtagttcttttgtaattaaggtttctgaaatctttactctcaatgttacttagggagagctaagatgggagagaaagaatggtacttctttagcctccgtgaccggaagtatccgacgggactgagaactaacagagcaactgaggctggttactggaaagctaccggaaaagacagagagatctttagttcaaagacttgtgcacttgttgggatgaagaagactcttgtcttttacaaaggaagagctccgaaaggagagaagagtaattgggttatgcatgaatatcgtcttgaaggcaaattctcttaccatttcatctcaagaagctccaaggtacttcgatttaacctttcattagttattttgttgataaagtaaagccttaattttctttgattaataaatttacaatctattatttggaaaaaaaattcgagagtgtgacatagtcggtgacgttgatttttttctcttttgctttattgcatttaattttgatggctgaaaaggcatggttctttactgtggttatctgagagcattatggaacatgaaatagaaaagatctgctgtttttatgtattgggatttcaatcataatggtgttttcctaaagtaagaaaacattcaatagctctgataaaataaaatattaatacatcctacttttggaaagcttaatgcaaaaaaccagaaccaatgcaaatcttcaggatttttttctgacctagatatattaaaaagaaatttaattaaattaattttacttaattagtgttccatatccattgtagacttgtagtgtccaatgtacattccctctgtgcacgcttttactctatggtttttcttaatcttcactctcttttatttccaagatctaacattgactttctcatcaaacatatattatataaaatatttgacttttcaaaactctaatttattccttcaggatgaatgggtgatctctagggttttccagaaaaccactttagctagcaccggagccgtctccgaaggaggaggaggaggaggagcaactgtgagcgtaagcagcggtactggtccatctaaaaagacgaaagtaccctcaacaatctcaagaaactatcaagaacaaccaagctctccttcctccgtctcactcccacctctcctggatccgaccactaccctcggctacaccgacagcagttgctcctacgacagccgtagcaccaacacaaccgtcacagccagcgcaataaccgagcacgtgtcctgtttctccactgtccctactactactacggccttgggcttagacgttaactcattcagccgtcttccaccgccgctagggtttgactttgacccttttcctcgtttcgtttctagaaacgtctcgactcaatctaacttcagatcgttccaagaaaacttcaatcaatttccttactttggatcgtcttctgcatcgactatgacctccgccgttaatctgccttctttccaaggcggcggaggcgtctccgggatgaattactggctaccggcgactgccgaagagaatgagtcaaaggtcggtgtgcttcatgctggacttgactgtatttggaactactgatcacaaaagaggtgacttataattgttcccgttagggttttatttatgtatttctaggatgattatggtattatgaaatgtgtgtaccgaggagcttaatattgcacttagcttgatgttccgcttaattctctagttttaagt

SEQ ID NO: 3882 - DNA, 1723 bp, Artificial Sequence
  P279 (35S::G516)
ccctctcttagttttgatctgaacctttttgtagctgttgaaaaatggcgaatccggtgggttttagattccgtccgactgacggggagatcgtcgacatttacctccgaccgaaaaatctcgaaagtaacacgagccatgtcgatgaagtcattagcacagttgatatttgtagcttcgacccttgggacttaccttgtaagtctttctaacgcgagtgtttgtttttctttggttcccaactgttgtatcatcccggtaatttctgatcatgttctgtctttcccagcccattctaggatgaaaacaagagatcaggtttggtatttcttcggccgtaaggagaacaaatatggtaaaggtgatcgacagataagaaaaaccaagtctggtttttggaagaaaactggcgttaccatggatataatgcgcaaaacgggagatcgtgagaagatcggtgagaaaagggttttggtgtttaagaatcacggtggttccaagtccgattgggctatgcatgagtatcacgctacgttctcgtctcctaatcaggtcatttttcgattctcttgtttaggcttctttaacttgttgttgttgttttcttaccgtgattttatttctcgtaaacgggaaaaatctgagtttatggtaatcatttatgctgagttgatctgtagataatgacatacacactctgcaaagttaagtttaagggtgaaaggagagaattttcagttgctactggtagtggaattaagcatactcactctttaatccctcctaccaacaattctggagttttgagtgtagagacagaggtgagtcaatctcaaaaactttccctgtttctcttttaaatcttcaaaatcatatctcgtacacatagttttttcatctgtgttacgttgttccttttttcagggatcgttgtttcacagccaagaatcacagaatccaagtcagttttctggctttcttgatgtggatgcactagatagggacttctgcaatattttgagtgatgatttcaaaggcttctttaatgatgacgatgagcagagtaagattgtttctatgcaagatgatcgcaacaaccacacacctcaaaagccattgaccggtgtcttcagtgatcatagcaccgatggtagtgattctgatccgatttctgcaacaactgtaagcaaaattttcctattttacctttactatctcctctgttttcagttttttctcacaaagctatagttttgtttaatacgacagatttccattcaaactttaagcacttgtcctagttttggtagctcaaatcctctataccaaatcactgacttgcaggaatctcctaactcaatcaagttagtgtcattagctcaagaggtgagctttatcatctccttttcttaaagaccaaccattctaaactgctaattaaccaagctactttgtgccagtactcacagcattttgggttctatgatgtgatttaaggtgagcaaaacaccgggaaccggtattgataatgatgcacaagggactgagattggtgagcataaattgggtcaagagacgatcaagaacaaaagagctggtttctttcacaggatgatacaaaaattcgtcaagaaaattcacctaagaacatgatatcaattttgtactttccaaaatctgtagtagtatgtaatatgtgtctatctggttttgtaacttttac

SEQ ID NO: 3883 - DNA, 1254 bp, Artificial Sequence; identical to SEQ ID NO: 415
  P281 (35S::G519)

SEQ ID NO: 3884 - DNA, 1641 bp, Artificial Sequence
  P282 (35S::G521)
gtctctgctagatcttgttattgtgagttttttgctttactggtgagggaagttacttagtgtagtgaaagttttccccttgtcttccaatggggaaaactaacttggcacctggttttcggtttcatccgactgatgttgaacttgtgagatactacttgaagaggaaagttatgggaaaaaagttccaagttgatgccattgctgaggtcgacatttacaagttcgaacctcctgatttacccggtaactaactcattctttcagaaatctttgttctgtttcatgctttcttatttatttcctgattactaacagaggtttctttacattgtacagacaaatcatgtctagggactggagatcttaagtggtacttcttctgtccaagagaaaagaagtatcccaaaggcggtaaggcaaaccgctctactgaatgtggttactggaagaccacagggagagacagagatgtttcttataatgacgaagtcactgggaagataagaactctgatttatcactacgggaaaatacctcgcggtgatcggactgattgggtcatacatgaatatagacttgaagacaaagtactggctcaaaagaatgttcctcaggtaatgacgattcgttcttgtctttttttaacgttttgattccttgcaagtttactaaacatgcttgttgtgccctgcaggatacttatgtgctttgcgttctctttaagaaaaatggacttggaccaagacatggatctcaatatggtgctccatttaaggaagaggattggagtgataaggaagaagaatatactcagaatcatcttgtagctggtcctagtaaagaaaccagtctagctgctaaggcctcacactcgtacgctcctaaggatggtttgacaggagtgatctcagaatcttgcgtctctgatgtgccgccactaactgccacagtgcttccacctctaacaagtgatgttatagcttacaatcccttttcttcttcacctcttcttgaggttcctcaagtatctctcgatggtggcgagttaaattcgatgcttgatctcttttctgttgacaatgacgactgtttacttttcgacgatttcgactaccataatgaggtaagtctgtctctgcatcatcatgcttttgatgaatcagatttcagtgttcctgaaaagaaacttgttttgattgcttctgaaactacaggtaagacatcctgatggttttgtaaacaaggaagctccggtgttcttaggagatggcaatttcagtggaatgtttgacctgagcaatgaccaagtcgtagagctacaggatctgatacagtcacccactcctcatcctccttctcctccagctcaagctagtattcctgatgactcaagaagcaacggtcagactaaggacgattaagtattttgtgctgacttatgctctttcttgctttggtctgatgctccatggaaacagagaccaaacatgtgaagctttagccagaacgtttctattgttgccatctctgtctgcacgaaagaagagacaaaaccatgaatcagtaacttgaaaccgtccagtagtggagccagctttctatgttatgtttctgcaactgcgttgtctgtagtcttag

SEQ ID NO: 3885 - DNA, 1481 bp, Artificial Sequence; identical to SEQ ID NO: 423
  P285 (35S::G526)

SEQ ID NO: 3886 - DNA, 768 bp, Artificial Sequence; identical to SEQ ID NO: 425
  P292 (35S::G536)

SEQ ID NO: 3887 - DNA, 1771 bp, Artificial Sequence
  P295 (35S::G559)
aataatcgtttgcagggtcgttgatttggtgataagtcagtagaaatggataaggagaaatctccagcacctccttgtggaggtcttcctcctccatctccatcaggtcgatgctctgcattctcagaagctggtcccattggtcatggttcagatgctaatcgaatgagtcatgatattagccgtatgcttgataacccacctaagaagattggacatcggcgagctcattctgaaatacttactctccctgatgatttgagctttgatagtgatcttggtgtggttggtaatgctgctgatggagcttctttctctgatgagactgaagaagatttgctctctatgtatcttgatatggataagtttaattcttctgctacatcttctgcccaagttggtgagccatcaggaactgcttggaaaaatgagacaatgatgcagacaggcacaggctcaacttccaatcctcagaatacggttaatagtcttggcgaaaggccaagaatcaggcatcaacatagccaatctatggatggttcaatgaatatcaatgagatgcttatgtcgggaaatgaagatgattctgctattgatgctaagaagtctatgtctgctactaaacttgctgagcttgctctcattgatcctaaacgtgctaagaggtaattggttttcgtttttcttctgtgattctctggtttcttaaatcctgtttatagtgtggatggacacggtgactatttgtgtgcttttggtttgaaccttaatgccaccagtcatttagttgcttcagctgttcccacataacttcagctttttaatgagtggagcaagtgtataatttgtttttgtttcatacaataggatatgggcaaacaggcagtccgcagcacgatcaaaagaaaggaagacgagatacatatttgagcttgagagaaaagtacagactttgcaaacagaggctacaactctctcagcccagttgaccctcttacaggttagttttgactcattgtacggttgttctttcttcatgctaaatgaaactaaatctagccttacaacgtttgttcgtgcattgtgattttttatgggttgaaaacttgtgctcttttcttcctgtttgtatagagagacacaaatggcttgactgttgaaaacaatgagctgaagctgcggttacaaacaatggagcagcaggttcacttgcaggatggtgagtctctcttttatcacaaacaatatccctctgtgccaagactgctatagttggttcatatcatcgaattgaatcttctctattaacagaactaaacgaagcactaaaggaggaaatccagcatctgaaggtgttgactggccaagttgctccatcagcgttgaactatgggtcgtttggatcaaaccagcagcaattctattccaacaatcagtcaatgcaaacaatcttagctgcaaaacagttccagcaacttcagattcattcacagaagcagcaacaacaacaacaacaacaacaacagcaacaccaacagcagcagcagcaacagcaacagtatcagtttcaacagcaacagatgcaacagcttatgcagcagcggcttcaacagcaagaacaacaaaatggagtaagactcaagccttcacaagcccagaaagagaactgaggaatatgaatatgtcccacgtaagtgagaggttctccttctgaacaattcctttctcattcataaattgttgttcatccatcacttgcagtctcttggat

SEQ ID NO: 3888 - DNA, 1405 bp, Artificial Sequence
  P297 (35S::G562)
gattcttgtagaaagagtcattgttctcttgagtgggaaaccttgaaaccattcctatgggaaatagcagcgaggaaccaaagcctcctaccaaatcagataaaccatcttcacccccggtggatcaaacaaatgttcatgtctaccctgattgggcagctatgcaggcatattatggtccaagagtagcaatgcctccttattacaattcagctatggctgcatctggtcatcctcctcctccttacatgtggaatcctcagcatatgatgtcaccatctggagcaccctatgctgctgtttatcctcatggaggaggagtttacgctcatcccggtattcccatgggatcactgcctcaaggtcaaaaggatccacctttaacaactccggggacgcttttgagcatcgacactcctactaaatctacagggaacacagacaatggattgatgaagaagctgaaagagtttgatgggcttgctatgtctctaggaaatgggaatcctgaaaatggtgcagatgaacataaacgatcacggaacagctcagaaactgatggttctactgatggaagtgatgggaatacaactggggcagatgaaccgaaacttaaaagaagtcgagagggaactccaacaaaagatgggaaacaattggttcaagctagctcatttcattctgtttctccgtcaagtggtgataccggcgtaaaactcattcaaggatctggagctatactctctcctggtgtaagtgcaaattccaaccccttcatgtcacaatctttagccatggttcctcctgaaacttggcttcagaacgagagagaactgaaacgggagcgaaggaaacagtctaatagagaatctgctagaaggtcaagattaaggaaacaggccgagacagaagaacttgctaggaaagtggaagccttgacagccgaaaacatggcattaagatctgaactaaaccaacttaatgagaaatctgataaactaagaggagcaaatgcaaccttgttggacaaactgaaatgctcggaacccgaaaagagagtccccgcaaatatgttgtctagagttaagaactcaggagctggagataagaacaagaaccaaggagacaatgattctaactctacaagcaaattccatcaactgctcgatacgaagcctcgagctaaagcagtagctgcaggctgaatcgatggtaattcatgtcgatttctacttaatttgtcgacataaacaaagaaaataagtgctactaatttcagaaaaacttgatagatagatagtatagtagagagagagagagagagagaggtgtgatgattattgatctataaattttcggagagagagagggagaaagagaaacttttcctccagatgaaaatttg

SEQ ID NO: 3889 - DNA, 2162 bp, Artificial Sequence; identical to SEQ ID NO: 463
  P308 (35S::G584)

SEQ ID NO: 3890 - DNA, 1287 bp, Artificial Sequence
  P310 (35S::G592)
cttcctgaaacgtcacgagacagagcttacaagaagagaaaacagaggaaatttcgttgcattttttttacatattgattcgattaatggattcaaataatcatctctacgacccgaatcccaccgggtcgggtcttcttcgttttagatcagctccgagctctgttctcgccgcttttgttgacgacgacaagattggtttcgactccgataggttgctttcaagattcgtgacctctaatggcgttaacggagatctgggttcacctaaattcgaggataagtctccggtttcgttaacgaacacctctgtttcatacgccgccactctgccgccaccgccgcagcttgagccgtcgagttttctgggtttgccgccgcattacccgaggcagagtaaagggataatgaactcggttggtttggatcagtttctcggtatcaataatcatcacaccaaaccagttgaatctaatcttctccgtcaaagcagctctccagccggaatgtttactaatctctctgaccaaaacggttatggttcaatgaggaatttgatgaattacgaagaagatgaagagagtccatctaattccaatggattaagacgccattgcagtctctcttcaaggccaccttcttcacttggaatgctttctcaaatacctgaaatcgcacccgaaactaattttccatatagccattggaatgatccatccagctttattgataacttatcctcacttaaaagagaagccgaggacgatggaaaattgtttctcggagctcagaacggagagtccgggaatcgtatgcagttactgtcgcatcatttgagcctaccaaagtcatcatcgacagcctcggacatggtttcagtggataagtatcttcagctacaagattctgttccttgtaaaatcagagccaaacgtggttgcgctacacatcctcgaagcatcgctgaacgggtaagaagaacgcggataagcgagcgaatgaggaagttacaagagcttgttcctaacatggacaagcaaaccaacacttcggatatgttggatttagctgtggattacatcaaagatttacaaagacagtataagattttaaacgacaacagagctaactgtaagtgtatgaacaaggagaagaagtcaatatagggcgcaacaaagtgtgtagtagataggactaaaaagcagggagaaggacaagaaagaaacaatgtcatgtctgaatattttttagccgaaacagaccaaattgtctatgtaagctctcgag

SEQ ID NO: 3891 - DNA, 1292 bp, Artificial Sequence; identical to SEQ ID NO: 473
  P311 (35S::G594)

SEQ ID NO: 3892 - DNA, 1226 bp, Artificial Sequence; identical to SEQ ID NO: 477
  P315 (35S::G598)

SEQ ID NO: 3893 - DNA, 1431 bp, Artificial Sequence; identical to SEQ ID NO: 489
  P320 (35S::G616)

SEQ ID NO: 3894 - DNA, 800 bp, Artificial Sequence
  P321 (35S::G620)
tgaacttggaccagcacagcaacaacccaaccccaatgaccagctcagtcgtagtagccggcgccggtgacaagaacaatggtatcgtggtccagcagcaaccaccatgtgtggctcgtgagcaagaccaatacatgccaatcgcaaacgtcataagaatcatgcgtaaaaccttaccgtctcacgccaaaatctctgacgacgccaaagaaacgattcaagaatgtgtctccgagtacatcagcttcgtgaccggtgaagccaacgagcgttgccaacgtgagcaacgtaagaccataactgctgaagatatcctttgggctatgagcaagcttgggttcgataactacgtggaccccctcaccgtgttcattaaccggtaccgtgagatagagaccgatcgtggttctgcacttagaggtgagccaccgtcgttgagacaaacctatggaggaaatggtattgggtttcacggcccatctcatggcctacctcctccgggtccttatggttatggtatgttggaccaatccatggttatgggaggtggtcggtactaccaaaacgggtcgtcgggtcaagatgaatccagtgttggtggtggctcttcgtcttccattaacggaatgccggcttttgaccattatggtcagtataagtgaagatggaattattcttcatttttatatctgttcaaaacatgtgtttggatagatattttatttttatgtcttatcaataacatttctatataatgttgcttctttaaggaaaagtgttgtatttcaatactttatgag

SEQ ID NO: 3895 - DNA, 2709 bp, Artificial Sequence
  P324 (35S::G634)
cggagctagagagaaagagagagtgtgtgtgtagaaaaagattgaaacatcatcaagattgatggagcaaggaggaggtggtggtggtaatgaagttgtggaggaagcttcacctattagttcaagacctcctgctaacaacttagaagagcttatgagattctcagccgccgcggatgacggtggattaggaggtggaggtggaggaggaggaggaggaagtgcttcttcttcatcgggaaatcgatggccgagagaagaaactttagctcttcttcggatccgatccgatatggattctacttttcgtgatgctactctcagagctcctctttgggaacatgtttccaggtctctcttcctctcttctcttccattttcatcaatggtgtttcttgatagagatccatttgcatgtgttttttttttgttaactttttttttttagtgttaggtatatataaatagtaatatattcgagatcaaagcatcttcaccatccccaagaaaaattaaaagaactgtttgtttattacagaagttggttcatgagtttctgggacgttttcgattttgaaaatcccaagactctctttacttccaaaaaaaaaaaaaaaaaatccgatcgaacagtaaccataaaaattttccagctaataacgacaaccaaaaataaaataaaactagagaatctgaattattttcatgtttttggaaacaggaagctattggagttaggttacaaacgaagttcaaagaaatgcaaagagaaattcgaaaacgttcagaaatattacaaacgtactaaagaaactcgcggtggtcgtcatgatggtaaagcttacaagttcttctctcagcttgaagctctcaacactactcctccttcatcttccctcgacgttactcctctctccgtcgctaatcccattctcatgccttcttcttcttcttctccatttcccgtattctctcaaccgcaaccgcaaacgcaaacgcaaccgcctcaaacgcataatgtctcttttactcctactccaccacctcttccgcttccttcaatgggtccgatatttaccggtgttactttctcgtctcatagctcatcgacggcttcaggaatggggtctgatgatgatgacgacgatatggacgttgatcaggctaacattgcgggttctagtagccgaaaacgcaaacgtggaaaccgcggtggaggcggtaaaatgatggaattgtttgaaggtttggtgagacaagtaatgcaaaagcaagcggctatgcaaaggagtttcttggaagctcttgagaagagagagcaagaacgtcttgatcgtgaagaagcttggaaacgtcaagaaatggctcggttagctcgagaacacgaggtcatgtctcaagaacgagccgcctctgcttctcgtgacgccgcaatcatttcattgattcagaaaattactggccataccattcagttacctccttctttgtcatctcaaccgcctccaccgtatcaaccgccacccgcggtcactaaacgtgtggcggaaccaccattatcaacagctcaatctcaatcacaacaaccaataatggcgattccacaacaacaaattcttcctcctcctcctccttctcatcctcacgctcatcaaccagaacagaaacaacaacaacaaccacaacaagagatggtcatgagctcggagcaatcatcattaccatcatcatcaagatggccaaaggcagagattctagcgcttataaacctgagaagtggaatggaaccaaggtaccaagataatgtacctaaaggacttctatgggaagagatctcaacttcaatgaagagaatgggatacaacagaaacgctaagagatgtaaagagaaatgggaaaacataaacaaatactacaagaaagttaaagaaagcaacaagaaacgtcctcaagatgctaagacttgtccttactttcaccgcctcgatcttctttaccgcaacaaagtactcggtagtggcggtggttctagcacttctggtctacctcaagaccaaaaacagagtccggtcactgcgatgaaaccgccacaagaaggacttgttaatgttcaacaaactcatgggtcagcttcaactgaggaagaagagcctatagaggaaagtccacaaggaacagaaaaggtacaaactttgcttttccttgtcaaaatgtgattggtttaatgttctttgataactgaaatatgatttgttggaattgaagccagaagaccttgtgatgagagagctgattcaacaacaacagcaactacaacaacaagaatcaatgataggtgagtatgaaaagattgaagagtctcacaattataataacatggaggaagaggaagatcaggaaatggatgaggaagaactagacgaggatgagaagtccgcggctttcgagattgcgtttcaaagccctgcaaacagaggaggcaatggccatacggaaccacctttcttgacaatggttcagtaaaatcagaatcattgtttcaagaaaatgtacttatgtgtgcatagttttctaaacaaaacacccaaaaacacaaaacacaaacacacacacacacacatctgacaccacaaactgaaatatcaaggtctcatcgatcttcgatttttcagtgaatacaattctttttcacattctttcccttttgtg

SEQ ID NO: 3896 - DNA, 3159 bp, Artificial Sequence
  P325 (35S::G638)
ttcccttcactatcgataattgatcttctctttcggctgaatataaatctgaaaaaatggatcaagatcagcatcctcagtacggtataccggagctccggcagctcatgaaaggcggaggaaggacgactactacaacaccgtctacttcttctcattttccctctgatttcttcggttttaaccttgctccggtgcagccaccgccacaccgtcttcatcagttcactactgatcaagatatgggtttcttgccacgtggcatacatggattgggtggaggttcttcaacggctggaaataacagtaacttaaacgcgagtactagtggtggaggagttgggtttagtgggtttcttgacggtggtggtttcggcagcggagtaggaggagacggtggaggaactggaaggtggccgagacaagaaaccctaactctgttggaaattagatctcgtcttgatcataaattcaaagaagctaatcaaaaaggacctctttgggatgaagtttctaggtttgcttcacttctcctctctcgattttaccctaatttctctctctcatcatttttcttgtttttttaaaagcaattatataaaaaaagacactatatgcatatttctcaaatcaattcataccacaagagtttgattcattcatatataatgtctctagctagttttccttctcttttttcaagataatgtctcctagtttaaacgttgatcaataatttgaagaaaattaatgatatttgtaactaaaacactaagtcgtagcttccatcttcttaacaatttttttttcaaacgttgagtattttgttgttgttgttttggattttctttcagatttgaaaagatttgacctttcatacgctttcttgttaaaaattagacctttcaagtgaaaatcccgaagacaattttaatctttttttattcttgtattaataacaagaaagaatgtgacctcaacactcttcttgggttcctcaatttaaacttactttttcagctgatctatacagacgtatatatataaatgtgttaacattctcacgtatatacgcagacacacatattgatgtataaactatagagtggtcagtttcaaacaatttctttaggagttgttttgttttggtcaagagaatgaccagaccttggcagtttcagttaagacactatcaggtgctttaaaaacccaaaagggtaaaacataaacaagagtaaaacaaaaagatttattatcttctttgactttgatttttagttttctacttttctttttactgataacttctgattcatctttcttagcttctgaagatatgtaccctcttcttttgtgtaactgagcattgaaacatgttcttgtgataaactattagtccactagtaactaagtctcaaaaacagtcttggtccgaaagttaacaactgtatgttataagaagacaaactttatgtgtgtcactatcgaatctaatatttgcatgaaaatgaatatgaatatcttatcaattgttaatgattcaagctagtttcaagattagggcactgctccgaattcaatcaaacatgagctgatttagctactttctattcttatttcttttattattatattcttaaataggattatgtccgaggaacatggataccaaaggagtgggaagaaatgcagagagaagtttgagaatctgtacaaatactataggaagactaaagaaggcaaagccggaagacaagacggaaaacattacagatttttccggcagctcgaagcgctatacggggattctaataacttggtttcttgtcccaatcataacacgcagttcatgagcagtgctcttcatggtttccatactcaaaaccctatgaacgttactacaacaacgtccaacatccataacgttgatagtgttcatggttttcatcaaagccttagtctttctaacaactacaactcctccgagcttgagctgatgacttcctcttcggaagggaatgattctagtagtagaaggaaaaagaggagttggaaagcgaagataaaggagttcattgatacgaacatgaaaaggttgatagagaggcaagatgtttggcttgagaagttgacaaaggttattgaagacaaagaggaacaacggatgatgaaagaagaggaatggaggaagattgaagctgcaaggattgataaagagcatttgttttgggctaaagagagggcgaggatggaagctagggatgttgcggtgattgaggcattgcaatacttgacaggaaagccattgataaagccgctgtgttcatccccggaagagaggacaaatggtaataatgagatccgaaacaatagtgagacacagaatgagaatggaagcgatcaaacgatgactaacaatgtttgtgttaaaggaagtagtagctgctggggtgagcaagagattttaaagcttatggagataagaacgagcatggactcgacctttcaagagatattaggagggtgctcggatgagtttctatgggaggaaatcgcagcgaagttgattcagttagggtttgatcagagaagtgccttattatgcaaggaaaagtgggaatggataagcaatggaatgaggaaagaaaagaagcaaatcaacaagaaaagaaaggataattcgtccagctgcggcgtgtactacccgagaaacgaagaaaatccaatctacaataatcgagaaagtggatataatgataatgatccgcatcaaatcaacgaacaaggcaatgtaggttcttcaacatcaaacgcaaacgcaaacgcaaacgtaaccactggaaatccgagcggtgcaatggctgctagtacaaactgcttcccgttcttcatgggagatggagatcagaatttgtgggagagttatggtttgaggctcagtaaagaagagaatcagtaagtaatttctcttaatgaagaagaagaaggtaatcatgtggttaactaattcttttgagttagctatatatgagataaaccttgacttagctattatatgtcacatgctgcttagaattaagaaatatttgttggggcttaacgaattatatatcagcatatataagatgagagtctaagaattatatcaaattaggcttt

SEQ ID NO: 3897 - DNA, 1252 bp, Artificial Sequence
  P334 (35S::G670)
cacagcattgcagctgtgaataactaaatggggagacattcttgctgttacaaacaaaagctgaggaaagggctttggtctcctgaagaagacgagaagcttcttactcacatcaccaatcacggccatggctgctggagctctgtccctaaactcgctggtttgcagagatgtgggaagagttgtcgactcgagcagatctggtaccgccgactaagatggatcaattacttgagacctgatttaaagagaggagctttttctcctgaagaagagaatctcatcgtcgaacttcatgccgtccttggaaacagatggtcacagattgcgtcaaggcttccgggtagaaccgacaacgagatcaagaatctatggaactcaagcatcaagaagaaactgaaacaaagaggcattgacccaaacacacacaagcccatctctgaagtggagagttttagcgacaaagacaaaccaacaacaagcaacaacaaaagaagcggtaacgatcacaagtctcctagttcctcttctgcgactaaccaagacttcttcctcgaaaggccatctgatttatccgactacttcggatttcagaagcttaacttcaactccaatctaggactctctgttacaactgattcttcactctgctcgatgattccgccgcagtttagccccgggaacatggttggttctgtccttcagacaccagtatgcgtaaagccctcgattagtcttcctcccgacaacaacagttcgagtcctatctccggaggagatcatgtgaaattggctgcaccaaactgggaatttcagacaaacaacaataatacctcaaatttcttcgacaatggcggattctcatggtctatcccaaattcttctacttcttcttcacaagtcaaaccaaatcataacttcgaagaaataaaatggtcagagtatttgaacacaccgttcttcatagggagtactgtacagagtcaaacctctcaaccaatctacatcaaatcagaaacagattacttagccaatgtttcaaacatgacagatccttggagccaaaacgagaacttgggcacaactgaaactagtgacgtgttctccaaggatcttcagagaatggccgtctcttttggtcagtccctttagcttttttctttctttctttcttatttctaacagatgtagagaacataaagatatacaaatacatacaatgtcaatacgtacagtggatttaagtgttctg

SEQ ID NO: 3898 - DNA, 1973 bp, Artificial Sequence
  P336 (35S::G680)
atagctgcaaccggtcctgttatggatactaatacatctggagaagaattattagctaaggcaagaaagccatatacaataacaaagcagcgagagcgatggactgaggatgagcatgagaggtttctagaagccttgaggctttatggaagagcttggcaacgaattgaagaacatattgggacaaagactgctgttcagatcagaagtcatgcacaaaagttcttcacaaagttggagaaagaggctgaagttaaaggcatccctgtttgccaagctttggacatagaaattccgcctcctcgtcctaaacgaaaacccaatactccttatcctcgaaaacctgggaacaacggtacatcttcctctcaagtatcatcagcaaaagatgcaaaacttgtttcatcggcctcttcttcacagttgaatcaggcgttcttggatttggaaaaaatgccgttctctgagaaaacatcaactggaaaagaaaatcaagatgagaattgctcgggtgtttctactgtgaacaagtatcccttaccaacgaaacaggtaagtggcgacattgaaacaagtaagacctcaactgtggacaacgcggttcaagatgttcccaagaagaacaaagacaaagatggtaacgatggtactactgtgcacagcatgcaaaactacccttggcatttccacgcagatattgtgaacgggaatatagcaaaatgccctcaaaatcatccctcaggtatggtatctcaagacttcatgtttcatcctatgagagaagaaactcacgggcacgcaaatcttcaagctacaacagcatctgctactactacagcttctcatcaagcgtttccagcttgtcattcacaggatgattaccgttcgtttctccagatatcatctactttctccaatcttattatgtcaactctcctacagaatcctgcagctcatgctgcagctacattcgctgcttcggtctggccttatgcgagtgtcgggaattctggtgattcatcaaccccaatgagctcttctcctccaagtataactgccattgccgctgctacagtagctgctgcaactgcttggtgggcttctcatggacttcttcctgtatgcgctccagctccaataacatgtgttccattctcaactgttgcagttccaactccagcaatgactgaaatggataccgttgaaaatactcaaccgtttgagaaacaaaacacagctctgcaagatcaaaccttggcttcgaaatctccagcttcatcatctgatgattcagatgagactggagtaaccaagctaaatgccgactcaaaaaccaatgatgataaaattgaggaggttgttgttactgccgctgtgcatgactcaaacactgcccagaagaaaaatcttgtggaccgctcatcgtgtggctcaaatacaccttcagggagtgacgcagaaactgatgcattagataaaatggagaaagataaagaggatgtgaaggagacagatgagaatcagccagatgttattgagttaaataaccgtaagattaaaatgagagacaacaacagcaacaacaatgcaactactgattcgtggaaggaagtctccgaagagggtcgtatagcgtttcaggctctctttgcaagagaaagattgcctcaaagcttttcgcctcctcaagtggcagagaatgtgaatagaaaacaaagtgacacgtcaatgccattggctcctaatttcaaaagccaggattcttgtgctgcagaccaagaaggagtagtaatgatcggtgttggaacatgcaagagtcttaaaacgagacagacaggatttaagccatacaagagatgttcaatggaagtgaaagagagccaagttgggaacataaacaatcaaagtgatgaaaaagtctgcaaaaggcttcgattggaaggagaagcttctacatgacagacttggaggta

SEQ ID NO: 3899 - DNA, 1530 bp, Artificial Sequence; identical to SEQ ID NO: 557
  P341 (35S::G718)

SEQ ID NO: 3900 - DNA, 513 bp, Artificial Sequence; identical to SEQ ID NO: 571
  P344 (35S::G736)

SEQ ID NO: 3901 - DNA, 1212 bp, Artificial Sequence; identical to SEQ ID NO: 575
  P345 (35S::G740)

SEQ ID NO: 3902 - DNA, 1606 bp, Artificial Sequence
  P346 (35S::G748)
agaagacggaacagaggctccaaaaaaatgatgatggagactagagatccagctattaagcttttcggtatgaaaatcccttttccgtcggtttttgaatcggcagttacggtggaggatgacgaagaagatgactggagcggcggagatgacaaatcaccagagaaggtaactccagagttatcagataagaacaacaacaactgtaacgacaacagttttaacaattcgaaacccgaaaccttggacaaagaggaagcgacatcaactgatcagatagagagtagtgacacgcctgaggataatcagcagacgacacctgatggtaaaaccctaaagaaaccgactaagattctaccgtgtccgagatgcaaaagcatggagaccaagttctgttattacaacaactacaacataaaccagcctcgtcatttctgcaaggcttgtcagagatattggactgctggagggactatgaggaatgttcctgtgggggcaggacgtcgtaagaacaaaagctcatcttctcattaccgtcacatcactatttccgaggctcttgaggctgcgaggcttgacccgggcttacaggcaaacacaagggtcttgagttttggtctcgaagctcagcagcagcacgttgctgctcccatgacacctgttatgaagctacaagaagatcaaaaggtctcaaacggtgctaggaacaggtttcacgggttagcggatcaacggcttgtagctcgggtagagaatggagatgattgctcaagcggatcctctgtgaccacctctaacaatcactcagtggatgaatcaagagcacaaagcggcagtgttgttgaagcacaaatgaacaacaacaacaacaataacatgaatggttatgcttgcatcccaggtgttccatggccttacacgtggaatccagcgatgcctccaccaggtttttacccgcctccagggtatccaatgccgttttacccttactggaccatcccaatgctaccaccgcatcaatcctcatcgcctataagccaaaagtgttcaaatacaaactctccgactctcggaaagcatccgagagatgaaggatcatcgaaaaaggacaatgagacagagcgaaaacagaaggccgggtgcgttctggtcccgaaaacgttgagaatagatgatcctaacgaagcagcaaagagctcgatatggacaacattgggaatcaagaacgaggcgatgtgcaaagccggtggtatgttcaaagggtttgatcataagacaaagatgtataacaacgacaaagctgagaactcccctgttctttctgctaaccctgctgctctatcaagatcacacaatttccatgaacagatttagagttacatatgtatatgtatatatgtatgattgattgtatgtatagatgatactggagaatgatgagtttttgagaatcaaactcttttcttctttctagtgattgcctttattcctttacatgttttggttctctgtacactatttgatttaccttttttactttctttcttcatttgtcaggaaatgttggaagataacattaatggtaaaaagttggtgtggaccgttg

SEQ ID NO: 3903 - DNA, 1069 bp, Artificial Sequence
  P352 (35S::G773)
aagtgcagatattttctttgtcctagagaaagaggtgataggaaaaatgggtctccaagagcttgacccgttagcccaattgagcttaccgccgggttttcggttttatccgactgacgaagagctgatggttgaatatctctgtagaaaagccgccggtcacgacttctctctccagctcatagctgaaatcgatctctacaagtttgatccatgggttttaccaagtaaggcgttattcggtgaaaaagaatggtattttttcagcccgagggataggaagtatccaaacgggtcaagacctaatcgggttgccgggtcgggttattggaaagccaccggtacggataaagttatctcgacggagggaagaagagttggtatcaagaaagctttggtgttttacattggaaaagctccaaaaggaaccaaaaccaattggattatgcatgagtaccgtctcatcgaaccctctcgtcgaaatggaagcaccaagcttgatgattgggttttatgtcgaatatacaaaaagcaaacaagcgcacaaaaacaagcttacaataatctaatgacgagtggtcgtgaatacagcaacaatggttcgtcgacatcttcttcgtctcatcaatacgacgacgttctcgagtcgttgcatgagattgacaacagaagtttggggtttgccgccggttcatcaaacgcgctgcctcatagtcatagaccggttttaaccaatcataaaaccgggtttcagggtttagccagggagccaagttttgattgggcgaatttgattggacagaactcggtcccggaactcggactgagtcataacgttccgagtattcgttacggtgacggtggaacgcagcaacaaactgaggggattcctcggtttaataataactcggacgtctcggctaatcagggttttagtgttgacccggttaacggatttgggtactcgggtcaacaatctagtgggttcgggtttatttgattgtgtaatggtaacgtaataagaaaaacatatttttattttttgtccgtgtcagattagttaattaat

SEQ ID NO: 3904 - DNA, 1640 bp, Artificial Sequence; identical to SEQ ID NO: 589
  P354 (35S::G776)

SEQ ID NO: 3905 - DNA, 1057 bp, Artificial Sequence; identical to SEQ ID NO: 591
  P356 (35S::G777)

SEQ ID NO: 3906 - DNA, 1389 bp, Artificial Sequence; identical to SEQ ID NO: 593
  P357 (35S::G778)

SEQ ID NO: 3907 - DNA, 1201 bp, Artificial Sequence
  P359 (35S::G784)
ctcggacaaagctgaaatccctaaagaaaaaacacttctccaaacttttcatctccgatatctctttaactaacatgtcgaataatcaagctttcatggaattgggatggagaaacgacgtcggatcacttgctgtgaaagatcagggcatgatgtcagaaagagcaagaagtgatgaagatcgtctaatcaacggtctaaaatggggctacggctactttgatcatgatcaaactgataattatcttcagattgttccagagattcataaagaagtagaaaatgcgaaggaggatttattggttgttgtccctgatgaacattctgaaactgatgatcatcatcatattaaagatttttcagagagatcagatcatcgattttatctgagaaacaaacatgagaaccccaaaaaacgtcgtatccaggtcttaagtagtgatgatgaatcggaggagtttacaagagaagttccttcagttactcgaaaaggttccaagagaagaagaagagacgagaagatgagtaataagatgcgtaagctacagcaactcgtacctaattgtcacaagacggacaaggtttcggttctcgacaagaccatagagtatatgaaaaaccttcaacttcaacttcagatgatgtcaacagtgggggtgaatccttattttcttccggcgacattaggatttggaatgcacaaccacatgctgacggcaatggcttcggctcacggcctaaatccggcgaatcacatgatgccatcgccgctaattccggcgttaaattggccattaccaccgtttactaatatttcattcccacattcatctagtcaatctctatttcttacaacatcatcaccagcttcttctcctcagtctcttcacggtttggttccttatttcccaagtttcttggatttttcttcccatgcgatgagaagactatgataagtaagtagctcgataaaagtttatgtgaaatgatcgttgactaattaagagagaaaagagttccaaattaggacagtttgtgtgaaccatttgtgtcatatacttttttttccgggtggttttgtatattaataataatcaataagttaaaactttttgtataaattcttgcatgtaacaatttttttcatttatctgatattttgtaaaatatattgagacatgcttataagagcaaaaaaaaa

SEQ ID NO: 3908 - DNA, 1107 bp, Artificial Sequence; identical to SEQ ID NO: 603
  P363 (35S::G791)

SEQ ID NO: 3909 - DNA, 1009 bp, Artificial Sequence; identical to SEQ ID NO: 609
  P366 (35S::G801)

SEQ ID NO: 3910 - DNA, 1604 bp, Artificial Sequence; identical to SEQ ID NO: 611
  P367 (35S::G802)

SEQ ID NO: 3911 - DNA, 1231 bp, Artificial Sequence; identical to SEQ ID NO: 613
  P370 (35S::G805)

SEQ ID NO: 3912 - DNA, 1134 bp, Artificial Sequence; identical to SEQ ID NO: 641
  P379 (35S::G861)

SEQ ID NO: 3913 - DNA, 1149 bp, Artificial Sequence
  P380 (35S::G864)
ttataaacacacagagagaaacaaagtcacagtctcgagtcaaaaacagagaatacgaaagaaaaatggaagcggagaagaaaatggttctaccgagaatcaaattcacagagcacaaaaccaacacgacaacaatcgtatcggagttaaccaacactcaccaaaccaggattcttcgtatctcagtcactgacccagacgctactgattcctccagtgacgacgaagaagaagaacatcaacgctttgtctctaaacgccgtcgtgttaagaagtttgtcaacgaagtctatctcgattccggtgctgttgttactggtagttgtggtcaaatggagtcgaagaagagacaaaagagagcggttaaatcggagtctactgtttctccggttgtttcagcgacgacgactacgacgggagagaagaagttccgaggagtgagacagcgtccatggggaaaatgggcggcggagataagagatccgttgaaacgtgtacggctctggttaggtacttacaacacggcggaagaagctgctatggtttacgataacgccgctattcagcttcgtggtcccgacgctctgactaatttctcagtcactccgacaacagcgacggagaagaaagccccaccaccgtctccggtgaagaagaagaagaagaaaaacaacaaaagcaaaaaatccgttactgcttcttcctccatcagcagaagcagcagcaacgattgtctctgctctccggtgtctgttctccgatctcctttcgccgtcgacgaattctccggcatttcttcatcaccagtcgcggccgttgtagtcaaggaagagccatccatgacaacggtatctgaaactttctctgatttctcggcgcccttgttctcagatgatgacgtgttcgatttccggagctcagtggttcccgactatctcggcggcgatttatttggggaagatctattcacggcggatatgtgtacggatatgaacttcggattcgatttcggatccggattatccagctggcacatggaggaccattttcaagatatcggggatctattcgggtcggatcctcttttagctgtttaataatattttaaataaataaatagttataccggccgttactaaacggaaccgg

SEQ ID NO: 3914 - DNA, 1126 bp, Artificial Sequence; identical to SEQ ID NO: 645
  P381 (35S::G865)

SEQ ID NO: 3915 - DNA, 1198 bp, Artificial Sequence; identical to SEQ ID NO: 647
  P382 (35S::G866)

SEQ ID NO: 3916 - DNA, 1281 bp, Artificial Sequence; identical to SEQ ID NO: 15
  P383 (35S::G867)

SEQ ID NO: 3917 - DNA, 1201 bp, Artificial Sequence
  P384 (35S::G869)
cgcttaagacccaaaaggacttgttctagtgttgaagtctttgggggttttcacataaagcagcaaaagttttcttttttcatagttcgctgagagttttgagttttgataccaaaaaagttttgaccttttagagtgattttttgttctttctgttttctgggtatttttgaggagtgggtttaacaatggttgcgattagaaaggaacagtctttgagtggtgttagtagcgagattaagaagagagctaagagaaacactctatcgtcccttcctcaagaaacccaacctttgaggaaagtccgtattattgtgaatgatccttatgctactgatgattcctctagtgatgaggaagagcttaaggttcctaagccaaggaaaatgaaacgtatcgttcgtgagattaactttccttctatggaagtttctgaacagccttctgagagttcttctcaggacagtactaaaactgatggcaagatagctgtgtcagcttctcctgctgttcctaggaagaagcctgttggtgttaggcaaaggaaatgggggaaatgggctgctgagattagagatcctattaagaaaactaggacttggttgggtacttttgatactcttgaagaagctgctaaagcttatgatgctaagaagcttgagtttgatgctattgttgctggaaatgtgtccactactaaacgtgatgtttcttcatctgagactagccaatgctctcgttcttcacctgttgttcctgttgagcaagatgacacttctgcatcagctctcacttgtgtcaacaaccctgatgacgtctcgaccgttgctccaactgctccaactccaaatgttcctgctggtggaaacaaggaaacgttgttcgatttcgactttactaatctacagatccctgattttggtttcttggcagaggagcaacaagacctagacttcgattgtttcctcgcggatgatcagtttgatgatttcggcttgcttgatgacattcaaggattcgaagataacggtccaagtgcgttaccagatttcgactttgcggatgttgaagatcttcagctagctgactctagtttcggtttccttgatcaacttgctcctatcaacatctcttgcccattaaaaagttttgcagcttcataggatcttgcttagtaatgttaagtgagaagagtgttttg

SEQ ID NO: 3918 - DNA, 675 bp, Artificial Sequence
  P385 (35S::G872)
ccggaaacagaatccaattcaaccaaaccgaatcgaaccgaaccggagtttttatccaatggtgaagcaagcgatgaaggaagaggagaagaagagaaacacggcgatgcagtcaaagtacaaaggagtgaggaagaggaaatggggaaaatgggtatcggagatcagacttccacacagcagagaacgaatttggttaggctcttacgacactcccgagaaggcggcgcgtgctttcgacgccgctcaattttgtctccgcggcggcgatgctaatttcaatttccctaataatccaccgtcgatctccgtagaaaagtcgttgacgcctccggagattcaggaagctgctgctagattcgctaacacattccaagacattgtcaagggagaagaagaatcgggtttagtacccggatccgagatccgaccagagtctccttctacatctgcatctgttgctacatcgacggtggattatgatttttcgtttttggatttgcttccgatgaatttcgggtttgattccttctccgacgacttctctggcttctccggtggtgatcgatttacagagattttacccatcgaagattacggaggagagagtttattagatgaatctttgattctttgggatttttgaattcccaaacataatatttttttagagcg

SEQ ID NO: 3919 - DNA, 1152 bp, Artificial Sequence; identical to SEQ ID NO: 657
  P388 (35S::G881)

SEQ ID NO: 3920 - DNA, 1195 bp, Artificial Sequence; identical to SEQ ID NO: 659
  P389 (35S::G883)

SEQ ID NO: 3921 - DNA, 724 bp, Artificial Sequence
  P393 (35S::G912)
catcttatccaaagaaaaaatgaatccattttactctacattcccagactcgtttctctcaatctccgatcatagatctccggtttcagacagtagtgagtgttcaccaaagttagcttcaagttgtccaaagaaacgagctgggaggaagaagtttcgtgagacacgtcatccgatttacagaggagttcgtcagaggaattctggtaaatgggtttgtgaagttagagagcctaataagaaatctaggatttggttaggtacttttccgacggttgaaatggctgctcgtgctcatgatgttgctgctttagctcttcgtggtcgctctgcttgtctcaatttcgctggttctgcttggcggcttcgtattcctgagactacttgtcctaaggagattcagaaagctgcgtctgaagctgcaatggcgtttcagaatgagactacgacggagggatctaaaactgcggcggaggcagaggaggcggcaggggagggggtgagggagggggagaggagggcggaggagcagaatggtggtgtgttttatatggatgatgaggcgcttttggggatgcccaacttttttgagaatatggcggaggggatgcttttgccgccgccggaagttggctggaatcataacgactttgacggagtgggtgacgtgtcactctggagttttgacgagtaattttttggctctttttctggataataagtt

SEQ ID NO: 3922 - DNA, 1057 bp, Artificial Sequence
  P396 (35S::G921)
ccaagatcgactcttacttcgaatctctctcaactttcttcctcagcttacgggaacttccacacatatacatccacaagaacccatatcgaagattcatcctacatatatttacatggatcagtactcatcctctttggtcgatacttcattagatctcactattggcgttactcgtatgcgagttgaagaagatccaccgacaagtgctttggtggaagaattaaaccgagttagtgctgagaacaagaagctctcggagatgctaactttgatgtgtgacaactacaacgtcttgaggaagcaacttatggaatatgttaacaagagcaacataaccgagagggatcaaatcagccctcccaagaaacgcaaatccccggcgagagaggacgcattcagctgcgcggttattggcggagtgtcggagagtagctcaacggatcaagatgagtatttgtgtaagaagcagagagaagagactgtcgtgaaggagaaagtctcaagggtctattacaagaccgaagcttctgacactaccctcgttgtgaaagatgggtatcaatggaggaaatatggacagaaagtgactagagacaatccatctccaagagcttacttcaaatgtgcttgtgctccaagctgttctgtcaaaaagaaggttcagagaagtgtggaggatcagtccgtgttagttgcaacttatgagggtgaacacaaccatccaatgccatcgcagatcgattcaaacaatggcttaaaccgccacatctctcatggtggttcagcttcaacacccgttgcagcaaacagaagaagtagcttgactgtgccggtgactaccgtagatatgattgaatcgaagaaagtgacgagcccaacgtcaagaatcgattttccccaagttcagaaacttttggtggagcaaatggcttcttccttaaccaaagatcctaactttacagcagctttagcagcagctgttaccggaaaattgtatcaacagaatcataccgagaaatagtttagcttcaaattccgttagagtttttagatt

SEQ ID NO: 3923 - DNA, 1388 bp, Artificial Sequence
  P398 (35S::G926)
ccaaaatctagggttttcttctcgcccaatttcacttttcttctacgaaattctccattcctgccggctgtcgggttttctgaatcgattctccttcaccaacttcttctctggttctgttcgattctgattttttttcaaggtcaattttttcttctctttaaactctgcaaaatcgtgatcgattaaattcacctcagggttttttgatttctgaaagaagttaatcttcttcgaaggcgattgcaaaagagtgctctgctgtgaatttccactgagatgcaatcaaaaccgggaagagaaaacgaagaggaagtcaataatcaccatgctgttcagcagccgatgatgtatgcagagccctggtggaaaaacaactcctttggtgttgtacctcaagcgagaccttctggaattccatcaaattcctcttctttggattgccccaatggttccgagtcaaacgatgttcattcagcatctgaagacggtgcgttgaatggtgaaaacgatggcacttggaaggattcacaagctgcaacttcctctcgttcagataatcacggaatggaaggaaatgacccagcgctctctatccgtaacatgcatgatcagccacttgtacaaccaccagagcttgttggacactatatcgcttgtgtcccaaacccatatcaggatccatattatgggggattgatgggagcatatggtcatcagcaattgggttttcgtccatatcttggaatgcctcgtgaaagaacagctctgccacttgacatggcacaagagcccgtttatgtgaatgcaaagcagtacgagggaattctaaggcgaagaaaagcacgtgccaaggcagagctagagaggaaagtcatccgggacagaaagccatatcttcacgagtcaagacacaagcatgcaatgagaagggcacgagcgagtggaggccggtttgcgaagaaaagtgaggtagaagcgggagaggatgcaggagggagagacagagaaaggggttcagcaaccaactcatcaggctctgaacaagttgagacagactctaatgagaccctgaattcttctggtgcaccataataaaaaaagccaaagctctgagaggagagagagacacacactttggctaatataatccattgcctcaaaccggcaaatcattcttggctttttcgtttttgtgtttgctagttgttcttgtcagagtctcatattgtgtgggtttaacagttatgatgaatgtacaaagagcgagttatgttaggtgttagattttggagacaagagacaaaggaatagcaagtaggtcttgtttttattctttgaccttttttttctcttttgcaaaattgaaaaatacgtttgcttaaaaa

SEQ ID NO: 3924 - DNA, 953 bp, Artificial Sequence; identical to SEQ ID NO: 697
  P399 (35S::G929)

SEQ ID NO: 3925 - DNA, 1491 bp, Artificial Sequence
  P400 (35S::G932)
ccacttgtacctctttgtcttaagtactctttaaccctacaatttcctaagctctcaagccacaaaaaaccacaaaccgttcttcaccaatatatatatctgatcatcatcaaagtccttctctctgctcataccacaaaccgttccattcttcccctaatcacaaagtgatatttacatagagaagatagagatgggaagaccaccatgctgtgacaagattggagtgaagaaaggaccatggacaccagaggaagatatcatcttggtttcttacatccaagaacatggtcctggaaactggagatctgtgcctactcacacaggtttgaggagatgtagcaaaagctgtagattgaggtggactaattatcttcgacctgggatcaagcgtggaaatttcaccgagcatgaagagaagatgattctccatcttcaagctcttttgggaaacaggtgggcagctatagcatcatatcttccagaaaggacagacaatgatataaagaactattggaacactcatttgaagaaaaagctcaagaagatgaatgattcttgtgatagtactatcaacaatggccttgataataaagacttctccatatcaaacaaaaacactacctcacatcaaagcagcaactccagtaaaggtcaatgggagagaaggcttcagacagatatcaacatggctaaacaagctctttgtgatgccttgtctattgacaaaccacaaaacccaactaatttttctattcccgatcttggttatggtccatcatcttcttcgtcctctaccaccaccaccaccaccaccaccaccacgagaaacactaatccatacccatctggggtctatgcttcaagtgctgagaacattgctcgtttgcttcagaattttatgaaagacacaccaaagacctcggtgcccttgccggttgcagccaccgagatggctatcaccacggcagcttcgagccctagcacaaccgaaggagacggagaagggattgaccattctttgttcagcttcaactccatagatgaagctgaagagaagcctaaactaatagaccatgacattaatggtctaattacacaaggctctctttctttgttcgagaaatggctctttgatgagcaaagccacgatatgatcatcaataacatgtcactagagggtcaggaagtgttgttctagaaagcattaaagtttgacgatttgcttgaggaaccacgaggcttagttataaacaatttgtataattaagtactctttagttttgttttcaatccttattatgatcatattgcagtaattagggattttagtctttagtagtaactcttaagttttaacacatttttctctatctttttagtagtaactctttattttttccttaaatctttgtcgacgtggagatgatatcttctatgtagtagaaactcaaaagtgtacatcatctttattaatgtaacgtcttttta

SEQ ID NO: 3926 - DNA, 1755 bp, Artificial Sequence; identical to SEQ ID NO: 705
  P401 (35S::G938)

SEQ ID NO: 3927 - DNA, 1592 bp, Artificial Sequence
  P402 (35S::G939)
cagattctatggatatgtataacaacaatatagggatgttccggagtttagtttgtagctcggcgcctccatttacagagggacatatgtgttctgattcgcatacggctttgtgcgatgatctgagtagtgatgaggaaatggaaatagaggagcttgagaagaagatctggagagacaagcagcgtttaaagcggctcaaggaaatggcgaagaacggtctaggaacaagattgttgttgaagcagcaacatgatgattttccagagcactctagtaagagaaccatgtacaaggcacaagatgggatcttgaagtacatgtcgaagacaatggagcgatataaagctcaaggttttgtttatgggattgtgttagagaatgggaaaacggtagcgggatcttctgataatctccgtgaatggtggaaagacaaagtgaggtttgataggaacggcccagctgctataatcaagcaccaaagggatatcaatctttctgatggaagtgattcagggtctgaggttggggattctaccgcacagaagttgcttgagcttcaagatactactcttggagctctgttatcggctctgtttcctcactgcaaccctcctcagaggcggtttccgttggagaaaggcgtgacaccgccatggtggccaacggggaaagaagattggtgggatcaactgtctttacccgttgattttcgaggtgttccgccaccttacaagaagcctcatgatctcaagaagctgtggaaaattggtgttttgattggtgtaatcagacatatggcttctgacattagcaacatacccaatctcgtgagacggtctagaagtttgcaggagaaaatgacgtcaagagaaggcgctttatggctcgctgctctttaccgagaaaaggctattgttgatcaaatagccatgtctagagaaaacaacaacacttctaactttcttgttcctgcaaccggtggagacccagatgttttgtttcctgaatctacagactatgatgttgaactgattggtggcactcatcggaccaatcagcagtatcctgaatttgaaaacaactacaactgtgtttacaagagaaagtttgaagaagattttgggatgccaatgcatccaacactcctaacatgtgagaacagtctctgtccttatagccaaccacatatgggatttcttgacaggaacttaagagagaatcaccaaatgacttgtccttataaagtcacttccttctaccaaccaactaaaccctatggtatgacgggtttaatggttccttgtccggattataacgggatgcagcagcaggttcagagctttcaagaccagtttaatcatcccaacgatctctacagaccaaaagctccacaaagaggcaacgatgacttggttgaggatttgaatccttctccttcgacgctgaatcagaatcttggtttagtcttacctactgacttcaatggaggtgaggaaacagtaggaacagagaacaatctgcataatcaagggcaagagttgcccacatcttggattcagtaaagaaagcttcagagttttctttttatg

SEQ ID NO: 3928 - DNA, 1983 bp, Artificial Sequence; identical to SEQ ID NO: 723
  P405 (35S::G965)

SEQ ID NO: 3929 - DNA, 686 bp, Artificial Sequence
  P408 (35S::G975)
attactcatcatcaagttcctactttctctctgacaaacatcacagagtaagtaagaatggtacagacgaagaagttcagaggtgtcaggcaacgccattggggttcttgggtcgctgagattcgtcatcctctcttgaaacggaggatttggctagggacgttcgagaccgcagaggaggcagcaagagcatacgacgaggccgccgttttaatgagcggccgcaacgccaaaaccaactttcccctcaacaacaacaacaccggagaaacttccgagggcaaaaccgatatttcagcttcgtccacaatgtcatcctcaacatcatcttcatcgctctcttccatcctcagcgccaaactgaggaaatgctgcaagtctccttccccatccctcacctgcctccgtcttgacacagccagctcccatatcggcgtctggcagaaacgggccggttcaaagtctgactccagctgggtcatgacggtggagctaggtcccgcaagctcctcccaagagactactagtaaagcttcacaagacgctattcttgctccgaccactgaagttgaaattggtggcagcagagaagaagtattggatgaggaagaaaaggttgctttgcaaatgatagaggagcttctcaatacaaactaaatcttatttgcttatatatatgtacctat

SEQ ID NO: 3930 - DNA, 838 bp, Artificial Sequence
  P409 (35S::G976)
cttatatataacaaataaacacataagttgacatatatactatatacaagtatattaattatacatatatggctgaccctaacaatcctatcactgaacctaaagctataatccaatcttctacttcatcgtcagttactattgtgccagttcccacgtgcggtgacagcctctctgactctgccacgtgtgaaaacccttgtccacttgatactatcactactactactactactgtttgttttgcggctccttcttctactgcaagtggtaatgatattaatactttaatggccactgacaccgacatctctcgccggaaaaagaatccggtttatcggggaattcgttgtcggagtggaaaatgggtgtctgaaatccgagagcctaaaaagactacacgtgtctggcttgggacttatccgacgccggagatggctgctgccgcatatgacgtggcggcgttagctcttaaaggtggagacactctcttgaacttcccggattccctgggatcttaccccattcccctttcctcttccgcagctcatatcagatgcgctgcagctgcggctgctgcgactaggggtgcggctggagcggccgtgaaggtaggtcaaaagaaggaagataaagtttatgatacggcggaatcttcaactatggggtttgtggatgaagaagagctattgaacatgcctggtttgctagcggatatggccaaagggatgatggtggctccaccgtggatgggatctccaccgtcagatgattcgccagagaattctgatggagagagcttgtggagctattgatcgattgaaagcagtttaatatc

SEQ ID NO: 3931 - DNA, 913 bp, Artificial Sequence; identical to SEQ ID NO: 751
  P417 (35S::G1006)

SEQ ID NO: 3932 - DNA, 813 bp, Artificial Sequence; identical to SEQ ID NO: 763
  P424 (35S::G1020)

SEQ ID NO: 3933 - DNA, 1236 bp, Artificial Sequence
  P426 (35S::G1023)
cttgttctggggtaaaggacttttcttgttcttgagagagttcattttgaggcttttctgggaattttgagaggttttttagggtttaagggggtttggttttgaatttcgcacaccaagtgttcgataaaatggctgaacgaaagaaacgctcttctattcaaaccaataaacccaacaaaaaacccatgaagaagaaaccttttcagctaaatcacctcccaggtttatctgaagatttgaagactatgagaaaactccgtttcgttgtgaatgatccttacgctactgactactcatcaagcgaagaagaagaaaggagtcagagaaggaaacgttatgtctgtgagatcgatcttcctttcgctcaagctgctactcaagcagaatctgaaagctcatattgtcaggagagtaacaataatggtgtaagcaagactaaaatctcagcttgtagcaaaaaggttttacgcagcaaagcatctccggtcgttggacgttcttctactactgtctcgaagcctgttggtgttaggcagaggaaatggggtaaatgggctgctgagattagacatccaatcaccaaagtaagaacttggttgggtacttacgagacgcttgaacaagcagctgatgcttatgctaccaagaagcttgagtttgatgctctggctgcagccacttctgctgcttcctctgttttgtcaaatgagtctggttctatgatctcagcctcagggtcaagcattgatcttgacaagaagctagttgattcgactcttgatcaacaagctggtgaatcgaagaaagcgagttttgatttcgactttgcagatctacagattcctgaaatgggttgcttcattgatgactcattcatcccaaatgcttgtgagcttgattttctcttaacagaagagaacaacaaccaaatgttggatgattactgtggcatagatgatctggacatcattggtcttgaatgtgacggtccaagcgaacttccagactatgatttctcagatgtggagatcgatcttggtctcattggaaccaccattgacaagtatgctttcgttgatcatatcgcaacaactactcccactcctcttaatatcgcgtgcccataagttttgcagctaggtgttattattagctataggagcaacgtaaaaagctcgttgttactcggttttgtcttaagttattaaagtatagcagaggcagttaatctca

SEQ ID NO: 3934 - DNA, 1057 bp, Artificial Sequence; identical to SEQ ID NO: 773
  P432 (35S::G1040)

SEQ ID NO: 3935 - DNA, 1606 bp, Artificial Sequence; identical to SEQ ID NO: 799
  P444 (35S::G1068)

SEQ ID NO: 3936 - DNA, 965 bp, Artificial Sequence
  P448 (35S::G1073)
ctgcctctacagagacctgaagattccagaaccccacctgatcaaaaataacatggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttagagttttagcgttttggtgacaccttttgttgcgtttgcgtgtttgacctcaaactactaggctactagctatagcggttgcgaaatgcgaatattaggtt

SEQ ID NO: 3937 - DNA, 1084 bp, Artificial Sequence
  P450 (35S::G1075)
tttgtgtttggtgttggcatggctggtctcgatctaggcacaacttctcgctacgtccacaacgtcgatggtggcggcggcggacagttcaccaccgacaaccaccacgaagatgacggtggcgctggaggaaaccaccatcatcaccatcataatcataatcaccatcaaggtttagatttaatagcttctaatgataactctggactaggcggcggtggaggaggagggagcggtgacctcgtcatgcgtcggccacgtggccgtccagctggatcgaagaacaaaccgaagccgccggtgattgtcacgcgcgagagcgcaaacactcttagggctcacattcttgaagttggaagtggctgcgacgttttcgaatgtatctccacttacgctcgtcggagacagcgcgggatttgcgttttatccgggacgggaaccgtcactaacgtcagcatccgtcagcctacggcggccggagctgttgtgactctgcggggtacttttgagattctttccctctccggatcttttcttccgccacctgctcctccaggggcgactagcttgacgatattcctcgctggagctcaaggacaggtcgtcggaggtaacgtagttggtgagttaatggcggcggggccggtaatggtcatggcagcgtcttttacaaacgtggcttacgaaaggttgcctttggacgagcatgaggagcacttgcaaagtggcggcggcggaggtggagggaatatgtactcggaagccactggcggtggcggagggttgcctttctttaatttgccgatgagtatgcctcagattggagttgaaagttggcaggggaatcacgccggcgccggtagggctccgttttagcaatttaagaaactttaattgttttttccacttttttgtttttctccgaattttatgaaattatgatttaagaaaaaaaacgatattgttcatgtattgaccctcttactgcatggtttcttctattgggttaattgactagctcataagaattgtttaatttggttattgtcatcaaatttgcccacatataaagcttctagcaaat

SEQ ID NO: 3938 - DNA, 1342 bp, Artificial Sequence; identical to SEQ ID NO: 805
  P452 (35S::G1076)

SEQ ID NO: 3939 - DNA, 2652 bp, Artificial Sequence
  P453 (35S::G1079)
cgatttcgatttgagtttgttaagtgataagagtctgaagaaatgggttgtgctgcttcaagaattgataatgaagaaaaggttttagtgtgtaggcagagaaagaggctaatgaaaaagttattagggttcaggggagaatttgcagatgcacagttggcttatcttagagctttgaggaacactggtgttactcttaggcaattcactgagtctgagaccttggagcttgaaaacactagttatggtttaagtttgcctttgcctccttcgcctcctcctacattgcctccttcacctccaccacctcctccatttagcccggatttgagaaatcctgagactagtcatgacttggctgatgaggaggaagagggtgaaaatgatggtggtaatgatggaagtggtgcagctcctccgcctccattgccgaattcttggaacatttggaacccttttgagtcacttgagctgcatagtcatccaaatggtgacaatgtagttacacaagttgaactgaagaagaaacaacaaattcagcaagctgaagaggaagattgggcggagacgaagtctcaatttgaggaagaagatgagcaacaagaagcaggaggtacttgccttgatttgagtgttcatcaaatagaggctgttagtggctgtaacatgaagaagccacgtcgtctgaagtttaagctgggagaagttatggacggtaactcatctatgacaagctgctccggtaaagatcttgagaaaactcatgtgactgattgtagaatcaggaggaccttagaaggaatcatcagagagttggatgattattttcttaaagcatcgggttgcgagaaggagatagctgtgatagtagacatcaacagtagggatactgttgatcctttcaggtaccaggaaacaagaagtaagtgactgactgagatttttaatcttttttgatgttggaccaactacagattttgatttgtgttcataagcataaacaatttgttgtacatattataatacttatgtggctcgcagggaagagaagcagctcggcaaaggtattcagtgcattgtcatggagttggtcttcaaagtctcttcagttgggcaaagatgctacaacaagcgggactgttgaaccctgtaggcctggagctcactgcagcacacttgagaagctatacacagctgagaagaaactttaccagctagtcagagtaagagctagctgatctaactctttcggtgttagattatcaagttcaacaatgaaatactaagttttattctctgaccagaacaaagagattgccaaagtggagcatgagaggaagtctgcattactgcaaaagcaagatggggaaacctatgatttgagcaaaatggagaaagcacgcttgtctttggagagtttggaaaccgagatacagcgtctagaagattccataactacaacacgctcatgtttgcttaacttgatcaatgatgagctgtatccgcagctagttgctttaacttcagggtaaactccacaaccactcttatgctgaccatctcattgaaaagcattttttttatgcgatttgcatatgtcgcttctcaagattgatttggtcttaatatgtgcaggctagcacagatgtggaaaacaatgctcaagtgtcatcaagttcaaattcatatatcccagcaactgaaccatcttccggattacccgagtatagatctcagttcggaatacaaacgccaggcggttaatgaactagagaccgaggttacttgctggtacaatagcttttgcaagttagtaaattcccagcgagaatacgtgaaaacactctgtacgtggatccaacttactgatcgcctctctaacgaagacaaccaaagaagtagcttgcctgttgctgctcgtaagctctgcaaagagtggcagcttgtatttgaaaagcttcctgataaggttcttctatcacttgcagcttatttgtattattctagttcatggctctatgaaagccatctttaatacgtgcaaatgcaactgttttgggtggcgtaggtaacttcagaggccattaaaagctttctgatgtcaattaaatctattattcatcaacaagctgaggaatacaacctgcgtaggaaatgcaataaacttgagaggaggcttgagaaagagctaatttcactggctgagattgaaagaaggctcgaggggattttagcaatggaagaggaggaagtaagctcaacgagtttgggctctaagcatccgttgtcaatcaaacaagccaagatcgaagccttgagaaaacgagtggatattgagaaaactaagtacttaaactcggtcgaggttagtaagagaatgacactagacaacctcaaatcaagccttcccaatgtctttcagatgttgactgctctagctaatgtctttgccaatgggtttgaatccgttaatggccaaaccggtacagatgtttccgacacatcccaacattccgatgaatctcaaccctaagaaaagacctcattccctttttgatgtttgtttctttcttggtgcttcagtgaagaggtttttgtatatgaatgactgtaagagaaactcaacttaacaactttgtccagctccaaaat

SEQ ID NO: 3940 - DNA, 838 bp, Artificial Sequence; identical to SEQ ID NO: 817
  P458 (35S::G1090)

SEQ ID NO: 3941 - DNA, 1322 bp, Artificial Sequence; identical to SEQ ID NO: 831
  P466 (35S::G1133)

SEQ ID NO: 3942 - DNA, 925 bp, Artificial Sequence
  P467 (35S::G1134)
cgtagtgtctattgaaaccagagaaaagccaaaggggatgcaaccaacatccgtcggtagtagcggcggtggtgacgacggaggaggcagaggaggaggaggagggctaagtagaagtggactatctcggatccgttcagctccagcgacttggcttgaagctttacttgaggaagatgaagaagagtctttgaaacctaatcttggtctcaccgatttgcttaccgggaactcgaacgatttaccgacaagtcgcggctcgttcgagttcccgattcctgttgagcaagggttgtatcaacaaggtgggtttcaccgacagaatagtactccggcggattttcttagtggttctgatggatttatccaaagctttgggattcaggcgaattacgattacttatcggggaatatcgatgtttctccgggaagtaagcggtctagagaaatggaagcactcttctcttctcctgagtttacttctcaaatgaaaggagagcaaagcagcggtcaagttcctaccggagtatcaagcatgtcggatatgaacatggagaaccttatggaggactctgttgcttttagggttcgggctaaacgtggttgcgcaactcatccccgcagcattgccgagagggtacgaaggacgcggattagtgatcggataaggaagctacaagagcttgtacctaacatggacaagcaaaccaacactgcagacatgttagaagaagcagtagaatacgtgaaagttcttcaaaggcagatccaggagttaacagaagaacagaagaggtgcacatgcatacctaaggaagaacaataaggtttgctcctgatttgttttatatttgcttaacggcaatgatctgatcgaaaaattcgaaagatgatcttagcttgaatttagatggatgtcatgttg

SEQ ID NO: 3943 - DNA, 1239 bp, Artificial Sequence; identical to SEQ ID NO: 851
  P471 (35S::G1181)

SEQ ID NO: 3944 - DNA, 859 bp, Artificial Sequence; identical to SEQ ID NO: 883
  P483 (35S::G1266)

SEQ ID NO: 3945 - DNA, 1166 bp, Artificial Sequence; identical to SEQ ID NO: 887
  P484 (35S::G1269)

SEQ ID NO: 3946 - DNA, 748 bp, Artificial Sequence; identical to SEQ ID NO: 893
  P486 (35S::G1275)

SEQ ID NO: 3947 - DNA, 911 bp, Artificial Sequence; identical to SEQ ID NO: 897
  P487 (35S::G1277)

SEQ ID NO: 3948 - DNA, 1619 bp, Artificial Sequence
  P701 (35S::G1314)
cttcaattcactaacgagagaaatgggaagagctccgtgttgcgacaagacaaaagtgaagcgagggccttggtcgcctgaagaagactctaaacttagagattacattgaaaagtatggtaatggtggaaattggatctctttccccctcaaagccggtaagttcatacacatgttcttaatcctagataaccttttcgagcttctaagcccaaataagagcttatgccattctttgttgtggtttaaggtttgaggagatgtgggaagagttgtagactgaggtggctaaactatttgagaccaaacataaagcatggtgacttctctgaggaagaagacaggatcatttttagtctcttcgctgccataggaagcaggttctctaattaattccttttgaaatcatctttaatcatataagatccttacaaaaaatgtagaaatgaaatcattttttcgcccacttgcctgtgaaggccctttcatagttatctgcttagataggtttaaagaaaatattaattcacactctccttcaattaatcttataatagtaacaaaatttctcctaaatctaattttgaatttatgtgttattttgaagtaatgatcaaaatatttccaaacgtgcttaatttcttcataaatctagtcaaaatcacgagctacattgattccatgatttagtcaaaactacgagcaactttaattcatcaagagtgctatacttttctccaatattagctattaatatacatcaattgaaacttgtaggtggtcaataatagcagctcatctaccgggacgaacagacaacgacataaaaaactattggaacacaaagctaaggaagaaactcttgtcttcttcctctgattcatcatcatcagccatggcttctccttatctaaaccctatttctcaggatgtgaaaagaccaacctcaccaacaacaatcccatcttcttcttacaatccgtatgctgaaaaccctaatcaatacccaacaaaatccctcatctccagcatcaatggcttcgaagctggtgacaaacagataatttcctatattaaccctaattatcctcaagatctctatctctcggacagcaacaacaacacctcgaacgcaaatggtttcttgctcaaccacaatatgtgtgatcagtacaagaaccacaccagtttttcttcagacgtcaatgggataagatcagagattatgatgaagcaagaagagataatgatgatgatgatgatagaccaccacattgaccagaggacaaaagggtacaatggggaattcacacaagggtattataattactacaatgggcatggggatttgaagcaaatgattagtggaacaggcactaattctaacataaacatgggtggttcaggttcatcttctagttcgataagcaacctagctgagaacaaaagcagtggtagcctcctactagaatacaaatgcttgccctatttctactcctagttcttctagactctcttgtcttcttatataaatatatcttggactgactgttagtaatatcaaagatttgatggggtatgggaggagagagaatgagatagagagcgactatgatcag

SEQ ID NO: 3949 - DNA, 971 bp, Artificial Sequence
  P703 (35S::G1317)
actccacttggctcttcgattttttctatctaaataacagaaccaaatcattatcgaaatttaaagttgtgcgaaacaaaacaaagatgggaagatcaccttgttgtgataaaaatggagtgaagaagggaccatggactgctgaggaggatcagaaactcatcgattatattcgatttcatggtcctggcaattggcgtacgctccccaaaaatgctggactccatagatgtggaaaaagctgccgtcttcgatggaccaattatctaagaccggacatcaagagaggaagattctcgttcgaggaagaagaaactatcattcagctacacagtgttatgggaaacaagtggtcagcaatagccgctcgtctaccagggaggaccgataacgaaataaaaaaccattggaacactcacatccgcaagagacttgtaaggagtggtatcgaccctgttactcattctccacgccttgatcttcttgatttgtcctcacttttgagtgcacttttcaaccagccaaacttttcagcagttgcaacacatgcgtcttctcttcttaatcctgatgtattgaggttggcctctctactactgccacttcaaaaccctaatccagtttacccatcgaacctcgaccaaaatcttcaaactccaaatacatcatcagaatcgtctcaaccacaagctgagactagtacagtcccaacaaactatgaaacttcatcattggagcctatgaacgcaagactcgacgacgttggtcttgcagatgtattaccacctttgtcagagagttttgacttagactcgctcatgtcaacgccaatgtcttctccacgacaaaatagcattgaagcagaaaccaactccagcactttcttcgactttggaattccggaagatttcatcttagatgactttatgttttaattttcaacatttgcatacacatgtcttgctttcaca

SEQ ID NO: 3950 - DNA, 1002 bp, Artificial Sequence
  P707 (35S::G1324)
agtatggaaaattcgatgaagaagaagaagagcttcaaagaaagtgaagatgaagaactaagaagagggccttggactttggaggaagacacacttctcacaaattacatcctccataacggtgagggtcgttggaatcacgtcgccaaatgtgctgggctaaagagaactgggaaaagttgtagattgagatggttgaattacttgaaacccgacataagacgagggaatcttactcctcaagaacagcttttgatccttgagcttcactctaaatggggtaataggtggtccaagattgcacagtacttgccaggaagaacggataacgagatcaagaactattggagaacaagagttcaaaaacaagctcgtcaactcaacatcgaatctaacagcgacaagttctttgacgctgttcgtagtttttgggtccctagattgatcgagaagatggaacaaaactcatccactactactacttattgttgtccccaaaacaacaacaacaactctcttcttcttccttctcaatctcacgactctttaagtatgcaaaaagatatagattactcgggtttcagcaacatagacggttcttcttcaacttctacttgcatgtctcatctaacaacagttccacactttatggatcaaagcaacaccaatatcatcgatggctcgatgtgtttccatgaaggcaatgttcaagaattcggaggatatgttcctggcatggaggattacatggtaaactcggacatctcaatggaatgtcacgtggcggatggttattcagcgtacgaggatgttacacaagatcccatgtggaatgtggatgacatttggcagtttagggagtaattaagtcgtcaagagatgagatggtagagcctaccactacggttctattatatggactaatatacttcttttgcttaactaagcaaaaagtttcgaaccttttacccatattatctcgggttggagactagaacatgt

SEQ ID NO: 3951 - DNA, 880 bp, Artificial Sequence; identical to SEQ ID NO: 923
  P709 (35S::G1326)

SEQ ID NO: 3952 - DNA, 1055 bp, Artificial Sequence
  P711 (35S::G1328)
catttgacttcatcgatcggttaacaattaatcaaaaagatgggacgatcaccatgttgtgagaagaagaatggtctcaagaaaggaccatggactcctgaggaggatcaaaagctcattgattatatcaatatacatggttatggaaattggagaactcttcccaagaatgctgggttacaaagatgtggtaagagttgtcgtctccggtggaccaactatctccgaccagatattaagcgtggaagattctcttttgaagaagaagaaaccattattcaacttcacagcatcatgggaaacaagtggtctgcgattgcggctcgtttgcctggaagaacagacaacgagatcaaaaactattggaacactcacatcagaaaaagacttctaaagatgggaatcgacccggttacacacactccacgtcttgatcttctcgatatctcctccattctcagctcatctatctacaactcttcgcatcatcatcatcatcatcatcaacaacatatgaacatgtcgaggctcatgatgagtgatggtaatcatcaaccattggttaaccccgagatactcaaactcgcaacctctctcttttcaaaccaaaaccaccccaacaacacacacgagaacaacacggttaaccaaaccgaagtaaaccaataccaaaccggttacaacatgcctggtaatgaagaattacaatcttggttccctatcatggatcaattcacgaatttccaagacctcatgccaatgaagacgacggtccaaaattcattgtcatacgatgatgattgttcgaagtccaattttgtattagaaccttattactccgactttgcttcagtcttgaccacaccttcttcaagcccgactccgttaaactcaagttcctcaacttacatcaatagtagcacttgcagcaccgaggatgaaaaagagagttattacagtgataatatcactaattattcgtttgatgttaatggttttctccaattccaataaacaaaacgccattggaatagagttatgtaaacatgcaatca

SEQ ID NO: 3953 - DNA, 873 bp, Artificial Sequence
  P714 (35S::G1334)
ccattggacttttggaacataagctatgcaaactgaggagcttttgtcgccaccacagactccttggtggaatgcttttggatctcagccgttgactacagagagcctttccggcgaagcttctgattcattcaccggagttaaggcagttactacggaggcagaacaaggtgtggtggataaacaaacttctacaactctcttcactttctcacctggtggtgaaaagagttcaagagatgtgccaaagcctcatgttgctttcgcgatgcaatcagcttgcttcgagtttggatttgctcagccaatgatgtacacaaagcatcctcatgttgaacaatactatggagttgtttcagcatacggatctcagaggtcttcgggccgagtaatgattccactgaagatggagacagaagaagatggtaccatctatgtgaactcaaagcagtaccatggaattatcaggcgacgccagtcccgagcaaaggctgaaaaactgagtagatgccgtaagccatatatgcatcactcacgccatctccatgctatgcgccgtcctagaggatctggcgggcgtttcttgaacaccaagacagctgatgcggctaagcagtctaagccgagtaattctcagagttctgaagtctttcatccggaaaatgagaccataaactcatcgagggaagcaaatgagtcaaatctctcggattctgcagttacaagtatggattactttctaagttcgtcggcttattctcctggtggcatggtcatgcctatcaagtggaatgcagcagcaatggatattggctgctgcaaacttaatatatgatcagcagataggggacaagacatgattggtcaccagtc

SEQ ID NO: 3954 - DNA, 965 bp, Artificial Sequence; identical to SEQ ID NO: 937
  P715 (35S::G1335)

SEQ ID NO: 3955 - DNA, 1630 bp, Artificial Sequence; identical to SEQ ID NO: 939
  P716 (35S::G1337)

SEQ ID NO: 3956 - DNA, 1002 bp, Artificial Sequence
  Artificial sequence
  P724 (35S::G1363)
ctactatggtctggagattagttcgtttattgaactaatgttttagacaatgcaagagttccatagtagcaaagattcattgccttgtcctgcaacttcttgggataactctgtcttcaccaactcaaatgtccaaggatcatcatccttgaccgataacaacactttaagcttgacaatggagatgaaacaaactggttttcaaatgcagcactatgattcctcctctactcaatccactggaggagaatcatatagtgaagttgctagcttaagtgaacctactaatcgttatggccacaacattgttgtcactcatctctcaggttacaaagaaaacccggaaaatcctattggaagtcattcgatatcaaaggtgtctcaagattcagtggttcttcctattgaggcggcttcttggcctttacacggcaatgtaacgccacatttcaatggtttcttgtcttttccttatgcatcacaacacacggtgcagcatcctcaaatcagagggttggttccgtctagaatgcctttgcctcacaacattccagagaacgaaccaattttcgtcaatgcaaaacagtaccaagccattctccgccgcagagagcgccgtgcaaagcttgaagctcagaacaagctcatcaaagtccgcaaaccatatcttcacgagtcgcggcacctccatgcactaaagagagttagaggctctggtggacgtttcctcaacacaaagaagcatcaagaatcaaattcctcactatctcctccattcttgattccacctcatgtcttcaagaactctccaggaaagttccggcaaatggacatttcaaggggtggggttgtgtctagtgtctcgacaacatcttgctcggacataaccgggaacaacaacgacatgttccagcaaaacccacaattcaggttctcaggttatccatcaaaccaccatgtctcagtcctcatgtgagagagctcccgcaagtggtggatgag

SEQ ID NO: 3957 - DNA, 944 bp, Artificial Sequence
  P737 (35S::G1411)
gaagaaaaggctatatttaaaagaaaatcaagcaaaagtagatcctcggatgtatgggaagaggccttttggaggtgatgaatctgaagaaagggaagaagatgagaacttgttcccggtcttctcggcccgatctcaacacgacatgcgtgttatggtctcggccttgactcaagtaatcggaaaccaacaaagcaaatctcatgataacatcagctctattgatgataactatccttctgtgtataatccacaagaccctaatcaacaagttgcgcctactcatcaagaccaaggggacttgaggaggagacattatagaggtgtaaggcaaaggccatggggaaagtgggcagctgaaatccgagacccaaaaaaggcggcacgtgtgtggctcgggacatttgaaaccgctgaatctgcggccttagcttatgatgaagcagccctaaagttcaaaggaagcaaagcaaaactcaatttcccggagagggttcagcttggaagtaactctacatattactcctccaaccaaattccacaaatggaaccacaaagtataccgaactataatcaatactatcatgatgcgagtagtggtgatatgctaagttttaatttgggcggtgggtatgggagtggtaccggatattcaatgtctcatgataatagtactacgactgctgctacaacttcttcgtcttctggtggctcttctaggcaacaagaagagcaagattatgccagattctggcgctttggggattcttcttcctctcctcattcgggatattaattaggagatttgatcagttacttgtgatgaagtaatgatacatttcccgtcaaaattgagatgatcatatgcttcctgaatgtttttgagtgtcatttttgtcttccgcgttaagatttattgaacgtgttttcttgtttttttggtt

SEQ ID NO: 3958 - DNA, 1281 bp, Artificial Sequence; identical to SEQ ID NO: 981
  P745 (35S::G1435)

SEQ ID NO: 3959 - DNA, 799 bp, Artificial Sequence; identical to SEQ ID NO: 987
  P751 (35S::G1449)

SEQ ID NO: 3960 - DNA, 1342 bp, Artificial Sequence; identical to SEQ ID NO: 1001
  P753 (35S::G1466)

SEQ ID NO: 3961 - DNA, 975 bp, Artificial Sequence
  P756 (35S::G1540)
ctctttctcttgttcctctctaagtcttgatcttatttaccgttaactttgtgaacaaaagtcgaatcaaacacacatggagccgccacagcatcagcatcatcatcatcaagccgaccaagaaagcggcaacaacaacaacaagtccggctctggtggttacacgtgtcgccagaccagcacgaggtggacaccgacgacggagcaaatcaaaatcctcaaagaactttactacaacaatgcaatccggtcaccaacagccgatcagatccagaagatcactgcaaggctgagacagttcggaaagattgagggcaagaacgtcttttactggttccagaaccataaggctcgtgagcgtcagaagaagagattcaacggaacaaacatgaccacaccatcttcatcacccaactcggttatgatggcggctaacgatcattatcatcctctacttcaccatcatcacggtgttcccatgcagagacctgctaattccgtcaacgttaaacttaaccaagaccatcatctctatcatcataacaagccatatcccagcttcaataacgggaatttaaatcatgcaagctcaggtactgaatgtggtgttgttaatgcttctaatggctacatgagtagccatgtctatggatctatggaacaagactgttctatgaattacaacaacgtaggtggaggatgggcaaacatggatcatcattactcatctgcaccttacaacttcttcgatagagcaaagcctctgtttggtctagaaggtcatcaagacgaagaagaatgtggtggcgatgcttatctggaacatcgacgtacgcttcctctcttccctatgcacggtgaagatcacatcaacggtggtagtggtgccatctggaagtatggccaatcggaagttcgcccttgcgcttctcttgagctacgtctgaactagctcttacgccggtgtcgctcggg

SEQ ID NO: 3962 - DNA, 766 bp, Artificial Sequence; identical to SEQ ID NO: 1063
  P758 (35S::G1545)

SEQ ID NO: 3963 - DNA, 896 bp, Artificial Sequence; identical to SEQ ID NO: 1085
  P760 (35S::G1634)

SEQ ID NO: 3964 - DNA, 1036 bp, Artificial Sequence
  P781 (35S::G208)
cttcttcattcaccatgggaagatctccttgttgtgaaaaagctcacacaaacaaaggagcttggactaaagaagaagatcaacgtctcgtagattatatccgtaatcacggtgaaggttgttggcgttctcttcctaaatccgctggattgttgcgttgtggtaaaagttgtagattgagatggattaattaccttcgtcctgatcttaaacgtggtaattttactgatgatgaagatcaaatcatcatcaaactccatagcttactcggtaacaagtacgataactttttcctctctttctcttcttctaaaaaaacagagtgaaaatagaaaaacagagtcacttttttttttctccctactcttgtttctaggaaaaagatttcaactttctaggaaacagagagaaaatagaaactgggtcactttgttttcctgctctttcttcttctttgatctttcccaggaaaaaagtttcaactttctaggaaacagagtcgttcacttttttgtttcctctgtttttgttaaagctttcctctgttattgttattcatatgaatttgaaatgttttgttttgcagatggtcattgatagctggaagattaccaggaagaacagataacgaaataaagaattattggaacactcatattaagaggaagcttcttagtcacggtattgatccacaaactcatcgtcagattaacgaatccaaaacggtgtcgtctcaagttgttgttcctattcaaaacgatgccgttgagtattctttttccaatttagccgttaaaccgaagacggaaaattcctccgataacggagcttcgactagcggcacgacgacggacgaggatctccggcagaatggggagtgttattatagtgataattcaggacatataaagctgaatttggatttaactcttgggtttggatcctggtcgggtcggatagtcggagtcgggtcatcggctgattctaaaccgtggtgcgacccggtgatggaggcgcgtttgtcactgttgtaata

SEQ ID NO: 3965 - DNA, 3283 bp, Artificial Sequence
  P783 (35S::G431)
ccatagatacacacacacagttacttactcttttagggtttcccaataaatttatagtactttaatgtgtttcatgatattgatgataaatgctagctgtatttacaatgggggctcctctttttttttctttatgttattttcattttttatttctcatagctatatagcaaagccaaagtgaataataatactagtgagagaaagagaagatggagagtggttccaacagcacttcttgtccaatggcttttgccggggataatagtgatggtccgatgtgtcctatgatgatgatgatgccgcccatcatgacatcacatcaacatcatggtcatgatcatcaacatcaacaacaagaacatgatggttatgcatatcagtcacaccaccaacaaagtagttccctttttcttcaatcactagctcctccccaaggaactaagaacaaagttgcttcttcttcttctccttcctcttgtgctcctgcctattctctaatggagatccatcataacgaaatcgttgcaggaggaatcaacccttgctcctcttcctcttcttcagcctctgtcaaggccaagatcatggctcatcctcactaccaccgcctcttggccgcttatgtcaattgtcagaaggtgatgagagaaagaaacttgaaaaaattactttgaaagtttcttcgtaactctaatgattcttatttgattttcttgcacaaaaaagaagagaaagattctagaaaccctaattaccaaactttaccttttatttcctttttacataaccctttacttgatgtctgagtttgattttgatatctacttttgtttactagttacttaacccagctaagtatatacaaatcaaaggatacaatttttcctatattgagaaagtttcaagaaacaatttgtaaaaaccctacttgcaagagattatccaaaatattgtatgtaggcttgaagattaggacatatataattatttcatttttttctttactatattatatatccacaataaacgtgaggatccttatcttagttcaattaacgtttttatgtctatcatttactaattacacaatttcttaaggttggagcaccaccggaggttgtggcgaggctagaggaggcatgctcgtctgccgcagccgctgccgcatctatgggaccaacaggatgtctaggtgaagatccagggcttgatcaattcatggaagcttactgtgaaatgctcgttaagtatgagcaagagctctccaaacctttcaaggaagctatggtcttccttcaacgtgtcgagtgtcaattcaaatccctctctctatcctcaccttcctctttctccggttactctctcctctctctctagttctctgtttttttttctttctttttaattcatattcttgttaattatggcgtcaaattaaacgtaagatgaggaaagttgttttttttctttgtgggttttaagaaagattttcctttttctgatttttcttgggtaaatacccctttgatggttgttactagggttagtgtcagattgttatatatagcttactaggtttacgtgtataatctatctatacataagttagtgtatgtagttgttttcattgaattaaaacagtttgtttactgtttttttgttttgtttggaattgaattcatttgctttggtacaacaacaatcactgttcttgtctctttcttctccgtttgttttggatctatttaattcaaatgcatcaaaaagaatatctggatctagagtctgctcgtccttagatctattgctcaatttagacatacacatgtttttgtacgtataatcacatatacatatatctacacaatgtcatatcactcttcttttcaagaatgtagttaagtttatatagacacacaaactcacatctacttaacatgttactttgaattatttggatcactagcctattctttttcatttccctagacacatgttcttgttgacaaatttgtcttgctttcacatgtttaatcaatataaggttatggagagacagcaattgataggaacaataatgggtcatccgaggaagaagtcgatatgaacaatgaatttgtagatccacaagctgaggatagagagcttaaaggacagctcttgcgcaagtacagtggttacttagggagcctcaagcaagagttcatgaagaagaggaagaaaggaaagctccctaaagaagctcgtcaacaactgcttgattggtggagccgtcactacaaatggccttacccttcggtaactctcttcccttatactctaattaaataatcatttcatgtttttaaaaaagcatttatatgatagcaaattcaatttagttgtctattagcttgtttcaatgtttttagtgatttttgcattcatactatatcgttagggacattagtttatgttagctcatgttggcattgcacaatatgcatttgcataatttgaaatcctaaaagctgaatgaagtgaacttatttagtctatgtgtactgttttggtctattagccgatgacaaacttgattcttgcttccataccttttttagggtccgaataatatgtcaatcttagtcaagactacgatcaatttcatcttatggctgtgtaccataacttagactaaactttgttgcacatatttcaagtcataactttggaaagtagggtgcatgaggccataccctaatgcaatagtagctcatgtctttattacacttgtatagtgtcattacccatgttcgtatgagtagatggattctaagttctccttacaatctagcaaatcgtgatgtagctgtgatcatggactgaccttatatcggagagaacacttgatgattgattttttctcgcatgtgatatgaaattgcaggagcaacaaaagctcgcccttgcggaatcaacggggctggaccagaaacagataaacaattggttcataaaccagaggaaacggcattggaagccgtcggaggacatgcagtttgtagtaatggacgcaacacatcctcaccattacttcatggataatgtcttgggcaatcctttcccaatggatcacatctcctccaccatgctttgatcgatcctttaaaacgtttatttcattatatttataatcgttaaacagcttataatatgtataatctatggttctcggtatacttggaacatatgaaacatgttccgattgatgaacaagcgtttgatgttgtggtgtgtatcc

SEQ ID NO: 3966 - DNA, 3633 bp, Artificial Sequence
  P784 (35S::G419)
gggttttaggagctatctctattgtcttggttctgatacaaagttttgtaattttcatggtatgagaagatttgcctttctattttgtttattggttctttttaactttttcttggagatgggttcttgtagatcttaatgaaacttctgtttttgtcccaaaaagagttttcttttttcttctcttctttttgggttttcaattcttgagagacatggcaagagatcagttctatggtcacaataaccatcatcatcaagagcaacaacatcaaatgattaatcagatccaagggtttgatgagacaaaccaaaacccaaccgatcatcatcattacaatcatcagatctttggctcaaactccaacatgggtatgatgatagacttctctaagcaacaacagattaggatgacaagtggttcggatcatcatcatcatcatcatcagacaagtggtggtactgatcagaatcagcttctggaagattcttcatctgccatgagactatgcaatgttaataatgatttcccaagtgaagtaaatgatgagagaccaccacaaagaccaagccaaggtctttccctttctctctcctcttcaaatcctacaagcatcagtctccaatctttcgaactcagaccccaacaacaacaacaacaagggtattccggtaataaatcaacacaacatcagaatctccaacacacgcagatgatgatgatgatgatgaatagtcaccaccaaaacaacaacaataacaatcatcagcatcataatcatcatcagtttcagattgggagttccaagtatttgagtccagctcaagagctactgagtgagttttgcagtcttggagtaaaggaaagcgatgaagaagtgatgatgatgaagcataagaagaagcaaaagggtaaacaacaagaagagtgggacacaagtcaccacagcaacaatgatcaacatgaccaatctgcgactacttcttcaaagaaacatgttccaccacttcactctcttgagttcatggaacttcagaaaagaaaagccaagttgctctccatgctcgaagaggtatatatattttcaagaaattatttcattactactatcaaaacttacatgagtttcttagaaaatctaatccttttttatttggtttcaacttattcctaaaaatgtaaaatacccacaagtcttttacaaatctttttttttttcctttcatttggtttcaacttattcctaaatatgtaagatacccataaatcttgtattttttcgattcttgattaggtccatatatttcttaaagttacaaatttcttttagatattaagataaaaagattcttttttgtcttcattctttcatgtattctcgtcgaaaacaagttcgatcgtatcaactacgaaaagatcaacccttttaattcctttactcattatttctttttttctatagaaccaaaatataattttgttttctttgctttgagctaatttggagactctagtggtcctccatatttatagcaatcagtttcatcatcataagccataacgagttgtttctttttcgtgtatttactcattctaagaatctacatttacacgattgtgattgaaatctttgtgaatggtgtggggtaacgtttttttgcggttttttggcagcttaaaagaagatatggacattaccgagagcaaatgagagttgcggcggcagcctttgaagcggcggttggactaggaggggcagagatatacactgcgttagcgtcaagggcaatgtcaagacactttcggtgtttaaaagacggacttgtgggacagattcaagcaacaagtcaagctttgggagagagagaagaggataatcgtgcggtttctattgcagcacgtggagaaactccacggttgagattgctcgatcaagctttgcggcaacagaaatcgtatcgccaaatgactcttgttgacgctcatccttggcgtccacaacgcggcttgcctgaacgcgcagtcacaacgttgagagcttggctctttgaacactttcttcacccgtaagttatttcatatacatcctcttaatatatttacacatacctaaaagttactaattgtgtctttctgaagtgatcaatgaaggtagaatcacaagttaattgggtatatttatggagctatataaaacctctttaacgattttatttcattgatagtacgttgataaatagtatgataggttttttttgtttgttacatgaatatttttgaacatataaaagtaaaaaaatatgtacattttatatagagagattgagattgacttgacaagcataggatacaatctaccttaatctgttaattgcatatagcttttttattttcctttttctttcatttgcactattggtgtgaaagtgagtgtacaaacatatacatatacacatgtatatatatgtatacgaacatataaaattaaataaaataaatttaactggtggatgaaagacagaaatagagaaaggtacaaagtggattgagagagagaatcaatgttctttacctaacactaacaaaagagagaaactatacataactccttgcttttttctccatgtttttattttgttctttttcttctactttttatttatttaatttacagaagttatatgtttatcatcatatgtaacacttgtctccatcaattcccaaacactgctcaaacaatgaaacatcttgttagttttcaccaaaccctttacctttgcttccattttatttgcatcattcttcaatcatttatatccttttttttaattacatatccatttgtcttatatttttccattaaagtaaaattttcttatttttgttttcagatatccgagcgatgttgataagcatatattggcccgacaaactggtttatcaagaagtcaggtaaagaataactccactaattcttgatatattccaaaatttattatcctatttactaaagttataataaaccaaaattgttaggtatcaaattggtttattaatgcaagagttaggctatggaaaccaatgattgaagaaatgtactgtgaagaaacaagaagtgaacaaatggagattacaaacccgatgatgatcgatactaaaccggacccggaccagttgatccgtgtcgaaccggaatctttatcctcaatagtgacaaaccctacatccaaatccggtcacaactcaacccatggaacgatgtcgttagggtcaacgtttgacttttccttgtacggtaaccaagctgtgacatacgctggtgaaggagggccacgtggtgacgtttccttgacgcttgggttacaacgtaacgatggtaacggtggtgtgagtttagcgttgtctccagtgacggctcaaggtggccaacttttctacggtagagaccacattgaagaaggaccggttcaatattcagcgtcgatgttagatgatgatcaagttcagaatttgccttataggaatttgatgggagctcaattacttcatgatattgtttgagattaaaagattaggaccaaagttatcgatacatattttccaaaaccgattcggttatgtaacggtttagt

SEQ ID NO: 3967 - DNA, 1055 bp, Artificial Sequence
  P786 (35S::G394)
tacgaagagaaaattcaaatgggtcttgatgattcatgcaacacaggtcttgttcttggtttaggcctctcaccaacgcctaataattacaatcatgccatcaagaaatcttcctccactgtggaccatcgtttcatcaggctcgatccgtcgttgactctaagcctatccggtgagagctacaagatcaagactggtgccggcgccggcgaccaaatttgccggcagacctcgtcccacagcggcatctcatctttctcgagcggaagggtaaagagagaaagagaaatctccggcggcgatggagaagaagaggcggaggagacgacggagagagtggtgtgttcgagagtgagtgatgatcatgacgatgaagaaggtgttagtgctcgtaaaaagcttagactcactaaacaacaatctgctcttctcgaagataacttcaaacttcatagcacccttaatcccgtatgatatagttaattatttccttaattaaactaatcagtctcttcttatttacgttaatcatatcgttaattattttttctatgaatttacagaagcaaaaacaagctcttgcgagacagctgaatctaaggcctagacaagttgaagtgtggttccaaaacaggagagctaggtaaatataattgattacttttgtgaattttaatatcatacttttctttctttattttggttcataaaaatattttttaattaaattttaatttgaacagaacaaaactaaagcaaacagaagtggattgtgagtttttgaagaaatgttgcgagactttaacggatgagaatagaaggcttcaaaaagagcttcaagaccttaaggctttaaaattgtctcaaccgttttacatgcacatgccggcggcgactttgactatgtgcccttcttgtgagagactcggcggtggtggtgtcggaggagatacgacggcggttgatgaagaaacggcgaaaggagctttctccatcgtcacaaagcctcgtttctataaccctttcactaatccttctgcagcatgttagttact

SEQ ID NO: 3968 - DNA, 1041 bp, Artificial Sequence
  P787 (35S::G255)
ctagaagcaattaggctcaccttccacctccaacacctctctccccttctctctccataaaaccctcaacaacagaatcaaaagcatcatcatcatcagaagaagagagtcatgggaagatctccttgctgcgagaaagaacacatgaacaaaggtgcttggactaaagaagaagatgagagactagtctcttacatcaagtctcacggtgaaggttgttggcgatctcttcctagagccgctggtctccttcgctgcggtaaaagctgccgtcttcggtggattaactatctccgacctgatctcaaaagaggaaactttacacatgatgaagatgaacttatcatcaagcttcatagcctcctaggcaacaagtaagcccctatgctctgttttatatagcttatgctctgtttcttgaaacttatcctctgtttttttattaggtggtctttgattgcggcgagattacctggaagaacagataacgagatcaagaactactggaacacacatataaagaggaagcttttgagcaaagggattgatccagccactcatagagggatcaacgaggcaaaaatttctgatttgaagaaaacaaaggaccaaattgtaaaagatgtttcttttgtgacaaagtttgaggaaacagacaagtctggggaccagaagcaaaataagtatattcgaaatgggttagtttgcaaagaagagagagttgttgttgaagaaaaaataggcccagatttgaatcttgagcttaggatcagtccaccatggcaaaaccagagagaaatatctacttgcactgcgtcccgtttttacatggaaaacgacatggagtgtagtagtgaaactgtgaaatgtcaaacagagaatagtagcagcattagctattcttctattgatattagtagtagtaacgttggttatgacttcttgggtttgaagacaagaattttggattttcgaagcttggaaatgaaataaatgaatagtattagattcttaatttgtaggtgtgataatgaatgttag

SEQ ID NO: 3969 - DNA, 969 bp, Artificial Sequence
  P790 (35S::G242)
cactaaagaggagaagattgctaaagtttgataaaacattccaaaatcaatggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccagctttcgccgcaagttgagcatcggccgttttcggctgaggaagacgagacgatcgcacgtgctcacgctcagttcggtaataaatgggcgacgattgctcgtcttctcaacggtcgtacggacaacgccgtgaagaatcactggaactcgacgctcaagaggaaatgcggcggttacgaccatcggggttacgatggttcggaggatcatcggccggttaagagatcggtgagtgcgggatctccacctgttgttactgggctttacatgagcccaggaagcccaactggatctgatgtcagtgattcaagtactatcccgatattaccttccgttgagcttttcaagcctgtgcctagacctggtgctgttgtgctaccgcttcctatcgaaacgtcgtcttcttccgatgatccaccgacttcgttaagcttgtcacttcctggtgccgacgtaagcgaggagtcaaaccgtagccacgagtcaacgaatatcaacaacaccacttcgagccgccacaaccacaacaatacggtgtcgtttatgccgtttagtggtgggtttagaggtgcgattgaggaaatggggaagtcttttcccggtaacggaggcgagtttatggcggtggtgcaagagatgattaaggcggaagtgaggagttacatgacggagatgcaacggaacaatggtggcggattcgtcggaggattcattgataatggcatgattccgatgagtcaaattggagttgggagaatcgagtagac

SEQ ID NO: 3970 - DNA, 1732 bp, Artificial Sequence
  P792 (35S::G256)
cgttgtgtttctcctcaacattcaaagtctttagtgaaacctctcttgtaagaagccaaaaaaataaagagaaagattcaaagaaggaaagaaattgaggatgactatttcaagtccaaagagagattttgagtagaccctcttcacaaaaatccaatcttagagtcttactagttactatctagcttacatacacagagacactataccaaaaatccaatcttattagagtacttactatatagcttacacatacacacacacgaagtactatttcaacgatcaagagcgtgtgcgtgaggatatgggtagaccaccttgttgcgagaagattgaggtgaagaaaggaccatggactcccgaagaagacataatcttggtctcttatatccaacaacacggccctggaaattggagatctgtccctgcaaacaccggtctttatatatcttcattcactctccttctttcttcttcttatatatctttcttataagatttttccacatatataaatatttatatatgtttcaggtttgctaaggtgtagcaagagttgcagacttagatggactaattaccttcgtcccgggatcaaacgaggaaatttcactcaaccggaagagaagatgatcatccaccttcaagctcttttgggaaataggtatggaattactcctttaattctccctgttttatattaaattgattcacgttgatctccaatatctaagtttgtccatcttccgtaatctcctaattaacaatataaattatatagagtattagcatttcattttattagtgttttttttgttattatttatttgattggatgtccactttgaaaataagatgggcagctatagcatcatatctacctcagaggaccgacaatgatatcaagaactactggaacactcatcttaaaaagaaactagtgatgatgaagtttcaaaatggtatcatcaacgaaaacaaaaccaatctggcaacagatatttcgtcttgtaataataacaacaatggatgtaatcacaacaaaaggaccaccaacaaaggccaatgggagaaaaaacttcaaacagacatcaacatggccaaacaagccttattccaagccttgtcacttgaccaaccatcttcattgatccctcccgatcctgactcaccaaaacctcatcatcattctaccaccacttatgcctcaagcacagataacatctctaaattactccagaactggacaagctcatcatcgtcaaagcctaacacttcatcagtctccaacaaccggagctcaagccccggtgaaggaggactttttgatcatcactctttgttctcatcgaattcagaatctggatcagttgatgagaagctgaatttgatgtccgagacaagcatgttcaaaggtgagagcaagccagacatagacatggaagctacacctactactactactactgatgatcaaggctcgttgtcattgatcgagaaatggttgtttgatgatcaaggcttggttcagtgtgatgatagtcaagaagatctcatcgacgtgtctttagaggagttaaaataatgataacaacagtcaagatttgttctataagaaaataaaacgtatagaacaacgataaagctagctaggtttattaatttttctttcttttgtcttttctctatgatctttagttacattttattttactgtgtggcttgcttgtgg

SEQ ID NO: 3971 - DNA, 1305 bp, Artificial Sequence
  P794 (35S::G198)
tactaaaccagttgaccatttttttctgataaacaatcaatggcaaggtcaccttgttgcgagaagaacggactcaagaaagggccttggacatctgaagaagaccagaagcttgttgactatatccagaaacatggttatggtaactggagaaccctccccaaaaatgccggtacgtgtcttaattttcatttattattcatgttttagttatgtttttcgaaagtttcaaattgtaatatgtttttttctcttcatcaggtttgcaaagatgtggcaaaagttgtaggttaaggtggactaattatctccgaccagatataaagcgaggaaggttctcttttgaggaagaagaaaccattattcagcttcatagcttcttaggaaacaagtaagtttgctttttttttctcctccgacaatatctactatgaaaatagttcaagattcttacgtgtttggtttatcttgttataggtggtctgcgattgcggcgcgtttaccaggaagaacagataatgagatcaagaacttttggaacactcatataagaaagaagctacttagaatggggattgatccagtgactcacagtccacgactcgatctcctcgatatctcatccatcttagcttcatctctatacaattcatcttcacatcacatgaacatgtcaagactcatgatggatactaatcgtcgtcatcaccagcaacatccattggttaaccccgagatactcaagctcgctacctctctcttctctcaaaatcaaaaccaaaaccttgtggtggatcatgactcgagaactcaagagaagcaaacagtttatagccaaaccggagtaaaccaataccaaaccaaccaatatttcgagaacacgattactcaagaactccaatcttccatgccaccattccccaatgaagctcgtcagtttaacaacatggatcatcacttcaatggttttggagaacaaaatcttgtttcaacttctactacgtcagtccaagattgctataatccgtcattcaacgattattcaagttcaaattttgtcttggatccttcttattcggatcagagcttcaacttcgcaaattcggtcttaaacacgccatcctcgagcccgagcccgactacgttaaactcgagttacatcaatagtagcagttgcagcactgaggatgaaatagaaagctattgcagtaatctcatgaagtttgatattcccgatttcttggacgttaatggttttattatataattccaagaaacaaaataaaactcgagtgggatacagtt

SEQ ID NO: 3972 - DNA, 1380 bp, Artificial Sequence
  P795 (35S::G222)
cctcttcaagcttatagaacctccaagaaccataaaactctctctgcaacaatctatactttcttcattacttttataaaaaatgggaagacattcttgttgttttaagcagaagctaagaaaaggcctttggtctcctgaagaagatgagaaacttctcaattacatcactagacatggtcatggctgttggagttctgtccctaaactcgcaggtttggtctctatgtgctcttatattatatatagcttaaagaggtttatatagcatcgtttataatgtttttatatgcgttggtggatatatatgatcaaataggtttgcaaagatgtggaaagagttgtagacttaggtggataaattatttgagaccagatttaaagagaggagctttctctcaagacgaagaaagcttgatcattgagctccatgctgcattaggcaacaggttcattaatttgcaacacatttatatagttttgaatttataatgtatattgtgtatatatatatatatgttaaaaaaaaaatctttggttcatattgaatatgtagatggtctcaaatcgcaacgcggttaccgggaagaacagacaacgagatcaaaaacttttggaactcatgtcttaagaagaagctgagaagaaaaggcattgacccaacaacacataaacccttaataacaaacgagcttcaatctcttaacgtcatagatcagaaactgacgtcatcagaagtagtaaagtcaacgggttcgataaacaacctacatgatcagtcaatggtcgtctcatcgcaacaaggtccatggtggttcccggcgaatacaactacgactaatcaaaactctgcgttttgctttagttcaagtaatactacaacggtttcagaccagatcgtatctttaatctcttcaatgtctacgtcatcatctccgacaccaatgacttcaaacttcagtcctgctccaaacaactgggaacaactcaactactgcaacacagtaccaagtcagagcaacagtatctacagtgccttctttggtaatcaatacacagaagctagccaaaccatgaacaataataatccactagtagatcaacatcatcatcatcaagacatgaagtcatgggcatcagagattcttcattacacagaacacaaccaaagctcagaaactgttatagaagcagaagtgaagccagacattgccaactactactggagatcagcatcatcatcgtcgtcaccaaaccaagaagctgcaacattactacacgatgctaacgtggaagtgtacggtaaaaatctacaaaagcttaataacatggtgtttgatcagagcctttagattattaacatgtgttatagagagtttc

SEQ ID NO: 3973 - DNA, 1068 bp, Artificial Sequence
  P796 (35S::G225)
gctactattaatccttcccctcgtgaggaaatcatttcttcttgtttctcgagatttattctctttctctctctctttctctgtgtgtttcgtgtcttcagattagttcgatgtttcgttcagacaaggcggaaaaaatggataaacgacgacggagacagagcaaagccaaggcttcttgttccgaaggtctgatttctctttgtttctctctatatctttttgatcggtttgagtctgattttgtatgtttgtttcgcagaggtgagtagtatcgaatgggaagctgtgaagatgtcagaagaagaagaagatctcatttctcggatgtataaactcgttggcgacaggttagagactctttctctctcgatccatcttgttgctttctcttttttttggtctttcatgttttgtcgaatctgcttagattttgatctcaaagtcggtcgtttatttatgcattttcttggtttttctattatattattgggtctaacttaccgagctgtcaatgactgtgttcagcctgatttttgatcttgttattattctctgttttttgttttagttgttcaaatagcaaaacctaatcaagatttcgttttcagtttctttttttatatatgattctttagcaaaacatattcttaatttatgtcagaactcactttggctagtttggttcaattttgattacagcatgtttgtatgaagtcaaagtgtaaattacgattttggttcggttccatagaattttaaccgaattacaaactttatgcggtttttatcggaataaaaggtatttggttaagtgtaagttcctcaacactgactgttagcctatcctacgtggcgcgtaggtgggagttgatcgccggaaggatcccgggacggacgccggaggagatagagagatattggcttatgaaacacggcgtcgtttttgccaacagacgaagagacttttttaggaaatgattttttttgtttggattaaaagaaaattttcctctccttaattcacaagacaagaaaaaaaggaaatgtacctgtccttgaattact

SEQ ID NO: 3974 - DNA, 3306 bp, Artificial Sequence
  P798 (35S::G217)
ggttccaaccctaatctagggttactctctctctcgcttccttctgttcttcgttcttaccgagttccacgagcattagcttcagagaccttgaattggagtgcggttggatcaaaaacagttgagcgaagatgaggattatgattaagggaggtgtttggaagaacaccgaagatgagattctcaaagccgccgtgatgaagtatggtaagaaccaatgggctcggatctcgtctcttctcgttcgtaagtctgctaaacagtgtaaagctcgctggtacgagtggctcgatccatctatcaaaaaggtaagtcgtgttcgcgttttccttctcttaactagtagtgttcgaaaaaaaactatggatctggcgaacatttttttgtttggggatttggccttttaggtagtttgttagcttgttactaggtgctttagttgtatatatgtattgatttgcatctggaaattcatagaaagtgtaggcagtaatgctaggagttttggagtattcgaaggttttcttatgtttttgaattacaactgagtttaattttgtgatgttaatgtagactgaatggaccagagaagaagatgagaagcttctacatcttgctaaacttctgcctactcaatggagaactattgctcctattgtgggtcgtacaccatctcaatgtcttgagaggtatgagaagctccttgatgcagcatgcactaaggatgaaaattatgatgcagcggatgatccacgaaaattacgtcctggtgagattgatccgaacccagaagcaaagcctgctcgtcctgatccggtagacatggacgaagatgagaaagaaatgctttctgaagcaagagctagattggctaacacgaggggaaagaaggctaaaagaaaagctagagaaaaacaacttgaggaagctagaaggcttgcttctctgcaaaaaagaagagaactaaaagcagctgggattgatggaaggcataggaaaagaaagagaaagggaatcgactataatgcagaaattccttttgaaaagagggcacctgcgggattttatgatactgcggatgaagatcgtcctgctgatcaagtaaaatttccaactaccattgaagaacttgaaggaaaaagaagagctgatgtagaagcacatttacgcaaacaagatgttgcaaggaataaaattgctcagagacaggatgctccagcagctatattgcaagcaaacaagctgaatgatccggaagttgttaggaagaggtcaaagctgatgttaccaccaccgcagatttcagaccacgagctagaagaaattgctaagatgggctatgccagtgaccttcttgccgagaatgaggagctaacagaaggcagtgctgctactcgtgcacttttggcaaattactcacaaacaccaaggcaaggaatgacacccatgaggacacctcaaagaactcctgctggtaaaggtgatgctattatgatggaagcagaaaacctggccagattaagagactctcagacacctttgctaggaggagaaaatcctgagttgcacccttctgacttcactggggtcactccgagaaagaaggagattcaaacgcctaatccaatgttgaccccttcaatgactcctggtggtgctggtcttactccaagaattggcttgacgccatcaagggatgggtcttctttttctatgacacccaaagggactcccttcagggatgaacttcacattaacgaagacatggacatgcacgaaagtgcaaaacttgagaggcagagacgagaggaagctagaaggagtttacgctctggtttgactgggcttcctcagccaaagaacgagtaccaaatagttgcacaacctcctcctgaggaaagtgaagagccagaagagaaaattgaggaagacatgtcagacaggatagcgagggaaaaggcggaggaagaagcaagacaacaggcattgcttaagaagagatccaaggtcttgcagagagatcttcctagacccccagctgcttcattggcagtaattaggaactcgttgctttcagctgatggagacaaaagttctgttgttcctcctactccgattgaggttgcagataaaatggtaagagaggagcttctacagttgctggagcatgataatgcaaagtatccgcttgatgacaaagctgagaagaagaaaggagccaagaaccgtaccaaccgttctgcttctcaagttcttgcaattgacgattttgatgaaaatgagctccaagaggtatgtagatgaaaatatctatccaatttcagtttacttttgttttgttttttggttgattaattcgttggccagcttctggaatccttagttctctcttggtttaggctagattgtttgattgataatttttgcatgaatgttaatccctccttaattatcaacatctgtaattaatttggtatacactagggagttttgaatgaaggttgttgcttatgatttttggtaggctgacaaaatgataaaggaggaggggaagtttctgtgtgtgtcaatgggacatgagaacaagacacttgatgattttgtagaagctcacaacacatgcgtgaatgatctcatgtatttccccactcgaagcgcttacgagctctcaagtgttgctgggaacgcggacaaagttgcagcttttcaggaggagatggagaatgtgagaaaaaagatggaggaggatgagaagaaggcagaacacatgaaggccaagtacaaaacttatacaaagggtcatgaggtaacatatagtccacattgccttaaatgttaattctgaaactatattttgtttggtgtcaatgtttaacggatttgtacatttgacagaggagggcagagaccgtgtggacccaaatagaggcgacattgaagcaggctgagattggtggaacagaagtagagtgctttaaagcattgaagaggcaagaagagatggctgcatcttttaggaaaaagaatttgcaagaggaagtgataaagcaaaaggaaacagagagtaaactgcagactcgctatgggaatatgttggcaatggttgaaaaagcagaggagataatggtcggtttccgagcacaggcattgaagaaacaagaggatgttgaagattctcacaaactgaaagaagctaagctagccactggagaggaagaggacatagccatagccatggaagcttctgcataaaaacttgagttttgtattgcttacaagttttaaggagacgtagcttgactttgt

SEQ ID NO: 3975 - DNA, 928 bp, Artificial Sequence
  P800 (35S::G207)
aaaagatctgtttcaatggcggatcgtgttaaaggtccatggagtcaagaagaagatgagcagctacgaaggatggttgagaaatacggaccgaggaattggtctgcgattagcaaatcgattccaggtcgatctggtaaatcgtgtagattacgttggtgtaatcagttatctccggaggttgagcatcgtcctttctcgccggaggaagatgagactattgtaaccgcccgtgctcagtttggtaacaagtgggcgacgattgctcgtcttcttaacggtcgtacggataacgccgttaaaaatcactggaactctacgcttaagaggaaatgcagcggaggtgtggcggttacgacggtgacggagacggaggaagatcaggatcggccgaagaagaggagatctgttagctttgattctgcttttgctccggtggatactggattgtacatgagtcctgagagtcctaacggaatcgatgttagtgattctagcacgattccgtcaccgtcgtctcctgttgctcagctgtttaaaccaatgccgatttccggcggttttacggtggttccgcagccgttaccggttgaaatgtcttcgtcttcggaggatccacctacttcgttgagtttgtcactacctggagctgagaacacgagttcgagccataacaataacaacaacgcgttgatgtttccgagatttgagagtcagatgaagattaatgtagaggagagaggagaaggacgtagaggtgagtttatgacggtggtgcaggagatgataaaagctgaagtgaggagttacatggcggaaatgcagaaaacaagtggtggattcgtcgtcggaggtttatacgaatccggcggcaatggtggttttagggattgtggagtaataacacctaaggttgagtagttttggt

SEQ ID NO: 3976 - DNA, 687 bp, Artificial Sequence
  P804 (35S::G25)
cgcaaatacgtcttgttctagtttggagttggaagcgtaaaaaacaaaaaacaaaaatgtgtgggggagctatcatttctgatttcatctggtcgaaatctgagtcagaaccgagtcaactcggctctgttagcagcaggaagaagcgtaaacccgtctcaggtacaacacttttggtttcgagttttgtttttttattataaaacctaatatatccgtttctgattcgggaatatcttcgaacagtgagtgaagaaagagatgggaaacgagagaggaagaatctgtacagagggataaggcagaggccatggggcaaatgggcagcggagattcgtgacccgagcaaaggtgtacgtgtctggcttggcacattcaaaaccgccgacgaagctgctcgagcctacgacgttgctgccatcaaaatccgtggccggaaagccaaactgaatttcccaaacactcaagtagaagaagaagccgatactaaaccaggggggaatcaaaatgagctgatttcggaaaaccaagtagagagcttatcggaggacctgatggcattggaggattacatgagattctatcagattccggttgccgacgaccaatcggcgaccgatattggaaatttatggagctatcaagactccaattaaatctcttatttcccggccggtttgctcactc

SEQ ID NO: 3977 - DNA, 907 bp, Artificial Sequence
  P806 (35S::G22)
ctcatacacaactacttatctcttcacttcattagtctccaagaagaaaacatctctcactctctaaaatacacactctcatcaaaaaccttctcttcggttcagaagcattcaagaatccattatgagctcatctgattccgttaataacggcgttaactcacggatgtacttccgtaacccgagtttcagcaacgttatcttaaacgataactggagcgacttgccgttaagtgtcgacgattctcaagacatggctatttacaacactctccgtgatgccgttagctccggctggacaccctccgttcctcccgttacctctccggcggaggaaaataagcctccggcgacgaaggcgagtggctcacacgcgccgaggcagaaggggatgcagtacagaggagtgaggaggaggccgtgggggaaattcgcggcggagattagggatccgaagaagaacggagctagggtttggctcgggacttacgagacgccggaggacgcggcggtggcgtacgaccgagcggcgtttcagctcagaggatcgaaagctaagctgaattttccgcatttgattggttcttgtaagtatgagccggttaggattaggcctcgccgtcgctcgccggaaccgtcagtctccgatcagttaacgtcggagcagaagagggaaagccacgtggatgacggcgagtctagtttggttgtaccggagttggatttcacggtggatcagttttacttcgatggtagtttattaatggaccaatcagaatgttcttattctgataatcggatataattagttttaagattaagcaaaatttgtccaacgagttttgctgtatgaaatatctatcgatgactcaacaggttttgatcatgatcatatgtaatgtgatgg

SEQ ID NO: 3978 - DNA, 1547 bp, Artificial Sequence
  P807 (35S::G26)
catagatgcagagaatagacatctttgctggttctttggcttgtacccaaacccatctttgacttcaaaaataaaataaaaataatcataattgacatcatcggataatgcatagcgggaagagacctctatcaccagaatcaatggccggaaatagagaagagaaaaaagagttgtgttgttgctcaactttgtcggaatctgatgtgtctgattttgtctctgaactcactggtcaacccatcccatcatccattgatgatcaatcttcgtcgcttactcttcaaggtaatttcatcagatcctttttccaataattttaattgctatactttataactcgagtgattgtcttttccattggtgattctctttacacataggaatgatttaatcttggattttgcaattggtaatcctttagtggctgcagcatggccttgatcaaatagagatataatttcatgtatggccacaatgcattagttcaatttactatatgatttttttaatgaatgttcatggttagattttcttgaaaaaacctgtcggctttattggttggacaaaattgatcatatttggctttcggacaaatatgattggcaaggcttggttgcaatggtcgtattttggttgagataactagccagagagagttttaggattgtaacatggggaaaacgtatttaaaatgatcaaacttaatttatatcctaattatatcattggtgtgatacataagtatatatatagttaattaccaattacgagagagaggaatgtataaatgtaggtttggcctaatatatagatttcataagtagatgtagaagaggggaataaaagttgatgtagaatgatcatatcatatgattcaaacgccctttaataatctttacgaaatgcctctacaccgatagtatacgttatattcatagacatgcacgtcacatttaagtcaccattttcatgacaagagtgaacttacaattttcatcatttttctacagaaaaaagtaactcgaggcaacgaaactacagaggcgtgaggcaaagaccgtggggaaaatgggcggctgagattcgtgacccgaacaaggcagctcgtgtgtggcttgggacgttcgacactgcagaagaagccgccttagcgtatgataaagctgcatttgagtttagaggtcacaaggccaagcttaacttccccgagcatattcgtgtcaaccctactcaactctatccatcgcccgctacttcccatgatcgcattatcgtgacaccacctagtccacctccaccaattgctcctgacatacttcttgatcaatatggccactttcaatctcgaagtagtgattccagtgccaacttgtccatgaatatgctgtcttcttcgtcttcatctttgaatcatcaagggctaagaccaaatttggaggatggtgaaaacgtgaagaacattagtatccacaaacgacgaaaataacatgttaatggcataaatatctcttcgtccaagttatcaaacgcattgacctccggct

SEQ ID NO: 3979 - DNA, 1130 bp, Artificial Sequence
  P810 (35S::G230)
gacctctctaaccatcacacctcgtataaatactctctcctcttcatacttatcctctcaacaaaaatcgtttcgttcttttccaaaatccccaaacaatagaaacgcgttttaaacgatttgattagttttaaattaaaaagaagatccgagcgatgtctggttcgacccggaaagaaatggatcggatcaaaggaccatggagtcctgaagaagacgatctgttacaatcgttggttcagaagcacggaccaaggaactggtctctgataagcaaatcaatccctggacgttccggtaaatcttgccgtctccgttggtgtaatcagctttctccggaggtagagcaccgtggattcacggcggaggaagatgatacgattatactagcgcacgctcggtttggtaacaagtgggcgacgattgcacggcttctcaatggtcgcactgataacgcgattaagaatcactggaactcaacgctgaagcggaaatgtagcggcggaggcggcggaggagaggaagggcagagttgtgatttcggtggtaatggagggtatgatggtaatttaactgatgaaaaaccgttaaaacggagggcgagtggtggaggaggagttgttgtggtgacggcgttaagtccaacgggatctgacgtcagcgagcaatcgcaatctagtggatctgttttaccggtttcttcttcttgtcatgtttttaaaccgacggcgagagctggtggagtggtgattgagtcatcatcgccggaggaggaggagaaagatccgatgacttgtttgaggttgtctttgccttgggtcaatgagtcaacaactccaccggagttgtttccggtgaagagagaagaagaagaagagaaggaaagagagatttctggacttggtggagattttatgacggtggtgcaggagatgattaagacggaggttaggagttacatggcggatttacagctaggaaacggcggaggagctggaggaggagcaagttcgtgtatggtgcaaggaactaatggtcgtaatgtagggtttagagagtttattggattaggtaggatcgagtagtgagtgagaaaagagaagaattgtgtagcaaatgcagagaaagag

SEQ ID NO: 3980 - DNA, 1099 bp, Artificial Sequence
  P814 (35S::G197)
aggcttcaccttcctcttccaacctctctctctctctctctttctcaaaccgtctctccataaagccctaatttcttcatcacaagaatcagaagaagaaagatgggaaggtctccttgctgtgagaaagaccacacaaacaaaggagcttggactaaggaagaagacgataagctcatctcttacatcaaagctcacggtgaaggttgttggcgttctcttcctagatccgccggtcttcaacgttgcggaaaaagctgtcgtctccgatggattaactatctccgacctgatctcaagaggggtaacttcaccctcgaagaagatgatctcatcatcaaactacatagccttctcggtaacaagtgagtcacaaaacaactcctctgttttttttactatcctctgttatgttaaaaagctctgttttttaaactctgttttttttttcttctatcaggtggtctcttattgcgacgagattaccaggaagaacagataacgagattaagaattactggaacacacatgttaagaggaagctattaagaaaagggattgatccggcgactcatcgacctatcaacgagaccaaaacttctcaagattcgtctgattctagtaaaacagaggaccctcttgtcaagattctctcttttggtcctcagctggagaaaatagcaaatttcggggacgagagaattcaaaagagagttgagtactcagttgttgaagaaagatgtctggacttgaatcttgagcttaggatcagtccaccatggcaagacaagctccatgatgagaggaacctaaggtttgggagagtgaagtataggtgcagtgcgtgccgttttggattcgggaacggcaaggagtgtagctgtaataatgtgaaatgtcaaacagaggacagtagtagcagcagttattcttcaaccgacattagtagtagcattggttatgacttcttgggtctaaacaacactagggttttggattttagcactttggaaatgaaatgaaatgaaatactatattaatcaatttatagctgtgaattgtgatataaaagctattaacagactcgttcatggttctc

SEQ ID NO: 3981 - DNA, 870 bp, Artificial Sequence
  P817 (35S::G241)
ccaagaagctcaccaatgcttttgaattctcccacatgtcttttgacaattttagtataaatactcaaaccccttagtcagtcattctcatgttcatcaacagcatttgatctcaagctcataggaatttgatctccacattatatcttgatcatcaccacaagaaaaacatttcaacttcttttatcagcaatcacaaaacaaagagatgggaagagctccatgctgtgagaagatggggttgaagagaggaccatggacacctgaagaagatcaaatcttggtctcttttatcctcaaccatggacatagtaactggcgagccctccctaagcaagctggtatgtaaaaattataatatcaaatttcttaattttgatcaaatttcttacattaattattggtaattattatttacaggtcttttgagatgtggaaaaagctgtagacttaggtggatgaactatttaaagcctgatattaaacgtggcaatttcaccaaagaagaggaagatgctatcatcagcttacaccaaatacttggcaataggtattttacttcaacatataagtatataaccgacacacaagttttattttgttttcttactatatataaatcaccaaaagaaagtaactttattacacacgtctaggtcgcactactattcttttaactacacaatgatcggctctttaattacttttgtattgatgttcttcgttttccttttggtatcatctttagatggtcagcgattgcagcaaaactgcctggaagaaccgataacgagatcaagaacgtatggcacactcacttgaagaagagactcgaagatttatcaaccagctaaacctaagaccatcaac

SEQ ID NO: 3982 - DNA, 1760 bp, Artificial Sequence
  P818 (35S::G206)
cacacttagccatcgtacacttactagttacttccaacatttggcttcctttgctttcacgaatagaaaccttagcttcttccatttcttctttctctcctcgtttaaattagtttttgacaaggaagaaaaagatggggagaagaccatgctgtgagaagataggattgaagaaagggccatggagtgctgaagaagatcgaatcttgatcaattatattagtctccatggccatcccaattggagagctctccctaaactagccggtaaataagccattttatatttgctatttgccatatgtatatattagtaacaaaataattttgtacctagctagcatgtgtattattgttctatagtatatagtagtgtatatttgttgtgtaaagttaataatggtgtttgtgaaatgattagggctacttcggtgcggaaaaagttgcaggcttcgttggattaattatttgagaccagacatcaaacgtggcaatttcactcctcatgaagaagatactatcatcagcttacatcaactcttaggcaacaggtttctcctccttttccattttctgtttttttacttcttcctttgattatatgcgaaattttagattttttggtcctatattctttgaaaccagaaattaaacaagaatttgagaaatcactcacaaatttttctttatttttaatctttgagaagtcaaatcacaagtttttttctttcttttaaagtaagtcaatgcaatttctgtttagtccataactccatatatattacagtgaaaatgatataatgttcatttgtagatgaaggattttgggacatcaaattgtgaaaagtatcattattttggaagtttagtttgttttaactgtggagactagctagctagattacttcacaattttctctttgtatatgtgttgcttttgtcaatatgcgaaattttatatctttgtggggcagagaactgagaagattccaacccgtgattgcctttgtccattaaataatttcaattttttactttcctctaattatactttttattcactagtagacaaagataggcactgtgatcagtgtaagacatgtgcaaattcttttaaccatacgcatgaacttcaataactttccttttgttttactcgctctttgttctcataacaatgtagacgacgtattatgatgattgatgagtcattcatgtgacatttgttttgagtagatggtctgcgatagctgcaaaattgcctggacgaacagacaacgaaattaaaaatgtttggcacactcatttaaagaaaagactccaccacagtcaagatcaaaacaacaaggaagatttcgtctctactacagctgcggagatgccaacctctccgcaacaacaatctagtagtagtgccgacatttcagcaattacaacattgggaaacaacaatgacatctccaatagcaacaaagactccgcgacgtcatccgaagatgttcttgcaattatagatgagagcttttggtcagaagtggtattgatggactgtgacatttcaggaaatgagaagaatgagaaaaagatagagaattgggagggctcactagatagaaacgataagggatataaccatgacatggagttttggtttgaccatctcactagtagtagttgtataattggagaaatgtccgacatttctgagttttgatttgttttagttaaagacttatatatcttcctttgtgacccacatg

SEQ ID NO: 3983 - DNA, 1766 bp, Artificial Sequence
  P819 (35S::G212)
ccatcataagttcactactcataatctctttctctctctcacacacacacacagacacacacaaacatagaaggaatcagagaataaaaaaagaatgagaataaggagaagagatgaaaaagagaatcaagaatacaagaaaggtttatggacagttgaagaagacaacatccttatggactatgttcttaatcatggcactggccaatggaaccgcatcgtcagaaaaactggtactctttctctctctcgcgcgttttgtgattatatatattaactttagtctctagctagttcatatataaatatatctcagttagactaaatttgattcgttgatagggctaaagagatgtgggaaaagttgtagactgagatggatgaattatttgagccctaatgtgaacaaaggcaatttcactgaacaagaagaagacctcattattcgtctccacaagctcctcggcaataggtacataactttatgttactacaatattatacaccatgtctttttatttaatcgatcgttaactgattttttctttcgtcaaatatttgaattgttgttttaaacaaagatttggccggttaagttgatttttaaaaatctaattgaaggattttcttacttgcaaatgtaaaaataaagagagttgacaagtaaagactgttttatttcaattaaactatgtgttcgtggattatttcacatttcaaaaggtgttttcttcacaaaataaatcttaaaaataatcctttgaacttaaaatatgttcaaaattttcaagttgatatatttttctgaagaagaaaagagttgcacaagataaaagtttgtcttctcttcaatgaaactcaaccgatgtgttggtgggttatttcaattttaaaaggtgtttcctccaaaaacaaatctttaagagtatcttttgaacttaaaaatgttcgaacatttcaagtggatatatttaatgaataatagacactttttcataagtgtattagtcgtgcaaacagtcacttctcaaaattcattatagagttagaaacgttttccacaattgaaaaataaaaataaaaaatcctctctatgtatataaatatgcattcatttatgaatcacatacagatgtcgaaataataaaaagaatcataaacatatggtatgttataatttatgttatatggtatgaatttaataaaaatgtcctataatattttttccccaaattcagatggtctttgatagctaaaagagtaccgggaagaacagataaccaagtcaagaactactggaacactcatctcagcaaaaaactcgtcggagattactcctccgccgtcaaaaccaccggagaagacgacgactctccaccgtcattgttcatcactgccgccacaccttcttcttgtcatcatcaacaagaaaatatctacgagaatatagccaagagctttaacggcgtcgtatcagcttcgtacgaggataaaccaaaacaagaactggctcaaaaagatgtcctaatggcaactactaatgatccaagtcactattatggcaataacgctttatgggttcatgacgacgattttgagcttagttcactcgtaatgatgaattttgcttctggtgatgttgagtactgcctttagttgatgttttgaatttgtctttgaatttttgagataaaataacaattaattatggatactaatatcgatatcaatactaccactattacaatctaggagtacgtacttct

SEQ ID NO: 3984 - DNA, 3961 bp, Artificial Sequence
  P821 (35S::G418)
caccaaggaggtatcttcaacttctctaatggattcgaccgatcagattctcccaatttaacaactcagcagaagcaagagcatcaaagggtagagatggacgaggaatcttcagtcgccggaggtaggattccggtctacgaatcagccggtatgttatccgaaatgtttaatttccccggaagcagcggtggaggaagagatctcgacctcggccaatctttccggtcaaataggcagttgcttgaggagcaacatcagaatattccggctatgaatgctacggattcagccaccgccaccgcagccgccatgcagttattcttgatgaatccaccgccaccgcaacaaccaccgtctccgtcatccacaacttccccaaggagccaccacaattcttcaactcttcacatgttacttccaagtccatccaccaacacaactcaccatcagaactacactaatcatatgtctatgcatcagcttccacatcagcatcaccagcagatatcgacgtggcagtcttctcccgatcatcatcatcatcatcacaacagccaaacggagattgggaccgtccacgtggaaaacagcggaggacacggaggacaaggcttgtccttatctctctcatcgtctttagaggctgcagcaaaagcggaagagtatagaaacatttactacggagccaattcttctaacgcatcacctcatcatcaatacaatcaattcaagactcttcttgctaattcttctcaacatcaccatcaagtattaaaccaattccgatcatctccggctgcttcttcctcttccatggcagcggtcaatatcttaagaaactcgaggtacacaacggccgcgcaagagttgttggaagagttttgtagtgttggaagaggatttttgaagaagaacaaacttgggaacagctcaaaccctaatacttgcggtggtgatggtggtggcagctctccttcgtcggccggagcaaacaaggagcatcctcctttatcggcgtctgatcggattgagcatcaaagaaggaaagtgaaactactcaccatgcttgaagaggtatgttcatattaacttttaatattgattttgactttgtctatactctacagtgatattagttcatacattttacgtaaaattgttttcgttgcatttcgataagattcataaattgatccaagagttatgacaaagaaacaagaaacctgatatgactgaattggtcttttgttttctcgattaactacttatttttgattattttggtagagtttgattgcgcaatcctaccatcatttgtttaaaattaaaattaatttaatcattttgctcgtgtgacggtcgtattagaaagtatattgaatattttgatgcttagcgtttggtggaatcgattaatcaaagaaaatgcattaaataattacgattaattatgtaattggcgtttccttctccatataagctactctccagttacgtcctaaagctaacccttgacgttacttatttgtttacccataattgaattatctactttttagttgaccttgcttttttctcactagaaataaatattttagtttatgctcgaggatacgataaaatgtgctgttggtaggattgcgcaaacattgaagtatattctctggtcaataatttgtctatataatatcttattttcttattttgtctcgtttaaaggtaactaattaatctcattagtttatttattagatgatgctcgtacacaagcataggttcccgtgataaaatctacactaaataataatcacgtgaacatataacacaacacacacgagttaacaataacattaattaaaagaaaaaggcaaatattgatatttatggattgtataatgtatagttttgtttcgttggcaggtggaccgacggtacaaccattactgcgagcaaatgcagatggttgtgaactctttcgacatagtaatgggccacggtgcggcattaccgtacaccgcattggctcaaaaagctatgtcaagacattttagatgccttaaagatgcagttgcggctcagcttaagcagagttgcgaacttcttggggacaaagatgcagcgggaatctcttcttccgggttaacaaaaggtgaaactccgcgtttgcgtttgctagagcaaagtttgcgtcagaaccgtgcgtttcatcaaatgggtatggaacaagaagcttggcggccacaacgcggtttgcctgaacgctccgtcaatatacttagagcttggctcttcgaacatttccttcacccgtaagtcaattttttctttctttctcgttatttattaattattatagagaaactgaattttgaaaaaagctgagaaaaagtatttattttctcgttatttcacctctactttctttagtactatgtctctagaattttgctattttattgttaacgagagtgaacgaaaaaatggaaataaagcaaaagagtagtgtttttgtactattttcacctctctgacaaattgctttaagagtaaaaccaaaccaaaaaagccaagtaaaaaaaaaaaaactggatcgatgatatgtaatcatcaacttttcttttgtctgttagattctcacgcccttgttaggaaaaagtctgtactttttcttgcgtctacttgattgtattgtatatagtgaaaagataaagaaaataaattacattgagtttattagggcaaagatagagagtgatgtcattttctggtctctttctcaggtatccaagtgatgcagataaacacctattggctcgacagactggtttatccagaaatcaggtcagtctacatatatacatatagccaacgatataatgaaatttaaaatctccatgaatcaaatacatatgcctctacttcaccaagttgtgttagctgagtatactcttaatcagacaatcaaatgaccacagtctggattacgaattcttaaccgcgtgttttaaagatttgttttaaacccatcattctatgtttataaataaactccacaatagtacacagttatatatataactacaatattaatttatcacccaaacccatttcataattttcataaacatatacatgcttgttataaacatcaaataataaatactagtagttactcaaaacgaatttgactaagccaaaattatttgacaccatgtacgagtacactaactagtagcctgagatgactctattgcatggtttttgtttcttatctttgtttggtttgtgatatgacagaggaacaccatgtgttttgccttccactcaccattagcttttcttgggattcgtctttaaattattatagcatatttatatatacaaaaacataggagagagagaaagagatcgacattaaagacgcaaaagggtccatttttcctcaagtacatcaaagtttgcagctttcaattgtcccaaagaaaccctcaatttcttgtatccctacattaaataaccaaatgacaaataaacaaaaagagccctcaattttatttcgatattataatgattcaactagtgaaaattttgtctcttttattcaggtatcaaattggttcataaatgctagggttcgtttatggaaaccaatggtggaagaaatgtaccaacaagaatcaaaagaaagagaaagagaagaggaattagaagagaacgaagaagatcaagaaacaaaaaacagcaacgacgacaagagcacaaaatccaacaacaatgaaagcaacttcactgccgttcggaccacttcacaaactccaacgacaaccgcaccagacgcatcagacgcagacgcagcagtagcgacaggccatccgtctaagatccaacattaatgcttacgaaaacgacgcttcatcacttctactcccttcctcttattccaacgccgccgctcctg

SEQ ID NO: 3985 - DNA, 1487 bp, Artificial Sequence
  P825 (35S::G409)
ctcagaactcagaagtagttgttgttttatttctgttgatcaaaaatggaatccaattcgtttttcttcgatccatctgcttcacacggcaacagcatgttcttccttgggaatctcaatcccgtcgtccaaggttcttttctcactctcttaatcttatttcatcatcttggaacacattacttttcggtgaatttcccctgtttttgtgtataaaacgttaggaacacacatacacacacatgagaaccaatttgaatatgaatacctcattcgattattgacagcagttgttcgtttgaatttgtgaaggaggaggagcaagatcgatgatgaacatggaggaaacttcgaagcgaaggcccttctttagctcccctgaggatctctacgacgatgacttttacgacgaccagttgcctgaaaagaagcgtcgcctcactaccgaacaagtagattctctcactatccacaataataattaacgatccactattcaaaaacaagtttgatagattctcattatattatggtaaaaggtgcatctgctggagaaaagcttcgagacagagaacaagctagagcctgaacgcaagactcagcttgccaagaagcttggtctacagccaaggcaagtggctgtctggtttcagaatcgccgagctcgttggaaaacaaaacagcttgagagagactacgatcttctcaagtccacttacgaccaacttctttctaactacgactccatcgtcatggacaacgataagctcagatccgaggtacttatacatgggactattatttatctcaacaagattacaaattgaatgatttaccttaattggtccaaaggagaaaaataaaaaaagcatcaagtgaaaagagaatatgcttttcctatttttcaacacaagctgatagagagaatccatcatcatatatatataaattagaggagagactagaaaaagaaagaaaattggggaatcaaatcaatcaacgagtttaattatctttttatgggaggaggttgcttgtgttgaccgttgtgattaaagttagaatctttccaacccgacaggttacttccctgaccgaaaagcttcagggcaaacaagagacagctaatgaaccacctggtcaagtgcccgaaccaaaccaacttgatccggtttacattaatgcggcagcaatcaaaaccgaggaccggttaagttcagggagcgttgggagcgcggtactagacgacgacgcacctcaactactagacagctgtgactcttacttcccaagcatcgtacccatccaagacaacagcaacgccagtgatcatgacaatgaccggagctgtttcgccgacgtctttgtgcccaccacttcaccgtcgcacgatcatcacggtgaatcattggctttctggggatggccttagaaaaccactctgataataaatgtgtgtttatttaagttcaagagtcatcttcttg

SEQ ID NO: 3986 - DNA, 4600 bp, Artificial Sequence
  P829 (35S::G390)
ctccaaccattaccatctcatgaacactctcacaggaggctctctcttctcagagagcctacccatctaatatttcttcatctgagtctcttttacttctctcaaagtatcgatctttattcttctttttgtaaaccctctctctctctctgatttctactgacctgtttggaagatatgatggctcatcactccatggacgatagagactctcctgataaaggatttgattccggcaagtacgttagatacacgccggaacaagttgaagctcttgagagagtttatgctgagtgtcctaaacctagctctctgagaagacaacagcttattcgtgaatgtcccattctctgtaacatcgagcctcgacagatcaaagtttggttccagaatcgcaggttattatttctttattaattgtctttaatggaatgttttttgtgttctttgattgtttctgtaattataaaattgaatttcttttgtttgtatttggagacaaaaatgttcttgtctgacaatgtttttggtaatcttcttgtttttggtctaattggtgattgttaagcttttgaaactttcagatctatgtctataaatttgtttttctctttttgcttattaggcttttgttgacacagttgaaagttaaaatcacaaggaaaagtgacagctaatcaaactgtctttgatgagctttaaaacgcctctctctttttttccttctgcagagaatatgttggaaattacattatcttttgttctttatgtcattctggtatcattctaaagcaaaaaagtgtgtgtttcttctgttcatttttctattatttcaacacatttatcatactgctataggtttgtctttaacttttctggtttcttttggttgttttgttgactttttagatgtcgagagaagcagaggaaagagtcagctcgtcttcagacagtgaacaggaagctgagtgctatgaacaagcttttgatggaagagaatgatcgtttgcagaagcaagtctccaacttggtttatgagaatggattcatgaaacatcgaatccacactgtaagtccttgaatcccttttgctaaatgcattgttgagttgttatctttgatgcttgtatatgtatttgttctttaagagttctctgttgttagagagtgactggtgaaatctctgtgttgtgtcttaggcttctgggacgaccacagacaacagctgtgagtctgtggtcgtgagtggtcagcaacgtcagcagcaaaacccaacacatcagcatcctcagcgtgatgttaacaacccagctaagtaaggaaggctctttttttgtttgtgaatttctcattgtgacattatgagaagagactaaatggagtgtttttttggtagtcttctctcgattgcggaggagaccttggcggagttcctttgcaaggctacaggaactgctgtcgactgggtccagatgattgggatgaaggtagataagttgaagtattttaacgttttcatatgtggaaatgaagtggtttttagaaaatgttttaatatgtattttcatggttatgtatgtagcctggtccggattctattggtatcgtagctgtttcacgcaactgcagtggaatagcagcacgtgcctgtggcctcgtgagtttagaacccatgaaggtaatggtgttttctttttattttaatcttgtgttgtaagaagcggaaattctacgaaggcaatctaaacttcaaatactgtgtaggtcgctgaaatcctcaaagatcgtccatcttggttccgtgactgtcgatgtgtcgagactctgaatgttatacccactggaaatggtggtactatcgagcttgtcaacactcaggtctgtttcataaatccatgagtgttgtttttgttcctttaaaatgtaatgatcattattcatggttggttatcagatttatgctcctacaacattagcagcagctcgtgacttttggacgctgagatatagtacaagtctagaagatggaagctatgtggtgggtattaggacctggttttgttcatctatgattctatttattagatttgccttatatttgcttttttgccttcaggtctgtgagagatcactcacttctgcaactggtggccccaatggtccactttcttcaagcttcgtgagagccaaaatgctgtcaagcgggtttcttatccgtccttgtgatggtggtggttccattattcacatcgttgatcatgtggacttggatgtaagcatattggatttgtaatagcacattaggtttcgtaaaagccttctatttatgttgattgatacgtttttttggtttggtaggtctcaagtgttcctgaagtcctcaggcctctttatgagtcttccaaaatccttgctcaaaaaatgactgtcgctgtaagttccatataaaccttatccacccgtgacctgattaggctctctttatgagttttacttccacatttcaggctctgagacatgtgcgccaaattgctcaagagactagtggagaagtccagtatagtggtggacgccagcctgcagttttaaggactttcagccagagactctgccggtaatacatttccttgataagcttagttttattttctaaagcattgttctaattgcttttcttgaaattcaggggtttcaatgatgctgtaaatggttttgtcgatgatggatggtctccaatgagtagtgatggaggagaggatattacgatcatgattaactcttcctctgctaaatttgctggctcccaatacggtagctcatttcttccaagttttggaagtggtgtcctctgtgccaaagcttctatgctgttgcaggtgcctatatcatgttttgacacttgtgaatagacaaaagaaccggtttcttcaatttctgacatcattctcttttttatctgctcttgaagaatgttccaccccttgtattgattcggttcctgagagaacaccgagctgaatgggcagactatggtgtcgatgcctattctgctgcatctctcagagcaactccatatgctgttccatgcgtcagaaccggtgggttcccgagtaaccaagtcattcttcctctcgcacagacactcgaacatgaagaggtacaaagaatctcaagaacattttccttgttgtctattcttttgccatgcctataatcctattttgcttacttgtttctcagtttctcgaagtggttagacttggaggtcatgcttactcacctgaagacatgggcttatcccgggatatgtatttactgcaggtttgctttatactaaagacactcagggattcttaaagatgagttattgaaattgaattcttggtttcttttttgcttttgtccagctttgtagcggcgttgatgaaaatgtggttggaggttgtgctcagcttgtctttgccccaatcgatgaatcatttgctgatgatgcacctttgcttccttctggtttccgtgtcataccactcgaccaaaaaacaaatccggtaaaaagaaaactgtttatgataagaaatttgatatcttgaaattgacacagtcctttttcttttattcctgtatgtaacgttacagaatgatcatcaatctgcaagtcgaacacgggatctagcatcgtccctagatggttccaccaaaaccgattcggaaacaaactctagattggtcttaacaatagccttccagttcacgtttgataaccattccagagacaatgttgctacaatggcgagacagtatgtgaggaacgttgttggttcgattcagagagtggctctagccattacgcctcgtcctggctcaatgcaacttcccacttcccctgaagctctcactcttgtccgttggatcacccgtagttacaggtactcttcttagaaccttaatctaaagacttgtaacaatatagaatgtgcttatctcatttaataactcaataaaatgtttttctccgatgttttagtattcatacaggtgcagatctgtttggagctgattctcagtcctgtggaggagacacattgcttaagcaactctgggaccatagtgatgccatattgtgctgctccctgaaaactaatgtaagaattctgtttttttaagaggtgctcaatctagtttatggttcggtttgggaattgtctgattattttttggttctcaggcctcaccggtattcacatttgcaaaccaagctggtttagacatgcttgaaactacacttgtggcacttcaggatataatgctcgacaaaacacttgatgactctggtcgtagagctctttgctccgagttcgccaagatcatgcagcaggttaaacattttctagctagtcttttaagtctttccctggaaaatactaagtttggattgaatcttcttcagggatatgcgaatcttccggcaggaatatgtgtgtcgagcatgggcagaccggtttcgtatgagcaagcgacggtgtggaaagttgttgatgacaacgaatcaaaccactgcttggcttttaccctcgttagttggtcgtttgtttgatgaagg

SEQ ID NO: 3987 - DNA, 789 bp, Artificial Sequence; identical to SEQ ID NO: 743
  P836 (35S::G991)

SEQ ID NO: 3988 - DNA, 2104 bp, Artificial Sequence; identical to SEQ ID NO: 251
  P841 (35S::G278)

SEQ ID NO: 3989 - DNA, 1832 bp, Artificial Sequence
  P865 (35S::G636)
cgatgatgcaactgggtggtggtactccgaccactacagcggcggctacaaccgtcacaactgctacagcaccaccgccacaatcaaacaacaacgattcagcggcaacagaagcagcggcagcagcggttggggcgtttgaggtgtcggaagagatgcacgaccgtgggtttggaggaaatcgttggccgcggcaggaaacgctagcgttgttgaaaatacgatctgacatgggaatagcgtttcgagacgctagcgttaaaggtcccttatgggaagaggtttctaggaaaatggcggagcatggttacataagaaacgcaaagaaatgcaaagagaaattcgagaacgtttacaaataccacaaacgaaccaaagaaggtcgtaccggaaaatccgaaggcaaaacttatcgcttctttgatcaattagaagctctcgagtctcaatctacaacctcactccaccatcatcaacaacaaacgcctcttcgaccacagcaaaacaacaacaacaacaacaacaacaacaacaacagctccatattttcaactcctcctccggtaacgacagttatgccgacgcttccttcttcatcaattcctccgtatactcagcagattaatgtaccttcgtttccaaacatctccggtgattttctatcggataattctacatcgtcttcgtcttcttattcgacttcttctgacatggagatgggtggtggaactgcgactacaaggaagaaaaggaagaggaaatggaaggtgtttttcgagcggttgatgaaacaagtagttgataaacaggaagagcttcaacgcacattcttggaagctgttgaaaagcgagaacacaagagattggttagagaagagtcttggagagttcaagagattgccagaatcaaccgcgagcacgagatcttagctcaagaacgctctatgtccgctgcaaaagacgctgctgttatggcctttcttcaaaaactgtcagagaaacaaccgaatcagccacaaccgcagcctcagccgcaacaagttcgaccatcaatgcagcttaataacaacaatcagcagcaaccgcctcaacggtctcctccaccgcaacctcctgctccgcttccgcagccaattcaagcggttgtgtcgacgttagacacaacgaaaacgcacaatcgtggtgatcagaatatgactcctgcagcttcagcgagctcgtcgcggtggccgaaagtggagatagaagcattgataaagctgaggacgaatcttgattcgaaatatcaagaaaacggaccaaaaggaccattgtgggaagagatatcagcgggaatgagaaggttaggattcaacaggaactcaaagagatgcaaagagaaatgggaaaacataaacaaatacttcaagaaagtcaaagagagcaacaagaaacgtcccgaagattccaagacttgcccttactttcaccagcttgatgctttatatagagagaggaacaaattccacagcaacaacaacattgcagcttcttcttcatcttccggtcttgttaaaccggataattctgttcccttgatggtccaaccagagcagcaatggcctccggctgtaacgactgcgacaactactcccgcagcggctcagcctgatcagcaatctcagccgtcggagcagaactttgatgatgaagaaggtacagatgaagagtacgacgatgaagatgaggaagaggagaatgaagaagaggaaggaggtgagttcgagcttgtgcctagcaataacaacaacaacaagacgacgaataatctgtaatgatgatgattcgagttc

SEQ ID NO: 3990 - DNA, 3283 bp, Artificial Sequence
  P866 (35S::G657)
gctttccttgctaactatgaagcgtgagatgaaagcacctactactccactagagagtctccaaggtgacctcaaaggaaaacaagggtacgcttacatctctcttccttttcttctattgggtttcaatgttgaagttggattgcttttggcaccaaattttgcattcaactagacattctcaggttaataatgatgcaagctctttgtgacattttcataggaggacatctggccctgctagacgatctaccaaaggacaatggacacctgaagaggtgcgttccgttcctgtgtcttttttgttgtctatctgattcttccatgcttcatattatgtatcctggaacactgcctgagcttaatcagttgtctctgtaacaccctattgttgcttcgcacagttccatttaactagttgacattagctatcctttgcatctattgaagaattcgtctctatgaagttttctgttgtatcaattctgtttttctggatcaggacgaagtcttgtgtaaagctgttgagcgttttcaaggaaagaactggaagaagataggtaaatcgaatagcaaattctgatttcttcttgttttcccagtttgtttttccagcgtatgttaagatcatatcaataataatctactttagctgccatgtttatttgtagtctttagttagtacggtgaaagtaatatgtggttttatttgattcaccttttcagctgaatgttttaaggatcggactgatgttcagtgtcttcatagatggcaaaaggtcttgaacccagagcttgtgaaaggaccgtggtcaaaagaggtgattttgtgaattgctttatatgctttactcggtttgagtctaatacaccttagcatttgtaatgtgttccatgacattacttttccatgttttgaaggaggataacacaataattgacctggttgaaaaatatgggccaaagaaatggtctactatatctcagcatttacctgggcgcataggaaagcaatgtagggaaaggtaatgcaaaggctctcaacttctttccgataaaatgatatttacatacattgggtggtacttcaacgcacataaacaatattgtgggtgatgtaggtggcataaccatcttaaccctgggattaataaaaatgcatggactcaggaagaggaactgactcttattcgtgcgcatcaaatttatgggaataaatgggcagagcttatgaaatttttgccaggaaggtaaatatgtcttttccatgggtcctagtataacaacataggtgtaacatgtccgtaaaattggtggcctcataaatgaaataataggtttttgatgctggtagttgtggtctatcgttcctgctttggtgatttgcttattttttcttacgttcctgtaggtcagataattcgataaaaaatcattggaacagctcagttaagaagaagttggattcctactatgcatcaggtcttttagatcagtgtcaaagctcgccattaattgcccttcagaacaaatctatcgcttcatcttcctcgtggatgcacagcaatggagatgaaggtagttcaaggccaggggttgatgctgaggaatcagaatgcagccaagcttcaactgttttctcacaatcaaccaacgatttacaagatgaagttcaacgtggaaatgaggaatattacatgcctgaatttcattcaggaacggagcagcaaatctcaaacgctgcatctcatgcagaaccgtactacccttcctttaaagatgtcaaaattgttgtccccgaaatttcttgtgaaacagaatgttcgaagaagtttcagaatcttaattgttctcacgagctaagaactaccacagctacggaggatcaattgccgggtgtatctaatgatgctaaacaggaccgtggtctagagttattgacccataacatggacaacggtggaaaaaaccaagcacttcaacaagattttcaaagttcagtaagattaagtgatcaaccttttttgtcaaactcggacacagatccagaagctcaaactttgatcacggatgaggagtgttgtagggttctttttccagataacatgaaagatagcagtacatcttctggtgagcaaggtcggaatatggttgaccctcaaaacggcaaaggatctctttgttctcaggctgcagaaacccatgctcatgaaactggaaaagttccagctttaccgtggcatccttcaagttctgagggcctggcgggtcataattgtgtccctttgttggattcagacttgaaggactcacttttaccccgtaatgattccaacgctcctatacaaggttgtcgcctttttggagctaccgaattagaatgtaagactgatacaaatgacggtttcatcgatacttacggacatgtaacttcccatggcaatgatgataatggtggtttcccagaacaacaggggctgtcatatattcccaaggattctttgaagctagtacctttgaatagtttttcttctccttctagagtgaacaagatttattttcctattgacgataagccggctgaaaaagacaaaggagctctttgttatgaacctccacgttttccaagtgcagatattcctttcttcagctgtgatcttgtaccatcaaatagtgacttacggcaagagtacagtccctttggtatccgtcagttgatgatttcttcaatgaattgtacaactccgttaaggttatgggattcaccgtgtcacgataggagccctgatgtcatgcttaatgatactgccaaaagttttagtggtgcaccatccatcttaaagaagcggcatcgagacttgctttcacctgtgcttgatagaagaaaagacaaaaagcttaaaagggctgcgacttcctccttggctaatgatttttcgcgcttagatgtaatgcttgatgaaggagatgattgcatgacctctcgtccgtcagagtctcctgaagataaaaatatatgtgcctccccttccatagccagagataacagaaattgtgcatcagctcggttatatcaagaaatgattccgatagatgaggaaccaaaggaaaccttagaatcaggtggagtgacttctatgcaaaatgaaaatggatgtaatgacggtggtgcttcagctaaaaatgtaagtccgtctttgtccttgcatattatctggtatcagttataaaatcccagtcatctcattctctgatgtctatagctgtaaggtgcaatgtctgg

SEQ ID NO: 3991 - DNA, 1419 bp, Artificial Sequence
  P868 (35S::G772)
tatgggtcgcgaatctctggctgttgtgtcctcgccgccatcggcgactgcgcccagtactgctgtgtcggctacctcgcttgctcctggctttcgatttcatccgactgatgaggaactcgtgagctattacttgaagaggaaggttctgggtaaacctgtacgcttcgatgcgattggagaggtagatatctacaagcatgagccctgggatttagcagtgttttcgaagttgaaaactcgggaccaagaatggtacttcttcagtgcgttagataagaagtacggtaatggtgctaggatgaatcgagcaactaacaaagggtactggaaagcaactggaaaagacagagaaatccgccgggatattcagttgctcggtatgaaaaagacgcttgttttccacagcgggcgtgctccagacggccttcggactaattgggtcatgcacgagtatcgccttgtggaatatgaaactgaaactaacggaagcctgctgcaggatgcatatgtgttgtgcagagtgtttcacaagaataacattgggccaccaagtgggaacagatatgcgccattcatggaagaagaatgggctgatggtggaggagctctgattccaggaatagacgttagggtcagggtagaggctctaccacaagccaatggaaacaaccagatggaccaggaaatgcattcagcaagcaaggatctcattaacatcaacgagctaccgagagatgctactccaatggacatcgaacctaaccaacagaatcatcatgagagtgccttcaagccacaggagagtaacaaccatagtggttatgaagaagatgaggacacactcaaacgcgagcacgcagaagaagatgagcgtcctccttctctatgcattctcaacaaagaagctccactacctctcctgcaatacaaacgtagacgccaaaacgagtccaacaacaactcaagcaggaacacacaggaccattgttcgtccacaataacaaccgtcgacaatacaaccaccttaatctcatcatctgctgctgctgctaccaacactgccatctctgcattgcttgagttctcacttatgggtatctccgacaagaaagaaaaccagcagaaagaggaaacttctcctcctagtccaattgcatctcctgaagagaaggttaatgatctccagaaggaggttcaccagatgtctgttgaaagagaaactttcaagcttgagatgatgagtgcagaggctatgatcagcattctccagtcaagaatcgatgcgctgcgtcaggagaacgaggaacttaagaagaagaacgccagtggacaagctagttaaaccaccgcaacatctctccaggtgtcttcttcttcttcttcttcttctttgcctcttagctgtaatcttcttaa

SEQ ID NO: 3992 - DNA, 2473 bp, Artificial Sequence
  P873 (35S::G837)
ttggggagatctgaggcaaccctttttctctggtgcatgtgactagggattgtgccgtgggtttaggatcatggcaatggggaagtattctcgtgtagacgggaagaagtcatcgggatatggcttaaccattaccatcgttttaattgtttctctatgtttggttggggcgtggatgttcatgtcttcatggtctgctccaactgagtctattgacttctctgcaaacgagaggacaaaagatgtagatactactaagagtgatttcaaaagtgaagaggttgatcgaggttccaagagttttccggatgaaaagaatgaggagacggaggttgtgacagagaccaacgaagagaagactgatcctgagaaatctggtgaggagaactctggtgagaaaacggagtcggctgaggaaagaaaggagtttgatgacaaaaatggtgatggggatagaaaaaatggagacggtgagaaagacacggaatcagaaagtgatgaaaccaagcaaaaagagaaaacacaactggaagagagctcagaagaaaacaaatctgaggatagtaatggaaccgaagagaatgctggtgaatctgaagaaaacaccgagaagaagtcagaagaaaacgctggtgaaactgaagagagcactgagaagagtaaggatgttttcccagctggtgaccaggctgaaatcacaaaggagtcaagcactggaagtggggcttggtctacccaattggtggaatcccagaacgagaagaaagcacaagtgtcctcaattaaatggaaagtctgcaatgtgacagctggaccagactacatcccttgccttgacaattggcaagctatcagaaagcttcattcgacaaagcattatgaacatcgtgagaggcattgtcccgaggagtctccacgctgccttgtttctcttcccgaagggtataagcgatccatcaagtggcctaagagcagagaaaagatctggtacaccaatattccacacaccaagcttgcagaagtcaagggacatcaaaactgggtgaagatgagtggtgaatacttaacattccctggtggaggtactcaattcaagaatggtgctcttcactacattgatttcctccaagagtcatatcctgatattgcttggggaaataggactcgtgttatattggatgttgggtgtggggttgctagctttgggggatatctttttgacagagatgtactcgctttgtcatttgcacccaaagacgaacacgaggcacaggtgcaatttgctctggaacgtggtattcctgcaatgtcaaatgttatgggaaccaagagattaccttttccaggatctgtttttgaccttatccattgtgctcgttgtagagttccttggcatatcgaaggtggtaaactacttttggagttgaaccgtgcattgaggccgggtggtttctttgtctggtcagcgactccagtctataggaagactgaggaagatgttggcatatggaaagctatgtcgaagctaacaaaggcaatgtgctgggaactgatgacgattaagaaagatgaactgaatgaagttggtgctgccatttaccagaagccaatgtcgaataaatgctacaatgaaagatctcaaaatgagccacctctctgcaaagactctgatgatcaaaatgccgcctggaatgttccacttgaggcatgtattcacaaagtaacagaagattcatcaaaacgcggagcagtttggcctgaaagttggccggaaagagtggagacggttcctcagtggttagattctcaggaaggagtatatggaaaacctgcacaagaggatttcacagcagaccatgaacgctggaagactattgtttcaaagtcatacctcaacggtatgggaatcgattggtcttatgttagaaatgtgatggacatgagagcagtctatggaggttttgctgctgcattgaaggatctgaaactgtgggtgatgaatgtagttcctatcgactcacctgatacccttccgattatatacgaacgtggtttgtttggaatctatcatgattggtgtgaatcattcagcacttaccctcggacttacgacctccttcacgctgatcatcttttctcttcactgaaaaagaggtgcaacttggtgggcgtgatggctgaagtagaccggattcttagaccacaaggaactttcatagtaagagatgacatggaaacgataggagaaattgagaagatggtgaaatcgatgaaatggaatgtaagaatgacacattccaaagatggagaaggattgctctctgttcagaagtcatggtggcgtcctacagaggccgagaccattcagtcggcaatagcttgagatcaaggaaacgaagaagagtgtgggttaatatagtcgacagttgttccttttacgatccaattgattgtttcttacatgtattagtcg

SEQ ID NO: 3993 - DNA, 535 bp, Artificial Sequence
  P893 (35S::G30)
ctcttctgacgcacaacagtatatacacatacacagatatatggatcaaggaggtcgtagcagtggtagtggaggaggaggagccgagcaagggaagtaccgtggagtaaggagacgaccttggggtaaatacgccgcggaaataagagattcgaggaagcacggagagcgtgtgtggctagggacattcgacactgcggaagacgcggctcgagcctatgaccgagccgcctattcaatgagaggcaaagctgccattctcaacttccctcacgagtataacatgggaaccggatcctcatccactgcggctaattcttcttcctcgtcgcagcaagtttttgagtttgagtacttggacgatagcgttttggatgaacttcttgaatatggagagaactataacaagactcataatatcaacatgggcaagaggcaataaagggaatacaatcggtattaactgaaagttatgtgaaagaccattttcagttataacaaataaaataaaatcccaagcgtacaaagctgtttc

SEQ ID NO: 3994 - DNA, 505 bp, Artificial Sequence
  P894 (35S::G47)
cttcttcttcacatcgatcatcatacaacaacaaaaaatggattacagagaatccaccggtgaaagtcagtcaaagtacaaaggaatccgtcgtcggaaatggggcaaatgggtatcagagattagagttccgggaactcgtgaccgtctctggttaggttcattctcaacagcagaaggtgccgccgtagcacacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttgatttatctcgacggtcatgatcacgtttgatctt

SEQ ID NO: 3995 - DNA, 868 bp, Artificial Sequence
  P895 (35S::G147)
aaatcatcagatagaaggaaatattctgattgagagatggctcgtggaaagattcagcttaagaggattgagaacccggttcacagacaagtgactttttgcaagaggagaactggtcttctcaagaaggctaaggagctctctgtgctctgtgatgccgagatcggtgttgtgatcttctctcctcagggcaagctctttgagctcgctactaaaggaacaatggagggaatgattgataagtacatgaagtgtactggtggtggtcgtggttcttcttctgctacttttactgctcaagaacaacttcaaccaccaaatcttgatccgaaagatgagatcaacgtgcttaagcaagagattgagatgcttcagaaagggataagctatatgtttggaggaggagatggggctatgaatcttgaagaacttcttttgcttgagaagcatcttgagtattggatttctcagattcgctctgctaagatggatgttatgcttcaagaaattcagtcattgaggaacaaggaaggagtcctcaaaaacaccaacaagtatctcctcgacaagatagaggaaaacaacaatagcatattagatgctaacttcgcagtcatggagacaaactattcctatccgctaacaatgccaagtgaaatatttcagttctagaccatagggtatttgaagactatgtctcacgaatttaaataaccttggtaagtataatatagtgttgttaaatcacacataattaaaataaagcctgtggaacttcgctaggcagttgaaaatctatccgtatgttttatcctcttgttttacatttgttggtgtgaagatgaaatgactgcaagtgtggtgtgta

SEQ ID NO: 3996 - DNA, 959 bp, Artificial Sequence; identical to SEQ ID NO: 109
  P896 (35S::G152)

SEQ ID NO: 3997 - DNA, 883 bp, Artificial Sequence
  P909 (35S::G442)
tttaatagtgattgtactgcgctccgtaatattttctacagtttgtacgtgttgtgtttttccaatggaaaaggaagataacggatcgaaacagagctcctctgcttctgttgtatcctcgagaagacgaagaagagtggttgagccagtggaagcgacgttacagagatgggaggaagaaggattggcgagagctcgtagggttcaagccaaaggttcgaagaaaggttgtatgagaggaaaaggtggaccagagaatcctgtttgtcggtttagaggtgttcgacaaagggtttgggggaaatgggttgctgagatacgtgaaccagtgagtcaccgtggtgcaaactctagtcgtagtaaacggctttggcttggcacgtttgctactgcagctgaagctgctttggcttacgacagagctgctagtgtcatgtacggaccctatgccaggttaaatttcccggaagatttgggtgggggaaggaagaaggacgaggaggcggaaagttcgggaggctattggttggaaactaacaaagccggtaatggcgtgattgaaacggaaggtggaaaagactatgtagtctacaatgaagacgctattgagcttggccatgacaagactcagaatcctatgactgataatgaaatagtgaacccagcagtgaaatcagaggaaggttacagctatgatcgattcaaattggataacggattgttgtataatgaacctcaaagctccagttatcaccagggaggtggattcgattcatattttgagtatttcagattctagcttaggatttatgctgcatcaatatactatgactatgagactatgttttttacattgttagtttactccattttcatttatctt

SEQ ID NO: 3998 - DNA, 779 bp, Artificial Sequence
  P912 (35S::G490)
acccttgttcttgccaaactctacatcttcaaagatttttcatcatctgttgtgaaatataacatgaggaggccaaagtcatctcacgtcaggatggaacctgttgcgcctcgttcacataacacgatgccaatgcttgatcaatttcgatctaatcatcctgaaacaagcaagatcgagggggtctcttcgttggacacagctctgaaggtgttttggaataatcaaagggagcagctaggaaactttgcaggccaaactcatttgccgctatctagggtcagaaagattttgaaatctgatcctgaagtcaagaagataagctgtgatgttcctgctttgttttcgaaagcctgtgaatacttcattctagaggtaacattacgagcttggatgcatactcaatcatgcactcgtgagaccatccggcgttgtgatatcttccaggccgtaaagaactcaggaacttatgatttcctgattgatcgtgtcccttttggaccgcactgtgtcacccatcagggtgtgcaacctcctgctgaaatgattttgccggatatgaatgttccaatcgatatggaccagattgaggaggagaatatgatggaagagcgctctgtcgggtttgacctcaactgtgatctccagtgaacatgaagctgctctggaagacaaaaacttgaagaagagaagaaatctgaagaggaatcacccaacaactctatgttatgttcaccttataatagtttatcataaactcattcactaaactatgtgta

SEQ ID NO: 3999 - DNA, 1339 bp, Artificial Sequence
  P915 (35S::G567)
gagcgagcgatgaacagtatcttctccattgacgatttctccgatcctttctgggaaactcctccgattcctctcaatcccgactcttctaagcctgttacggcggatgaagttagccagagtcaaccggaatggactttcgagatgtttctcgaagagatttcttcgtcggcggtgagctctgagccacttggtaacaacaacaacgcgatcgtcggtgtttcttcggcgcaatctcttccttctgtttccggacagaatgatttcgaggatgatagtcgatttcgtgatcgcgattcgggaaatttggattgtgctgctcccatgacgacgaagacggtgaatgttgattccgatgattatcgtcgtgttcttaagaacaagcttgaggctgagtgcgcgactggtgtttctcttcgggttgggtctgtgaagcctgaagattcgactagttctccagaaactcaacttcaaccagttcaatccagtcctcttactcaaggagaacttggtgttacttcttccttaccagctgaggtgaaaaaaactggtgtatcaatgaagcaggttactagtggatcgtcgagagaatattctgatgacgaggaccttgatgaagagaatgaaaccaccggttccttgaagccagaggacgttaaaaaatctagaaggatgctgtcaaatcgtgagtcagctaggcgatctagaaggagaaagcaggagcaaacaagtgacctcgaaacacaggttaatgatctaaaaggtgagcattcatcacttcttaaacaactgagcaacatgaatcacaagtatgacgaggctgctgttggcaatagaatactaaaggctgacattgagacattaagagctaaggtgaaaatggcggaagaaaccgtgaagagagtaacaggaatgaatccgatgcttctcggaagatcaagtggacataacaacaacaacagaatgccaataactggtaacaacaggatggattcttctagcattattccagcttatcaaccacactcaaacctaaaccatatgtcaaaccaaaacatcgggatcccaaccattctacctccaagactcggaaacaatttcgctgctcctccatcccaaaccagctctcccttgcagagaattagaaatgggcaaaatcaccatgttactccaagcgccaacccgtatggctggaataccgaacctcagaacgattcagcatggccgaaaaaatgcgtggactgatcaaacaagaagcgggtttcgcactatattaatgtctatgcatctgtaatttgtaagtgttattaagttacgaatcatgagaaaacatcttgtg

SEQ ID NO: 4000 - DNA, 2079 bp, Artificial Sequence; identical to SEQ ID NO: 623
  P927 (35S::G831)

SEQ ID NO: 4001 - DNA, 768 bp, Artificial Sequence
  P929 (35S::G913)
aaaacacattgtaacattagtttaagcattaagcttctttatgtcgaataataataattctccgaccaccgtgaatcaagaaacgacgacgtctcgtgaagtctcaatcacattgcctactgatcaatctcctcaaacctcaccaggatcatcttcttctccttcaccgagaccttccggtggatcaccggcgagaagaacggcgactggattatccggcaagcactctattttcagggggattcgactacgtaacggaaaatgggtatcggagattagagagccacgtaaaacgacaagaatttggctcgggacttatccggtaccggagatggctgccgccgcttacgacgtggctgcgttagctttaaaaggacccgacgccgttttgaattttcctggtttagctttgacttacgtggctccggtttcaaactctgctgcggatataagagcggctgctagtagagcagcggagatgaagcaaccggatcagggtggggatgagaaggtattggaaccggttcaacccggcaaagaggaagaattagaagaagtgtcgtgtaactcgtgttcgttggagtttatggatgaggaagcgatgttgaatatgccgactttgttgacggagatggctgaagggatgttgatgagtccaccgagaatgatgatacatccgacgatggaagatgattcgccggagaatcatgaaggagataatctttggagttataaatgaatccattgaagctgctctcttttttattg

SEQ ID NO: 4002 - DNA, 532 bp, Artificial Sequence
  P934 (35S::G1053)
ctcatataaaccaaactaaaaccatgattccggcagaaatcaacggatatttccaatatctatcaccggaatacaacgtaataaacatgccttcatctccaacctcttccttaaactacctaaacgatttgatcatcaacaacaacaactattcctcatcatccaacagtcaagatctcatgataagcaacaactcaacttccgacgaagatcatcatcaaagcatcatggtactcgacgagaggaaacagagaaggatgctttcgaacagagaatctgcaaggaggtcaaggatgaggaaacagagacatcttgatgaactctggtctcaggtaataaggcttcgcaacgagaacaactgtcttatcgataagctgaaccgcgtatcggagactcaaaattgtgtattgaaggagaactctaaactcaaagaagaagcttctgatctccgacagcttgtttgtgaactgaaatctaacaagaacaacaacaatagttttccaagagagtttgaagataattagtattactc

SEQ ID NO: 4003 - DNA, 1311 bp, Artificial Sequence; identical to SEQ ID NO: 837
  P938 (35S::G1137)

SEQ ID NO: 4004 - DNA, 747 bp, Artificial Sequence
  P939 (35S::G1140)
attcaagaacagtagtgaaggagagatctggtaaaatggcgagagagaagataaggataaagaagattgataacataacagcgagacaagttactttctcaaagagaagaagaggaatcttcaagaaagccgatgaactttcagttctttgcgatgctgatgttgctctcatcatcttctctgccaccggaaagctcttcgagttctccagctcaagaatgagagacatattgggaaggtatagtcttcatgcaagtaacatcaacaaattgatggatccaccttctactcatctccggcttgagaattgtaacctctccagactaagtaaggaagtcgaagacaaaaccaagcagctacggaaactgagaggagaggatcttgatggattgaacttagaagagttgcagcggctggagaaactacttgaatccggacttagccgtgtgtctgaaaagaagggcgagtgtgtgatgagccaaattttctcacttgagaaacggggatcggaattggtggatgagaataagagactgagggataaactagagacgttggaaagggcaaaactgacgacgcttaaagaggctttggagacagagtcggtgaccacaaatgtgtcaagctacgacagtggaactccccttgaggatgactccgacacttccctgaagcttgggcttccatcttgggaatgaatctgagagagagaaagatccagcagagttgacttcgatggaagcccac

SEQ ID NO: 4005 - DNA, 1563 bp, Artificial Sequence
  P941 (35S::G1198)
gagactaatcaagaagagatatcatcaattgaagctgttttcttgagtagagatggcgaaccatagaatgagcgaagctacaaaccataaccacaatcatcatcttccttattcacttattcatggtctcaacaacaatcatccatcttctggtttcattaaccaagatggatcgtccagtttcgattttggagagctagaagaagcaattgttctgcaaggtgtcaagtataggaacgaggaagccaagccacctttattaggaggaggaggaggagctacgactctggagatgttcccttcgtggccaatcagaactcaccaaactcttcctactgagagttccaagtcaggaggagagagcagcgattcaggatcggctaatttctccggcaaagctgaaagtcaacaaccggagtctcctatgagtagcaaacatcatctcatgcttcaacctcatcataataacatggcaaactcaagttcaacatctggacttccttccacttctcgaactttagctcctcctaaaccttcggaagataagaggaaggctacaacttcaggcaaacagcttgatgctaagacgttgagacgtttggcccaaaatagagaagctgctcgcaaaagccgtcttaggaaaaaggcgtatgtgcaacagctagaatcaagtaggataaagctttcccaattggagcaagaacttcagcgagctcgttctcaggggctgttcatgggtggttgtggaccaccaggacctaacatcacttccggagctgcaatatttgacatggaatatgggagatggctagaggatgataaccggcatatgtcggagattcgaaccggtcttcaggctcatttatctgacaatgatttaaggttgatcgttgacggttacattgctcattttgatgagatattccgattaaaagccgtggcagcgaaagccgatgtttttcacctcatcattgggacatggatgtccccagccgaacgttgttttatttggatggctggtttccgtccatccgacctaatcaagatattggtgtcgcaaatggatctattgacggagcaacaactgatgggaatatatagcctacaacactcgtcgcaacaagcagaggaggctctctcgcaaggcctcgaacaacttcagcaatctctcatcgatactctcgccgcatctccagtcattgacggaatgcaacaaatggctgtcgctctcggaaagatctctaatctcgaaggctttatccgccaggctgataacttgaggcagcagaccgttcaccagctgaggcggatcttgaccgtccgacaagctgcacggtgtttcctagtcatcggagagtactatggacggctcagagctcttagctccctttggttgtcacgcccacgagagacactgatgagtgatgaaacctcttgtcaaacgacgacggatttgcagattgttcagtcatctcggaaccacttctccaatttctgaatggaatgaaactttgtataactaaaaggccaagtttcattgtctgtcgtaatttcacctatttc

SEQ ID NO: 4006 - DNA, 1200 bp, Artificial Sequence
  P946 (35S::G1229)
caacgaacgaggaagagagagagagaaggatatatctctaatcacgatgcaggagataataccggattttcttgaagagtgtgaatttgtcgacacttcactagccggagatgatctatttgccatcttagagagtcttgaaggtgccggagagatatctccgacagctgcatctacacctaaagatggaaccacaagttccaaggagttagttaaggatcaagattatgaaaactcatctcctaagaggaaaaagcaaagactagaaaccaggaaagaagaggacgaagaagaagaagacggagacggagaagcagaagaagataataagcaagatgggcaacaaaagatgtctcatgtaaccgtggaacgtaaccggagaaagcaaatgaacgagcacttaaccgttttgcgttctcttatgccttgtttctacgtcaaacggggggaccaagcatcgatcataggaggagttgtggagtacataagcgagttacaacaagttctccaatctttggaagccaagaaacaacgtaaaacctacgccgaagtcctaagcccgagagttgtcccgagccctcgtccttcaccgcctgttctaagcccaagaaaaccgcctcttagcccgcgcatcaaccaccaccagattcaccaccacctacttctccctcccataagtcctcgaacacctcagccaacaagcccataccgggccattccaccgcaactaccactcatcccacagcctccgcttcgctcttacagctcattggccagttgcagcagcttaggagatccacctccatactctcctgcttcatcttcttcatctccttcagttagtagtaaccatgagagtagtgtgatcaatgagcttgttgctaactcaaaatcggctttggctgatgtggaagtgaagttttcaggagctaacgtgctgctcaaaacggtgtcgcataagatcccgggacaagttatgaagataattgctgctcttgaagatttggctcttgagattcttcaggttaatattaacaccgtcgacgaaaccatgcttaattctttcaccatcaagattggaattgagtgccaactaagtgcagaagaactggctcaacaaattcagcaaacattctgctagtaaagaaggatttaatatagcttcgtataaaccttaacgagagagcagtacgtactcac

SEQ ID NO: 4007 - DNA, 1424 bp, Artificial Sequence; identical to SEQ ID NO: 1027
  P961 (35S::G1494)

SEQ ID NO: 4008 - DNA, 800 bp, Artificial Sequence; identical to SEQ ID NO: 1099
  P964 (35S::G1646)

SEQ ID NO: 4009 - DNA, 719 bp, Artificial Sequence
  P965 (35S::G1781)
cagattgatcacatgtggttaacatcaatcaaaaaaaaaaacaaagagatagagatatgactgaggagagcccagaagaagatcatgggtctcctggagtagctgaaacaaatccaggaagcccttcttcaaagaccaacaacaacaacaacaacaacaaagaacaagaccggtttcttcccattgcgaatgtcggaaggatcatgaaaaaagttcttcccggtaacggtaagatctcaaaagacgctaaagaaaccgttcaagaatgtgtctcggagttcattagtttcgtcactggtgaagcttctgacaagtgtcaaagagaaaagaggaagaccatcaatggagatgatatcatttgggctatcacaactctcggtttcgaagactacgtggctccattaaaggtctacctctgcaaatatagagacaccgaaggagagaaagttaacagcccaaaacaacaacaacaaagacaacaacaacagcagattcaacaacagaatcatcataattatcagtttcaagaacaagaccaaaacaataacaacatgtcatgtactagttacatctctcatcatcatccttctccattcctaccagtggatcatcaaccttttcccaatattgctttctctcctaaatcattgcagaaacagttcccgcagcagcatgataataacattgattcaattcactggtgagagagacatttgctt

SEQ ID NO: 4010 - DNA, 1007 bp, Artificial Sequence
  P966 (35S::G1782)
gatttgtgactggacttgttggtttggacatttagtttattgaagtaaagatttgaagacaatgcaagtgtttcaaaggaaagaagattcatcttggggaaactcaatgcctacaacaaattcaaatattcaaggatctgaatctttcagcttgactaaggatatgataatgtctacaacacaattacccgcgatgaaacattcgggtttgcagctgcaaaatcaagattcaacctcatcacaatctactgaagaagaatcaggcggcggtgaagttgcaagctttggagaatataagcgttatggatgcagcattgttaataacaatctctcaggttacatcgaaaacttgggaaagcctattgaaaattatactaagtcaattactacctcgtcgatggtgtctcaagactctgtgtttcctgctcctacttctggtcaaatatcttggtctcttcaatgtgctgaaacgtcacatttcaatggtttcttggctcctgaatatgcatcaacaccaacggcgctgccacatttagagatgatgggtttggtttcttcaagagtgccattgcctcatcacattcaagagaatgaaccaatatttgtcaatgcgaaacagtatcatgcgattctccgtcgcaggaagcaccgtgctaaactcgaagctcagaacaaactcatcaaatgccgtaaaccgtaccttcatgagtctcgccatcttcatgctttaaagagagctagaggctccggtggacgtttcctcaatacaaagaagcttcaagaatcatcaaactcactgtgttcttctcaaatggcaaatggacaaaatttctctatgagccctcacggtggtggaagcggaatcgggtctagttcgatctcaccgagctccaattcaaactgtatcaacatgttccaaaacccgcagttcagattctcaggttatccgtcaacacaccatgcctcagctctcatgtcagggacttgaggcacatgagaagaccttg

SEQ ID NO: 4011 - DNA, 1701 bp, Artificial Sequence
  P968 (35S::G184)
gttacattcctagggttttggagaatccaatcaacaacaaagaaaataatcatcgttacaataatcagtatcacgcacagacttagatgttccggtttccagtgagtctaggcggttcacgtgacgaagaccgtcacgatcagatcacaccgttggatgaccatcgtgtggtggttgatgaggttgacttcttctcagagaagagagatagggtttcacgtgagaacatcaacgacgacgacgacgaaggcaataaggttctcatcaaaatggagggttcacgagttgaagaaaacgatcgttccagagatgtcaatatcggtctgaatcttctgaccgcgaatacgggaagcgatgagtcaacggtggatgatggactatcaatggatatggaagataaacgtgcaaagattgagaacgcacaactacaagaagagctcaagaagatgaaaatagagaatcaaaggctaagagatatgttgagccaagcgacgaccaacttcaatgccttacaaatgcaacttgttgccgtcatgaggcaacaagaacaacgtaactcttcacaagatcatctcctggagagcaaagcagaaggaaggaaacggcaggaactgcaaatcatggtgccaaggcagttcatggaccttgggccgtcgtctggagcagcagagcatggagccgaagtgtcatctgaagagaggacaacggttcgttcaggttctcctccttcgcttctagaaagttccaatccccgagagaacggaaagaggttgcttggaagagaagaaagctcagaggaatcagagtctaacgcctggggaaaccctaacaaagtccccaaacataatccatcctctagcaatagcaatggaaacagaaacggaaatgttattgatcagtcggccgcagaagccaccatgcggaaagcccgtgtctcagttcgtgcccgatctgaagctgccatgataagcgatggatgtcaatggagaaagtacggacaaaaaatggctaaaggaaacccgtgtccgcgggcttattatcgttgcacaatggccggtggatgtccagttcgcaagcaagtgcagcgttgcgcagaagacagatctattctcataaccacctacgaaggaaaccacaaccatccactcccaccagccgctacggccatggcctcaacaaccaccgcagctgcaagcatgctcctctcgggctcaatgtcgagtcaagacggtttaatgaacccaacaaacctcctagctcgagctatcttgccttgctcctcaagcatggctacaatctcagcctccgcaccattcccaaccatcacattggacctcaccaattcacccaacggtaacaaccctaatatgaccactaataacccgttgatgcagttcgctcaacggcccggtttcaacccggcagttttgcctcaagtggttggtcaagctatgtacaataaccaacaacagtccaagttttctggtttacagttaccggctcagccactgcagatcgcggccacttcctcggtggccgagagcgttagtgctgccagtgcagcaattgcgtccgatccaaactttgcggcggctctagcggcagcgatcacgtccattatgaacggttccagtcatcaaaataataacaccaataataataatgtggctacgagcaacaatgacagtaggcaataagagt

SEQ ID NO: 4012 - DNA, 597 bp, Artificial Sequence
  P969 (35S::G24)
gttttgtaatttttttaccggcggttatggagacggaagcggcggtgacagcgacggttacggcggcgacgatggggattgggacgaggaagagagatctgaaaccgtataaaggaatacgaatgaggaaatgggggaaatgggtggcggagatacgggaaccgaataagagatcaaggatctggttaggttcttatgcgacgcctgaagcggcggcgagagcttacgacactgctgttttttacctccgtggtccttcagcgaggcttaattttccggagcttttggctggacttactgtttctaacggcggaggaagaggtggtgatttatcggcggcgtatattaggagaaaagcggcggaggttggtgctcaggttgatgcgcttggagcgacggtggttgtgaataccggcggcgagaatcgcggtgattacgagaagattgagaattgtcgtaagagcggtaacgggtcattggaacgggtcgatttgaataaattacccgacccggaaaattcggatggtgatgatgacgaatgtgtgaaaagaagatagaaaaaataaaaagtagttgtagaaggagagacgagaatgt

SEQ ID NO: 4013 - DNA, 1097 bp, Artificial Sequence
  P970 (35S::G189)
ccacaactctctccttgtagagagagagattttatggcggtggagctcatgactcggaattacatctccggcgtcggagctgatagcttcgccgttcaagaagcagctgcttcaggactcaaaagtatcgaaaatttcatcggtttaatgtctcgtgatagctttaactctgatcagccatcttcttcttccgcctccgcctccgcctccgccgccgcagatcttgaatcagctcgtaacacaacggcggacgcggctgtttcaaagtttaaaagagtcatatctctcttagatcgaactcgaaccggacacgcccggtttagacgtgctccggttcatgttatttctccggttcttttacaagaagaaccaaaaacgacgccgtttcagtctcctcttcctcctccgccgcaaatgatccgaaaaggttcgttttcttcatcgatgaaaacgattgatttctcatctctctcctctgtaacaacggaatcagacaaccagaagaagattcatcatcatcaacgtccctctgaaacggcgccgtttgcgtctcaaactcaaagcctctccacgacggtctcgtctttctcaaaatcaacaaagagaaaatgtaactctgagaatcttctcaccggaaaatgcgcttccgcttcttcctccggtcgttgtcattgctcgaagaaaagaaagataaaacagaggagaataattagggttccggcgataagtgcaaaaatgtccgatgtaccaccggacgattattcatggaggaaatacggacaaaaaccaattaaaggatctccacatccaagaggatattataagtgtagtagcgtaagaggttgtccagcacgtaaacatgttgagagagcagctgatgattcgtccatgttgattgttacttatgaaggagatcataatcattctctctccgccgctgatctcgccggagccgccgttgctgatcttattttggaatcgtcttgaaaagaacaaatctttatttaaggcttttataatataaatttagatccttacttagtgaagtactcaaactatgaatgaaatcaatgtaatcaaaatcaaaaagcttttgc

SEQ ID NO: 4014 - DNA, 734 bp, Artificial Sequence
  P972 (35S::G1311)
gaaaaatggattttaagaaggaagaaacacttcgtagagggccatggctcgaagaagaagacgaacggctagtgaaggtcattagtcttttgggagaacgtcgttgggattctttagcaatagtttccggtttgaagaggagtggtaagagttgcaggctaaggtggatgaactatctgaatccgactctgaagcgtggaccgatgagtcaagaagaagagagaatcatctttcagctccatgctctatggggtaacaagtggtcgaagattgcgagaagattacccggtaggactgataacgagataaagaactattggagaactcattatagaaagaaacaggaagctcaaaactatggaaagctctttgagtggagaggaaatacaggagaagaattgttgcacaagtataaggaaacagagatcactaggacaaagacgacgtctcaagaacatggttttgttgaagttgtgagcatggaaagtggtaaagaagccaacggtggtgttggtggaagagaaagcttcggtgttatgaaatcaccgtatgaaaatcggatttcggattggatatcagagatttctactgaccagagtgaagcaaatctttcagaagatcacagcagcaatagctgcagtgagaacaatattaacattggtacttggtggtttcaagagactagggactttgaggagttttcatgttctctatggtcataattctaaagttgg

SEQ ID NO: 4015 - DNA, 706 bp, Artificial Sequence
  P979 (35S::G1047)
caattttaaaccggtcattatgatgtctactgtaccggcctttacctttactgaaccgggtttggttaaccaattatcggatttccagaccggattcactccttgggaattgaactgctccgatctcttctctacaatccatctcgaaccggtcgtaccgagtccttgttctggtgaatccgatgccggttctgtcaaaattaacaccgattttaacggttttgacgaatcgtgtatcggttccatcaaaactaactccggttctgatgattccaaccttttccacggcgtaccgagtcctcaatccgacgaattggactcaaaaaacacgaaaatccgaagtaacgccacgaatcataaccggaacaaattgaaccggtcggttttgcaggtgactgacgaccgtaaacgcaaacggatggaatcaaaccgagaatcagcgaagcggtcgaggatgcgtaaacaaagacacattgataatttaaaagacgaagcaaatcgtctcggtttagaaaaccgggaactcgcaaaccggcttcgaattgttttgtacaacatcgcattaatgtgtacggacaacaatcagcttttgtcggaacaagagattctcagacggagattcttggagatgaggcagattttgattttcagacagcttcagctgaatccatcattgatcatcaatcatcatcatatgatttgaaag

SEQ ID NO: 4016 - DNA, 2844 bp, Artificial Sequence
  P980 (35S::G1084)
cttgagctctggatttgagcttaggaaagaagagtagagagaaatgggatgttctcattccaagttagatgatgaagaagcagttcagatctgtaaagacaggaaacgtttcatcaaacaagctattgaacatagaactaagtttgcttctggtcacattgcttatattcactctcttagaaaagtctctgatgctctccatgactttatcctccaaggagacaacaacaatgagtttgttcctactctctgtcaagactcattcgtcactccggtcaagagaatgccacagagacgtcgtcgaagcagccgtagtaatagcggtgagttcatctccatttcgccttcttcgattcctccgaaaatgattcaaggtaggccaagatcgaatgtgaaagcgaattatttgatggctaatagaagtagaccggttagagtcgaacagagatctcctgaaacgtttagagttgagacattttctccacctagtagtagtaaccaatatggtgaatcagatggtttctttggaatgaatatgaatatgaatacttctgcgtctacttcatcttcgttttggaatccgttgagctctcctgagcaaaggttaagtagtcataacattcctcctccttcaccgcagaattcgcagtgggatttcttctggaatccgttttcttcgttggattattatggatacaatagttatgaccgaggaagtgttgatagtaggagtggtatagatgatgagattagaggattgagacgtgttagagaggaagaagggattcctgatttggaagaagatgatgaacctcataaacctgaacctgtcgtcaatgtgcggtttcagaatcataatccgaatccgaaagcaacggaagagaatagaggtaaagttgataagagttgttgcaatgaggaagttaaagttgaagatgttgatgaggatgaagacgaggatggagatgaggatgatgatgagtttacggatagcgggtgtgagactgagaatgagggagacgagaaatgcgttgctcctccaacgcaagaacagcgaaaagctgaggtgtgtagaggaggagaagctacagggaatgttgttggagtaggtaaggttcaagagatgaagaatgttgttggtgttagagatgatgcaaagacgacggggttcacggtatatgtgaaccggagaccaactagcatggctgaagtaatcaaagatcttgaagatcagttcacaacaatttgtgatgcggctaaggaagtctcggggctattggaagctggtagagctcaatacacatcatcctttaatgaccatagtggtgagtttatgaacaatgttgcaatatttctctgtttaatgacttcacttataaatatgaagtccttttttatgtgtgtttgtagccaggaaaatgctgaatccagtagcgttgttccgctcgggttcatcaagatcttcctcgtcaagattcttgatcacttcttctggtggttcaagagagagcgggtctgaaagcagaagcgatgtttcagatgaatcttgcatgatttcaggtagccaccaaacaacattggacagacttttcgcgtgggagaagaaactctatgatgaagttagggtaagtaacaagagatataagcaactagtgactacatattaatctctgttggttataactgagccgtctttgtggtgttgtaacagtctggagaacgtgttcgaagagcatatgaaaagaaatgtatgcagctgaggaatcaggacgtgaaaggagatgatccgcttgcggttgataaaactagggctactatcagagatctagatacacagatcaaggtgtcaatacactccattgaatccatctccaaaagaatcgagactcttcgtgaccaagaactgttgcctcagcttcttgagctcgttgaagggtaacaacaccaacaacttctttttccttctcttcggtttcacttttaagcctcagactgacaaatggtaatcatgatcataacagattaacaaggatgtggaaagtaatggcggaaagtcaccagatacagaaacgaacactagacgaagccaaactgttacttgcaggcacaccggtttcaaagcgtcacaagaagagacaacctccaataatgccagaggctattaactctcaaagattagctcaatctgctttgaatcttgaagctcagcttcgaaactggagaacctgttttgaattctggatcacctctcagagatcctacatgaaagcattatctggttggcttctaagatgtttcagatgtgatcctgaccccgaaaaagttagattatcctcatgtcttcacccgatataccgagtctgcattcaatggtcaaggttgcttaacagcttgaatgaaaaaccagttttggacaaacttgagttctttgcctcagggatgggttcaatatatgcaaggcaagttagggaagatccaaactggagtggaagcgggtcaaggagatactccgggtcagaaagcatggagcttgtagtggctgataagggagaagaagatgttgtgatgactgctgagaaacttgcagaggttgctgtgaaggttctctgccatggaatgtctgttgcagttagttcactagctgagttttccatcaactcggccgatgaacactcgaagcttgttagccaaccagcagacgatgcgtcggagcagcagcccccggatgtaaatttcaattcctagtacttgttattaattttgtttggttttagagagtttagaattaggtaggtttttggcatcatcttttgctatcagaagatagtttcttagatggatgag

SEQ ID NO: 4017 - DNA, 1142 bp, Artificial Sequence
  P983 (35S::G1640)
cgtcgacctctcactcaagggtccaaaagtgttttctctttttcagtttctctttctctttttgacagaagagaccgagaagcaatgggaagggctccgtgttgtgagaaaatcgggttgaagagagggagatggacagccgaggaagatgagatcctcaccaagtatattcagaccaatggtgaaggttcttggcgatctttgcctaagaaagctggattgttgagatgtggaaagagctgtagactaaggtggataaactacttaagaagagacttaaaaagaggaaatattacttccgacgaagaagaaataatcgtcaagttgcattcccttctcggcaacagatggtcacttattgcaacacatctaccaggaagaacagacaacgaaattaaaaactattggaactcacatctcagccgcaaaatctatgccttcactgccgtttccggagatggacacaatctactcgtcaacgatgtagtcttgaagaaatcttgttcatcgtcttctggagccaagaacaataacaagaccaagaagaagaagaagggaaggactagtaggtcatccatgaagaaacacaagcaaatggtgacggcctcacaatgtttctcacaacctaaggagctagagagtgatttcagtgagggagggcaaaatggtaattttgaaggagagtctttggggccttatgagtggttggatggtgagttagaacggctcttgagtagttgtgtctgggaatgcactagtgaagaggctgtgattggagtaaatgatgaaaaggtgtgtgagagtggggacaatagtagttgttgtgttaatttgtttgaagaagaacaaggaagcgagacaaagattggtcacgtaggaatcacagaggttgatcatgatatgacggtggaaagagaaagagagggaagttttttaagttcgaattcaaatgaaaataatgataaagattggtgggttggtctatgtaattcttcagaagttgggtttggggttgatgaggagttgcttgattgggagtttcaaggtaatgtcacttgtcaaagtgatgatctatgggatctctcagatattggagagataacattggagtgattgtaccgagcaagtggattggcggccgc

SEQ ID NO: 4018 - DNA, 912 bp, Artificial Sequence; identical to SEQ ID NO: 907
  P984 (35S::G1309)

SEQ ID NO: 4019 - DNA, 974 bp, Artificial Sequence
  P986 (35S::G1330)
cgacctctttgtgggtcactcttcatcaatgggtgacaaaggaaggagcttaaagatcaacaagaacatggaggaattcacgaaagtggaagaagaaatggacgtaaggagaggtccatggacagttgaggaagatttagagctcatcaattacattgctagtcatggtgaaggtcgatggaactctctcgctcgttgcgccgaactcaaaaggaccggaaaaagctgcagacttcggtggctgaactatctccgaccagatgtgcgccgtggaaacataaccctcgaagaacaactcttgattcttgaacttcacacacgttggggcaatagatggtctaagattgcacaatatttaccaggaagaacggataacgagatcaaaaactattggagaacacgtgttcaaaagcatgcaaaacagcttaaatgcgacgtgaacagtcaacaatttaaagacaccatgaagtatctttggatgcctcggctcgtagaaaggatccaagccgcgtccatcgggtctgtttccatgtcatcttgcgtcaccacctcctcagatcagttcgtgatcaacaacaacaacaccaacaacgtggataatttggctttaatgagtaaccctaatggttacatcacgccggataattccagcgtggcagtatctcctgtatcagatttgacggagtgtcaagtgagtagtgaagtgtggaagattggtcaggatgagaatttggtggatccaaaaatgacatcgccgaattatatggataatagcagtggactattaaacggagattttacgaagatgcaagatcaaagtgaccttaattggtttgaaaatattaatgggatggtaccaaattattcggacagtttttggaacattggaaatgatgaagacttctggctcttacaacaacatcaacaagtccacgacaatggaagcttctgaatagacaagaagctatgcggcc

SEQ ID NO: 4020 - DNA, 931 bp, Artificial Sequence
  P987 (35S::G1323)
gagagagaatatgggcaaaggaagagcaccatgttgtgacaaaaccaaagtgaagagaggaccatggagccatgatgaagacttgaaactcatctctttcattcacaagaatggtcatgagaattggagatctctcccaaagcaagctggattgttgaggtgtggcaagagttgtcgtctgcgatggattaattacctcagacctgatgtgaaacgtggcaatttcagtgcagaggaagaagacaccatcatcaaacttcaccagagctttggtaacaagtggtcgaagattgcttctaagctgcctggaagaacagacaatgagatcaagaatgtgtggcatacacatctcaagaaaagattgagctcggaaactaaccttaatgccgatgaagcgggttcaaaaggttctttgaatgaagaagagaactctcaagagtcatctccaaatgcttcaatgtcttttgctggttccaacatttcaagcaaagacgatgatgcacagataagtcaaatgtttgagcacattctaacttatagcgagtttacggggatgttacaagaggtagacaaaccagagctgctggagatgccttttgatttagatcctgacatttggagtttcatagatggttcagactcattccaacaaccagagaacagagctcttcaagagtctgaagaagatgaagttgataaatggtttaagcacctggaaagcgaactcgggttagaagaaaacgataaccaacaacaacaacagcataaacagggaacagaagatgaacattcatcatcactcttggagagttacgagctcctcatacattaatgaagccataaagcaagtcattttcaccttgaaaatggaattattagctaacttattggcattattagtatataagcaagatcagataggcgcatgtag

SEQ ID NO: 4021 - DNA, 1300 bp, Artificial Sequence
  P988 (35S::G1635)
tcaagtctagattcgcgaatttatcttggtgtttccttttctgtgttccacacctttcgagtttttttttgttttcctccgccgagatcttaatccgggaagttatggcgtcgtctccgttgactgcaaatgttcagggtaccaacgcttctttgaggaatagagatgaagaaactgcagacaagcagatacaattcaatgaccaaagttttgggggaaatgactatgcacccaaggtacggaagccatacacgataacaaaagagagagagagatggacagatgaagagcacaagaagtttgttgaagccttgaaattatacgggcgagcttggagacgaatagaagaacatgtgggctcaaagaccgcagttcagattcgaagccatgctcagaagtttttctctaaggttgctcgagaagcaactggaggtgatgggagctcagtagagccgattgtaatacctcctcctcgtcccaagagaaagccagcgcatccgtaccctcgtaagtttgggaacgaggcagatcaaacaagtagatcggtttctccctcagaacgtgatactcaatctccaacctctgtgttgtccactgttggatcagaagcattgtgttcccttgattcgagttcacccaatcgaagcttgtccccagtttcttctgcatcaccaccagctgctcttacaaccactgcaaatgcacctgaagagcttgagactctgaagctggagttgtttcctagtgagagactcttaaacagggagagctcgatcaaggaaccaacgaagcaaagtcttaaactctttgggaagacagttttggtatctgattcaggcatgtcctcttctctaacaacttcaacatattgtaaatccccaattcagccattaccacggaaactctcatcatccaagacactacccataataagaaactcacaagaagaactcttgagctgctggatacaagtccctcttaagcaagaagatgtggaaaatagatgtttggattcaggaaaggctgtccaaaacgaaggatcatcgactggatcaaacactggttcggtggatgatacgggacacacggaaaagaccacagaacccgaaacaatgctatgtcaatgggagtttaaaccaagtgagaggtctgcattttctgagctcagaagaacaaactccgagtcaaattcaagaggatttggtccatacaagaagagaaagatggtaacagaagaagaagagcatgagattcatctccacttataacacattttcttacgtaccctaaagaagagact

SEQ ID NO: 4022 - DNA, 433 bp, Artificial Sequence
  P989 (35S::G1911)
atcatcctcttgactcgtaatctccccatacttaaataatctctttctaaccagttatattagtctataactcaacatggcatcaagctcaatgtcttctcagagctctggctcgtggactgctaagcagaacaaagcctttgagcaggctctagcaacctatgaccaggacactcctaaccgttggcaaaatgttgccaaagtcgtgggtggaaaaacaacagaggaggtaaagagacactacgaactcttagtgcaagacatcaacagcatagagaacggtcatgttccattcccaaactacaggactagtggaggctgcactaatggcaggcttagtcaggaggaaaaaaggtatgtattgtcctaaaaaagacacattctgctataattaagaatacaaaacaatccaagccaaagacaccaatctgat

SEQ ID NO: 4023 - DNA, 1732 bp, Artificial Sequence
  P991 (35S::G1637)
agcgagatcttgtgattctaattcttgtgataccgaaaacattggtggcgagagagagatggtgaaggagacggtgacggtggcgaaaacgtgctcacactgtggccataatggccataacgcacggacttgtctcaacggcgttaataaggcaagtgttaaactgttcggcgttaatatatcgtctgatccgattaggccgcctgaggtaacggcgttaaggaagagtcttagtttgggaaaccttgatgctcttctcgctaacgatgaaagtaacggtagcggtgatcctatcgccgccgttgatgataccggttatcattccgatggtcagattcattccaagaagggtaaaactgctcatgagaagaaaaaggggaagccatggacggaagaagaacatcgtaatttcttaatcggtttaaacaaactcggaaaaggagattggagaggcattgcaaagagtttcgtgtcgacaagaacaccaacacaagtcgcaagtcatgctcagaaatattttattaggttaaacgttaacgacaagagaaaaagacgtgctagtctctttgacatctctctcgaagatcagaaggagaaagagaggaactctcaagatgcttcaacaaagactccacctaaacaaccaataaccggaattcaacaaccggtagtacaaggtcatactcaaaccgagatttcgaacaggtttcagaatttatcaatggagtatatgccaatctaccaacccataccaccttactacaactttccacctattatgtaccatccaaattatccaatgtactatgccaaccctcaagtaccggttaggtttgttcatccttctggtatacctgttccaagacatataccgattggtttgcctctgtctcaaccgagtgaagcttctaatatgacaaataaagacggtttggatcttcatatcggtttgcctccacaagctactggagcttctgacttgactggtcatggcgttattcatgtgaaatgaaatctcattttttgtgtgtttatttaagcatgatataggtatattgcttcttttttttggtgttgagttttatttgaatatatagctccatattcaaaagttttgccaatcggattatgtatcatttttatttcttcccagattagattaaataagaatatagatatatttggatttatatttagctgcttctttatcaaccaaaaacaaaacaaaaaaaatcttagttttggtgaagtttattgagtaaaatcaacattcattgggagaaaattaaaaaaatggtgttgattaactagtaaaatcctttgatcaatttcctagaagctcgtctggttctatcagtgaggtttggtttgtcaggatctccgagttctaaggtggcacccaagaaaccggtctgagttccatcgctatcattgtcgatgtctccttcgatcgtcaatccttcaatcttagccgcaatagattcttctctcatcccaacatccacatcttcaaaatttggatcgatgttataagtgccacaaagaataaagtatcaacatgtaacagttacataaaatatttcccaacttcacaaccgccaaatgcagacatgatctctctaccatttgcaatccaatttgatcatgttggattattgcggatgagttcgtggttaacaacatgcatgttttttctttcactttaaaaccgggcatggtttgatcaaacaca

SEQ ID NO: 4024 - DNA, 1317 bp, Artificial Sequence; identical to SEQ ID NO: 219
  P994 (35S::G248)

SEQ ID NO: 4025 - DNA, 1243 bp, Artificial Sequence
  P995 (35S::G671)
ttcacttgagaacaaccccctttgaactcgatcaagaaagctaagtttgaagaatcaagaatggtgcggacaccgtgttgcaaagccgaactagggttaaagaaaggagcttggactcccgaggaagatcagaagcttctctcttaccttaaccgccacggtgaaggtggatggcgaactctccccgaaaaagctggactcaagagatgcggcaaaagctgcagactgagatgggccaattatcttagacctgacatcaaaagaggagagttcactgaagacgaagaacgttcaatcatctctcttcacgcccttcacggcaacaaatggtctgctatagctcgtggactaccaggaagaaccgataacgagatcaagaactactggaacactcatatcaaaaaacgtttgatcaagaaaggtattgatccagttacacacaagggcataacctccggtaccgacaaatcagaaaacctcccggagaaacaaaatgttaatctgacaactagtgaccatgatcttgataatgacaaggcgaagaagaacaacaagaattttggattatcatcggctagtttcttgaacaaagtagctaataggttcggaaagagaatcaatcagagtgttctgtctgagattatcggaagtggaggcccacttgcttctactagtcacactactaatactacaactacaagtgtttccgttgactctgaatcagttaagtcaacgagttcttccttcgcaccaacctcgaatcttctctgccatgggaccgttgcaacaacaccagtttcatcgaactttgacgttgatggtaacgttaatctgacgtgttcttcgtccacgttctctgattcctccgttaacaatcctctaatgtactgcgataatttcgttggtaataacaacgttgatgatgaggatactatcgggttctccacatttctgaatgatgaagatttcatgatgttggaggagtcttgtgttgaaaacactgcgttcatgaaagaacttacgaggtttcttcacgaggatgaaaacgacgtcgttgatgtgacgccggtctatgaacgtcaagacttgtttgacgaaattgataactattttggatgagtgaaactcataatcgatgaatcccacgtgaccatgtcaatatgatgtctatggatatgttaccttgatgatgttgatggtaataataataaataatagatggtgatgatgaccatgcatgaat

SEQ ID NO: 4026 - DNA, 1306 bp, Artificial Sequence; identical to SEQ ID NO: 1029
  P1005 (35S::G1496)

SEQ ID NO: 4027 - DNA, 771 bp, Artificial Sequence
  P1008 (35S::G1655)
tcacattgagagagagagagagagaaagagagactctcagaatctgaagaagaagaagagattgttgtttttgccttttatcatcggtttctttgaatctctggttttaaatcggatttaatggtggagtctctgttcccgagcatcgaaaacacaggtgaatcgtctcgaagaaagaagccgaggatatcagagacggcggaggcggagatagaggcacgacgtgtcaacgaagaaagcttgaagagatggaaaacgaatcgtgtgcaacagatctacgcttgtaagctcgtcgaagctttacgccgagttcgtcagagatcttccaccaccagcaacaacgagaccgataaactcgtctccggcgcggcgagggagatacgtgatacggcggatcgagttctagctgcgtccgctcgtggtacgactcggtggagcagagcgattttagcgagtcgcgtccgagcgaagctgaagaaacatagaaaggcgaaaaagtcaacgggaaattgtaaatcgagaaaaggtctcacggagacgaatcggattaagttaccggcggttgagagaaaactgaagattcttggccgtttggttcctggttgccggaaagtctctgtaccgaatcttttagatgaagcgaccgattacatcgcagcgttagagatgcaggttcgagccatggaggctctcgccgaacttttaaccgcagccgcaccacggacgacgttgaccggaacttaacggcggcagttagtttgtcagttgtta

SEQ ID NO: 4028 - DNA, 1519 bp, Artificial Sequence; identical to SEQ ID NO: 487
  P1020 (35S::G615)

SEQ ID NO: 4029 - DNA, 897 bp, Artificial Sequence; identical to SEQ ID NO: 1255
  P1022 (35S::G1900)

SEQ ID NO: 4030 - DNA, 609 bp, Artificial Sequence; identical to SEQ ID NO: 1301
  P1028 (35S::G1965)

SEQ ID NO: 4031 - DNA, 716 bp, Artificial Sequence
  P1030 (35S::G627)
tatataaagaataaactagaagtaaaggatggtgaggggcaaaacggagatgaagaggatagagaacgcaacaagcaggcaagtgacgttttcgaagagaagaaatggactcttgaagaaagccttcgaattatcggtcctttgtgatgctgaagttgctttggttatcttctctccaagatccaaactctatgagttctctagctctagtatagcagcaacaattgaacgctatcagagacgaataaaagaaattgggaataatcataagagaaatgataattctcagcaagcgagagacgaaacatctggattgacaaaaaagattgaacagctagagatatctaaacgaaaattgcttggagaaggcattgatgcatgttccatcgaggagctgcaacagttagagaatcagttggaccgaagcttgagcaggataagagccaagaagtaccaattactccgtgaagaaattgagaagttgaaggcagaggagaggaatctcgttaaggaaaataaagatctgaaggagaagtggcttggaatgggaacagcaacaatagcatcatcacaatcaacgttatcatcatcagaagtgaacatagatgacaatatggaagtggagactggtttgttcattggacctcctgagacaagacaatccaaaaaattccctcctcaaaattaatcttacaacttcttcaaaaagaatgttt

SEQ ID NO: 4032 - DNA, 2452 bp, Artificial Sequence
  P1033 (35S::G183)
acatcccctctgtattcttctttcatttgctgctagcgttttctgaagaaaaaggtttatcctcttatatctattaattatgtcattatttcaataatttactaatcatttgattctaaatctcaaaattatcacttttacactagattttgtttcttgacatcctaaggatttgtcaaaaatgagtgattttgatgaaaacttcatcgaaatgacgtcgtattgggctccaccatccagtcctagcccaagaacgatattggcaatgctggagcaaaccgacaatggtctgaatccaatcagtgagatcttccctcaagaaagcttgccaagagatcatactgatcaatctggacaaagatctggtcttcgtgagagactggctgcaagagtaggattcaatcttccaacactcaatacagaagaaaacatgagtcctttggatgcatttttcaggagctcgaatgttcctaattctcctgtcgttgcaatctctccaggattcagtccatcagcactattgcatactcccaatatggtcagtgattcttcccaggtaagtattaatgtcttttgtctttatgattgtttaataatatacatgatataaagtttatatgataaatagtaaaaatctctctgtgattgaaccaatatttgggaatatgatcatgtatgttatcataattctatttcgttttaacatatatagagtaatattgctgtcaaagaaaaaaaaagagaaaaaaagtaataatatctatcggtaaacacagaatctattatttccttttgtttaggtttgatatttttcattcctatctgtgtttacaaattttgtcgaaaacaaaataaaaaaaatctgtgtttacaacttaaaaatggttgtcccggactaattaatttatgttgtttatgatcgaaatgtatatgggttgaataaaattttgataccatgtaaatgattattttcaaatccttcttttcttaatttacgtttgaagccatagggatctctaggcctcaattctaaaaccgtaactaaaatagtctttgtgaccttcttgttacagattatccctccgtcttcagccaccaattacggacctctagagatggtggaaacttccggtgaagacaatgcagcgatgatgatgttcaacaacgatcttccttatcagccgtacaatgttgatctgccttctctagaaggtaaatagagttgcttgtgtctcaagtttgcttccattttcaattttccaaatctttttgtcataattttcttacatgtgaaacagtctttgatgatattgcaacggaagagtccttttatatcccatcttatgaacctcatgttgacccaattggaactcctttagtcacatcctttgaatctgaactcgttgacgatgcccataccgacatcatctccattgaggacagtgagagcgaggatggaaacaaagatgatgacgacgaggacttccaatacgaagacgaagacgaagaccaatacgaccaagatcaagatgtagatgaagatgaagaggaagaaaaagatgaagacaatgttgcattagatgatcctcaacctccacctccaaagagaaggtcccaacaaaacttataatatcataatcaataatcttttcacaaaaacttatttaagttaaccatacatatataaaatcttgtaggagatatgaggtatcaaacatgattggagccacaagaacaagcaagacacaaaggatcatacttcagatggaaagcgacgaagacaatcctaacgatggttatcgctggagaaaatacggtcagaaagtcgtcaaaggaaatcctaatccgaggttattatttcgcaatgttgttagtctcttttccctaacgatttaatcatcttacacattaatatgtttttttgtgtggtatatatgttaatatgcaggagttacttcaagtgcacaaacatcgagtgcagagtgaaaaaacatgtggagagaggagcagacaatatcaagttggttgtgactacatacgatgggatacacaaccatccttcaccacctgcacgtagaagcaattccagttcaaggaaccggtctgcaggggcaacaatacctcaaaatcagaatgatcgaaccagtcggttaggtagggctcctcctactcctactcctcctactcctcctccttcgtcttacacacctgaggagatgaggcctttctcttcgttggctacagaaattgatctgacagaggtttatatgaccggaatctctatgctgccgaatataccggtttacgagaattcgggttttatgtaccagaatgatgaaccgacgatgaatgcgatgccggatggttcagatgtgtacgatgggatcatggaacgcctgtattttaagtttggtgtcgacatgtagacataaaacctttattttcagtcctt

SEQ ID NO: 4033 - DNA, 1135 bp, Artificial Sequence
  P1034 (35S::G1750)
ccttttcctctctttctccaaatctctgaaaattttcaccagaatctctgttctttttttcaccagaatctctctgtttaaaataataggtgatgatgatggatgagtttatggatcttagaccagtgaagtacacagagcacaagactgttatcagaaagtacactaaaaagtcgtctatggagaggaagaccagtgttcgtgactcggccaggttggttcgggtctcaatgacggatcgtgacgccactgattcatcaagcgacgaggaagagtttctgttccctcgaagacgtgtcaagagattgattaacgagatcagagtcgagcctagcagctcttccaccggcgacgtctctgcttctccgacgaaggaccggaaaagaatcaacgttgattctacggttcaaaagccctctgtttccggccaaaaccagaagaagtaccgcggcgtgagacagcgaccatggggaaaatgggcggcggagattcgtgatcctgagcaacgccggagaatctggctcggtacttttgcaacggcggaggaagctgccatcgtctacgacaacgcagcaatcaaacttcgtggccctgatgctcttaccaacttcaccgtacaaccagaaccagaaccggtacaagaacaagaacaagaaccggagagcaacatgtcggtttcgatatcagaatcaatggacgattctcaacatctatcatctccgacatcggttctcaactaccaaacatatgtctcggaggaaccaatcgatagtcttatcaaaccggttaaacaagagtttcttgaaccagaacaagagccaataagctggcatcttggagaaggtaatactaatactaatgatgattcatttccattggacattacatttctcgacaactatttcaatgaatcattaccagacatctccatcttcgatcaacctatgtctcctattcaaccaacagagaatgatttcttcaacgaccttatgttattcgatagcaacgcagaagaatactactcctccgagatcaaagagattggttcatcgttcaacgatcttgatgattctttgatatccgatctcttacttgtgtgatatttttgccattaacgaaacaccggtttggttgc

SEQ ID NO: 4034 - DNA, 594 bp, Artificial Sequence
  P1036 (35S::G181)
aacaatggacagagaagacataaatcctatgttaagccgcctagatgtcgaaaacaacaacaccttctcttcctttgtagacaaaaccctaatgatgatgcctccatcaacattttccggtgaagtggaaccttcatcttcttcttcttggtatccagaaagctttcatgtgcatgcgccgccattaccacctgagaatgatcaaataggtgagaaagggaaggagctgaaagagaagagatcgaggaaagttccaaggattgcgtttcatacgaggagcgatgatgatgttcttgatgatggttatcgttggcgaaaatatgggcagaaatctgtcaagcacaatgctcatcccaggagctattacagatgtacgtaccacacatgcaacgtgaagaaacaagtgcagagattggcaaaagatccaaacgtcgtcgtaacgacctacgaaggcgttcataaccatccttgtgagaagctcatggagactcttaatcctcttctcaggcaactccagttcctctccagtttctctaatctttgaatatataatggcttaattaatggtgtaattacttaaaggtgattaaggtg

SEQ ID NO: 4035 - DNA, 1002 bp, Artificial Sequence
  P1038 (35S::G185)
agtaacaatactttaaactatttacaccactttaatcttattctccactctttgaacgtaatggagaagaaccatagtagtggagagtgggagaagatgaagaacgagatcaacgagctaatgatagaaggaagagactatgcacaccagtttggatcagcttcatctcaagaaacacgtgaacatttagccaaaaagattcttcaatcttaccacaagtctctcaccatcatgaactactccggcgaacttgaccaagtttctcagggtggaggaagccccaagagcgatgattccgatcaagaaccacttgtcatcaagagttcgaagaagtcaatgccaaggtggagttcaaaagtcagaattgcccctggagctggtgttgatagaacgctggacgatggattcagttggagaaagtacggccagaaggatattctcggagccaaatttccaagaggatactatagatgcacgtatagaaagtctcaaggatgtgaagccactaaacaagtccaaagatctgatgaaaatcagatgctccttgagatcagttaccgaggaatacattcttgctctcaagctgcaaatgtcggtacaacaatgccgatacaaaacctcgaaccgaaccagacccaagaacacggaaatcttgacatggtaaaggaaagtgtagacaactacaatcaccaagcacatttgcatcacaaccttcactatccattgtcatctaccccaaatctagagaataacaatgcctatatgcttcaaatgcgagatcaaaacatcgaatattttggatctacgagcttctctagtgatctaggaactagtatcaactacaattttccagcatctggctcggcttctcactcagcatcaaactctccgtccaccgtccctttggaatccccgtttgaaagctatgatccaaatcatccatatggaggatttggtgggttctattcttagttatctacttaagggagggacggaactttt

SEQ ID NO: 4036 - DNA, 847 bp, Artificial Sequence
  P1047 (35S::G1537)
ggtcttaaaaccctagttctccataaaaaaaatatccttgaacacaaataaatggaaaacgaagtaaacgcaggaacagcaagcagttcaagatggaacccaacgaaagatcagatcacgctactggaaaatctttacaaggaaggaatacgaactccgagcgccgatcagattcagcagatcaccggtaggcttcgtgcgtacggccatatcgaaggtaaaaacgtcttttactggttccagaaccataaggctaggcaacgccaaaagcagaaacaggagcgcatggcttacttcaatcgcctcctccacaaaacctcccgtttcttctacccccctccttgctcaaacgtgggttgtgtcagtccgtactatttacagcaagcaagtgatcatcatatgaatcaacatggaagtgtatacacaaacgatcttcttcacagaaacaatgtgatgattccaagtggtggctacgagaaacggacagtcacacaacatcagaaacaactttcagacataagaacaacagcagccacaagaatgccaatttctccgagttcactcagatttgacagatttgccctccgtgataactgttatgccggtgaggacattaacgtcaattccagtggacggaaaacactccctctttttcctcttcagcctttgaatgcaagtaatgctgatggtatgggaagttccagttttgcccttggtagtgattctccggtggattgttctagcgatggagccggccgagagcagccgtttattgatttcttttctggtggttctacttctactcgtttcgatagtaatggtaatgggttgtaacgaaggtttaatg

SEQ ID NO: 4037 - DNA, 618 bp, Artificial Sequence
  P1048 (35S::G1538)
gcatctcataggactcaacctcaccaaagtcatatcctattgcatcactctcctttaaacacagtcagagaaaacagcaactcttgtctgaaaaactagagagagaaaatggatcatggtaggttaatggatgatcaaatgatgctaggctctcaagtgtacccctacacgacccaaccccaaaattcacactgcatcatcgttaaccagatcgatggaggcgaagaatcaaaaccggtgaagcggaggaggaagaggaggagtaaaggttcatcagccaccaacgaagaagacgtggcggagatcggagggatgttgaggaagaggaagttgaccgatgaacaagtgaacatgctcgaatatagcttcgggaacgagcataagctggagtcagggaggaaggagaagatcgccggagagttaggtcttgacccgagacaggtggctgtttggttccagaaccgccgtgcacgttggaagaacaagaaactagaggaagagtacgccaaactcaaaaaccaccacgacaacgtcgtactcggccaatgccaactcgagtctcaggtataaattttatgttttttcactataaaacagagtaaatttggtgattcttaa

SEQ ID NO: 4038 - DNA, 1008 bp, Artificial Sequence
  P1051 (35S::G1543)
ggttgatgagataccaaacgcatcttaatattttctccttaatttactttggttatgtctttctatgataaaactactatttacgtacatatgcacatacacatataaactatatgctctatatcatatggattacgcatgcgtgtgtatgtataaatataaaggcatcgtcacgcttcaagtttgtctcttttatattaaactgagagttttcctctcaaactttaccttttcttcttcgatcctagctcttaagaaccctaataattcattgatcaaaataatggcgattttgccggaaaactcttcaaacttggatcttactatctccgttccaggcttctcttcatcccctctctccgatgaaggaagtggcggaggaagagaccagctaaggctagacatgaatcggttaccgtcgtctgaagacggagacgatgaagaattcagtcacgatgatggctctgctcctccgcgaaagaaactccgtctaaccagagaacagtcacgtcttcttgaagatagtttcagacagaatcatacccttaatcccaaacaaaaggaagtacttgccaagcatttgatgctacggccaagacaaattgaagtttggtttcaaaaccgtagagcaaggagcaaattgaagcaaaccgagatggaatgcgagtatctcaaaaggtggtttggttcattaacggaagaaaaccacaggctccatagagaagtagaagagcttagagccataaaggttggcccaacaacggtgaactctgcctcgagccttactatgtgtcctcgctgcgagcgagttacccctgccgcgagcccttcgagggcggtggtgccggttccggctaagaaaacgtttccgccgcaagagcgtgatcgttgatttgtgtatcttaattatttgagtatggtttagaagtcaacgaaggtctgctattgagcctacaaaatattaacgatcacatgatttcgtgtaaatactaagagactctgttccgc

SEQ ID NO: 4039 - DNA, 983 bp, Artificial Sequence
  P1056 (35S::G1380)
caaacacacacagatctcttcttcatcacattacttctggctttacatcttttttcttctccatgaggaaagggagaggctcttccgtcgttggacccgcccttccagtaaccgccggtggatctgtgaaggagccgaggtatagaggcgttaggaagagaccttggggtcgattcgcagctgagatccgtgatccattaaaaaaatctcgtgtctggctcggtactttcgattccgccgtagatgctgcacgcgcttacgataccgccgcacgtaacctccgtggtccaaaggccaagaccaatttcccgatcgattgttctccttcttctcctctccaacctctcacctacctccacaatcaaaacctctgttctcctccggtgattcagaaccagatcgatccgtttatggaccatcggttatacggcggaggtaatttccaggagcagcagcagcagcagattattagtcggccggcgagtagcagcatgagcagcaccgttaaatcttgtagcggaccgagaccgatggaagccgcggcggcgtcttcgtcggtggcgaaaccgttacatgcgattaagagatatccgagaactccaccggtagctccggaggattgtcatagcgactgcgattcttcgtcgtctgttattgacgacggagatgatatcgcatcttcgtcttcccgccggaaaacgccgtttcagtttgatcttaatttcccgccgttggatggcgttgacttattcgctggcgggatagatgatctccactgtaccgatctacgtctctgatttgctgctttacaaaaaaaatccgttgattacacacaaaaaaaattctcaaattttacaaaatgataactttatgctcttttgtttttccattttcctttgatatcatattgaaagagaaaaaaaggaagaacaaaaaaaaaagattgagcgtgatgattttatcatcaacgaagatgatgacga

SEQ ID NO: 4040 - DNA, 803 bp, Artificial Sequence
  P1057 (35S::G1419)
ttcatcatctatggcttcttcacatcaacaacagcaagaacaagaccagtcagctttagatctcataacccaacaccttcttactgatttcccttccttagacacctttgcctccaccatccaccactgcaccacctcaactctaagccaacgcaaaccacctcttgccactatagcagttcctactactgcaccggtggttcaagagaatgatcaaaggcattacagaggcgtcaggagaagaccatggggtaagtatgcggctgagatcagagacccaaacaagaaaggtgttcgtgtctggttaggcacttttgacacagccatggaagctgcaagaggttatgacaaggcagcttttaaactacgaggaagcaaagctattcttaacttcccacttgaagcaggaaagcatgaggacttgggagacaacaagaagactatttctttaaaagcaaagaggaagagacaggtgacggaggatgaaagccagctgatcagccgtaaagctgttaagagggaagaagctcaggttcaggctgatgcttgtccattaacgccatcaagttggaaggggttttgggacggagcagacagtaaagacatgggaatattttccgtgcctctgttatctccttgtccatctcttggacactctcaactcgtagttacttaagcttcagagggtcaaactggaaaaaatcaacattggattgttttcaaagcttctagattagctgattgtaaaaaaatgttttactatattcattcattcttcttaaatgcaattctttctacccttc

SEQ ID NO: 4041 - DNA, 727 bp, Artificial Sequence
  P1059 (35S::G1902)
gaagttgataaatgttcaaggaaacataaaaaagagaagatttttgaataaaggttgaagaaaaatgcaggatccagcagcatattaccagacgatgatggcgaagcaacaacaacaacaacaaccacagtttgcagagcaagaacagttaaagtgtcctcgttgtgactcaccaaacactaaattctgttactacaacaactacaatctctcacagcctcgtcacttttgcaaaagctgtcgtcgttactggactaaaggcggcgctctccgtaacgttcccgtcggtggtggttctcgtaagaacgcaaccaaacgatccacttcttcttcttcttctgcttcctctccttccaacagtagccaaaacaagaagacgaaaaacccggatccggatcctgatccacgtaattctcaaaaaccggatttggatccgacccggatgctttacgggtttccgatcggtgaccaagacgtgaagggtatggagattggtggaagctttagctcgttgttggcgaataatatgcagcttggtcttggaggaggagggatcatgcttgacgggtcgggttgggatcatccgggtatgggtttgggtttgaggagaaccgaaccgggtaataataataataacccatggaccgatctggctatgaacagagcggagaaaaactgaagaagaaaagaagagaggggtattttggtaaattatagcaacctgatt

SEQ ID NO: 4042 - DNA, 1243 bp, Artificial Sequence
  P1060 (35S::G1903)
cttcatatctctagaagtttcataattagttatgtctaaatctagagatacggagataaagttgtttgggaggacaatcacatctcttttagatgtgaattgttatgatccgtcgtcgttgtcccctgttcacgatgtttcttctgatccaagcaaggaggattcgtcttcttcttcatcttcttgttctccaactattggaccaatcagggttccggttaaaaaaagtgagcaagagagtaacaaattcaaagatccatatatattatccgatctaaacgaaccaccaaaagcagtatctgagatttcatcaccaagaagttccaagaacaactgtgatcaacagagcgagatcacaacaacaactaccacaagtactacatcaggagagaaatcaacggctctcaagaaaccggacaagcttattccatgtcctagatgtgaaagcgcaaacaccaaattctgttattacaacaactacaacgtgaaccagccacgttacttctgcaggaactgtcagaggtattggacagctggtggatctatgaggaacgttcctgttggctcaggtcgtcgcaagaacaaaggatggccttcttcaaaccattacttgcaagtcacttctgaggattgtgataataataactcggggacgatccttagtttcggttcttcggagtcttcggttacagagactggtaagcatcagtcaggtgatacagcaaagataagtgctgattcagtttctcaagaaaataaaagctaccaagggtttcttcctccgcaagtaatgttacctaataattcttctccttggccttaccaatggagtccaacgggtcctaacgctagtttctaccctgtccccttctactggggatgcacggttccgatataccctacctcagagacttcatcatgtttaggaaaacggtcaagagatcaaactgaaggaagaatcaatgatactaatacaacaataactactacaagagcaagattggtctcagaatctcttagaatgaatatcgaagctagtaagagcgctgtgtggtctaagttaccgacaaaacccgagaaaaaaacgcaaggattcagtttgttcaatggatttgacacaaagggaaacagcaacagaagtagcttggtctccgaaacttctcacagtctacaagcaaaccctgcagcgatgtctagagctatgaacttcagggagagcatgcaacaataatcagacactaat

SEQ ID NO: 4043 - DNA, 1551 bp, Artificial Sequence
  P1073 (35S::G1672)
ggtaccgatcactcccgtctttatcaaattcttcttcctcttacattttccctatccaatcgatctcacgcagatctgatcaatttctcatcaaatcatttagagatcaaaagaaaactatgaagaatagtaaatgtaacctcatagattcaaagctcgaagaacatcatcatctttgcggatcaaaacattgtcctggatgtggtcgcatgattcaagctgctactaaaccaaattgggttggattgccggcaggagtgaaattcgatccgacagatcaagaacttatagaacatttagaagcaaaagtgaagggaaaagaagaaaataagaaatggtcgtcgtctcatccacttatagatgaatttattcccaccattgatggagaagatggaatatgttacactcatcctcagaagcttccaggggtgacaagagatggcttgagcaaacacttcttccacaaaccatcaagagcttacacaaccggaacaagaaaacgacgtaaaataattcaaaccgatcacgactctgagttaaccggatcatcagaaaccaggtggcacaaaacgggcaaaacaagaccggttatgatcaacggtcaacaaagaggatgcaagaagatattagtactctacacaaacttcggcaagaatcgtcgaccggagaaaacaaattgggtgatgcatcaatatcatttagggattaatgaggaagagagagaaggagaacttgtggtctccaagatattttatcagacacaaccaagacagtgtgttagtaatactaattggtctgatcaccatggttccaaggacgtgatcggaattggtgtcggagatgagatttccagcgtagctgccacgttgcagagtcttggctccggtgacgtcgtttctagggttaatatgcatccccatacaagatcctttgatgaggggacagccgaagcttcaaagggaagagagaaccagcatgtgtctggcacgtgcgaggaagtacatgatgggatcataacatcatcaatgtcatctcatcatatgattcatgatcatcataatcaacatcatcaaatcggagatagaagagaatttcacatgtcatcatcatatcccatgacccctactatcacatcacaacatgagtcaatcttccatgttacaagtactatgccctttcagcggcagcaattaaggggtcggtcgtctggttcgggattagaagacctaattatgggttgtaccacagctacgtgtacagaagacaataatcacaaatgattaaattcgcaggagcattcagaagcaaaccctcagcgaaatgcagagtggttaacgtttccacaattctggaaccaagccgaatcagatgatcaaaaccgaagattttaacagaaccaaaaggaagcagagaaatcttgcaaaaagctcctgcttagctgttgatcaatgccggaaatgctgagctatgactgactagtctctgccatttaacttacaatatcaccagaggttgcgatgaatgttgattcgctcaaaggagagcggccgc

SEQ ID NO: 4044 - DNA, 1121 bp, Artificial Sequence
  P1074 (35S::G1677)
cagtactaattctgtgtgtgttaatggttctagttatggatgatgaagagagtaacaacgttgaaagatatgacgacgtcgtattgccagggtttaggttccatcccactgatgaagaactcgtaagtttctacttgaaacggaaggttttacacaaatctcttccctttgatctcatcaagaaagtcgacatttacaaatacgatccatgggacctcccaaagcttgcagcgatgggggaaaaagagtggtacttttattgtcctagagacaggaaataccgcaacagcacaagacctaaccgagtaactggaggtggcttctggaaagcaaccggaacagaccggcctatatactcattggactccactcgatgcatcggtttgaagaaatcacttgtgttctaccgtggtcgagctgctaaaggagtcaaaaccgattggatgatgcatgaatttcgtctcccttctctctctgactctcatcactcatcatatcccaattacaataacaagaagcaacaccttaacaataacaacaacagcaaggagcttccttcaaacgatgcttgggcgatatgtagaatatttaagaagacaaatgcagtatcctcacaaagatcaatcccacaatcttgggtttatccaacgattcctgacaacaatcaacagtcacacaacaacaccgcaactctcttagcttcatcagacgttctcagccacatatcaacaagacaaaactttattccttctccagtcaacgaacccgcaagcttcacagaatcagctgcttcttacttcgcgtctcagatgctcggagtcacgtacaatacagccagaaacaacggaacaggggatgctctgtttctgagaaacaatggaacaggggatgctctggttctgagcaacaatgagaataactacttcaacaacttgactggagggttgactcatgaggttccgaatgtaagatcaatggtgatggaggagactacggggagtgagatgtcggcgacgtcgtattccactaacaattaagatcatagtactattaacacttgaattagtgtagacgttgatcatcgctaatatgtattaatttttcttgtcttactataaacg

SEQ ID NO: 4045 - DNA, 1410 bp, Artificial Sequence
  P1076 (35S::G1399)
agattcgtggaggatctctactgatttgtcggaatctctcactacagaatcacttgatcttatgtccggatggaggagagagaaggaaccaacatcaacaacaacatcactagcagtttcggcttgaagcagcaacatgaagctgctgcttctgatggtggttactcaatggacccaccaccaagacccgaaaaccctaacccgtttttagtcccacccactactgtccccgcggccgccaccgtagcagcagctgttactgagaatgcggctactccgtttagcttaacaatgccgacggagaacacttcagctgagcagctgaaaaagaagagaggtaggccgagaaagtataatcccgatgggactcttgtcgtgactttatcgccgatgccaatctcgtcctctgttccgttgacgtcggagtttcctccaaggaaacgaggaagaggacgtggcaagtctaatcgatggctcaagaagtctcaaatgttccaattcgatagaagtcctgttgataccaatttggcaggtgtaggaactgctgattttgttggtgccaactttacacctcatgtactgatcgtcaacgccggagaggatgtgacgatgaagataatgacattctctcaacaaggatctcgtgctatctgcatcctttcagctaatggtcccatctccaatgttacgcttcgtcaatctatgacatccggtggtactctaacttatgagggtcgttttgagattctctctttgacgggttcgtttatgcaaaatgactctggaggaactcgaagtagagctggtggtatgagtgtttgccttgcaggaccagatggtcgtgtctttggtggaggactcgctggtctctttcttgctgctggtcctgtccaggtaatggtagggacttttatagctggtcaagagcagtcacagctggagctagcaaaagaaagacggctaagatttggggctcaaccatcttctatctcctttaacatatccgcagaagaacggaaggcgagattcgagaggcttaacaagtctgttgctattcctgcaccaaccacttcatacacgcatgtaaacacaacaaatgcggttcacagttactatacaaactcggttaaccatgtcaaggatcccttctcgtctatcccagtaggaggaggaggaggtggagaggtaggagaagaagagggtgaagaagatgatgatgaattagaaggtgaagacgaagaattcggaggcgatagccaatctgacaacgagattccgagctgatgatgatcatacggtttcttttcgcggatttgttaggtttgatggatttcagattttggttgattgtttttattaacacagaatgtttagaagctgctatctttaggttcccatcctcttgtgatt

SEQ ID NO: 4046 - DNA, 938 bp, Artificial Sequence; identical to SEQ ID NO: 1115
  P1079 (35S::G1667)

SEQ ID NO: 4047 - DNA, 1065 bp, Artificial Sequence
  P1080 (35S::G635)
ccttccttgtatgattttctataatccagcatggagatcatgcgtccaggggtctcagaaaacactttgaaaggaaaaataagaatcacaacgcggtgcatgtggcttgacaaaggaagacttttagatgcacttcacaaagcagctcatgctgctctatcaagttgtcctgtgacatgtcccttgtctcacatggaaagaacagtctccgaagtcctgaggaagattgtaaggaagtacagtggtaaaaggcctgaagtcatcgctatagccactgagaatccaatggctgtccgagctgatgaggtcagtgcgagactgtctggtgatccaagtgttggttctggagttgcagctttaaggaaagttgttgaaggaaatgacaaaagaagtcgggcgaagaaagcaccttcacaagaagcttcccccaaagaagtagatcgcactttggaagatgatatcattgatagtgcaagactactggctgaagaagaaactgcggcatcaacatacacggaagaagttgatacgcccgttgggagttcttcagaagagtcagacgatttttggaaatcattcatcaatccatcatcgtcaccttcaccgagtgaaacagaaaatatgaataaggtagctgatacggagcctaaagcagagggtaaggaaaacagcagagacgacgatgaattagctgatgcttcagattctgaaaccaagtcatcaccaaaacgtgtgaggaagaacaaatggaaaccggaggagataaagaaggtaatcagaatgcgaggagagctgcacagtagatttcaagtggtgaaaggtagaatggcattgtgggaagagatctcttcaaatctatcagctgaaggaatcaatcgaagcccgggacaatgcaaatctctctgggcatcacttattcagaaatacgaggagagcaaggctgatgagagaagcaagacgagttggccacattttgaggatatgaacaacattttgtcagagctaggcacacctgcgtcttaagtaatgtgatttagatgacattatcttcccaaaagaatcatc

SEQ ID NO: 4048 - DNA, 2646 bp, Artificial Sequence
  P1083 (35S::G1082)
gggtttggaatcatattattgagtgttatgggttgtacaagttctaagcttgacgatcttccggcggttgctctttgccgtgaacgctgtgctttcttagaagctgctattcatcaacgttacgctttagctgaatcacacgtggcttacactcattcgcttcgagaaatcggtcactctctccatcttttcatcaatcaccaccaccgtttcgtcgcttccggcggcgctaacgtcggtgattctcctcgacttaatcttcctcctcagagaaaaggtgaccttgacgacgaagcaacaaattccccaaaaaaacaaaagcttgcttcttctcaccacaaccacaaccacgctcactcgggttccggttctgattcgggtcatctcgaattcgattcagattccgacgaagatgaagaagacgacgacgacttggatttggattcgttgcatcaccactctcctccccaccaccatctcggcaatttccctattcccgaatcagcaccaatgggcggatacatggaacaacaaccgggttatataaacccgtacccgaatccagatatgatggggcatccttactctggaggaggaagttatatgcacatgaattacatgaagaacaaatccatgcctccttcagttgtctatgagcaaagaccaactagtcctcaacgagtctacataggcgaatcatcatcttcatatccatatcctcctcaaaattcatattttggatactcaaatccagtacccggacccggaccaggatactacggttcttcttctgcttctacaactgctgcagcaacaaaaccgccaccacctccaccgtcgccgcctaggtctaacggttgggattttttgaatccctttgatacttattatcctccgtatactccgagtcgagattcgagagagttaagagaagaagaaggtataccggatttagaagacgatgattcacattacgaagttgttaaagaagtttacggcaaaccaaaattcgccgccggtggtggtcaccaaccaaatcccgccgccgtacacatgatgagggaagagtccccgtctccgccgcttgataaatccggtgctagtactagcggtggaggtgatgtcggagatgcatctgcgtatcagtctagaccaagtgtgtcggtggagaaagaagggatggagtatgaagttcacgttgttgagaagaaggttgttgaagatgaggaacggcggagtaatgccacggcgacacgtggtggtggtggaggaggagggccacgtgcggtgcctgaagttgcgaaagagattgagaatcaattcgtgaaagctgcagagtcaggaagtgagattgctaagttacttgaagttgggaagcatccttatggtcgtaaacatgctgcttcgaagatgttgcacggtgttactccttcgttaccttctacctctggaggaacttcttcgtctgctgctgctgctgttgtgccacctacttatgcagatattgaagaagagcttgcttcgaggtcgaggaatctttcttcgacgttgcacaagctccatctttgggagaagaagctttatcatgaagtcaaggccgaggagaaactgcgtctagctcacgagaaaaagcttaggaagctaaagcgtttggatcaaagaggtgccgaggctatcaaagtagataaaacgcggaaattagtgagagatatgtccacaaaaatacggattgcgattcaggttgtcgacaaaatatccgtgacgattaataagataagagacgaagacctgtggccgcaactgaatgcattgattcaagggcttacaagaatgtggaaaacaatgcttgaatgtcatcaaagtcaatgtcaagctattagggaagcacaaggtttaggcccgataagagcaagcaagaaactaggcgatgaacatctagaagcgacgagtttgcttggacatgaacttattaattggatattgggattctctagctgggttagtgcgcagaagggttatgtaaaagagttgaataaatggctcatgaaatgtcttctgtatgaacctgaggaaacacctgatgggatagttcccttttcacctggtaggattggggctccacctatctttgtcatctgtaaccaatggtctcaagctctggataggatatctgagaaggaagttattgaggcaatgcgtagtttcactacaagtgtgcttcagctttgggaacaagatcggttagatacgatgatgacggggcatggtgattcagagaagaaagtcaggaacatggacagagaagaacagaggatacagagagagattcaagcattggaaaagaaaatgattcttgtggcaccgggtgatggtaacagtctttcgatatccggcaacgttgtttaccaaagcgatactagcagcgatagtttacaaggtagtttgcaacggatttttgaagctatggagagattcactgctgaatcgatgagagcttatgaggatctcttagagcgcaccaatgaagaaactgcaccacgggaacttgaggaagaagaggaggagtaaaaaagcaaaacaggaagaagaggtttgcttgtcaattcaatttgaatcccatgatcgagctgtttgctgatcttgcaa

SEQ ID NO: 4049 - DNA, 1088 bp, Artificial Sequence
  P1084 (35S::G1051)
attcagatttgctttctttggtaatcttttggatcaagatccatctattttttcttcaatggcacaactccctcctaaaatccccaacatgacacaacattggcctgatttctcttcccaaaagctctctcctttctctaccccaaccgcaaccgctgtcgccaccgctacaaccaccgtacaaaacccctcatgggtcgacgaattcctcgacttctcagcgtctcgccgtggcaaccaccgtcgttccatcagcgactctatcgcattcctcgaagctccaacagtcagcatcgaagaccaccaattcgacaggttcgatgacgaacagttcatgtcgatgttcaccgacgacgacaaccttcatagcaatccttcccatatcaacaacaaaaataacaatgtggggcccacgggatcttcctcgaacacatccacgccgtccaatagcttcaacgacgataacaaagaattaccaccgtccgatcataacatgaacaataatatcaacaacaactataacgatgaagtccaaagccaatgcaagatggagccagaagatggtacggcgtcgaataacaattccggtgatagctccggcaaccggattctcgatcccaaaagggttaagagaatattagcaaatcggcaatcagcacagagatcaagggtgaggaaactgcaatacatatcagagctcgaacgtagcgtcacttcgttgcaggcggaagtgtcagtgttatcgccaagagttgcattcttggatcatcaacgtttgcttcttaacgttgacaacagcgctctcaagcaacgaatcgctgctttatctcaagacaagcttttcaaagacgcacatcaagaagcattgaagagagaaatagagagacttcgacaagtgtataatcaacaaagcctcacgaatgtggaaaatgcaaatcatttatcggcgaccggagccggtgctactccggccgtcgacatcaagtcgtccgttgaaacagagcagctcctcaatgtctcataaattaaccatcatgcatcatcatcaacatttctctcttttagcttcttggcaaaagttcttgact

SEQ ID NO: 4050 - DNA, 2514 bp, Artificial Sequence
  P1086 (35S::G1804)
cggaacacaaagccaccggtttttagacacacagatttcattttcaggttaacacttttcttgttttataatttttcaagatcttggattagaagactgttaaataaatctatctctttatttataagtttaggtcttcgttttctggtccttacttatctgcgtattaccaaatattaaactttgtggtaaagtgatacttagtaatagacggatataatgatgacccaagctaatgattaatttattttactaatcatcaggttaagctctagattatcttttgtttaaaaccgtattaataaatgattaaagaggaaaaaaatcttgtgttgataagttcgctttaagaagaaaacgagtgggttaagatattttcctcttttggtaacgaaaactttattggaagagtaaattattagtttatttattgctaattttagtatcgtttgtcgctgtcacgatgtggaccgttcttctttattttcacgtggaccgacttaattaccttctttcattcttgttatttcaatattttttacgtcatttaaactccactttaccaaaataatttatttcattctttgagagcatcaattatcaaataattcaattgtcttttttcgtgatagttgaataagggacaactattaagtgagtttcgtgaatagctgaacagggacaagtaactgaagtttggtcaaaataatacgatgaatttaatatataagagacaaaattgttattgtcgtttaggtggtatccatatttcaatatagtttgtgtgaatacagatataaaaatggttattgttgtgtatatgatgcagttgttaaatggtaactagagaaacgaagttgacgtcagagcgagaagtagagtcgtccatggcgcaagcgagacataatggaggaggtggtggtgagaatcatccgtttacttctttgggaagacaatcctctatctactcattgacccttgacgagttccaacatgctttatgtgagaacggcaagaactttgggtccatgaacatggacgagtttcttgtctctatttggaacgcagaggagaataataacaatcaacaacaagcagcagcagctgcaggttcacattctgttccggctaatcacaatggtttcaacaacaacaataacaatggaggcgagggtggtgttggtgtctttagtggtggttctagaggcaacgaagatgctaacaataagagagggatagcgaacgagtctagtcttcctcgacaaggctctttgacacttccagctccgctttgtaggaagactgttgatgaggtttggtctgagatacatagaggtggtggtagcggtaatggaggagacagcaatggacgtagtagtagtagtaatggacagaacaatgctcagaacggcggtgagactgcggctagacaaccgacttttggagagatgacacttgaggatttcttggtgaaggctggtgtggttagagaacatcccactaatcctaaacctaatccaaacccgaaccaaaaccaaaacccgtctagtgtaatacccgcagctgcacagcaacagctttatggtgtgtttcaaggaaccggtgatccttcattcccgggtcaagctatgggtgtgggtgacccatcaggttatgctaaaaggacaggaggaggagggtatcagcaggcgccaccagttcaggcaggtgtttgctatggaggtggcgttgggtttggagcgggtggacagcaaatgggaatggttggaccgttaagcccggtgtcttcagatggattaggacatggacaagtggataacataggaggtcagtatggagtagatatgggagggctaaggggaaggaaaagagtagtggatggtccagtggagaaagtagtggagagaagacagaggaggatgatcaagaaccgcgagtctgctgctagatctagagcaagaaaacaagtaaatagagaccttcttcattccttttatgatgtttcttgttgaaaaaaatctaatgtttgttgttgttgttttgggaaggcatatacagtggaattggaagctgaacttaaccagttgaaagaagagaatgcgcagctaaaacatgcattggtatatatttactcatctcgttaaagagtttattctttttgtgaaagtgagtttgtaacaatttagcctttgttatgttttcatcaaggcggagttggagaggaagaggaagcaacaggtaaagacacctattgagtttgcattactaagatggttgcagtattttggtcagaagaaaactacaaaatggaattgttggtttatggttgcagtattttgagagtttgaagtcaagggcacaaccgaaattgccgaaatcgaacgggagattgcggacattgatgaggaacccgagttgtccactctaaacaaacaataggaagatggagaagaagtcggagacagaacgagggaaaaactgatgattttctacgttgttgttttgtctttgagg

SEQ ID NO: 4051 - DNA, 1307 bp, Artificial Sequence; identical to SEQ ID NO: 1337
  P1089 (35S::G2057)

SEQ ID NO: 4052 - DNA, 818 bp, Artificial Sequence; identical to SEQ ID NO: 77
  P1090 (35S::G46)

SEQ ID NO: 4053 - DNA, 678 bp, Artificial Sequence
  P1092 (35S::G1049)
ctaactttcttcccaagtaaacttcaaaatgcagccgcaaacagacgttttcagcctccataactacctaaactcatcgatactgcagtctccgtatccttctaatttcccgatatctacgccatttccaaccaacggtcaaaacccgtacctcctctacggattccaaagccctacaaacaatccacaatccatgagcctaagcagcaacaactcaacatcagatgaagcagaagagcagcagacgaacaacaatataatcaacgagcggaagcagagaaggatgatttcaaaccgagaatccgcaaggagatcgcgtatgaggaagcaaagacaccttgacgagctttggtcacaagtgatgtggttaaggatcgagaatcatcagttgcttgataagcttaacaatctctctgagtctcacgacaaggttcttcaagagaatgctcagcttaaagaagaaacatttgagcttaagcaagtgatcagcgatatgcaaattcaaagccctttctcttgctttagagacgatataatccccattgaataaagcatttttccccgattcatatttatgaaaattttcttcaagagtatgtttctttgtatgtatatgtggagatgtatttcagggttttgataatatgaccctttacgacgacgtttttagattgtagt

SEQ ID NO: 4054 - DNA, 944 bp, Artificial Sequence
  P1093 (35S::G643)
cgacgtgtcgttttccagaagcagtttccggcgatctgtttaagcctttttggatggaggaaggaacttcaggttcacggagaacacggtctcaagttgctccagaatgggcagtcaaagattgtctagtcctcgtgaatgagatcgctgcggttgaagccgattgttcgaatgctttatctagcttccagaaatggacaatgatcacagagaactgcaacgctttggatgttagcagaaatctaaaccaatgcaggaggaaatgggattctttgatgtctgattacaatcagatcaagaagtgggaatctcagtaccgaggcactggtcgttcctattggtccctgagtagtgacaagaggaagttacttaatctcccgggggatatcgatatcgagctttttgaagccatcaatgcggttgtgatgatccaagatgaaaaagctgggactgaatctgatagtgaccctgaagcgcaagacgttgttgatctctctgctgaattagcttttgtaggatcaaaaagatcaagacagcgaacaatggtcatgaaggagacaaagaaagaagagccacggactagccgagttcaagtaaacactcgagagaaacctataactacaaaagcaacccatcagaacaaaaccatgggagagaagaagccggtggaagatatgtccacagatgaagaagaagatgaaacaatgaacatagaagaggatgtagaagtgatggaagcgaagctaagttataaaattgacttgatacatgcgatagtcgggagaaatctagcaaaggataatgaaacaaaggatggtgttagtatggacgacaagttgaagtctgtgagacagcaaggagacgagctcatcggttgtctgagtgaaattgttagtacccttaataggcttcatgaagttccacaagaaatcgagtgatttacg

SEQ ID NO: 4055 - DNA, 505 bp, Artificial Sequence
  P1094 (35S::G3)
gtttgtcttttatcaatggaaagagaacaagaagagtctacgatgagaaagagaaggcagccacctcaagaagaagtgcctaaccacgtggctacaaggaagccgtacagagggatacggaggaggaagtggggcaagtgggtggctgagattcgtgagcctaacaaacgctcacggctttggcttggctcttacacaaccgatatcgccgccgctagagcctacgacgtggccgtcttctacctccgtggcccctccgcacgtctcaacttccctgatcttctcttgcaagaagaggaccatctctcagccgccaccaccgctgacatgcccgcagctcttataagggaaaaagcggcggaggtcggcgccagagtcgacgctcttctagcttctgccgctccttcgatggctcactccactccgccggtaataaaacccgacttgaatcaaatacccgaatccggagatatatagtcaatttatatacatgtagtttgttttg

SEQ ID NO: 4056 - DNA, 1312 bp, Artificial Sequence
  P1096 (35S::G1517)
cgaagcttctcctgcttatttgatacatattctctcttccagttactctacatggaaccattcgttgttaaggagaacatcgtcgcatccgcttcttcgccgatgaagaagcgacggatcgatcacactgagtcagctgatggttctgcgattaacgcttctaactctagtagcatcggtggtaacgatacggtgatgaacatggcggagtttggtaacgacaactccaacaatcaggagtctcaacaagtttgcactttcttcaagaagccaacgaaaagtaaaaacataaggaaaagaaccattgacgctgatgaagaagacggagattcgaaaagcgaaagctctattttacaaaatctaaagaaagttgcaaaacccgatagcaacttgtacttttcttctggaccatctactagaacgagtggagctcctgagagacccgtttttcactacgattcatccaaggaaatccaggttcagaacgacagtggagcaacagcgacccttgaaactgaaaccgacttcaatcaagacgctcgagctatccgtgaaagagttcttaaaaaagcagaccatgcattgaaggggaataagaaaaaggcttcagatgagaagctgtacaaaggaattcatggatatacagatcacaaagctgggtttagaagagaacaaacaatctcgagcgagaaagctggaggctcacacgggcctttaagagcttctgctcacatcagagtatcggctagattcgattaccagccagacatttgcaaggattacaaggaaaccggatactgtggatatggagattcgtgtaagttcttgcatgaccgtggggattacaagccgggatggcagatagagaaagagtgggaagaggcagagaaagttaggaagagaaataaagctatgggagttgaggatgacgatgatgaggctgacaaggatagcgacgaagacgaaaatgcattgccctttgcttgcttcatttgcagggagccttttcttgatccagttgtcaccaaatgcaagcattacttctgtgagcattgtgctttaaagcatcacacgaagaacaagaaatgctttgtgtgtaaccaaccaacaatggggattttcaatgcagcacatgagatcaagaagagaatggctgaagaacggagtaaagctgaacaaggattgtgaagtccttctttcacaggacaaaaaggcaaaaactatacatttgattatttgcttgaggaaagctttttgttttgttgtactcactggcctatatactgtatattcggatgacgatggttgtttc

SEQ ID NO: 4057 - DNA, 1028 bp, Artificial Sequence
  P1099 (35S::G1488)
acaactctttagttttaatcaacgaaacttatggaagatgaagcacatgaattcttccacacatctgattttgccgttgatgaccttttagttgatttctctaacgatgatgacgaagaaaacgatgttgttgctgattccaccactaccaccaccataaccgacagctctaacttctccgctgctgatcttcccagtttccacggtgatgttcaagacggcactagcttctccggtgacctttgtataccttctgatgatttggctgatgagttagagtggctttcgaacattgtggatgaatcattgtcgcctgaagatgtacacaagctcgagctaatatccggttttaagagtcgaccggacccgaaatccgataccggaagcccggaaaacccgaatagcagcagtccgatttttactaccgacgtttctgtaccggccaaagctagaagcaaacgctcacgcgccgctgcgtgtaattgggcctcacgtgggcttctcaaggaaacgttttacgacagtcctttcaccggagaaaccattctctctagccaacaacacttgtctccgccaacctcgccgcctttgttgatggctccgctagggaaaaagcaagccgttgatggaggacaccgacggaagaaggatgtttcttcaccggagtctggtggcgcagaggagagacggtgtctccactgcgccacggataagactccgcaatggcggacaggcccaatgggcccgaagacgttgtgcaacgcttgcggtgttaggtacaaatcgggacgtttagtgccggagtatcggcccgcggcgagtccgacgtttgtgctggcgaaacactcaaattctcatcggaaagttatggagctccggcgacagaaggagatgagtagggcccatcatgagttcatacatcaccatcacggtacggacactgccatgattttcgacgtttcatcggacggtgatgattacttgatccaccacaacgttggcccagatttcagacagcttatttgatt

SEQ ID NO: 4058 - DNA, 1116 bp, Artificial Sequence; identical to SEQ ID NO: 801
  P1178 (35S::G1069)

SEQ ID NO: 4059 - DNA, 738 bp, Artificial Sequence; identical to SEQ ID NO: 879
  P1184 (35S::G1249)

SEQ ID NO: 4060 - DNA, 3518 bp, Artificial Sequence
  P1187 (35S::G1382)
ctctcatttcgccatagctgagagcttcttctactttcccttagcttcttttttccttcatttttgttctacccttgcgaatctctgaaatgaaccctcaagctaatgaccggaaggagtttcagggagattgttcggcgacgggagatctcacggcaaagcacgattcagctggaggaaacggaggtggaggtgctaggtataagctgatgtcaccggccaagcttccgatctcgaggtcgactgatatcacgattcctcctgggttgagtccgacttcgtttttggaatctcctgttttcatctccaacatcaaggtttaagcagctactttactatctctttcttcttcttcttcttcgattttggtaaatgcaatcacagtttcacctcatttttgttgtcgatttgagaaattaggttttctgatttcatatttttaagacctaaaggatttttcatgaaattggattgtgccattttgaaactgagtttggaattggaattgattcataacattgacattttgtcccacttgttcggtttctcgttgcttcaatttcgatttggatcactgttcatgttagtggggaatttctggtaatttggtggagatgctctctgcttgctcactaggaaaaacattggacttgggtttccatttttgtttcttagtccattacaagtgattaaaaaactatgatttgtttgcttacgttagggactttggccaagattctgattctttgtgctactatactctgcattggtttgcatttgtgtccgttcagattgttctttcgaataaaccttttttttttatcatgttctattggtgctggatactttatttatatcctcttgctctttgtcgtttcttcttcatactgtctagtgtctatcttccatgtgtttggtgcttctcttttctttttccattctttgtacatttaggtttcggttagctgcgtctgtgtggggattccttttacttatatgagctattgaatgattctgttggtgagaaaatgtactttactcgcatgttcaccatttagatctatagagtattcgttttgttcaattaagttatgaataataggttatatgctatgtgctcaattttattttgcatctcttagttatatcttcttatcccttgattgaacaagatattgtttttgtttttagaagactgttttttttaaaacatcatgtttattgatagatcaggttcatgttttacaaaatctgatatgtattgttttattcatgccattaataatatgccactttctttaactttcagccagaaccttcccctactactggttctttgttcaagcctcgaccagtgcacatttctgctagctcaagttcttatacaggcagggggttccatcagaacacctttactgagcagaagtccagtgaatttgagttcagacctcctgcatcaaatatggtattgtccaaaacaatgctgtttgttatgctttgcatgtaatgtactgttcagatagtcgacgacatatgaaccccgaacagtggctgacctaatttttctgcacgaagtctatttattcagcgcttggattgcttgtaaatctcaaaatctttcgcctttgcatacatataataccatgccagccttaaattgtttcataaggagccttgtatccaaaagctcacagtttataagttacttgtatattgttgggggatgactttgtctaaacatctttattgatttcaaggtatatgcagagcttggcaagattagaagtgagccaccagtacattttcaaggccagggccatggatcctcacactcaccttcttcgatcagtgatgctgcaggttcctcaagtgagctaagccggccaactcctccttgtcagatgacaccaacgagctcagatattccggctggatctgatcaagaggaatcaatccagacttcccaaaatgactccagaggaagcactccatccatcttggctgatgatggttataactggagaaaatatggtcaaaagcatgtcaaagggagtgaatttccccggagctattataaatgtacacatcctaattgtgaagtgaaaaagttatttgaaagatctcatgatgggcagatcaccgatattatatacaagggtacacatgaccatcctaaacctcaacctggtcgccgaaactctggtggtatggctgcacaagaagaaaggctagacaagtatccttcttcaactggccgagatggtaatcataactaaaacttgagacaaatatgcacttactcccttggcaatatctataactttttccttctactcttatgtctgcatacagagaagggatctggcgtctacaacttgtctaaccccaatgaacaaactggtaaccctgaagtacctcctatctcagcatctgacgatggtggagaagcggcagcgtcaaataggaataaagatgagccggacgatgatgatccattctcaaaacggaggtattagagtttaacaaaggattcaggtgcttgatttgaatctgtgatttgacatgattaaaactttattttaactttatgtaggaggatggagggtgcgatggaaataactccactagtgaaacccatccgggagcctcgggttgttgttcaaactctgagtgaggttgacattctggatgatggttatagatggcgcaaatatgggcagaaagtcgtaagggggaacccaaatcccaggtttgtacagcattaaagcttttaacaccccaaaaaattccttgcttttttctcgaatgaacatacataaacataacttgcgagttcaaaatggtagctagaacagtttagtccttgtcttcaggacctagttatttgacatgtgcataaagtgttgcttcttttaggaatttggtttggaatatggaagatagtgatcttaacagactcaacatgtgcgcaatggagatattatgtttcatgatgttcctcggccttttgtaggagctactacaaatgcacagctcatggatgcccagtgagaaaacacgtggagagagcatcacatgatccaaaagctgtaataacaacatacgaaggcaaacacgatcatgatgttcccacttcaaagtctagcagcaatcacgaaatccagcctcggttcagaccagatgaaacagacaccatcagcctcaatcttggtgttggaatctcatctgatggacctaaccacgcttccaacgaacatcagcaccagaatcaacaacttgtcaaccaaactcacccaaatggagtcaatttcaggtttgttcatgctagtcccatgtcatcctactatgctagcttaaatagcggtatgaatcagtacggccagagagaaacaaagaacgagactcaaaatggtgacatctcgtccttgaacaattcatcttacccatatccgcccaacatggggagagtacaatcgggtccgtaaaacaaaaagtaagcaacattatgtacgggatct

SEQ ID NO: 4061 - DNA, 766 bp, Artificial Sequence; identical to SEQ ID NO: 595
  P1192 (35S::G779)

SEQ ID NO: 4062 - DNA, 1196 bp, Artificial Sequence; identical to SEQ ID NO: 867
  P1195 (35S::G1228)

SEQ ID NO: 4063 - DNA, 4471 bp, Artificial Sequence
  P1196 (35S::G447)
gaactctgtttcttccctgcaccaaaccaattttttcgttctttctataaaccatgaaagctccatcaaatggatttcttccaagttccaacgaaggtacacaagctttatatttatcttcttcttttccagattttatactattcaatttcttcatcaaggagtttctgcatttcatgtttgtgattttctcattgaaaaaatgaattttgttattcaatttcaactttggagtcagcacaaagtcacaaatcgagttcttctatcactttatttaataaagtggttgaaacataaatgccgctcataaaatttccagactttaaatgaaactatgcaaaaattctatcacttttaacagatttgaatatgtgtgtgatgatgatgaacaggagagaagaagccaatcaattctcaactatggcacgcttgtgcagggcctttagtttcattacctcctgtgggaagtcttgtggtttacttccctcaaggacacagcgagcaagtaagttcattgcgtttcaaactattttgaaacctttggtagcaatctaagtaatatgttcaatgaaaccttttttcaggttgcagcatcgatgcagaagcaaacagattttataccaaattacccaaatcttccttctaagctgatttgcttgcttcacagtgttacattacatgtaagtctcttctgactccaacttgtgaatcaacaagaagatgaactaatcaggacttttgtgaaattctgaatcaggctgataccgaaacagatgaagtctatgcacaaatgactcttcaacctgtgaataaggtctgaattatatcattcttcttgtgctatcttggtttaaagttgaggactttaatgctgatctttgctcaaaatgtgtgacagtatgatagagaagcattgctagcttctgatatgggcttgaagctaaacagacaacctactgagtttttttgcaagactcttactgcaagtgacacaagcactcatggtggattctctgtaccgcgtcgtgcagctgagaaaatattccctcctcttgtatgtctctctgatcaaagctactctcagtttcttttgcttcaaacttttgaatctgttttgctaaaagttctaagggtgcttaaaataggatttctcgatgcaaccgcctgcgcaagagattgtagctaaagatttacatgatactacatggactttcagacatatctatcgaggtttgaatcatctaaagtttgttttattagtctaaaagattgaaaacttcaacctgatttgttttctttgatgtaatctgatctcaggccaaccaaaaagacacttgcttaccacaggttggagcgtttttgttagcacaaagagactatttgcgggtgattcagttttgtttgtaaggtatgagtcatactttgatcaaaacattaagcagaattggactttcatcttctcataagggtacttgggtttgcagagatgagaaatcacagctgatgttgggtataagacgtgcaaatagacaaactccgactctttcctcatcggtcatatccagcgacagtatgcacattgggatacttgcagctgcagctcatgctaatgccaatagtagcccttttaccatcttcttcaatccaagggcaagtccttcagagtttgtagttcctttagccaaatacaacaaagccttatacgctcaagtatctctaggaatgagattccggatgatgtttgagactgaggattgtggggttcgtagatatatgggtacagtcacaggtattagtgatcttgaccctgtaagatggaaaggctcacaatggcgtaatcttcaggtaatgacatatccgagttatgctaaactgtttatgatggtcatttcttctgaatcttttgttcatggtttaaacaggtaggatgggatgaatcaacagctggagataggccaagccgagtatccatatgggaaatcgaacccgtcataactcctttttacatatgtcctcctccatttttcagacctaagtacccgaggcaacccgggatgccaggtgagtttactgctttcgttcatttttttcccatagatctttgactgagtttccggatactaaccttggtggtttgttgcagatgatgagttagacatggaaaatgctttcaaaagagcaatgccttggatgggagaagactttgggatgaaggacgcacagagttcgatgttccctggtttaagtctagttcaatggatgagtatgcagcaaaacaatccattgtcaggttctgctactcctcagctcccgtccgcgctctcatcttttaacctaccaaacaattttgcttccaacgacccttccaagctgttgaacttccaatccccaaacctctcttccgcaaattcccaattcaacaaaccgaacacggttaaccatatcagccaacagatgcaagcacaaccagccatggtgaaatctcaacaacaacaacaacaacaacaacaacaacaccaacaccaacaacaacaactgcaacaacaacaacaactacagatgtcacagcaacaggtgcagcaacaagggatttataacaatggtacgattgctgttgctaaccaagtctcttgtcaaagtccaaaccaacctactggattctctcagtctcagcttcagcagcagtcaatgctccctactggtgctaaaatgacacaccagaacataaattctatggggaataaaggcttgtctcaaatgacatcgtttgcgcaagaaatgcagtttcagcagcaactggaaatgcataacagtagccagttattaagaaaccagcaagaacagtcctctctccattcattacaacaaaatctgtcccaaaatcctcagcaactccaaatgcaacaacaatcatcaaaaccaagtccttcacaacagcttcagttgcagctactgcagaagctacagcagcagcaacagcagcagtcgattcctccagtaagctcatccttacagccacaattatcagcgttgcagcagacacaaagccatcaattgcaacaacttctgtcgtctcaaaatcaacagcccttggcacatggtaataacagcttcccagcttcaactttcatgcagcctccacagattcaggtgagtcctcagcagcaaggacagatgagtaacaaaaatcttgtagccgctggaagatcacattctggccacacagatggagaagctccttcttgttcaacctcaccttccgccaataacacgggacatgataatgtttcaccgacaaatttcctgagcagaaatcaacagcaaggacaagctgcatctgtatctgcatctgattcagtctttgagcgcgcaagcaatccggtccaagagctttatacaaaaactgagagccggatcagtcaaggcatgatgaatatgaagagtgctggtgaacatttcagatttaaaagcgcggtaacagatcaaatcgatgtatccacagcgggaacgacgtactgtcctgatgttgttggccctgtacagcagcaacaaactttcccactaccatcatttggttttgatggagactgccaatctcatcatccaagaaacaacttagctttccctggtaatctcgaagccgtaacttctgatccactctattctcaaaaggactttcaaaacttggttcccaactatggcaacacaccaagagacattgagacggagctgtccagtgctgcaatcagttctcagtcatttggtattcccagcattccctttaagcccggatgttcaaatgaggttggcggcatcaatgattcaggaatcatgaatggtggaggactgtggcccaatcagactcaacgaatgcgaacatatacaaaggttagagatctttctctccctttccatagctctaatcttttgcttcttaattttcgaatgctaaatgccgaaagttgttaaatcattgaaggttcaaaaacgagggtcagtaggtagatcaatagatgttacccgttatagcggctatgatgaacttaggcatgacttagcgagaatgtttggcatcgaaggacagctcgaagatccgctaacctctgattggaaactcgtctacaccgatcacgaaaacgatattttactagttggtgatgatccttgggagtacgttccagacctgaaaaatctatctgtaacagtcaagattgaacaattctgataattcttgtctgtttgttttttccacagagagtttgtgaactgcgtgcagaacataaagatactatcatcagtagaagttcagcaaatgagcttagacggagatcttgcagctatcccaaccacaaaccaagcctgcagcgaaacagacagcggaaatgcttggaaagtacactatgaagacacttctgctgcagcttctttcaacagatagaaataaaaagatgcaaatataccaagtcaactt

SEQ ID NO: 4064 - DNA, 1953 bp, Artificial Sequence
  P1209 (35S::G1242)
ggatcttgaagtggttaatggtggtggagaacgcaaacgtctgttgaacatagcaatgcaattgcggaaatgctgcaatcacccttatctcttccagggtgcggagcctggtcccccatatactacaggagatcaccttgtaacaaacgcaggtaagatggttctcttagataaattgctacctaagttgaaggatcgagattcaagggttctgatattttctcagatgacaaggcttttggatattctcgaggattacctaatgtatcgtggttaccagtactgccgtattgatggaaatactggtggtgacgaacgagatgcttccatagaagcctataacaagccaggaagtgagaaattcgttttcttgttatccactagagctggaggacttggtatcaatcttgctactgcagatgttgtgatcctctatgatagtgactggaaccctcaagttgacttgcaagctcaggatcgtgcacataggattggtcaaaaaaaagaagttcaagtgttccggttctgcaccgagaatgctattgaggctaaagtcattgagagagcttacaagaagttggcacttgatgctctggttattcagcaagggagattggcagaacagaaaactgttaataaggatgagttgcttcaaatggtgagatatggtgctgaaatggtgtttagttctaaagatagcacaattacggatgaggatattgacagaatcattgccaaaggagaagaggcaacggctgaacttgatgccaagatgaagaaatttactgaagatgcaatacagtttaaaatggatgacagtgctgacttttatgattttgacgatgacaacaaggatgagagcaaggtggattttaaaaagattgtgagtgaaaattggaatgatccaccaaaaagagagagaaagcgcaactactctgaagttgaatacttcaagcaaacgttgcgacaaggtgctccagctaaacctaaagagcctagaattccacgcatgccccaattgcatgattttcagttctttaacattcagaggctgactgagctgtatgaaaaagaagtgcgataccttatgcaagcacatcagaaaactcaaatgaaagacacaattgaggttgatgaacctgaagaagttggagatcccttaactgctgaagaagtggaagaaaaggagctattgctggaagagggtttctcaacatggagcagaagagacttcaatgccttcattagggcttgtgagaagtatggccggaacgacataaagagtattgcctctgagatggaagggaaaactgaggaagaggttgaacgatatgctcaagttttccaagtgcgatataaagagctgaatgattacgacagaatcatcaagaatattgagagaggggaagcaagaatctctaggaaagatgaaatcatgaaagctattgggaagaaactggatcgctacagaaacccgtggctggaactgaagattcaatatggtcagaacaaagggaagctgtacaatgaagagtgcgaccgtttcatgatatgcatggtccataaacttgggtatggaaactgggatgagctaaaggcagcgtttcggacatcccccttgtttaggtttgactggtttgtaaaatcccgcacaactcaggaacttgcaaggagatgtgacacactaatcaggttgattgagaaagagaatcaagaatttgatgagagagagaggcaagcccgaaaagagaagaagctttcaaagagtgcaacgccatcaaaacgaccttcgggtaggcaagcaaatgagagcccttcatctcttctgaagaaacgaaagcagctgtcaatggatgattatggaaagcgtaggaaataagaaggcttgtgttgaatccatcactaagtaatcagaaagatttatgatcacttctaggtttgattccgaatcgg

SEQ ID NO: 4065 - DNA, 1306 bp, Artificial Sequence; identical to SEQ ID NO: 973
  P1211 (35S::G1420)

SEQ ID NO: 4066 - DNA, 3083 bp, Artificial Sequence
  P1214 (35S::G600)
ccaaggtatttcatactctcattcgcagtcttttatatttgtgtgtaccatcattggtaaactaatgagtattaaatctagatatggagtctgtacggtgtccacctcccaaggctctatctcctactacatctgctgcatctggaggcgaaaagaaaccagctcctagtaacaacaatgagacttcaactctaaagccgtcaatagaaatagcagagatcacaagtgcttgggcgtctgcagaaatagttaaagtggaaaagccagttgatgcatctgcaaacattcaaggatcctcaaatggcaaggaagcagcagtttcacaactgaatacgcagccccccaaggaagaaatgccgcagcaggttgcttctggggagcaaggtaatcactggctattgtcccattagcacgagaaacttatgcatttaaagaagagaaagcatcaccttttacacattatataatatacattgatgtttggcgattagtatcatcagtaaagtaataatgcatacttttgctcttcagcaggaaaaaggaagaagaagaaacctcggatgagtggaaccggtaggtttttcttattttgatgtggactacccatgctctttcttcccagactatgttaactgtatagagaggcttaacagattgtttgtcttccttttcctttgccagatctagcaggccctgactatatgatgcccatgggcccaggtcccggtaatcagtacttcaatggtttccaacccggcttcaacggcgttcaacatgggttcaatggcgttcaacctgggttcaatggctttcatcatggtttcaatgggtttccaggcccttttcctggtgcgatgcctccttttgttggctatggatttggcggtgtgatccatccagatcctttcgctgcacagggctttgggttccctaatataccaccaccttataggtactgagaagctgagacttgctctctcagttcatagatagtttgtgattttgtatcttcattatagctattagtaaccaggacatgtgacttgagcagggaccttgcggagatggggaatcgtatgaatctccagcatcctataatggggagagaagaatttgaagctaagaaaactgagatgaaaagaaagcgtgaaaacgagattcgacgatcggaagggtaaagcactgtctgtgcattcactagtttcaggcttatgtatgtatactgcagcatgttgactagttgtttgtttttgtgtggtacagagggaatgtcgtcagggacagtgaaaagagcagaataatgaacaactcggcagtcacttcctcacccgtgaagccaaaatctgtatgtatcattttgttgtctcagttctctctcgctctctctctctctctctcggccaattggtttggtttgcaagagatgacgttttctcagcaccctctttctctctttttatttctatatttttcgctctctgcatatccttttacgttaaaaagaaaggggttgattccacaattgctaaataggcgtctgctttatagttgatttggtttaggggtaaaactcaaaggagagacatttaagattagaatgaggtagatgtagaaattgaattgacaccataaaatgtattgacttgcgatagaatatatgcataaatgaaatgaattgaaagttatttccacatagtcttctcgttggcagtttggtcacaagtaatgctcgactgatcccataatttttggcctcttcaagacagaaaaatttgtagggaacaaaagactaaagtagaaagtcgtaggaaatgtttttaatttcagggtagtatatcttatcgtacgggttaatatggccctatagacttacatgaagcgtggtcccaaacagaccagttggctttatattgccgaccttataaaatattatttttctaacattatattttacctaaatagttttttttttttttttttttttgacgaaatttttttttacaatattaaatttttgttatctattaaaatgtagatatttgatctactttatttttaaagtaaacgttaaatactgatatcaaaatcatattaaatcaggactatattaaatacgtctttttatattttgaaaccaaaacacgtttgtaatccacgtgtaaggatagtagtggtcactctttatcctccaaaattaagattttactgggaagctataaagtataaacctttgtttgctttctcttttctttgtttcttcgttaaataagctatttagagtaaagtaaaagataaatgggttgggcccaatatatctcttattgggctcaagatttaaatttcttttctgttattttaccaataatggccttgttcttgaataaacagagacaaggacctccgccgccgatttcgtctgattacgaccgtcgcaggcgatcggatagatcgtcaccggagcgtcagtcatctcgaaggttcacctctcctcctcgatcatccagcaggaaatctgagcgtgatcgtcaccatgacctcgattccgaacacgaccgccgccgtgaccgtcccagagagacagatcgcaagcaccgtaagagatccgaaaagtcatcatcggatccaactgtagagatagacgataacaataagtctaacgtgttcactcggataagctttccagaggaatcttctggcaaacaacgaaagacatcaaagtcttctccagcgcctccagagagctcagtcgccccagtttcatcgggtcgtcgtcatcacagtcgaagagaaagagagatggtggaatacgattcaagtgatgatgaagacagacatttcaagaggaagccatcaaggtacaagcgatctccttcggttgcaccttctgacgccggtgatgagcatttccgtcattctaagcgatctaaaggagaaagagcgcgagcttgattcgaagaatgaagaagattcaaatgtgtgcgtaaatgactaaaacgcccttcattatcttcacggagacgaacccatggcctggtactatgacgagaatgccctatgactcagagatggaagatgactagatg

SEQ ID NO: 4067 - DNA, 702 bp, Artificial Sequence
  P1216 (35S::G12)
cgccgtcaatatcacatctttcttcttctttatctttaaaatctctttagatcgattcttttgtggattcttgaaatctccggagaaaaccactatggagacggcgactgaagtggccacggtggtgtcaactccggcggttacggttgcggcggtggcgacgaggaagagagataagccgtataaagggataaggatgaggaagtgggggaagtgggtggcggagataagagagcctaataaaaggtcaaggatctggcttggctcttactctactcctgaagcggcggcgcgtgcttacgacacggcggtgttttatctccgaggtccttctgctcggcttaacttcccggagcttttagccggagtgacggtgacgggaggaggcggaggaggagtgaacggtggtggagatatgtcggcggcgtatataaggagaaaagcggcggaggttggagcacaagtggatgcgttagaagcggcgggggcgggagggaatcgtcatcatcatcatcatcaacatcaacgtggtaatcatgattacgtagataatcatagtgattatcgtattaatgatgatcttatggagtgtagtagtaaagaagggtttaagaggtgtaatggatcgttggaacgggttgatttaaacaaattacccgatccggaaacttcagatgacgattaggaaagcaaaaaatagaa

SEQ ID NO: 4068 - DNA, 1460 bp, Artificial Sequence
  P1218 (35S::G8)
taatcgttgttgctgtagaagacgatctctaacaactgattccttcatcatcaccttcgctagatttgtaattttcagagcttgagatgttggatcttaacctcaacgctgattctcccgagtcgactcagtacggtggtgactcatacttagatcggcagacatcagacaactccgccgggaatcgagtggaagagtccggtacatcgacgtcgtcagttatcaatgccgatggagacgaagactcttgctctactcgagctttcactctcagtttcgatattttaaaagtcggaagtagtagcggcggagacgaaagccccgccgcttcagcttccgttactaaagagttttttccggtgagtggagactgtggacatctacgagatgttgaaggatcatcaagctctagaaactggatagatctttcttttgaccgtattggtgacggagaaacgaaattggtaactccggttccgactccggctccggttccggctcaggttaaaaagagtcggagaggaccaaggtctagaagttcacagtatagaggagttactttttatagaagaactggtcgatgggagtcacatatttgggattgtgggaaacaagtttatttaggtggtttcgacactgctcatgctgcagctagagcttatgatcgagctgctattaaatttagaggtgttgatgctgatatcaactttactcttggtgattatgaggaagatatgaaacaggtacaaaacttgagtaaggaagagtttgtgcatatactgcgtagacagagcacggggttttcgcgggggagttcgaagtatcgaggggttacgttacacaaatgtggtagatgggaagctaggatggggcagtttcttggtaaaaaggcttatgacaaggctgcaatcaacactaatggtagagaagcagtcacgaacttcgagatgagttcataccaaaatgagattaactctgagagcaataactctgagattgacctcaacttgggaatctctttatcgaccggtaatgcgccaaagcaaaatgggaggctctttcacttcccttctaatacttatgaaactcagcgtggagttagcttgaggatagataacgaatacatgggaaagccggtgaatacacctcttccttatggatcctcggatcatcgcctttactggaacggagcatgcccgagttataataatcccgccgagggaagagcaacagaaaagagaagtgaagctgaagggatgatgagtaactggggatggcagagaccggggcaaacaagcgccgtgagaccgcagccaccgggaccacaaccaccaccattgttctcagttgcagcagcatcatcaggattctcacatttccggccacaacctcccaatgacaatgcaacacgtggttacttttatccacacccttaacttgtaaggggacatatgagagtt

SEQ ID NO: 4069 - DNA, 971 bp, Artificial Sequence
  P1219 (35S::G161)
tcctatattttagcttctcaaatatcactaaaaatggtgaaaaaaagcaaaggtcgtcaaaaaatagagatggtcaaaatgaaaaatgaaagtaaccttcaagttactttttcaaaaagaagatctggacttttcaaaaaggctagtgagctttgcacactttgtggtgcagaagtggccatagttgtgttctcacctggtcgaaaagtcttttcttttggtcatccaaatgttgattctgtaattgatcgattcataaacaataaccctctacctcctcaccaacacaacaacatgcaacttagagaaactcgtcgaaattcgattgttcaggatctgaataatcatcttactcaggtgttgagtcaattagaaacagagaaaaagaagtacgacgagttaaagaaaataagagaaaagacaaaagcccttgggaattggtgggaagatcccgttgaggaacttgcgttatctcaactcgaggggttcaaaggtaatcttgaaaatttgaagaaagtagttacagtcgaagcttccagattttttcaggcaaatgttccaaacttctatgtgggaagttctagtaataatgctgcttttgggattgatgatggtagtcatatcaaccctgatatggatctctttagccaaagaagaatgatggacataaatgccttcaactacaaccagaaccaaattcaccctaatcatgcattaccaccctttggaaacaatgcttatggtattaatgaagggtttgttccagaatacaatgtgaacttcagaccagagtataacccaaaccaaaaccaaatccaaaaccaaaatcaagttcaaatccaaatccaaaaccagagttttaagagagaaaacatctctgaatatgaacatcatcatggttatcctccccagtctagatctgattactattaaccctttgttgtgtgatccaacttaagtctctagacaaa

SEQ ID NO: 4070 - DNA, 751 bp, Artificial Sequence
  P1223 (35S::G154)
tatcaaacccttttagccaatcgggaaattaactaaagaagaagatatggtgaggggcaaaactcagatgaagagaatagagaatgcaacaagcagacaagtgactttctccaaaagaaggaatggtttgttgaagaaagcctttgagctctcagtgctttgtgatgctgaagtttctcttatcatcttctctcctaaaggcaaactttatgaattcgccagctccaatatgcaagataccatagatcgttatctgaggcatactaaggatcgagtcagcaccaaaccggtttctgaagaaaatatgcagcatttgaaatatgaagcagcaaacatgatgaagaaaattgaacaactcgaagcttctaaacgtaaactcttgggagaaggcataggaacatgctcaatcgaggagctgcaacagattgagcaacagcttgagaaaagtgtcaaatgtattcgagcaagaaagactcaagtgtttaaggaacaaattgagcagctcaagcaaaaggagaaagctctagctgcagaaaacgagaagctctctgaaaagtggggatctcatgaaagcgaagtttggtcaaataagaatcaagaaagtactggaagaggtgatgaagagagtagcccaagttctgaagtagagacgcaattgttcattgggttaccttgttcttcaagaaagtgatctccactcaacaaaaaaaacaaaaaaacaaactaagtaaaaacaggtttagcagtactg

SEQ ID NO: 4071 - DNA, 699 bp, Artificial Sequence
  P1224 (35S::G1758)
ccctcctcttagcttcaaccgccggaaaaactaaacaaccttcttggaaaaaaagagaaactaaaaatgaactatccttcaaaccctaaccctagctccacagatttcactgaatttttcaagttcgatgattttgacgatacttttgagaagatcatggaagaaatcggccgtgaggaccactcgtcgtcaccgactttgagttggagttcatcggaaaagttagtggctgcagaaatcacaagcccgcttcaaacaagcctagctacctcacctatgagctttgaaataggtgacaaagatgaaatcaaaaagaggaagagacacaaagaagatccgattattcacgtcttcaaaacgaaatcatcaattgatgaaaaggttgctttagatgatgggtataaatggaggaaatacggaaagaagccgataacgggtagtccatttccaaggcattatcacaagtgttcgagcccagattgcaacgtgaagaagaagatcgaaagagatacgaacaatccagattacatattgacaacatacgaaggtagacataaccacccaagcccttctgtagtttattgtgattcagacgactttgatcttaactctctcaacaattggtcctttcagacggcaaatacgtatagtttctctcattctgctccatattgatcgatcgtagttacaagtttgtgt

SEQ ID NO: 4072 - DNA, 992 bp, Artificial Sequence; identical to SEQ ID NO: 377
  P1226 (35S::G464)

SEQ ID NO: 4073 - DNA, 1544 bp, Artificial Sequence
  P1227 (35S::G618)
cagataacgaccatttcttagattctccgtcgccgcctcttctagagatgagacaccaccaatcagcgacggagaacggtggtggttgcggagagattgtggaggtacaaggaggtcacattgttcggtcaacaggaagaaaagacagacatagtaaagtatgtacagcgaaaggaccacgtgaccggcgcgtgagactctcagctccgacggcgattcaattctacgatgttcaagatagacttggttttgatcgaccaagtaaagctgttgattggcttattactaaagctaaatccgccattgatgatcttgctcagcttcctccttggaaccccgccgatactcttcgtcaacacgccgccgctgctgctaacgctaaacccagaaaaaccaaaactttaatttctccgccaccgccacaaccggaagaaacagagcatcatcgaatcggagaagaagaagataacgaatcgagttttcttccggcgtcaatggattctgattcgatagctgacactataaagtcgttttttccggtagcttcaacgcaacagagctatcatcatcagccaccgtcacgaggcaatacacagaaccaagatcttcttcgtctctcgcttcaatctttccaaaatggtccaccttttcctaatcaaacagaacctgctctgttctccggccagagcaataatcagttagcgtttgactcatcgacggcaagctgggaacagagtcatcagtcaccggaatttggaaagatacagagactagtgtcatggaacaacgtcggagcagctgaatccgccggaagtaccggaggatttgtgtttgcttctccgtcgtcgttgcatccagtttatagccaaagtcagcttttatcacagaggggtccccttcagtccattaacacacctatgattcgtgcttggtttgatcctcaccatcatcatcatcatcatcagcagtccatgaccactgacgatctccaccatcatcatccctaccatatccctcccgggattcaccaatctgctattccaggcattgcatttgcttcaagtggtgaattctccggttttcgtataccagcacggtttcaaggcgaacaagaggagcacggcggcgacaacaagccgtcctctgcttcatccgattctcgccattaaacaagttccaaaaacacataagattgtgcaacacaacaggtttcttttcatattccagggcgcttcgaatgcgtggaatagtgaaggcggttttcgttgttgtgtgtttcgaatatccaaatggcctataaatctgatcaacagtttcaggttcttcttaagtctttaaaagcctaggccttggttaatttgaattcatcttgtatcaattagagaacgttctgtaagttcaattctgttttacaatgtttagctctagctacatgagctcacatcttgtttgttgtaacttgttctacaattacttgtcgtttctttatgttcttgtgttggaaacctttaaccccacttgaagctaaagtcttttgtttgccc

SEQ ID NO: 4074 - DNA, 780 bp, Artificial Sequence
  P1228 (35S::G450)
gacatatatagacagcaagaagagatatgaaccttaaggagacggagctttgtcttggcctccccggaggcactgaaaccgttgaaagtccggccaagtcgggtgttgggaacaagagaggcttctccgagaccgttgatctcaaacttaatcttcaatctaacaaacaaggacatgtggatctcaacactaatggagctcccaaggagaagaccttccttaaagacccttctaagcctcctgctaaagcacaagtggtgggttggccaccggtgaggaactaccggaaaaatgttatggctaatcagaagagcggcgaagcagaggaggcaatgagtagtggtggaggaaccgtcgcctttgtgaaggtttccatggatggagctccttatcttcggaaggttgacctcaagatgtacaccagctacaaggatctctctgatgccttggccaaaatgttcagctcctttaccatggggagttatggagcacaagggatgatagatttcatgaacgagagtaaagtgatggatctgttgaacagttctgagtatgttccaagctacgaggacaaagatggtgactggatgctcgttggtgatgtcccctggccgatgtttgtcgagtcatgcaaacgtttgcgcataatgaaaggatccgaagcaattggacttgctccaagagcaatggagaagttcaagaacagatcatgaacaaaaaaaaaagaggacaatatgcattgatttttttttttttggtattgttatgatcatgtgtttt

SEQ ID NO: 4075 - DNA, 1501 bp, Artificial Sequence; identical to SEQ ID NO: 163
  P1232 (35S::G196)

SEQ ID NO: 4076 - DNA, 2834 bp, Artificial Sequence
  P1233 (35S::G916)
caatctaagatatctatcaagatcttaagatatctacatttatagagatgtttcgttttccggtaagtcttggaggaggtccacgtgagaatctgaagccatcagatgagcagcatcaacgtgcggtggtgaatgaggttgactttttccgatcagcggagaagagagatagggtttcacgtgaagaacaaaacattatcgccgatgagactcatagggttcatgtcaaaagggagaattcacgtgttgatgatcatgacgatcgttctactgatcacatcaatgtaagcagatggttaactcatcgcttttgttttctttgttttttttttattatctagaagttcaagctaaaaattctacatttccgatatgcgaaacccacattagattaaattcattttttttggagaagagatcgttcccaacgtgcatcaaacccagtacatccacatgagaaatttaccactggaccaacagctcgttggttacttcattgttttccttttcgtcaatatcatttaattacttcggattttagttagtaatattataaaacaataatttcgttatatagatgaaaactttgttcattgaaatgtgtatgattattgtaaatagattggacttaatcttctcactgcgaatacgggaagcgacgagtcaatggtggatgatggattgtctgtggatatggaagagaaacgtacaaagtgtgaggtacacttattattcaattagtatagatcatttttgagtaataataacaaaaaaaagacacaactagtgtatttatcgcacgaaccaaagaaaaagagattgtcaaaatccaacaaataaaaaatgattgtcaaaaaccatcaagagtgtatatttttgtgcgtctgttacgtacgtaaacaattttccgcttttctgattcgtcagaattttaaataatatctgatgacaaaaaaaataaaaatatttttatgctaaattttgattatttttactgttcatcttcattttgtcacataattaagcataaaaagatattttctgattttctctacaaattttttatttcttaagaattagtaaaaatataccgttttcgtagacttagacattctatttttatatgttgttcgtatcggtccgtaagatccggacatgttagagagatttactctttcttactagaatgatttaatgtctgatacatgatttttttgttttttaataaaatgaagaatgcacaacttcgcgaagagctaaagaaggcgagtgaagataatcaaagactaaagcaaatgctaagtcaaacaaccaacaacttcaattccttgcagatgcaacttgttgctgtcatgaggcaacaagaagatcatcatcacctagtaattaattaacactctaatacgtcttaatcatttatttcatataattagttaaagattttatacccttgtttttcatcaggctacgaccgagaacaatgacaatgtaaagaaccgacatgaagtgcctgaaatggttccaagacagttcatcgatttgggaccgcattctgacgaagtgtcgtccgaggagaggacgacggttcggtcgggatctcctccctcgcttctagagaaatctagctcacgtcaaaacggaaagagagtgcttgtaagagaagaaagcccggaaaccgaatccaacggctggagaaaccctaacaaagttcctaaacaccatgcatcatccagcatttgcggtggcaatggcagtgaaaatgcaagtagcaaggtcattgagcaagcggccgccgaagccaccatgcgtaaagcccgtgtctcggttcgtgctcgatccgaagctcccatggtaatactaattaatcttcctctctagaatttctatgaagattgatctctacaaatgtttttggaggttcattaacatcaatgacattgttttacagttaagcgatggatgtcaatggagaaaatacggacaaaaaatggcgaaaggaaacccgtgccctcgagcttattaccgttgcacaatggctgttggatgtcctgttcgcaagcaagtacgttacctaaacaattcacacatctaaaattatgtttgaaggtgatcaatcaagtgtaataatttagagaaaaaaaaaataatgtattgtaacaaactcatgatgacctaacaggtgcaacgttgcgcggaagatagaaccattctcataacaacctacgaaggaaaccataaccatccattacctcctgcggctatgaacatggcttcaactacaacagcagccgcaagcatgcttctctcaggctccaccatgtcgaaccaagacggtttaatgaacccaacaaatctcttggctcgaaccatattaccgtgttcctcaagcatggctactatctcagcctctgcaccattcccaaccattacattagacctcacagagtcacccaacgggaacaatccaaccaataacccgctgatgcaattctctcaacggtctggtttggtggagttgaaccaatcggttttgcctcatatgatgggtcaggctttgtactacaaccaacagtctaagttttcgggtttacatatgccgtctcagccgctaaacgctggtgagagtgttagcgccgctactgccgcaatcgcctccaatcccaactttgccgcggctctagctgcagccataacttcgattatcaacggttcgaacaatcagcagaatgggaacaacaataacagtaatgttacaacgagcaacgttgacaataggcaataacatttttttataagttttagttagggactttttatcggtcgattttgttttg

SEQ ID NO: 4077 - DNA, 2021 bp, Artificial Sequence
  P1235 (35S::G175)
cttgagcccaagttaaagctgaaacttgggtttgcaatggctggtattgataataaagctgctgtaatgggagaatggttcgactgtagtactactaaccacaggaagagatcgaaagcggaacttggtagagagttttctttaaattacatcaagaatgaggattctttgcaaaccacctttcaagaaagttcacgaggagctcttcgtgaaaggattgctgcgagatccgggtttaatgcaccgtggttaaacactgaggatattcttcagtcgaaatctttaaccatctcttctcctggtcttagtcctgcaactctgttagagtctcctgttttcctctcaaaccctttggtaactttttcttttcaacatttcattatggtctctctctttcgtgaatcagtgctctaaaatctcttatcatttgtaagctcagctatctccaacaaccgggaagctctcatcagtaccttctgataaggctaaagctgagttatttgacgacattaccacatccttagccttccaaaccatttcaggaagtggccttgatcctactaacatcgctttagaacccgatgattcccaagactatgaagaaagacagctcggcggtttaggagactcgatggcttgttgtgcacctgcagatgatggatacaactggagaaaatatggacaaaagctagttaaaggaagtgagtatccgcggagctattacaagtgcacgcacccgaattgtgaggccaagaagaaggttgaacggtctcgggaaggtcatattatagagatcatatacacaggagatcatatacacagcaaacctccacctaaccgccggtcagggattggatcatccggtactggccaagacatgcaaatagatgcaaccgaatacgaaggttttgctggaaccaatgagaacatagaatggacatcacctgtatctgcagagctcgaatacggaagccattcaggatcaatgcaggttcaaaacgggactcatcagttcgggtatggtgatgcagcagctgatgccttatatagagatgaaaacgaagatgatcgcacgtcccacatgagtgtttccctgacttacgatggagaggtagaagagtccgaatcaaagagaaggtataaaaagttgctctagtaaccattataatacttagaaagacaagacgttctgacttctgagctctgatggcattcccgtatcaggaaactagaagcttatgcaacagaaacgagtggatcaaccagagccagccgtgagccaagagttgtggtgcagaccacaagtgacattgacatcctcgatgatggttatcgctggcgcaagtatgggcaaaaagtcgttaaaggaaacccgaatccaaggttcttgtatccaaatgctctgttctgctgctatccctttgttgaatttaataaaatcagttttctatgttttcaggagctactataaatgcacagctaatggatgtaccgtaacgaagcatgtagagagagcctctgatgacttcaagagcgtactaacaacttatataggcaagcacacccacgttgtaccagcagcacgcaacagcagccacgtcggtgcaggcagttcagggactctccaaggcagtttagcgactcagacccacaaccacaatgtgcactatccaatgccacacagtagatctgagggactggccacagccaactcatctctatttgacttccagtcacacctgaggcatcctacaggtttctccgtttacataggccaatctgagctttctgatctttcaatgcctggtctaactattgggcaagagaagcttaccagcctgcaggcgcctgacattggggatccaactggcctaatgttgcagttagcagcacagccgaaggtggaaccagtgtcaccacaacagggacttgatttgtcagcgagctcattgatatgcagagagatgttgagtagattacgacagatatgaaacaaatctctttgttcactgattgctcaa

SEQ ID NO: 4078 - DNA, 674 bp, Artificial Sequence
  P1238 (35S::G462)
atttcataattgtatcaaattgtgagaggaaaaaaagaagttcaagaaatggagaaggaaggactcgggcttgagataacggagctgagattggggcttccggggagagatgtggcagagaagatgatgaagaagagagctttcacggagatgaatatgacgtcgtcgggtagtaatagtgatcaatgtgaaagcggcgtcgtttcatctggtggtgacgctgagaaggttaatgattcgccggcggcgaaaagccaggtggtggggtggccaccggtttgttcttaccggaagaaaaacagctgtaaggaagcttcgaccacgaaagtggggttagggtatgtgaaagtgagcatggatggtgtgccttatttgaggaagatggatcttggttcgagccaaggctatgatgatctagcctttgctcttgataagctcttcggtttccgtggcatcggtgtggccttgaaagatggtgacaactgcgaatacgttaccatatacgaagacaaagatggagactggatgctcgccggtgatgtaccttgggggatgtttctagagtcatgcaagaggttgagaataatgaaaagatcggatgctaccgggtttgggctgcagcctagaggagtagacgagtgatgatgacttgaacaagaagcaaggagctggtt

SEQ ID NO: 4079 - DNA, 897 bp, Artificial Sequence
  P1240 (35S::G1499)
tccttaattgcatcaccaacctaacccctcatcatatgatcacctttctttttttcctttaatatatatatatgctcacacacacacatatatatatacatataagcatcgcctcaagcattaaaatttttacgaaccaaacaaacaaaaattatgaataattataatatgaacccatctctcttccaaaattacacttggaacaacatcatcaacagcagcaacaacaacaacaagaatgatgatcatcatcatcaacataataatgatccaatcggtatggccatggaccagtacacacagctccatatcttcaatcctttctcttcttctcatttccctcctctctcttcttccctcacaaccaccactcttctctccggagatcaagaagacgacgaagacgaagaagaacctctagaggaactcggtgctatgaaggaaatgatgtacaagatcgcagccatgcaatcggttgacatcgacccagcaaccgtcaagaaacccaaacgccgtaacgtgaggatctccgacgaccctcagagtgtggcggctagacatcgccgtgagagaatcagtgagaggatcagaattcttcagagactcgtgccaggtggcactaaaatggatacggcttcaatgctcgatgaagctatacgctatgtcaagttcttgaaacggcagatccggctactcaataataataccggatatactcctccgccgccgcaagatcaagcttctcaggcggtgacgacgtcatgggtttcaccgccaccaccgccaagtttcggccgtgggggaagaggagtaggagaattaatctagacaagatgacatttccattagtagtaactaaattatgctataatgtgtgagtaatggtgcaattatgga

SEQ ID NO: 4080 - DNA, 985 bp, Artificial Sequence
  P1245 (35S::G227)
cgtcgacgatccggcgatgtcaaacccgacccgtaagaatatggagaggattaaaggtccatggagtccagaagaagatgatctgttgcagaggcttgttcagaaacatggtccgaggaactggtctttgattagcaaatcaatccctggacgttccggcaaatcttgtcgtctccggtggtgtaaccagctatctccggaggtagagcaccgtgctttttcgcaggaagaagacgagacgattattcgagctcacgctcggtttggtaacaagtgggctacgatctctcgtcttctcaatggacgaaccgataacgctatcaagaatcattggaactcgacgctgaagcgaaaatgcagcgtcgaagggcaaagttgtgattttggtggtaatggagggtatgatggtaatttaggagaagagcaaccgttgaaacgtacggcgagtggtggtggtggtgtctcgactggcttgtatatgagtcccggaagtccatcgggatctgacgtcagcgagcaatctagtggtggtgcacacgtgtttaaaccaacggttagatctgaggttacagcgtcatcgtctggtgaagatcctccaacttatcttagtttgtctcttccttggactgacgagacggttcgagtcaacgagccggttcaacttaaccagaatacggttatggacggtggttatacggcggagctgtttccggttagaaaggaagagcaagtggaagtagaagaagaagaagcgaaggggatatctggtggattcggtggtgagttcatgacggtggttcaggagatgataaggacggaggtgaggagttacatggcggatttacagcgaggaaacgtcggtggtagtagttctggcggcggaggtggcggttcgtgtatgccacaaagtgtaaacagccgtcgtgttgggtttagagagtttatagtgaaccaaatcggaattgggaagatggagtaggcggcc

SEQ ID NO: 4081 - DNA, 812 bp, Artificial Sequence
  P1246 (35S::G247)
tcgggatcaagaaaagtgaagaagaatgagaatgacaagagatggaaaagaacatgaatacaagaaaggtttatggacagtggaagaagacaagatcctcatggattatgtccgaactcatggccagggccactggaaccgcatcgccaagaaaactgggctcaagagatgtgggaaaagctgtaggttgagatggatgaactacttaagccctaatgttaacagaggcaattttactgaccaagaagaagatctcatcatcagactccacaagctcctcggcaacagatggtcgttgatagcgaaaagagttccgggaagaacagacaaccaagtaaagaattactggaacacacatctcagcaagaaacttggtctcggagatcattcaactgccgtcaaagccgcatgcggtgtagagtctccaccgtctatggcccttataaccacaacgtcctcctctcatcaagagatctccggtggaaaaaattcaactctaaggttcgacactttagttgacgaatccaaactcaaaccaaaatccaaactagtccacgcaacaccaactgacgtagaagttgcagctacggttccaaatctgttcgataccttttgggttcttgaagacgacttcgagcttagttcactcactatgatggattttactaatgggtattgcctttgaatatctttgatgattagcttctaaaaagtaattaattatcgaataatagattataatgaccaataataataatatgaatacaattaaatttttttccgaatatttgcttgtagcttttgtactttct

SEQ ID NO: 4082 - DNA, 1185 bp, Artificial Sequence
  P1247 (35S::G971)
ccctcttttagaactctctctctctctcgtttttgacacttatcctctctcttttttctctctccctctctctctggccggaaaaaagaacaacgtcgtttatagctaaagattcgatcatgttggatcttaacctaaagatcttttcttcttataacgaagatcaagatcggaaagtaccattaatgatctcaaccaccggtgaagaagaatctaactcatcttcctcctccacaacagactctgcagcgagagatgctttcatcgcttttggaattctcaaacgcgacgatgaccttgttcctcctcctcctcctcctcctcataaagaaacaggagatctctttccggtggtggctgatgctcgtcggaatatagaattctccgtggaagacagtcactggttgaatctttcttctttacaaagaaatacacagaaaatggtgaagaagagcagaagaggaccaaggtctcgtagctcccaatatcgtggcgtcactttttaccgtcgcaccggtcgttgggaatctcatatttgggattgtggaaagcaagtttatttgggcgggtttgatactgcttacgcagcagcaagggcttacgaccgagctgctatcaaattccgtggtctcgatgcagacatcaatttcgtcgtggatgattataggcatgacatcgataagatgaagaatttaaataaggtggagttcgtgcaaacacttaggcgagagagtgcgagtttcggaagaggaagttccaaatacaaaggcttggctcttcaaaaatgcacccaattcaaaactcatgatcagattcatctcttccaaaacaggggatgggatgcagcagcaataaaatacaatgagttgggaaagggagaaggagccatgaagtttggtgcccatatcaaaggaaatggtcacaatgatcttgaactaagtctcggaatttcatcatcatcggaaagtataaagttgacaacaggcgattactataagggtatcaatcggtccacgatgggtttatacggtaagcaatcatcgatatttttacccatggcaaccatgaaacctctgaagacagttgcagcatcatcaggattcccttttatcagcatgacaagttcctcttcctccatgtccaattgttttgatccataggatcgttctacactctcttaactaa

SEQ ID NO: 4083 - DNA, 638 bp, Artificial Sequence
  P1249 (35S::G557)
aagacaacaaatctttccctctctctctcgcctgatcgatcttcaaagagtaagaaaaatgcaggaacaagcgactagctctttagctgcaagctctttaccatcaagcagcgagaggtcatcaagctctgctccacatttggagatcaaagaaggaattgaaagcgatgaggagatacggcgagtgccggagtttggaggagaagctgtcggaaaagaaacttccggtagagaatctggatcggcgaccggtcaggagcggacacaggcgactgtcggagaaagtcaaaggaagcgagggaggacaccggcggagaaagagaacaagcggctgaagaggttgttgaggaacagagtttcagctcagcaagcaagagagaggaaaaaggcttacttgagcgagttggaaaacagagtgaaagacttggagaacaaaaactctgaacttgaagagcgactctctactcttcagaacgagaaccagatgcttagacatattctgaagaacacaacaggaaacaagagaggaggtggtggtggttctaatgctgatgcaagcctttgatctccttcttcttcttgtgttatatttttgtggataaaatttacagagaattgtatcaataattatcatgtta

SEQ ID NO: 4084 - DNA, 1595 bp, Artificial Sequence
  P1254 (35S::G1506)
tgtataagctcaattagtagcaaacaagaaaaaacaatcttaaactcaatttcacaaaatctctgattcttgtgaaaatttgtatattgcaaaactttggaaaaaaaagagaaaaaagatggggaagcaaggtccttgctatcactgtggagttacaagtacacctctatggagaaacgggccaccagagaagccggtgttgtgcaatgcgtgtggttcgaggtggagaactaaaggatcattagtaaactacacacctcttcatgctcgtgctgaaggtgatgagactgagattgaggatcatagaactcaaacggtgatgattaagggaatgtctttgaacaaaaagattcccaagaggaaaccatatcaagaaaacttcacagtgaaaagagctaacttggaattccataccggtttcaagaggaaggctctggatgaagaagctagcaatagatcgagttcaggatcggttgtatcaaactccgagagctgtgcacaatctaatgcgtgggactcgacttttccttgtaagagaaggacatgtgtgggacgtccaaaggcagcttcttctgttgaaaagctcacaaaggatctttatactattctacaagaacagcaatcttcttgtctctctggtacttcagaggaagatttgctttttgagaatgaaacaccaatgctgttaggacatggtagtgttcttatgagagatcctcactcaggtgctcgagaagaggaatctgaagctagctcactcttagttgagagcagcaagtcttcatcagttcattctgttaaatttggtggaaaagcaatgaagcaggagcaagtgaagaggagcaaatctcaagtcttaggaagacatagttcactactctgtagcatagatttgaaggatgttttcaactttgatgagttcatagaaaatttcacagaggaagaacagcaaaaactgatgaaattacttcctcaagttgactctgttgatcgtcctgatagcctcagaagcatgtttgagagttctcaattcaaagagaacttatccttgtttcagcaacttgtggcagatggtgtttttgagacaaattcgtcttatgcaaaacttgaagacattaagacacttgcaaagcttgctttatcagatcctaacaaatcccatttgttggaaagctattacatgctcaagagaagagagattgaagactgtgttactacaacatcaagggtctcaagcttgagtccatcgaataataatagtcttgtaaccattgaaagaccttgtgaaagcttaaaccaaaacttctcagagacaagaggtgtgatgagaagcccgaaagaagtgatgaagattagatcaaagcacaccgaagagaatttagagaatagtgtatcttcctttaaacctgtgagctgtggtggacctctggtgtttagctatgaagataatgatatttctgatcaggatcttcttcttgatgtgccgtcgaacggctcattccctcaagcagagcttctaaacatgatatgaaagaagataaagtttctcaaactcattggttaaactcattgtgtttctcagaacaaagacagac

SEQ ID NO: 4085 - DNA, 958 bp, Artificial Sequence; identical to SEQ ID NO: 3847
  P1257 (35S::G1048)

SEQ ID NO: 4086 - DNA, 1183 bp, Artificial Sequence
  P1258 (35S::G568)
caaccaaagactaaagctgtgttgttggttcacttctgttctcttttccaatgttgtcatcagctaagcatcagagaaaccatagactctctgctacaaacaagaaccagactctcaccaaagtttcttccatttcatcctcatcaccatcgtcttcttcttcatcatcatcaacctcatcatcatctcctttaccttctcaagactctcaagcccagaagagatctcttgtcaccatggaagaagtttggaatgacatcaaccttgcttccatccaccacctaaaccgacacagccctcatccacaacacaaccacgagccaaggttcaggggccaaaaccaccacaaccaaaaccctaactcaatcttccaagattttctcaaaggatctttgaaccaggaaccagcacccacaagccagaccacgggttctgcgcctaatggcgattccaccacggtcactgttctttacagctctccttttccacctcctgcaactgttctgagcttgaattccggcgctggcttcgagtttctcgataaccaagatcctcttgttacctcaaactctaatcttcatacccaccatcacctctcaaacgctcatgccttcaacacctctttcgaggctctggttccatccagttcttttggtaagaaaagaggccaagattccaatgaaggttcagggaatagaagacataagcgtatgatcaagaacagagaatctgcagctcgttcccgcgctaggaaacaggcttatacaaacgagttagaacttgaagttgctcacttgcaggcagaaaatgcaagactcaagagacaacaagatcaaaaaatggctgcagcaattcagcaacccaaaaagaacacacttcaacggtcttccacagctccattttgagaaatctacaagtccttgtttctcttttggggattgagattgtctcatgaagaagtgaaaaaatggcaaaagtttgtacccttttttattagctataagtataactaagcctaaaattgtagaactaagatattgtaggggaaaaaagaagatgtaaaacaaaagacccggaaagagaaaaggatctttcaatttcctaaggcacaggaacacctgtcctgggtcctctcttaatgttctgtcgttttcctatgcaaacccttttttcacttctgtac

SEQ ID NO: 4087 - DNA, 1559 bp, Artificial Sequence
  P1263 (35S::G1145)
tggctatttatcaaattgagcattagggtttctgatttgtgggttcagaattgtttttatctatctgtcttgttgttttttgtccgctacaaaagcctatggattctcagaggggtattgttgaacaagctaaatctcagtccttgaataggcaaagctctctttacagcttaacacttgatgaggttcaaaatcacttggggagttctggtaaagctctgggaagcatgaaccttgatgagcttttgaagagtgtctgttctgttgaagctaatcagccatcgtctatggctgtcaatggtggagcagctgctcaggagggtctttctcgccaggggagtttgactttgcctcgggatctcagcaaaaagactgttgatgaggtttggaaagacattcagcagaataagaatggaggtagtgctcatgagaggagggataagcagcctacacttggggaaatgacgcttgaagacctgttgttgaaagcaggagtggtcactgagactatccctggttcgaaccatgatggtcctgttggtggtggtagtgctggttcaggtgctggtttagggcaaaacattactcaagttggcccatggattcaatatcatcagctcccatcaatgccacagcctcaagcatttatgccctatccggtttcagatatgcaagcaatggtgtctcagtcttctttgatgggtggtttgtcagatacacaaactcctggaaggaagagggtagcttcaggagaagttgtagagaagactgtagagaggaggcagaagagaatgataaagaacagagagtctgctgctcgttcccgagctaggaaacaggtgagaaacaactaatttgttgttgttattcttcttgtcaagtcatgctcgtttttgttttaacattggatattgatgagcaggcttacactcatgagctagagatcaaagtttcacggttagaagaagaaaacgaaagactcaggaagcaaaaggtaatgcattgtaggtttttctccctttttacaacacatgcattgattaaatttgtgattactagaaacttgtaagagctgatcgttgattagttctggattcatattaaagggaatgatagatgatagaagatgtagtgaagtatagaatagggcacacgcatagtagacaatatatgatagaaaatataaccacgaacaagagacaggaggaataggtttagaccaaacgtcttaggagacatagttttcctttacccggaacaagttggtcttgctggtttctagtcttcatggactttctgttcttcaattttgtctgcgtttatgtgtggccaaagctaatccttacattactttgcaggaggtggaaaaaatcctcccaagtgtaccaccgcctgatcccaagcggcagctccgacggacaagctcggctcctttctgatctctaaactctttttgtctttttctttttttctcttctgtgtcggttcacttataaaaaagagaggaaaacagctttgtttctttgtacattccgtagactttcttgacttggagcaat

SEQ ID NO: 4088 - DNA, 1475 bp, Artificial Sequence
  P1264 (35S::G1340)
gctacctcttggtaaatccaaagagacacatatatggctgacgctgatccatcgagtggtgaacagatagttatgagagagtgcagaaaagggaattggacagtgagtgagactttggttctcatagaagccaagaagatggacgaccagaggcgtgtacggcgatcggaaaaacaacctgaaggcagaaacaaaccagcagagctccggtggaaatggatagaggagtattgctggagaagaggatgttaccgcaaccagaatcagtgcaacgataagtgggacaatctcatgagggattacaagaagatcagagagtacgagagatcaagggtagaatcgtcttttaacaccgtcacttcttcctcttactggaagatggacaagactgagaggaaagagaagaacttgccgagtaacatgttgcctcagatatacgacgtgttgtctgagcttgttgacagaaaaactcttccttcctcctcctccgccgccgccgccgtaggaaacggtaacggtggccagatcctaagagtttgccaacaaagtttaggatttgtagctccgatgatggctcagccgatgcatcaaatcccgactactatagtgttatctcttccgccaccaccgccacagtctcttagcttatcacttccttcgccgcctcaacctccaccatcgtcttcatttcacgctgagcctataccgcccacagtaggtaccttccgttttatctctcttcttattcttaaagcctaattaaatgaccactaaagttagattttatattaaatctataaagtggatttcgacattccaacaaacaccctcaagtcaacttgttattaattataatcaatctaattataaatttaaaatcaaaacttatacaattactatgaaggaaaaaatgtaaccctaaatttgcttgtgtgtgcatagacaattctttacaataaagttcttgagtacattaagattaaagtagtaattaaacccgcattttggtcgatgaagagactgataagagtgtgtacattcaggtacatcatcgacaaagcgaaggagaacaacgccgggagaaaccaccgctggaggagagagggaggtagaggaggatgcggttggggtggcgttgtctagatgcacgtctgtgatcacacaagtgataagagagaatgaggagggacaagagaggaggcataaggaagtggtgaggctacaagagaggagactaaagattgaggaatcaaaaactgaaataaatagacaaggtatgaatggtttggtagacgccattaatcaactcgcaagctctattcttgctttggcttcttcttcttgccataataatcgcaatcatcaaggaggtccaccatgatacctatattgaatagatgtgttactttaatacttaagttgatgattagttgcttagttaatatgtaggtatgtgtatataaagtgacgttatg

SEQ ID NO: 4089 - DNA, 624 bp, Artificial Sequence
  P1266 (35S::G977)
caccaaactcacctgaaaccctatttccatttaccattcacactaatggcacgaccacaacaacgctttcgaggcgttagacagaggcattggggctcttgggtctccgaaattcgtcaccctctcttgaaaacaagaatctggctagggacgtttgagacagcggaggatgcagcaagggcctacgacgaggcggctaggctaatgtgtggcccgagagctcgtactaatttcccatacaaccctaatgccattcctacttcctcttccaagcttctatcagcaactcttaccgctaaactccacaaatgctacatggcttctcttcaaatgaccaagcaaacgcaaacacaaacgcaaacgcagaccgcaagatcacaatccgcggacagtgacggtgtgacggctaacgaaagtcatttgaacagaggagtaacggagacgacagagatcaagtgggaagatggaaatgcgaatatgcaacagaattttaggccattggaggaagatcatatcgagcaaatgattgaggagctgcttcactacggttccattgagctttgctctgttttaccaactcagacgctgtgagaaatggccttgtcgttttagcgtattcttttc

SEQ ID NO: 4090 - DNA, 1099 bp, Artificial Sequence
  P1268 (35S::G993)
caaatatggaatacagctgtgtagacgacagtagtacaacgtcagaatctctctccatctctactactccaaagccgacaacgacgacggagaagaaactctcttctccgccggcgacgtcgatgcgtctctacagaatgggaagcggcggaagcagcgtcgttttggattcagagaacggcgtcgagaccgagtcacgtaagcttccttcgtcgaaatataaaggcgttgtgcctcagcctaacggaagatggggagctcagatttacgagaagcatcagcgagtttggctcggtactttcaacgaggaagaagaagctgcgtcttcttacgacatcgccgtgaggagattccgcggccgcgacgccgtcactaacttcaaatctcaagttgatggaaacgacgccgaatcggcttttcttgacgctcattctaaagctgagatcgtggatatgttgaggaaacacacttacgccgatgagtttgagcagagtagacggaagtttgttaacggcgacggaaaacgctctgggttggagacggcgacgtacggaaacgacgctgttttgagagcgcgtgaggttttgttcgagaagactgttacgccgagcgacgtcgggaagctgaaccgtttagtgataccgaaacaacacgcggagaagcattttccgttaccggcgatgacgacggcgatggggatgaatccgtctccgacgaaaggcgttttgattaacttggaagatagaacagggaaagtgtggcggttccgttacagttactggaacagcagtcaaagttacgtgttgaccaagggctggagccggttcgttaaagagaagaatcttcgagccggtgatgtggtttgtttcgagagatcaaccggaccagaccggcaattgtatatccactggaaagtccggtctagtccggttcagactgtggttaggctattcggagtcaacattttcaatgtgagtaacgagaaaccaaacgacgtcgcagtagagtgtgttggcaagaagagatctcgggaagatgatttgttttcgttagggtgttccaagaagcaggcgattatcaacatcttgtgacaaattct

SEQ ID NO: 4091 - DNA, 1080 bp, Artificial Sequence
  P1269 (35S::G860)
acaaaaccacatctctgaactgaaccaatttctcttctcccccttccggttatcggattaccagatctcgtttcccgcgatctagtttattctttgaaaaagtgatagaagcagaaatgggaaggggcaagatcgcgattaagaggatcaataactctacgagccgtcaggttacgttctcgaagcgaaggaatggattgttgaagaaagctaaggagcttgcgattctctgcgatgctgaggttggtgtcatcatcttctccagcaccggtaggctctacgatttctccagctccagcatgaaatcggtcatagagagatacagcgatgccaaaggagaaaccagttcagaaaatgatcccgcttcagaaattcagttctggcaaaaggaggctgcgattctaaagcgtcagctacataacttgcaagaaaaccaccggcaaatgatgggggaggagctctctggactaagtgtagaagctttacagaatttggaaaatcagcttgaattgagccttcgtggcgttcgaatgaaaaaggatcaaatgttaatcgaagaaatacaagtacttaaccgagaggggaatctcgttcaccaagagaatttagacctccacaagaaagtaaacctaatgcaccaacagaacatggaactacatgaaaaggtttcagaggtcgagggtgtgaaaatcgcaaacaagaattctcttctcacaaatggtctagacatgagagatacctcgaacgaacatgtccatcttcagctcagccaaccgcagcatgatcatgagacgcattcaaaagctatccaactcaactatttttccttcattgcataatataattcggtgtgccaacacacttatgttgacctcgtcggaatcatatcacaattcactgtgtcagcttgcctctgcataagcgaaaataaaaacataaacatgatcagtttgcattccatatctatcaaacaccagctttgtaacttttaaaactttttctccgtgcaaagacctttggtttggcgcttaagcatgtagtttgatgatcaaaggaaatgggtgttttagcataaagttg

SEQ ID NO: 4092 - DNA, 1149 bp, Artificial Sequence
  P1270 (35S::G1421)
ctccttctttagtgtcctccttcaccaaactcttgattccataagcatatattaaaaaagctctctgctttcttcaactttcccgggaaaatcttcttgttacaaagcatcaatctcttgttttaccaattttctctctttattccttttttgccctttacttttcctaactttggtctttatatataaacacacgacacaaagaagaacacacataagttaaaactattacaacagttttaaagagagagatttaaaaaatggagacagagaagaaagtttctctcccaagaatcttacgaatctctgttactgatccttacgcaacagattcgtcaagcgacgaagaagaagaagttgattttgatgcattatctacaaaacgacgtcgtgttaagaagtacgtgaaggaagtggtgcttgattcggtggtttctgataaagagaagccgatgaagaagaagagaaagaagcgcgttgttactgttccagtggttgttacgacggcgacgaggaagtttcgtggagtgaggcaaagaccgtggggaaaatgggcggcggagattagagatccgagtagacgtgttagggtttggttaggtacttttgacacggcggaggaagctgccattgtttacgataacgcagctattcagctacgtggtcctaacgcagagcttaacttccctcctcctccggtgacggagaatgttgaagaagcttcgacggaggtgaaaggagtttcggattttatcattggcggtggagaatgtcttcgttcgccggtttctgttctcgaatctccgttctccggcgagtctactgcggttaaagaggagtttgtcggtgtatcgacggcggagattgtggttaaaaaggagccgtcttttaacggttcagatttctcggcgccgttgttctcggacgacgacgtttttggtttctcgacgtcgatgagtgaaagtttcggcggcgatttatttggagataatctttttgcggatatgagttttggatccgggtttggattcgggtctgggtctggattctccagctggcacgttgaggaccattttcaagatattggggatttattcgggtcggatcctgtcttaactgtttaagaaataactggccgtttaacggcgt

SEQ ID NO: 4093 - DNA, 960 bp, Artificial Sequence
  P1271 (35S::G1043)
aaataagataccactcaccaaaaacttcctcaaaactaacaaatggatactaataaagcaaaaaagcttaaagttatgaaccaactcgttgaaggccatgacttaacaactcagcttcagcaactcctctctcaacccgggtccggtctagaggatctagtggctaaaatcttagtgtgtttcaataacaccatctccgttcttgataccttcgaacccatctcctcctcctcatccctcgccgccgttgagggatctcaaaatgcttcatgtgataacgacggcaagtttgaagattccggcgatagtcggaaaagattgggacccgttaagggtaaaagaggatgctacaaaagaaaaaagagatcggagacgtgtactatagagtcgactatacttgaggacgcattttcttggaggaaatatggacaaaaggagattcttaatgccaaattcccaagaagttactttagatgcacacacaagtatacccaagggtgcaaggcaacaaagcaagtccagaaggttgagctcgaacccaagatgttcagtatcacatacataggaaaccacacgtgtaacaccaacgcagaaactcccaagagcaagacttgtgaccatcatgatgagatcttcatggattccgaagatcacaagagtcctagtttatctacctcaatgaaggaagaagacaatcctcatcgtcatcatggttcgtccacggagaatgacttgtcattggtgtggccagaaatggttttcgaagaagattatcatcatcaggccagttacgtcaatgggaaaacgagtacatctatcgatgttttgggttctcaggatctcatggtgtttggaggtggcggcgatttcgagtttagcgaaaatgagcacttctctatcttcagttcatgttcgaatctatcttgagtttaccactactataggactaagaccatgagt

SEQ ID NO: 4094 - DNA, 897 bp, Artificial Sequence
  P1277 (35S::G255)
agcatcatcatcatcagaagaagagagtcatgggaagatctccttgctgcgagaaagaacacatgaacaaaggtgcttggactaaagaagaagatgagagactagtctcttacatcaagtctcacggtgaaggttgttggcgatctcttcctagagccgctggtctccttcgctgcggtaaaagctgccgtcttcggtggattaactatctccgacctgatctcaaaagaggaaactttacacatgatgaagatgaacttatcatcaagcttcatagcctcctaggcaacaagtggtctttgattgcggcgagattacctggaagaacagataacgagatcaagaactactggaacacacatataaagaggaagcttttgagcaaagggattgatccagccactcatagagggatcaacgaggcaaaaatttctgatttgaagaaaacaaaggaccaaattgtaaaagatgtttcttttgtgacaaagtttgaggaaacagacaagtctggggaccagaagcaaaataagtatattcgaaatgggttagtttgcaaagaagagagagttgttgttgaagaaaaaataggcccagatttgaatcttgagcttaggatcagtccaccatggcaaaaccagagagaaatatctacttgcactgcgtcccgtttttacatggaaaacgacatggagtgtagtagtgaaactgtgaaatgtcaaacagagaatagtagcagcattagctattcttctattgatattagtagtagtaacgttggttatgacttcttgggtttgaagacaagaattttggattttcgaagcttggaaatgaaataaatgaatagtattagattcttaatttgtaggtctgataatgaatgttagattcgcggcc

SEQ ID NO: 4095 - DNA, 583 bp, Artificial Sequence
  P1278 (35S::G2010)
ctccaacaaaccatctttataagactccaaaatggagggtaagagatcacaaggacaaggttacatgaaaaagaagtcttaccttgtggaagaagatatggagactgatacggatgaagaagaggaagtaggtagggatagagttagagggtctagaggtagcatcaatcgtggtggctcgttgcggctttgccaagtagatagatgcacagctgatatgaaagaggcaaaactgtatcaccggagacacaaagtgtgtgaagttcatgcaaaggcatcttctgtctttctctcaggacttaaccaacgcttttgtcaacaatgcagtaggtttcatgacctccaagagtttgatgaagctaagagaagttgcaggaggcgcttagctggacacaatgagcgaagaaggaagagctctggtgagagtacttatggagaaggatcaggtcggagaggaatcaatggtcaggtggtgatgcagaatcaagaaagatcaagggtagagatgacacttcctatgccaaactcatcattcaagcgaccacagattagatagagaagctgttctgctctctctcttctg

SEQ ID NO: 4096 - DNA, 1575 bp, Artificial Sequence
  P1279 (35S::G1786)
ccctgacgttctaccaatcacccgggacgcagagggggcaatgatcgtgtacggtgggggagcatccgaggacggtgaaggtggaggggtggttctgaagaaagggccatggacggtggccgaggacgagacactggcggcttacgtacgggaatacggtgaagggaactggaattctgttcagaagaagacatggctggctaggtgtggcaagagctgccgcctccgctgggctaaccacttacgacctaatctcaggaaaggctccttcacccccgaggaagaacgtctcatcatacaactccactctcagctaggcaacaaatgggctcgcatggctgctcaggttaatgatcaatcctacacttatataaatctgataaaactgcattgcttctctctgttttctaggcttcttagttcttcatgctctcttcttcttcttccagctctcaaaaaactttaaccattgtcttcttctactgtttgttttgaatagttaccaggcagaacagataacgagatcaagaactactggaacacgaggttgaaacgcttccaacgccaaggcctccctctctaccctccagaatattcccaaaacaatcatcaacaacaaatgtatcctcaacagccctcctcacctctcccgtcccaaacacctgcttcttcctttacctttcctctcctccaaccgccttctctgtgtcccaaacgttgttataacactgccttctctcccaaggcctcatatatttcttctccaaccaatttccttgtctcgtctccgacctttcttcacacccattcctctctttcctcctatcagtctaccaatccggtttactccatgaaacatgagctctcttcaaaccaaattccatactctgcctctttaggagtctatcaagtaagcaagttctcagacaatggggattgtaaccaaaacctgaacaccggtttgcatacaaatacctgtcagctgttagaggatcttatggaggaggccgaggctctagctgatagctttcgtgctcctaagcggagacaaatcatggctgcgcttgaggacaacaacaacaacaacaactttttctcgggaggtttcggacatcgtgtttcttccaacagtctatgttccttgcaaggtaataataatcagacaactcaaaatgcttcaatctgcaaaaacaagtgtttgaattttattttattttgattgacacaggtttaacaccaaaggaagatgagtctctccagatgaacacaatgcaagatgaggacataacaaagcttcttgactggggaagtgaaagtgaagaaatctcaaacgggcaatcctctgtgataacaacagagaacaaccttgtccttgacgatcaccagttcgcttttctgtttccagttgatgatgacaccaacaacttgccagggatctgctagagaaagacgaaacaactaaatggaaacatgttcctgattgtacaattaaaatcctgaatatacctgtcaaatatgttattaaagcaatatgatcctcatgtatagagatcttagcattgttcatctgttaca

SEQ ID NO: 4097 - DNA, 734 bp, Artificial Sequence
  P1284 (35S::G1820)
tctcacttccaacatccaaatccctagaaattgtaaatggctgagaacaacaacaacaacggcgacaacatgaacaacgacaaccaccagcaaccaccgtcgtactcgcagctgccgccgatggcatcatccaaccctcagttacgtaattactggattgagcagatggaaaccgtctcggatttcaaaaaccgtcagcttccattggctcgaattaagaagatcatgaaggctgatccagatgtgcacatggtctccgcagaggctccgatcatcttcgcaaaggcttgcgaaatgttcatcgttgatctcacgatgcggtcgtggctcaaagccgaggagaacaaacgccacacgcttcagaaatcggatatctccaacgcagtggctagctctttcacctacgatttccttcttgatgttgtccctaaggacgagtctatcgccaccgctgatcctggctttgtggctatgccacatcctgacggtggaggagtaccgcaatattattatccaccgggagtggtgatgggaactcctatggttggtagtggaatgtacgcgccatcgcaggcgtggccagcagcggctggtgacggggaggatgatgctgaggataatggaggaaacggcggcggaaattgaagtgtagatttagggtttgtaaccgcctatgtgggaaatttgaaatttggtggtgtttattagggttcttcaattcgtcggatttgctt

SEQ ID NO: 4098 - DNA, 800 bp, Artificial Sequence
  P1285 (35S::G1819)
aatagttgggctgatttcgtagcccacttaatcagcctttaaatatggaaaccctagcctagaaagtgaacaagaaaaacgtaaagatcaaaatggaagagaacaacggcaacaacaaccactacctgccgcaaccatcgtcttcccaactgccgccgccaccattgtattatcaatcaatgccgttgccgtcatattcactgccgctgccgtactcaccgcagatgcggaattattggattgcgcagatgggaaacgcaactgatgttaagcatcatgcgtttccactaaccaggataaagaaaatcatgaagtccaacccggaagtgaacatggtcactgcagaggctccggtccttatatcgaaggcctgtgagatgctcattcttgatctcacaatgcgatcgtggcttcataccgtggagggcggtcgccaaactctcaagagatccgatacgctcacgagatccgatatctccgccgcaacgactcgtagtttcaaatttaccttccttggcgacgttgtcccaagagacccttccgtcgttaccgatgatcccgtgctacatccggacggtgaagtacttcctccgggaacggtgataggatatccggtgtttgattgtaatggtgtgtacgcgtcaccgccacagatgcaggagtggccggcggtgcctggtgacggagaggaggcagctggggaaattggaggaagcagcggcggtaattgaaaagtgttgattgggttttagggttgtaatgcttttgtgagaatttgtatctctatggagtcatgtttg

SEQ ID NO: 4099 - DNA, 746 bp, Artificial Sequence
  Artificial sequence
  P1286 (35S::G1821)
accgcgcatgcagacgtcatcgaagccattatgcactaaaacttccatttttcttatttttgttaggattagcagcgaattttctgatggcagagggcagtatgcgtcctccagaattcaaccagcctaacaaaaccagtaatggtggtgaggaggagtgcacggtgagggagcaagacaggttcatgcctattgccaacgtgatacggatcatgcggaggatcttacctgctcacgccaagatctcagatgactccaaggagacgatccaagagtgtgtttcggagtacatcagcttcataacaggggaggctaatgagcggtgccagcgggaacagcgcaagaccatcactgctgaggacgtcttgtgggcaatgagcaagctcggttttgatgactacatcgaacccctcacgttgtacctccaccgctacagagagttggaaggtgaaagaggggttagctgcagtgctgggtccgttagtatgaccaacggcttggtggtcaagaggcctaatgggaccatgaccgagtatggagcctacgggcctgtgccagggattcacatggcgcagtaccattatcgtcatcagaacgggtttgttttcagtggtaacgaacctaattctaagatgagtggttcatcttcaggagcaagtggcgccagagttgaagtatttccgactcaacaacataagtactgagaacaatggctaataacatagacagctgacagagtcataact

SEQ ID NO: 4100 - DNA, 1164 bp, Artificial Sequence; identical to SEQ ID NO: 1341
  P1294 (35S::G2060)

SEQ ID NO: 4101 - DNA, 1219 bp, Artificial Sequence; identical to SEQ ID NO: 829
  P1298 (35S::G1129)

SEQ ID NO: 4102 - DNA, 913 bp, Artificial Sequence
  P1301 (35S::G1143)
agaagaagaaataaatgggtggaggaagcagatttcaagaaccagtgaggatgagccgtaggaaacaagtaacaaaagagaaggaagaagatgaaaacttcaaatctccaaatcttgaagcagagagacgtagaagagagaagcttcattgtcggcttatggctctgcgatctcatgtccccattgtcaccaacgtaagtcccaaatctcgattattattttatgggtattttggtgatgattgttgttgtttttgtttcgttttcagatgactaaagcaagtattgttgaagatgcgattacttacataggagagcttcaaaacaatgttaagaatctcttagagacatttcatgaaatggaagaagctcctcctgagattgatgaagaacaaacggatccaatgataaaacctgaagttgaaactagtgatcttaacgaagagatgaagaaactcggaatcgaggtttttaaaatttctctaatcgatttttgattcattttctttatctttcttgatgattttttatttttgggacaggagaatgtgcaattgtgtaagattggggagaggaagttttggttaaagatcataacagagaagagagatgggatctttactaaattcatggaggttatgagatttctcggattcgagattatcgatattagtctaacaacttcaaatggagcaattcttattagtgcctctgttcagacacaggaactctgtgatgttgaacagacaaaagattttcttttggaagttatgagaagcaatccataagtattaattatatacatcttggaaatttcttgatctaataacatttccattggtttttattacattgttgttccattttaaatatgatatgattcagatgaaaaagagtttgtgttacaagccaat

SEQ ID NO: 4103 - DNA, 2205 bp, Artificial Sequence
  P1302 (35S::G1652)
gcaagtccaaatctccctctctctctctctatctatctctctatagaaggtaaacttcaacttcatctttcttagactgcttaaatttctcaaattcttgtaaagcttttggaattcaagaaatattaatgttatataatttcattttcttgggttaatagtttcctcatatgattaccaattttcagattttttaactaagaagctagcgatcatggccacagcgatgaacgttttctctaccaaatggtcctccgaattggtatatttctatacacacatacatacatatttatgtgtgcctctctttcctcatatgattttgtatatatataaaatctatattcatgttcttttaacctactttttcttaggcaaatttcacgaatctttattatttgcttttcgtataggatatagaagaatatagtatcatccaccaattccacatgaactcactcgtcggagatgttccacagtctctctcatctcttgatgataccaccacttgttataaccttgatgcttcttgtaataaaagtttggtagaagaaagaccttcaaagatcctcaagaccactcacatatcaccaaacttacatcctttttcttcttctaatcctcctcctccaaagcaccagccctcttctaggattctttcttttgaaaagacaggtttacatgttatgaatcacaactctccaaacttaatatttagccccaaggacgaagaaattggattaccagagcataagaaagccgagctgataataagagggacaaagagagctcaatccttgactcgaagccaatcaaatgctcaagatcacatactggcagagagaaaacggagagagaagcttactcaaagatttgtagctctttccgcgctaattcctggcctaaagaaggtacacatatgtaaaaataaatcttctcttcttcttcttgtttaataaagaggcgcataccaaccaaatgatagtgtagtcttttcttaaataattctattttgctaggcaagaaaccaattttcatggacagtattcactcttttcttatacccacaatgaaagttttgacttcagatctcccggttatgagactaaattatttgaccaggaccgactttgtgaaactcgaaatatactaaaacaaatcctctatatataagaattattacttttttacaaatcatttgcagttccggcttgaaggtttttcatttcgattaaatataaatatatttacatgctatatattgaaatatgcatctatgtcattatagatggacaaggcttctgtgttgggagatgcaataaagcatataaagtacctccaagagagtgtgaaagagtatgaggaacaaaagaaggaaaagacaatggaatcagtggttcttgtaaagaagtctagtctggttttagatgaaaatcatcaaccatcatcatcatcttcctcagatggaaatcgcaatagctcgagctcaaatcttccagaaatagaagttagggtttcaggaaaagatgttcttattaagatcctatgcgagaagcaaaagggtaatgtgatcaagattatgggggagattgaaaagcttggtttgtctatcaccaacagcaatgtcttgccctttggacccacttttgacatctctattatcgctcaggtaactatatattttctcatataagctacaacataactttattctagtattcaacataaatatatatatcgtgtgacaacataaatcaattctatagataatgtacatgtttcagaattagtatgactttggacttaaatattctagtattcgaaaattctaatgatatagtttattctttgcagaagaataacaattttgatatgaaaatcgaggatgttgtgaagaacttgagttttggcttatcaaagctcacttaattggtttcacgttacatacatatacacattcatcatcgatttctccgatcgaagaatccaaaatcagtttttccatgaaagtggttttttagttgttaagtttgttgtatggagattcttaagtcatttaaagatccttgttcttgtgttgttaagtgtgctttaagatgcatatcatcaaatgtttagtaattatttctctccagtttcatttgggacggaatttttttcgcagttgttggatatatatttcctgcgatgtaaagcatttcgtta

SEQ ID NO: 4104 - DNA, 1445 bp, Artificial Sequence; identical to SEQ ID NO: 1285
  P1305 (35S::G1944)

SEQ ID NO: 4105 - DNA, 895 bp, Artificial Sequence
  P1308 (35S::G1759)
aacgcttagtatctccggcgacttgaacccaaacctgaggatcaaattagggcacaaagccctctcggagagaagccatgggaagaaaaaaactagaaatcaagcgaattgagaacaaaagtagccgacaagtcaccttctccaaacgtcgcaacggtctcatcgagaaagctcgtcagctttctgttctctgtgacgcatccgtcgctcttctcgtcgtctccgcctccggcaagctctacagcttctcctccggcgataacctggtcaagatccttgatcgatatgggaaacagcatgctgatgatcttaaagccttggatcatcagtcaaaagctctgaactatggttcacactatgagctacttgaacttgtggatagcaagcttgtgggatcaaatgtcaaaaatgtgagtatcgatgctcttgttcaactggaggaacaccttgagactgccctctccgtgactagagccaagaagaccgaactcatgttgaagcttgttgagaatcttaaagaaaaggagaaaatgctgaaagaagagaaccaggttttggctagccagatggagaataatcatcatgtgggagcagaagctgagatggagatgtcacctgctggacaaatctccgacaatcttccggtgactctcccactacttaattagccaccttaaatcggcggttgaaatcaaaatccaaaacatatataattatgaagaaaaaaaaaataagatatgtaattattccgctgataagggcgagcgtttgtatatcttaatactctctctttggccaagagactttgtgtgtgatacttaagtagacggaactaagtcaatactatctgttttaagacaaaaggttgatgaactttgtaccttattcgtgtgag

SEQ ID NO: 4106 - DNA, 1163 bp, Artificial Sequence
  P1310 (35S::G1930)
acattcacattactaatctctcaagatttcacaattttcttgtgattttctctcagtttcttatttcgtttcataacatggatgccatgagtagcgtagacgagagctctacaactacagattccattccggcgagaaagtcatcgtctccggcgagtttactatatagaatgggaagcggaacaagcgtggtacttgattcagagaacggtgtcgaagtcgaagtcgaagccgaatcaagaaagcttccttcttcaagattcaaaggtgttgttcctcaaccaaatggaagatggggagctcagatttacgagaaacatcaacgcgtgtggcttggtactttcaacgaggaagacgaagcagctcgtgcttacgacgtcgcggctcaccgtttccgtggccgcgatgccgttactaatttcaaagacacgacgttcgaagaagaggttgagttcttaaacgcgcattcgaaatcagagatcgtagatatgttgagaaaacacacttacaaagaagagttagaccaaaggaaacgtaaccgtgacggtaacggaaaagagacgacggcgtttgctttggcttcgatggtggttatgacggggtttaaaacggcggagttactgtttgagaaaacggtaacgccaagtgacgtcgggaaactaaaccgtttagttataccaaaacaccaagcggagaaacattttccgttaccgttaggtaataataacgtctccgttaaaggtatgctgttgaatttcgaagacgttaacgggaaagtgtggaggttccgttactcttattggaatagtagtcaaagttatgtgttgaccaaaggttggagtagattcgttaaagagaagagactttgtgctggtgatttgatcagttttaaaagatccaacgatcaagatcaaaaattctttatcgggtggaaatcgaaatccgggttggatctagagacgggtcgggttatgagattgtttggggttgatatttctttaaacgccgtcgttgtagtgaaggaaacaacggaggtgttaatgtcgtcgttaaggtgtaagaagcaacgagttttgtaataacaatttaacaacttgggaaagaaaaaaaagctttttgattttaatttctcttcaacgttaatcttgctgagattatttatg

SEQ ID NO: 4107 - DNA, 1190 bp, Artificial Sequence
  P1313 (35S::G168)
acaaccacacaaaacaaaaaacaaattcatggggatgaagaaggtaaagctatctttgatagctaatgaaatatcaagggaaacatccttcatgaagaggaaaaatgggataatgaagaaactctacgagttgtcaactctatgtggtgtccaagcttgtactctcatctacagtccattcattccggttccagagtttctggagatgtcgccgacagcccgaacaaggaagatgatgaatcaagaaacgtatctaatggagaggattaccaaagcaaaagagcaactacagaacctggttggtgcgaaccaagagttacaggttagacgatttatgtttgattgtgttgaaggcaaaatgtcgcagtatcgttatgatgcaaaagaccttcaagatttgttatcttgtataaatctatatctcgatcagcttaacggaaggatcgagatccttaaagaacacggtgactcgttgccttccgtctctccttttcctactagaattggtgttgaagaaactggtgatgagtcgtcttccgactctcctattcttgctacaactggggttgtagatactcctaatgctacaaatcctcgtgttcttgtggccgatacgactcattttcttgatgcgaatgcaactgcggtaactgctccctttggattttctaatcatattcaatataagaatatgaatatgagtcaagatctgcatcgaccgtttcaacaccttgttcctactaacttttgtgatttttttcaaaatcagaatatgaatcaggttcaataccaggctcctcctaatgatatgtttaatcagattcaacgagagttctacaacattaatttgaatcagaaatcaaatcagtatatgaatcaacaacaaccattcatgaatccgatggtggaacaacatatgagtcatgttggagggcgtgagagcattcctttcatggacggaaactactacaactacaatcaactaccagtcgttgatcatggttccacaagttacatgccttccaccaccggtgtttatgatccttacttcaacaataatctctaatcaaaagagggagattttctaatctaagtgttcagttgtttgtatttgtgttttcttcatttcaaaagacaaaaactaattttgtttattaataattgttgtaatggttaaagtgtctctcttt

SEQ ID NO: 4108 - DNA, 1921 bp, Artificial Sequence; identical to SEQ ID NO: 459
  P1329 (35S::G581)

SEQ ID NO: 4109 - DNA, 1613 bp, Artificial Sequence; identical to SEQ ID NO: 239
  P1330 (35S::G264)

SEQ ID NO: 4110 - DNA, 677 bp, Artificial Sequence
  Artificial sequence
  P1344 (35S::G353)
accaaactcaaaaaacacaaaccacaagaggatcatttcattttttattgtttcgttttaatcatcatcatcagaagaaaaatggttgcgatatcggagatcaagtcgacggtggatgtcacggcggcgaattgtttgatgcttttatctagagttggacaagaaaacgttgacggtggcgatcaaaaacgcgttttcacatgtaaaacgtgtttgaagcagtttcattcgttccaagccttaggaggtcaccgtgcgagtcacaagaagcctaacaacgacgctttgtcgtctggattgatgaagaaggtgaaaacgtcgtcgcatccttgtcccatatgtggagtggagtttccgatgggacaagctttgggaggacacatgaggagacacaggaacgagagtggggctgctggtggcgcgttggttacacgcgctttgttgccggagcccacggtgactacgttgaagaaatctagcagtgggaagagagtggcttgtttggatctgagtctagggatggtggacaatttgaatctcaagttggagcttggaagaacagtttattgattttatttattttccttaaattttctgaatatatttgtttctctcattctttgaatttttcttaatattctagattatacatacatccgcagatttaggaaactttc

SEQ ID NO: 4111 - DNA, 1740 bp, Artificial Sequence
  P1345 (35S::G878)
gagaaacacgacacgaattttgtataattaagattacacaaaaaaaagtgttagaaagagaaatatcttcttcttttttctgtgtgagttgggtttgttaaagttttatcctttttgttctcaaaatcaagaatcgatggcggagaaggaagaaaaagaaccatcgaagttaaaatcatccaccggagtttcacggccaacgatttcactacctcctcgaccgtttggtgaaatgttttttagcggtggcgttggatttagtcctggaccaatgactctcgtctcaaatttattctctgatcctgatgagttcaagtctttctctcagcttttagctggagctatggcttctccggcggcagctgctgttgccgccgctgctgtggttgctactgctcatcatcagacacctgtgagctctgtcggtgatggcggtggaagcggtggtgatgttgacccgaggtttaagcagagtagaccaacgggattgatgataactcaaccaccggggatgtttactgtaccgccggggttaagtccggctactcttttggattctccgagcttctttggtcttttttcacctcttcagggaacatttggtatgacacatcaacaagctttagcacaagtcactgcacaagcagttcaaggcaataatgttcatatgcagcaatcacaacaatctgaatatccttcttctacacaacaacaacaacaacaacaacaacaagcttcattgactgagattccatcattttcttctgcacctaggtctcagattcgagcctcggttcaagaaacatcgcagggtcagagagagacttcggaaatatctgtctttgagcatcggtcacagcctcaaaatgctgacaaaccagctgatgatggatacaactggcggaaatatgggcagaagcaagtgaaggggagcgattttcctcggagttattacaaatgtacgcatccagcttgtcctgtcaagaagaaagtggagaggtcactcgatggacaagtaacggaaatcatctacaagggtcaacacaatcatgagcttcctcaaaagcgcggtaacaataacgggagttgtaaaagttctgatattgcaaatcagtttcaaacaagtaatagcagtctcaacaagagtaagagggaccaggaaacaagccaagttacaacaacagagcagatgtctgaagcaagtgatagcgaggaggttgggaatgcagagactagtgtgggagaaagacatgaggatgagcctgatcccaagcgaagaaatacagaagttcgggtttcagaaccagttgcttcatcgcatagaactgtgacagagcctaggattattgtccaaacgacgagtgaagttgacctcttagatgatggatataggtggcgcaagtatggtcagaaagtagtcaaaggaaatccttatccgaggagctactataagtgtacaacaccagattgcggagtaaggaaacatgtagagagagcagcaactgacccaaaagctgttgtaacaacatatgaaggtaaacataaccatgatgttccagctgctagaaccagcagccatcagttaagaccaaacaatcaacacaacacctcaacggttaacttcaatcatcaacagcctgttgcacgtttaaggcttaaagaagagcaaatcacttgacagagaagaagaatacgacggcgcttgagcttttgtgagtttaatgaatcttctttttggtt

SEQ ID NO: 4112 - DNA, 1086 bp, Artificial Sequence
  P1349 (35S::G200)
cagagagatctagaggaagagagagagagaaagatgggtaggcctccatgctgtgacaagatagggatcaagaaaggaccatggactcctgaagaagatatcattcttgtttcttacattcaagaacatggtcctggaaactggagatcagttcccaccaacactggtcattatcttttctcaacatgttttcttctagtgtctttcttttctttgtttgtatatgtgtcctgatgtttgtatcttaatttggcttttaaaagggttattgagatgcagcaaaagttgtagactgagatggacaaattatctgagacctggaattaaacgtggaaactttactcctcatgaagaaggaatgatcattcacttgcaagccttattgggtaacaagtaatctcagacaaaaggatctacatctctttatacttgaatgttttgtgtatatattttgatgatgtgaaccctaaactggcttatttgtttacatatggttgtggtaagatgggcgtccatagcttcatacctaccacaaagaacggacaatgatatcaagaactactggaacacacatttaaagaagaagctcaacaagtctgacagtgatgagaggagcagatcagagaacattgcgctgcaaacttcttcgacaagaaacaccattaatcatagatctacctatgcttcaagcaccgaaaacatttcccgccttcttgagggttggatgagagcgtctccaaagagtagtacaagtactactttcttggaacacaaaatgcagaaccggacaaacaatttcatcgatcatcacagcgatcagtttccatacgagcagcttcaaggttcttgggaagagggtcatagcaaaggaatcaacggggatgatgaccagggtataaagaattcagagaataacaacggtgatgatgttcatcatgaagatggtgatcatgaggatgatgatgatcataatgctacaccaccattgacatttattgagaaatggcttttggaggaaacaagtactactgggggtcaaatggaagagatgagccacttgatggagctctctaatatgctttaatt

SEQ ID NO: 4113 - DNA, 1380 bp, Artificial Sequence
  P1350 (35S::G979)
cctctgaggaatcaaatcactcacactccaaaaaaaaatctaaactttctcagagtttaatgaagaagcgcttaaccacttccacttgttcttcttctccatcttcctctgtttcttcttctactactacttcctctcctattcagtcggaggctccaaggcctaaacgagccaaaagggctaagaaatcttctccttctggtgataaatctcataacccgacaagccctgcttctacccgacgcagctctatctacagaggagtcactagacatagatggactgggagattcgaggctcatctttgggacaaaagctcttggaattcgattcagaacaagaaaggcaaacaagtttatctgggagcatatgacagtgaagaagcagcagcacatacgtacgatctggctgctctcaagtactggggacccgacaccatcttgaattttccggcagagacgtacacaaaggaattggaagaaatgcagagagtgacaaaggaagaatatttggcttctctccgccgccagagcagtggtttctccagaggcgtctctaaatatcgcggcgtcgctaggcatcaccacaacggaagatgggaggctcggatcggaagagtgtttgggaacaagtacttgtacctcggcacctataatacgcaggaggaagctgctgcagcatatgacatggctgcgattgagtatcgaggcgcaaacgcggttactaatttcgacattagtaattacattgaccggttaaagaagaaaggtgttttcccgttccctgtgaaccaagctaaccatcaagagggtattcttgttgaagccaaacaagaagttgaaacgagagaagcgaaggaagagcctagagaagaagtgaaacaacagtacgtggaagaaccaccgcaagaagaagaagagaaggaagaagagaaagcagagcaacaagaagcagagattgtaggatattcagaagaagcagcagtggtcaattgctgcatagactcttcaaccataatggaaatggatcgttgtggggacaacaatgagctggcttggaacttctgtatgatggatacagggttttctccgtttttgactgatcagaatctcgcgaatgagaatcccatagagtatccggagctattcaatgagttagcatttgaggacaacatcgacttcatgttcgatgatgggaagcacgagtgcttgaacttggaaaatctggattgttgcgtggtgggaagagagagcccaccctcttcttcttcaccattgtcttgcttatctactgactctgcttcatcaacaacaacaacaacaacctcggtttcttgtaactatttggtctgagagagagagctttgccttctagtttgaa

SEQ ID NO: 4114 - DNA, 1672 bp, Artificial Sequence
  P1351 (35S::G884)
gtttgttaattttggggatcgatgtcggaaaaggaagaagctccgtcgacatcgaagtccaccggagctccgtcgcgtccgactttatctcttcctccacggccgtttagtgagatgttctttaacggtggcgttggattcagtcctggtccgatgactctggtctctaatatgttccctgattccgatgagtttaggtctttctctcagcttctcgctggagccatgtcttctccagcgactgcagctgctgctgctgctgctgcgacggctagtgattaccagagacttggtgaagggactaatagctctagtggtgatgttgacccgagattcaagcaaaacagaccaaccggtttgatgatttctcaatctcaatcgccgtcgatgttcaccgtaccgcctggtttaagtccagctatgttgctcgattcaccaagctttttgggtcttttctctcccgttcagggatcatatggaatgacacatcagcaagctctagctcaagtcactgctcaagcagttcaagccaatgccaatatgcaaccacaaacagagtaccctcctccctctcaagttcaatcattttcatcgggtcaagcgcagatcccgacctcggctccactaccagctcaaagagaaacctcagatgtaaccatcatagagcacaggtcacaacagcctctaaatgttgacaaaccagctgatgatggctataactggcgaaaatatgggcaaaagcaagttaaaggtagcgagtttccacgaagctattacaagtgtactaatccaggatgtcctgtcaagaagaaggttgagagatctcttgatggacaagtaacggagattatctacaaaggtcagcacaatcatgaacctcctcaaaacactaagcgaggtaacaaagataacaccgcgaatataaatgggagttcgataaataacaatcgcgggagttctgaattgggggcatcacagtttcaaactaatagctccaacaagactaagagagagcaacatgaagcagtaagtcaagctacgacaacagagcacttgtctgaggcaagtgacggtgaagaagttggtaatggagaaactgatgtgagagagaaagatgagaatgagcctgatcccaagagaagaagtacagaagttcggatttcagaaccagctcctgctgcttcacatagaactgtgacagagcctagaattattgtccaaacgacgagtgaagttgatcttctagatgatggatataggtggcgtaaatatggacagaaagttgtcaaagggaatccttatccgaggagctactacaagtgcacaacaccaggatgtggtgtgaggaaacatgtagagagagcagcaacagatccaaaagctgtagtaacaacatatgaaggaaaacataaccatgaccttcccgctgctaaatcaagcagccatgccgctgcagcggcacagttaaggccagataatcgacctggcggtttggctaacttaaatcaacagcagcagcaacagcccgttgcgcggctaaggcttaaagaagagcaaacaacttgagagaagaaaactcttgaccgtttttcattacaaaagctttcaaattccactcacacacttgtctgaaaaatctagcagtttgcaggaaagaaacagcttcaagagg

SEQ ID NO: 4115 - DNA, 1152 bp, Artificial Sequence
  P1353 (35S::G1100)
cctcttacaagaattgtgagagtgaatgattacatccttagtttttctaaaccacaaaataaaaactttcgttcatgaaatcttatggtaagttttgagagaaatatccgagtattgcttcagtccgttgcatacgaatcaagcgagacgatggtgcagcctggaaccgagataaaagcaagcgacctaaccctactagtaatcacgattatactcttcgcaatcttcatcgttggcttggcttcggtttgcttccgctggacctctcgccaattttactcacaagaatccatcaaccctttcactgactccgacgttgaatcccgtacgagtattacggcggtgcgtgggctcgacgaggctatcatcaactcatttccgacgtttctctactcggaggtgaaggagcggagaatcgggataggtggcgtcgagtgtgcagtgtgtatctgtgagttcgaagaccatgaaacgctccgtttgatgcctgaatgctgccacgtgtttcatgctgattgtgtaagtgtctggctctctgatcactccacgtgtccactctgtcgtgtggatctttgcttacaaccgggtgagagaagctacttgaatccggaaccggatcttgtagaatctacaaactcgcatttgtttgatggtgtgacgtggaccaataggaacagaccgtctcggtcatggtcaacgagattgtctcaatgtcgagtctcccagatattaatctcgagatcgcattcgaccggacattctgtggttcaaccgctagataatttagaccggtttacgcttcggttaccagaagaagtccggaggcaactgacgaaaaaaacggtggacaacgtggcattttctcaggctaggagctcacggcgtggttacagaagcagaagtgccggaagcgagaggagtgtcttctcgtaccaacggcggatgcattccttctctgattgtgcatggtccacctcctgtggcggagaagcggtggctccgtcaaaggattcccgccgaatatcagttgaacaatcccagctagatgatcgagtgtagtagataggcaattttcttggtgtgtgttttttgctaacaacatttgtgtttgtctgtttgtctgtttgctatcatttgcttttcgaacatgac

SEQ ID NO: 4116 - DNA, 624 bp, Artificial Sequence
  P1354 (35S::G377)
ctttcaaagactctcagtttctatctctgtgaatataatcttagttataaaaaaatgggtctctcgcattttccaacagcgtcagaaggagtactaccacttctggtgatgaacacggttgtttcaatcactctgttgaagaacatggtgaggtctgtttttcaaattgttgcatccgagactgaatcttccatggagatagacgacgagcctgaagatgattttgttactagaagaatctcgataacacagttcaagtctctatgtgagaacatagaagaggaagaagaagagaaaggtgtggagtgttgtgtgtgcctttgtgggtttaaagaggaagaggaagtgagtgagttggtttcttgcaagcatttcttccacagagcttgtctagacaactggtttggtaataaccacaccacatgccctctttgcaggtccattctctagtggtggaatcttgttttacactttccttttgttttgctttgctataggaaaataccacattctctatcctctgttttaccctttttggtgtttatgtttttccccttcttttttcttggtatggagaaggggttttttcataataaaggactatacaattgatgtgtgtgaatg

SEQ ID NO: 4117 - DNA, 1280 bp, Artificial Sequence
  P1355 (35S::G1095)
ctactgaatatttcccttcaaatcctagagggagcttttcatttagattgttttgtagtcaaatggatctaacagaccgtcgtaacccttttaacaatcttgtttttccgccgccgcctccgccgccatccacgaccttcacaagccctatattcccacgaacaagctcttccggcaccaatttccccattctggccatcgcagtgattggaatcttagccactgcgttcttacttgtaagttactacatcttcgtgatcaaatgctgtcttaattggcaccaaatcgacatctttcgccgccgcagacgaagcagtgaccaaaaccctctaatgatttactctcctcatgaggtaaacagaggactagacgaatccgccattagagctatcccagtcttcaaattcaagaagagagacgttgttgcaggagaagaagatcagagtaagaactctcaagaatgctctgtttgtttaaacgagtttcaagaagacgagaagctaaggattattcctaactgctgccacgtgtttcacattgattgcattgatatctggcttcagggcaacgcaaattgtcccttgtgcagaaccagcgtttcttgcgaagcaagtttcactcttgacctaatctctgcaccgagctctcctcgggagaatagccctcattctcggaacaggaatctcgaacccggcctggttctaggaggcgatgatgacttcgtcgtcatagagcttggggccagtaatggtaacaacagagaaagcgtgagaaacatagacttccttacggagcaagaaagggttacctcgaatgaggtctcgaccggaaacagcccgaaatcggtgagtcctttgcctataaagtttggtaatcggggaatgtataagaaagaaaggaaatttcacaaagtgacgagtatgggagacgaatgtatcgatactagaggcaaagatggtcattttggtgaaattcagcccataagaagatcgatctcgatggattcatcagtggatcgtcagctgtacttggcggtccaagaggaaatcagccggagaaacaggcagattccggtagctggagacggtgaagatagtagcagtagtggtggtggtaatagcagagtcatgaagagatgtttcttctcttttggaagtagtagaacttcaaaaagttcttcaatattacctgtttatttggaaccctaattctgtattttcctcttcttgattcattgttcaaaaaaattattttttgtatttgttatttgctgaggtgaa

SEQ ID NO: 4118 - DNA, 2596 bp, Artificial Sequence
  P1359 (35S::G760)
cagatatctgattatctcttgtatttcttctactcgatttgctcccataaaaacccttactttcttcaagttctggttttcaccgattgatgggtcgtggctcagtgacgtcgcttgctcctgggttccgttttcacccgacggatgaggaacttgttcgctactaccttaagcgtaaggtctgcaacaaaccctttaagttcgatgctatttccgtcaccgacatatacaagtctgagccttgggatctaccaggttacaactttttctctcaatctctcttttttgttgtctagttagatcgaattatggagcttgattatgaatgatctagaattctgattgattcgattgattttgtgtgtgtatagataagtcgaagctgaaaagtagagacttggaatggtacttctttagtatgctggataagaagtacagtaatggttccaagacgaatcgtgctacggagaaagggtattggaagacgactgggaaagatcgggagattcgtaatggttcaagagtcgttgggatgaagaagacacttgtttatcacaagggtcgagctcctcgtggtgaaaggaccaattgggttatgcatgagtatcggctttctgatgaggacttgaagaaagctggtgtgccacaagtaagttttgagcaattgggtttgttttgttttccatttttgatctgaaagttgttttcttttgtgtctatggagagttattgactttgttgagtctttttggtggttggtggagaaggaagcatatgtgttatgtaggatattccagaaaagtggtacgggtcctaagaatggggagcagtatggtgctccttatcttgaggaggagtgggaagaagatggaatgacttatgtacctgctcaagatgctttcagtgaaggattggctttgaatgatgatgtttatgtcgatattgatgacattgacgaggtagcctacctttttcttcaaccgttccagaaattatttctctttgtgattagtgtgtagtgtaaaagtgattagttatatggttagaaagatggcttggaatatcgcaaatgcgaaagagtgataaatgcagtgttttcgtgttagcaagccttgggtgccttttgcttatgtgctggaatagtatacctgtttaggtttaagatgagtgatggatgttagttagctttaggtcttggcatattgatgatgatatagatctttacatcttctgatggtttggattcattcatgacatgtcttttatgttagcgtctgaatatgatttccttttgcagaagcccgaaaatctggtggtctatgatgccgttcctattctacctaactattgtcatggggaatcaagtaacaatgttgaatcaggcaattactcagactctggaaattacattcaaccaggaaacaatgttgtcgactctggtgggtactttgaacaaccaattgaaacttttgaggaagatcggaagcctattatacgggagggtagcattcagccttgttctctgtttccagaggaacaaattggctgtggtgtgcaagacgaaaatgtggtgaatctggaatcttccaacaataatgtgtttgtagctgatacatgctacagtgacattcctattgatcataactatttacccgatgagccattcatggatcctaataacaatcttccactcaacgatggtctgtacctggaaacgaatgatctcagctgtgctcaacaagatgattttaacttcgaagattatctcagcttctttgatgatgagggtttgacttttgacgattctctattaatgggacctgaagattttcttcccaaccaagaagcccttgaccagaaagtaagacccgttcttccaacgtgcttagtttatatatatgtgaaaaacttctgtttaactcacctttacatcaacagcctgcccctaaagaattggagaaggaggtcgcaggaggcaaagaggcagtggaggaaaaggaaagtggcgaaggatcttcttcaaaacaagatacagatttcaaggactttgattcaggtaacactcagatgttcatggaattccttttaaaacaagtcatatgatgactgattctgactcttttgaatctaaatcatgtagctccgaagtacccatttctcaaaaagacgagccacatgcttggagccattcctactccatcttcatttgcttcacagttccaaacaaaggacgcaatgcgtctacacgcagcacaatcttctggttcagttcacgtgactgcaggtatgatgagaatatcaaacatgactctagcagcggacagcggtatgggctggtcatatgacaagaacggtaacctcaacgtagtcctttcattcggggtagtccaacaggatgatgcgatgactgcctcgggaagcaagacaggaattacggcgacaagagctatgttagtcttcatgtgtttatgggttctcctactctctgttagcttcaaaatagtaaccatggtgtctgctcggtaataggatcaaagttgaatcgtctcaaagactttttttggtgtttgtacctctccaatcatatagcctttaa

SEQ ID NO: 4119 - DNA, 1023 bp, Artificial Sequence
  P1361 (35S::G1425)
aatattctccgatcatcattttaatggagagtacagattcttccggtggtcctccgccgccgcaaccaaacctccctccaggattccggtttcatccaacagacgaagaacttgtaattcattacctcaaacgcaaagcagattctgttcctttaccagtcgcgatcatcgccgacgttgatctttacaaatttgatccatgggaacttcccgcgaaagcttcgtttggagaacaagaatggtattttttcagtccaagagatcggaaatatcccaacggagctagacctaaccgagctgcgacttccggttattggaaagcgactggtacagataaaccggtgatttcaaccggcggtggtggtagtaaaaaagtgggagttaaaaaggctctagtgttttacagtggtaaaccaccaaaaggagttaaatcagattggattatgcatgaatatcggttaactgataataaacctactcacatttgtgacttcggcaacaagaaaaactctctcaggcttgatgattgggtgttgtgtcgtatctacaagaaaaacaatagtacagcatctagacatcatcatcatcttcatcatattcatctagataatgatcatcatcgtcatgatatgatgattgatgatgatcgattccgtcatgttcctcctggtcttcacttcccggcgattttttctgacaataatgatccgacggctatatatgatggtggcggcggcggatacggaggtggaagttactcgatgaatcattgtttcgcatctggatcaaagcaggagcagttgtttccaccggtgatgatgatgactagtctaaatcaagattccggtattggatcgtcgtcgtcacctagcaagagatttaacggcggcggcgttggagattgttcgacttctatggcggcgacgccgttaatgcagaaccaaggtgggatttaccaattgcctggtttgaattggtattcttgaaaacaatttacgatgaagaatttttaaaatttgtgta

SEQ ID NO: 4120 - DNA, 1272 bp, Artificial Sequence
  P1364 (35S::G561)
cttttgtgggttcaattcgaattgttttccctgagactcaagttactgtgtcattactctgcattgagcaatgggtagcaacgaagaaggaaaccccactaacaactctgataagccatcgcaagctgctgctcctgagcagagtaatgttcatgtgtatcatcatgactgggctgctatgcaggcatattatgggcctagagttggtatacctcaatattacaactcaaatttggcgcctggtcatgctccaccgccttatatgtgggcgtctccatcgccaatgatggctccttatggagcaccatatccaccattttgccctcctggtggagtttatgctcatcctggtgttcaaatgggctcacaaccacaaggtcctgtttctcaatcagcatctggagttacaacccctttgaccattgatgcaccagctaattcagctggaaactcagatcatgggttcatgaaaaagctgaaagagttcgatggacttgcaatgtcaataagcaataacaaagttgggagtgctgaacatagcagcagtgaacataggagttctcagagctccgagaatgatggctctagcaatggtagtgatggtaatacaactgggggagaacaatctaggaggaaaagaaggcaacaaagatcaccaagcactggtgaaagaccctcatctcaaaacagtctgcctcttagaggtgaaaatgagaaacccgatgtgactatggggactcctgttatgcccacagcaatgagtttccaaaactctgctggcatgaacggtgtgccacagccatggaatgaaaaagaggttaaacgagagaagagaaaacagtcaaaccgagaatctgctaggaggtcaagactgaggaagcaggctgaaacagaacaactatctgtcaaagttgacgcattagtagctgagaacatgtctctgaggtctaaactaggccagctaaacaatgagtctgagaaactacggctggagaacgaagctatattggatcaactgaaagcgcaagcaacagggaaaacagagaacctgatctctcgagttgataagaacaactctgtatcaggtagcaaaactgtgcagcatcaactgttaaatgcaagtccgataaccgatcctgtcgcggctagctgaccgtggccgcaacaatgagaacccgatatttcttcctttgggttgtgattgtaacttaaaaggagactttttgtttttattcttagatttgtagctctctgcatagtgagcataaattg

SEQ ID NO: 4121 - DNA, 1272 bp, Artificial Sequence
  P1365 (35S::G565)
cgacagataacagagggcgcgaaacagagagaaaataagaagaagaaggacgatccagatatggaggatccttctaacccacgaccaaaccagagcaatctctcgcaatgcccgcctttagccacagctccgacacctgcgccagttcgtggtccgtaccaccggagagcacattcggaggtccaattccgtctccctgaagatctggatctctctgaaccattcggaggattcgatgagcttggatccgaagatgatctcttttgctcatacatggacattgagaaacttggatccggatccggatccgcatccgattcggctggtccttctgctcctaggtctgataacccgttttccgctgagaatggaggtgcggaggctgggaattcgggacctcgacacaggcatagcctctccgttgatggctcttcgactttggagtcaattgaggctaagaaagctatggctcctgataagctcgctgagctttgggtcgtcgaccctaaaagagctaaaaggataattgctaatcgacagtctgctgctcgttcgaaagagaggaaggctcggtatatcttggagctcgagaggaaagttcagaccttgcaaactgaagctactaccctttcagcacagttgtctttgttccagagagacacaactggtttgtcatctgagaatacagagctcaagcttcgtttacaggtcatggaacaacaagctaagttgcgagatgcactgaacgagcaactgaaaaaggaagttgagaggctgaaattcgccacgggagaagtctcacccgcggatgcttataacctcggaatggcacacatgcaatatcagcaacaaccacaacaatccttctttcaacatcatcatcagcaacaaaccgatgctcaaaacctgcaacaaatgactcatcagtttcatctcttccagcctaacaacaaccagaaccaatcttctcgcacaaaccctcccaccgctcatcagcttatgcatcacgctacttctaatgccccggctcaatctcattcctattcagaggcaatgcatgaagaccatcttggccggttacaggggcttgacattagcagctgtggcagaggctcaaactttggtaggtctgacaccgtcagtgaaagcagcagcactatgtgaggctgcctttcccagattcccctttgtcgataaacctattctttcgccctcccttgaaatctttagctaaaaagtaatatcttcgtgacagtcggattcagcggccgc

SEQ ID NO: 4122 - DNA, 1740 bp, Artificial Sequence
  P1369 (35S::G1050)
ttccccatttcagaaaatcaaaatgggtggtggtggtgatacaacagataccaatatgatgcagagagttaattcttcttctggtacatcgtcttcttcgatccctaaacacaatcttcacttgaatcctgctcttatccgctctcaccatcacttccgtcaccctttcaccggagctcctccaccgccgattccacccatttctccttactctcagatcccggcgactttacaacctagacattctcgctctatgtcgcaaccgtcttctttcttctcctttgattcattgccgccgttaaatccttctgctccgtcggtttcggtgtcggtggaggagaaaaccggtgccggatttagtccttcgttgcctccgtcaccgtttacgatgtgtcattcttctagctctaggaacgccggagatggagagaatctacctccgagaaagtcgcataggcgttcgaatagtgatgttacttttgggtttagttcaatgatgtctcagaatcaaaagtctcctcctttgagttctttggagagatcgatctctggtgaagatacatcagattggtctaatttggtgaagaaagaaccgagagaaggcttctacaagggaagaaaaccagaggttgaagcagctatggacgatgttttcacggcttatatgaatcttgataacattgatgtcttgaattcttttggaggtgaagatggcaagaatgggaatgagaatgtggaggagatggagagtagtagaggtagtggtacaaagaagacgaatggtggaagtagtagtgattctgaaggagatagcagtgcgagtgggaatgtgaaggttgcgttgagttcttcttcttcaggcgtgaagagaagagcaggtggagatattgctcctactggtagacattacaggagtgtttctatggacagttgtttcatggggaagttgaatttcggcgacgaatcatcgctaaagcttccgccttcttcatcagctaaagtttccccaaccaattcaggtgaagggaattcaagtgcttatagtgttgaatttggaaacagtgagtttactgcagctgaaatgaagaagattgcagctgatgagaaactcgctgagattgtaatggctgaccctaagcgtgttaaaagaatcttggcgaaccgcgtatctgctgcacgttcaaaggagcggaagacgcgatacatggcagagttggaacacaaggtgcagacacttcagactgaagctactacattatcggctcagctcacacatttgcagagagattctatggggttgacaaaccagaacagtgagctgaagtttcgtcttcaagctatggagcagcaagcacaactccgcgatgctctgtcagagaaactgaatgaagaagtccagcggttgaaactggtgataggggagccgaaccgcaggcaaagtgggagcagcagcagcgaatcaaagatgtcactaaacccggagatgtttcagcagcttagcataagtcagttacaacaccaacagatgcagcattccaatcagtgtagcacaatgaaagcaaagcacacttcaaacgactagggtaagtaaaactgcgatccgcagttgtctagttacatatatgataagaatcttttgtgcagagttctgtttttggaagttttaaagaaacatatataaagattatgtccgggaaatttgatcatatttcctgaaacatacacacatatatatagtgg

SEQ ID NO: 4123 - DNA, 1125 bp, Artificial Sequence
  P1370 (35S::G1052)
ctttcctttgtttttcatttgacctcttacaaaaaaatctggtgtgccattaaatctttattaatggcacaacttcctccgaaaatcccaaccatgacgacgccaaattggcctgacttctcctcccagaaactcccttccatagccgcaacggcggcagccgcagcaaccgctggacctcaacaacaaaacccttcatggatggatgagtttctcgacttctcagcgactcgccgtgggactcaccgtcgttctataagcgactccattgctttccttgaaccaccttcctccggcgtcggaaaccaccacttcgataggtttgacgacgagcaattcatgtccatgttcaacgacgacgtacacaacaataaccacaatcatcatcatcatcacagcatcaacggcaatgtgggtcccacgcgttcatcctccaacacctccacgccgtccgatcataatagccttagcgacgacgacaacaacaaagaagcaccaccgtccgatcatgatcatcacatggacaataatgtagccaatcaaaacaacgccgccggtaacaattacaacgaatcagacgaggtccaaagccagtgcaagacggagccacaagatggtccgtcggcgaatcaaaactccggtggaagctccggtaatcgtattcacgaccctaaaagggtaaaaagaattttagcaaataggcaatcagcacagagatcaagggtgaggaaattgcaatacatatcagagcttgaaaggagcgttacttcattgcagactgaagtgtcagtgttatcgccaagagttgcgtttttggatcatcagcgattgcttctcaacgtcgacaatagtgctatcaagcaacgaatcgcagctttagcacaagataagattttcaaagacgctcatcaagaagcattgaagagagaaatagagagacttcgacaagtatatcatcaacaaagcctcaagaagatggagaataatgtctccgatcaatctccggccgatatcaaaccgtccgttgagaaggaacagctcctcaatgtctaaagctgttcgttcactaagatctttcttttcatggcgaaaagattcttgactataaaacctctttgtgtcaag

SEQ ID NO: 4124 - DNA, 4715 bp, Artificial Sequence
  P1372 (35S::G1146)
tggagaaaaagagtttttgaaaatccaaacaacaaaaaatgccgattaggcaaatgaaagatagctctgagactcacttagttatcaaaacccaacctttaaagcaccacaatccaaaaaccgttcaaaacggtaaaatccctcctccttctccttctccggtgacggtgactactccggcgacggttactcagagtcaagcttcttcaccttcaccaccgtcaaagaatcgtagccggaggagaaaccgtggtggaagaaaatctgatcaaggagatgtttgtatgagacctagctctcgtcctcgtaaaccgccaccgccaagtcaaaccacttcctccgccgtctccgtcgccaccgccggtgagattgtcgctgtgaatcatcagatgcagatgggtgttcgtaaaaactcaaactttgctccaagacctggatttggaacacttggaactaaatgcattgttaaagctaaccactttctcgctgatttgcctaccaaggatttgaatcagtatgatgtaagtttttattagaaaaagttaagattttttttgccttttttttagtttttgctgtaatgagaaacaaagcttgaacctttagatggtttcctgaaaaaaggtttgaaatttaatgaaggagagagagttagattttaatgttgttcttattgcttatttgggtccattgacatttggttaatgttttgcaggttacaattactcctgaagtgtcatcaaagagtgttaacagagctataattgctgagttagttagactttacaaagagtctgatctcgggaggagacttccggcttacgatggccggaaaagtctttacactgctggagaacttccttttacttggaaggagttcagtgttaagattgttgatgaagatgacggtatcatcaatggccctaagtaagtgtctaaggttctttaggtgattgattttgttatgtgtagttttatattgaaattgacacattttgctttgtagaagggagagatcatataaggtggcaatcaagtttgttgcacgggcaaatatgcatcacttaggcgagtttctagctggtaaacgggcagattgtccgcaagaggcggtgcagattcttgatattgtactcagggagttgtcggttaagaggttttgtcccgttggaagatctttcttttcgcctgatattaaaacaccgcagcgactcggtgaagggttagagtcatggtgtgggttttaccagagtattagaccaactcaaatgggtttatcactaaatatcggtaaagatttgacttaagagattgttacagttttggttttattttataagtcagcccaatcttaatgttattctccttactttgtagatatggcttcagctgcattcatcgagcctcttccagtgatagagtttgtagcacagcttcttggaaaggatgtcttgtcgaagccattgtcggattctgatcgcgtcaaggtacacaagtctcttcatcttattatatcttgtctcaagtccttgattgtttcctcaagaatgttttttttcttgggaatttttaacagattaagaagggtcttagaggagtgaaagtagaggttactcacagagcgaatgtaagaaggaaataccgtgttgcgggtttaacaactcaaccaacaagagagctaatgtgagtattttctttttacttactctttgattactaaggcttgtttcattgagattaatttctggtttatattcttaggtttccagtagatgagaactgtactatgaagtcagttattgagtatttccaagagatgtatggattcacgatccagcacacgcatttgccatgtctccaagttggaaaccaaaagaaggcaagctatttgccgatggaggtaaaccgtaaactgctggtttgtttgtttcaagacttcacatttcagctcttggctattttcgctgattcaatttccaatgtaggcatgcaaaattgtcgagggacaacggtacacgaaaaggttgaatgagaagcagattactgctctcttgaaagttacatgccaaaggccgagggacagagaaaacgatattttgcgggtatttttttagtcatgtatcttatatggttctttgtgagttagaacttagaagtgaggattaatcttgttgtcaaaaatgttttatagactgtccaacacaacgcatatgatcaagatccatatgcaaaggagtttggcatgaacataagcgaaaagttagcttctgttgaagctcgtattcttccagctccatgggtaaaaaacctaaacagatctctgaatgctcatactatgagaatactgttatgttaattcgtctctctttgcttgctacagcttaagtatcacgagaacgggaaagaaaaagattgtctcccgcaagttggtcagtggaatatgatgaacaagaaaatgatcaacgggatgactgtgagcagatgggcctgtgttaacttctcacgcagcgttcaagaaaacgttgctcgtggattttgtaatgaacttggtcagatgtgtgaagtctcaggcatggtaataatattcatctttttttcttttcttgttgcattgtttgaattctcttttaactcgatgtgattcttatcagaaagctttgcttcgtttatcattgtaggagtttaatccagaacccgtgataccaatatatagtgcgaggcccgatcaagtcgagaaagctctaaagcatgtttatcacacttcaatgaacaaaaccaaaggcaaagagttagagcttctgctggcaatattacctgataacaacggttcactttatggtattatttcgacatccataaacttaacccttttgccttctttagtaatggttttgatgaaaacgaaatgtttcttgtaatctcaggtgatcttaagagaatctgtgaaaccgagcttggtttgatatctcaatgttgtctcacaaaacatgtgttcaagattagcaaacagtatctggcaaatgtatcccttaaaatcaacgtaaaggtgaatagtttttactgctgtatcgaagattttcgattgtttttagtattatgaatctcagatctttctatgtttggtttcagatgggaggaaggaacacagttctagtagacgccataagctgtagaataccactggttagcgatataccgacaatcatttttggcgcagacgtgactcacccagagaacggggaagagtcaagcccttcaatcgctgctgtaaggattatacacttttatcaagtagtggagcatcgaaattcattatactcagtttttttcttttgttttctttaggttgttgcttctcaagactggcctgaagtgacaaaatatgcgggtttagtttgtgctcaagctcacaggcaagaacttatacaagatttgtataaaacatggcaagatcctgttcgcggtactgttagtggcggtatgatcaggtaataactcgcaatatttcggtttttgtagtttgattttatcggtgtatctcaaggtttttttgcttgctttctacagggaccttcttatctcatttagaaaagcaacagggcaaaaaccgcttcgaattatcttttatcggtaagtctctctttgctcatttaagtaaaagaattatatctaaaacccacaattagttctcatggttgttttattcgcgcagtgatggagtaagcgaagggcaattctatcaagttttactctatgagttggatgcaattcgaaaggtaaaaacttttgtgcatagcatgaaatgaatccgccacaaagttagcaaaacattttacataatcggaaacgggtttgtgtttgtttaggcttgtgcatcgcttgaaccgaattatcagccaccggtgacattcatagttgtacagaagcgtcaccacactcgtttgtttgctaataatcaccgagacaaaaacagtactgaccgaagcggaaatatcttaccaggttagttattaaaaacggttgaaagaagatcataacagaaataattaactaactaactaactgcttctttgccaccttttgtttcaggtactgtagttgacactaaaatatgtcatccaactgaattcgacttctacctttgtagccatgcgggtattcaggtacgaaacaactatcgaaatatccgttaatatgaccttttccgtaactatacagataaaatgacactgtttgtgtttgttgtatgatctagggaacaagcaggcctgcacattaccatgttctttgggacgagaacaatttcacagcagatggtattcaatctctgactaacaatctctgttatacctatgcgcggtgcactcggtcggtctctataggtaaataacaacatttcttcttcttcttcgtgtacccgcaaatatgacgaaaatcagcaaactcatatgttcttttattttctgatgttgtacagttcctccagcgtattatgctcatcttgcagcatttcgagcacgtttctacctggaaccggagataatgcaagacaacggatcaccgggtaaaaagaacacgaaaacaacaactgtcggagacgtaggtgtgaagcctttaccagccttgaaggagaatgtgaagagagtaatgttctactgctaaaaatccaaacattccttaatcagttttaataagtagtttggttgtttgcttgt

SEQ ID NO: 4125 - DNA, 877 bp, Artificial Sequence
  P1374 (35S::G634)
cggagctagagagaaagagagagtgtgtgtgtagaaaaagattgaaacatcatcaagattgatggagcaaggaggaggtggtggtggtaatgaagttgtggaggaagcttcacctattagttcaagacctcctgctaacaacttagaagagcttatgagattctcagccgccgcggatgacggtggattaggaggtggaggtggaggaggaggaggaggaagtgcttcttcttcatcgggaaatcgatggccgagagaagaaactttagctcttcttcggatccgatccgatatggattctacttttcgtgatgctactctcaaagctcctctttgggaacatgtttccaggaagctattggagttaggttacaaacgaagttcaaagaaatgcaaagagaaattcgaaaacgttcagaaatattacaaacgtactaaagaaactcgcggtggtcgtcatgatggtaaagcttacaagttcttctctcagcttgaagctctcaacactactcctcctcctcctccttctcatcctcacgctcatcaaccagaacagaaacaacaacaacaaccacaacaagagatggtcatgagctcggaacaatcatcattaccatcatcatcaagatggccaaaggcagagattctagcgcttataaacctgagaagtggaatggaaccaaggtaccaagataatgtacctaaaggacttctatgggaagagatctcaacttcaatgaagagaatgggatacaacagaaacgctaagagatgtaaagagaaatgggaaaacataaacaaatactacaagaaagttaaagaaagcaacaacagcaactacaacaacaagaatcaatgataggtgagtatgaaaaag

SEQ ID NO: 4126 - DNA, 626 bp, Artificial Sequence
  P1376 (35S::G1839)
gtttccattcattggctataaaaaccatgctcactcccttttgttcttcacaccatttgcaggaaaaaatgaatagttgtcagtctaatcccaccaaaatggataattcagaaaatgttctatttaatgatcaaaacgaaaatttcacacttgttgcaccacacccttcttcttcgtacttgacaagagatcaagagcacgagatcatggtctctgctctgcgacaagtgatatctaactccggagctgacgacgcgtcatcatcaaacttgatcatcacaagcgttccgcctccagacgctggcccttgtcctctctgtggcgtcgccggttgctacggctgcacattacaacggccgcaccgagaggtaaagaaggagaagaaatacaaaggagtaaggaaaaaaccatcgggtaaatgggcggcggagatatgggatccgagatcgaaatcaaggaggtggcttggaacgtttcttacggcggagatggcggcacaatcttacaatgatgcggcggctgagtatcgagcaagacgtggtaaaacaaacggagaaggaattaaacggcggtggagatgactgagaaggacatggtcggtgatcatacacggcgaggtggaaatg

SEQ ID NO: 4127 - DNA, 1031 bp, Artificial Sequence; identical to SEQ ID NO: 1141
  P1377 (35S::G1756)

SEQ ID NO: 4128 - DNA, 827 bp, Artificial Sequence
  P1379 (35S::G32)
cataaaggtatagtatcattattagaaagatgaacacaacatcatcaaagagcaagaagaagcaagacgatcaggttggtacaaggtttcttggggtgagaagaaggccttggggaagatacgcagctgagattagagacccaactacgaaggagcgtcactggcttggcactttcgatacggcggaagaagctgccttggcctacgatagagctgctcggtccatgcgtggcacacgtgccagaaccaactttgtttactcagacatgcctccttcctcatccgtcacctccattgtttctcctgacgatcctcctcctcctccacctcctcctgctcctcctagcaatgatcctgtcgattacatgatgatgtttaaccaatactcatccactgactcgccaatgcttcagcctcattgtgatcaagtggacagttacatgtttggtggctctcaatcttcgaattcttattgctattctaatgacagtagtaatgagctgcctcctctcccgagcgacttgtcgaattcgtgttatagccaaccacagtggacctggaccggtgacgactactcgtctgagtacgtacatagtccaatgttcagcagaatgcctccggtttctgactctttccctcaaggtttcaactactttggctcctaattctttctcatcgtccatatttaataccttcctcatttgtaccttttccttcttcttcttttttgggtttatctatgtttcgccgtccttgatctctgcctatgtgatcaaagtgactgtttgtcattagtttttcaataacaagttatcatttgtatcttg

SEQ ID NO: 4129 - DNA, 2018 bp, Artificial Sequence
  P1383 (35S::G1202)
ccaaagaaagtttttgctttcaccggccagtcatgggaaactatcggtggccgtcaaagctatcaaagttatcactcagagcaaaacaaacgaatctgtaccgcgtcattctaatcgcgatcctctgcgtcaccttttacttcgtcggagtatggcaacactccggcagaggaatctcacgctcttccatttctaaccacgagctcacgtccgtgccctgcacgtttcctcaccaaaccacaccgattctcaacttcgcctcccgtcacacagcccctgaccttcctccgacgataacggacgcgcgtgttgttcaaatcccgtcgtgcggcgttgaattctcggagtacacgccctgcgagttcgtgaatcggtctttgaatttcccaagagagaggcttatatacagagagagacactgtccggaaaaacacgagatagtcaggtgtcggattccagcgccgtacggttacagtttaccttttcggtggccggagagccgtgacgtggcgtggtttgctaacgtgccgcatacggaactaacggtggagaagaagaatcagaactgggtaaggtatgagaaggataggtttttatttcctggtggtggtacgatgtttccacgtggagctgatgcttacatcgacgagatcggacggttgataaatctcaaagatggatcaattcggacagccattgatactggatgtggggtagcgagctttggggcgtatctaatgtcgaggaacatagtaacgatgtcgtttgcaccaagagacacacacgaagctcaggttcagttcgcacttgagagaggagtccctgccatcataggagtgttagcctctattaggctcccatttccggccagagccttcgacattgctcattgctctcgatgtctcattccttggggccaatacaacgggacgtatctcatagaagtggatagggtactgagaccgggggggtattggattttgtcgggaccgccgattaactggcagagacactggaagggttgggaaagaactagagacgatctcaactcggagcagtctcagatcgagagggtggctaggagcttgtgttggaggaaattggtgcagagagaggatcttgcggtttggcagaaacctaccaaccatgttcactgtaagcgcaatcggatagctttaggacgccctccgttctgccaccggacactacccaaccagggctggtacactaagcttgaaacctgtttgacgccgttgccggaagtaacaggatctgagatcaaagaagtagcgggtggacagttggcgagatggcctgagagattgaatgctcttcctccgaggatcaaaagtggaagcttggaagggatcactgaggatgaatttgtcagcaacacagagaaatggcagagaagagtgtcttactacaagaaatatgaccaacagctagcggagacgggaagatacagaaactttctcgacatgaacgctcatcttggaggtttcgcctcagccttagtcgatgatcctgtatgggtcatgaatgttgtccccgtggaggccagtgttaacacccttggagttatctatgagcgaggattgattggaacgtatcaaaactggtgtgaagcaatgtcaacttacccaaggacatacgatttcatccatgccgattcggtgttcagtctgtacaaagacagatgtgacatggaagatatcttgctagaaatggacaggattctaagaccaaagggaagcgtgatcatcagagacgacattgatgtgctaaccaaagtgaagaagattacagatgcgatgcaatgggaagggaggataggagatcatgaaaacggacctcttgaaagagagaagattttgtttcttgtgaaggagtactggaccgcacctgcgcctgatcagtcatcagatccttgatcaagcttggaataattcataaaatttgtagctccattcttttttcttcaaatgttttgtacacactaatcgactttgggggaa

SEQ ID NO: 4130 - DNA, 2711 bp, Artificial Sequence
  P1384 (35S::G1289)
tacctgaaacgcgtctcgtaacactgatctctaatgatcttcgtctccaatggcgatatcagtacaacacgtcgtcgttttactcctctccactctcctcatcgccatcaccttcttcctcttcacctccgataacgccagattccctttcccttctctctccaccaccgattactacacaccaatcccaaaatctccaattcctcaccgaatcgtcgacgtttcttcagatcaaactccacagaagatgaagctaaacacttccctcgaggtgggagagctgaaatgggatctatgtaaaggtgcagaatctgttgattacataccttgtcttgataattacgctgccatcaagcagctcaaatcaaggagacatatggagcatcgagaacgtcattgccctgaaccaagtcctaaatgtctccttcccttgcctgataattataagccgccggttccgtggcctaagagccgggatatggtgagagacagttcctgtttttgtttttggtaagatttggttgctgctcttgatcagcttgatctgaagatacatgatttagtttagtgacccattttagtatgtgaaagtaaaggagaaagatccgttctttagagtctgatagattcaaagtttacatttttagagtattataggtggtttactctataatgtgcagatttggtatgacaatgttcctcatcccaagcttgttgaatacaagaaggaacaaaattgggttaaaaaagagggtgaatttctagtttttcctggaggaggtactcaattcaaattcggggttactcattacgttgagttcatcgaaaaggtcagcactttcttagctctgtttcccctgtttttcttgaatagaaagcatctatctttgtgttgaaatcatttcatattcacaggcgttaccgagtatcaaatgggggaaaaacataagggttgtattagatgttggttgtggtgttgctagctttggcggatctttattagataaagatgtcattacaatgtcgtttgctcctaaagatgaacatgaagctcagattcaatttgcgttagaacgaggaatacctgcaacactttctgttattggaacacaacagctcacgtttccgagcaatgcatttgatcttatacattgtgcacggtgcagagtccattgggatgctgatggtatttcttttgttccattctttttcctcttagcccatttgcttcaaggttccaatgatcattatggtttaatttgttaggtgggaaaccgttgttggagctcaatagggtacttaggccaggaggtttcttcatatggtctgcaacaccagtctatcgagataatgacagagatagcagaatttggaatggttcgcaacaatcatgttttttttatttgatcattcaacactgatgttgatctctatggttttaactgttacaattctgttttgcagaaatggtttctcttactaaatccatttgctggaaggtcgtgacaaagacggttgattcctctggaatcggacttgtgatctatcaaaagccaacatcagaatcctgttataataaacgcagcacacaagatccaccactttgtgataaaaaggaagcaaatggttcatggtaaaaaaactattacacaaaatgatgctttacattcacatataagtaatgtccactattttttgtaacatttccttctgattaattttaggtatgttcctctcgctaaatgcctttccaagttacctagtggaaatgtccagagttggcctgaactatggcctaaacggcttgtgagtgttaaaccgcaaagcatttcagttaaagcggaaacattgaagaaagatacagagaaatggtcagcaagtgtttctgatgtttacctcaaacatctagctgtaaactggtcgactgtgcggaatgtgatggacatgaatgctggttttggcgggtacatttacaatctctgaaactttaaccagaatccggtttatcccaaactgaaacttgacacaagtttttcttcttttcttctttttggtatagttttgctgctgcacttataaatctaccactctgggtgatgaatgttgtccctgtggataaacctgacactctctccgtcgtttatgatcgaggcttgatcggagtttaccatgattggtgtgagtccgtcaacacttaccctagaacatacgatctgttacattccagtttcctcctaggtgatctcacacaaaggtaaacaacagatctgagtttgtatatctatagagtttcagttctttagcagtagccagtaggcattcactgttttggttcggttcacggttagcttaaccaaagtcggagttgtcataccaaactcggtttgatattgcgaatagtgtggttaacctttaatatgtgttttttgggtcaatttcaggtgtgagattgtacaagtggtagctgagatagatcggatagtgagaccaggtggatatcttgtggtacaagacaacatggaaacaataatgaagcttgaatccatacttggttcgcttcattggtcaaccaaaatatacgaggaccggtttttggttggtcggaagggattttggcgtcccgctaaaccggagctcagatagacagaacgagagacataaacatactagcaaagtaaatttgtacactactatcaatgacgcaaccagat

SEQ ID NO: 4131 - DNA, 952 bp, Artificial Sequence; identical to SEQ ID NO: 1239
  P1387 (35S::G1865)

SEQ ID NO: 4132 - DNA, 1774 bp, Artificial Sequence; identical to SEQ ID NO: 1241
  P1388 (35S::G1868)

SEQ ID NO: 4133 - DNA, 1055 bp, Artificial Sequence
  P1393 (35S::G1226)
cagaaaacagttccattagagagactcataaagcttctcatctaattatgagtggattgatgagttttggtgaattagaagaccaatttggtcagatttcagacactactatggaagagaagataccatttctgcaaatgcttcaatgcatagaacacccttttacaacaacagaaccaaatcagtttctccaatcacttctccagatccaaaccctagaatcaaagagctgtctcacccttgaaacaaacatcaaaagagatccgggtcaaacagatgacccggaaaaggatccaagaacagaaaacggagcagtaacggtcaaagaaaaaagaaaacggaaacgtacaagagctccaaagaacaaagacgaagttgaaaaccaaaggatgactcacattgccgtcgaacgtaatcgaagacgacaaatgaacgaacacttaaactctctccgatctctcatgcctccttcgtttcttcaacggggtgaccaagcttcgattgtaggaggggcaatagatttcatcaaggaactagagcaactcttgcaatctctagaagctgagaaacgaaaggatggaactgatgaaactcctaaaacggcgtcgtgttcttcatcttcgtctcttgcatgcactaactcttctatttctagcgtgtctacgacgtcggaaaatggatttacggcgagattcggcggtggagatacgacagaagtggaggctacggtgatacagaaccatgtgagcttaaaagttcggtgtaagagaggaaaacgacagatcttaaaagctattgtctcgattgaagaactaaagcttgcgattctacatctcactatctcttcttcctttgactttgtcatctactctttcaatctcaagatggaagatggttgtaaattaggatcagcagatgagatagcgacagccgttcatcagatcttcgagcaaatcaacggtgaagtcatgtggtcaaatcttagtcgaacttagttgacttttgactcctagtaacgtgtgtaaactttaggttacaaagaaaagggacgtgat

SEQ ID NO: 4134 - DNA, 896 bp, Artificial Sequence; identical to SEQ ID NO: 233
  P1397 (35S::G259)

SEQ ID NO: 4135 - DNA, 1349 bp, Artificial Sequence
  P1399 (35S::G1850)
ttgggtattgggattaaggaaagtttagatttttgatctataactcatgccgggggaacaaaccggagaaactccgacggtggccggagttggcggcggtggagctggttgtagcgccgggaatagtggtggaagtagtggatgtggtgctggtggtggcggtggtggtagtggtggaggtggtggcggaggaggagattcacagaggtcaattccgacgccgtttttgacgaaaacgtatcagcttgtggaagatccggtttacgacgaattgatctcgtggaacgaagatggaaccacttttattgtgtggcgaccagctgaattcgctagagatcttcttcccaaatacttcaaacataataacttctcgagttttgttcgtcagctcaatacttacgtgagtctcaatatacgtttgaatcgaaattttcagttattaggttttttagtagtgagctcttattttggtttattattggttttagggatttcgaaaagtagttccagatcgttgggagttttctaatgattgttttaagagaggtgagaagattctgcttcgggatattcaacggcggaaaatctctcagcctgctatggccgcggctgctgcagcggcggcggcagccgtagcggcttcggctgttacagtagcagctgttcctgttgtagctcatattgtttctccatcgaactctggagaagaacaggttatatcgtctaattcttcgcctgcggctgctgctgctgctataggaggagtggttggtggtggttctttgcagaggacaacgagctgcaccactgcaccagagctggttgaggagaatgagcgattgaggaaagataatgagcgattgaggaaagagatgacaaagcttaaaggattgtatgcgaatatctacacattaatggcgaatttcacaccgggtcaagaagattgtgcgcatttgttacctgaagggaaacctttagatcttttaccggagagacaagagatgagtgaagccattatggcttctgaaatagagacagggattggtctgaaacttggtgaggatttgactccaaggttgtttggggtttctattggggtcaagcgagctagaagagaagaagaattgggtgctgcagaggaagaagatgatgatagacgagaagctgctgcccaagagggagaacaaagttctgatgttaaggcagagccaatggaggagaataactccggtaaccataatgggtcgtggcttgaactcggaaaatgaaaaacacttgccgattcagaggcattgttgaatatgcaagaaactgttactgatccccattgcataggcaagccattgcgc

SEQ ID NO: 4136 - DNA, 1927 bp, Artificial Sequence; identical to SEQ ID NO: 1233
  P1401 (35S::G1852)

SEQ ID NO: 4137 - DNA, 1912 bp, Artificial Sequence
  P1405 (35S::G1290)
cggtcgttgtttcttgaaattccactgttattagactcttgactctgttttgtttcccgccgatctcgtgatgatggccaccaccaccaccaccaccaccgctagattctctgattcatacgagttcagcaacacaagcggcaatagcttcttcgccgccgagtcatctcttgattatccgacggaatttctcacgccaccggaggtatcagctcttaaacttctgtctaactgcctcgagtctgttttcgactcgccggagacgttctacagcgatgctaagctagttctcgccggcggccgggaagtttcttttcaccgttgtattctttccgcgagaattcctgtcttcaaaagcgctttagccaccgtgaaggaacaaaaatcctccaccaccgtgaagctccagctgaaagagatcgccagagattacgaagtcggctttgactcggttgtggcggttttggcgtatgtttacagcggcagagtgaggtccccgccgaagggagcttctgcttgcgtagacgacgattgttgccacgtggcttgccggtcaaaggtggatttcatggtggaggttctttatctgtctttcgttttccagattcaagaattagttactctgtatgagaggcagttcttggaaattgtagacaaagttgtagtcgaagacatcttggttatattcaagcttgatactctatgtggtacaacatacaagaagcttttggatagatgcatagaaattatcgtgaagtctgatatagaactagttagtcttgagaagtctttacctcaacacattttcaagcaaatcatagacatccgcgaagcgctctgtctagagccacctaaactagaaaggcatgtcaagaacatatacaaggcgctagactcagatgatgttgagcttgtcaagatgcttttgctagaaggacacaccaatctcgatgaggcgtatgctcttcattttgctatcgctcactgcgctgtgaagaccgcgtatgatctcctcgagcttgagcttgcggatgttaaccttagaaatccgaggggatacactgtgcttcatgttgctgcgatgcggaaggagccgaagttgataatatctttgttaatgaaaggggcaaatattttagacacaacattggatggtagaaccgctttagtgattgtaaaacgactcactaaagcggatgactacaaaactagtacggaggacggtacgccttctctgaaaggcggattatgcatagaggtacttgagcatgaacaaaaactagaatatttgtcgcctatagaggcttcactttctcttccagtaactccagaggagttgaggatgaggttgctctattatgaaaaccgagttgcacttgctcgacttctctttccagtggaaactgaaactgtacagggtattgccaaattggaggaaacatgcgagtttacagcttctagtctcgagcctgatcatcacattggtgaaaagcggacatcactagacctaaatatggcgccgttccaaatccatgagaagcatttgagtagactaagagcactttgtaaaaccgtggaactggggaaacgctacttcaaacgatgttcgcttgatcactttatggatactgaggacttgaatcatcttgctagcgtagaagaagatactcctgagaaacggctacaaaagaagcaaaggtacatggaactacaagagactctgatgaagacctttagtgaggacaaggaggaatgtggaaagtcttccacaccgaaaccaacctctgcggtgaggtctaatagaaaactctctcaccggcgcctaaaagtggacaaacgggattttttgaaacgaccttacgggaacggggattaaggaatgggaaatcatattccatttcactcccacaac

SEQ ID NO: 4138 - DNA, 883 bp, Artificial Sequence; identical to SEQ ID NO: 1293
  P1406 (35S::G1950)

SEQ ID NO: 4139 - DNA, 1322 bp, Artificial Sequence
  P1407 (35S::G1863)
gtcgacccattatccttaaagtaaccaacacttctctctctctttcttcaatggatttgcaactgaaacaatggagaagccagcagcagcaacaacatcagacagagtcagaagaacaaccttctgcagctaagataccaaaacatgtctttgaccagattcattctcacactgcaacttctactgctcttcctctctttacccctgagcctacttcttctaaactctcctctttgtctcctgattcttcctccaggttccccaagatggggagcttctttagctgggcacagtggcaagaacttgaactacaagctctgatctacaggtacatgttggctggtgctgctgttcctcaggagctccttttaccaatcaagaaaagccttctccatctatctccttcctactttcttcaccatcctcttcaacacctacctcattaccaacctgcttggtatttgggaagggcagcgatggatcctgagccaggcagatgcaggagaacggatggtaagaagtggagatgttcaagagacgtcttcgctggccacaagtattgcgagcgccacatgcaccgtggccgcaaccgttcaagaaagcctgtggaaactccaaccaccgtcaatgcaactgccacgtccatggcttcatcagtagcagccgcagccaccactacaacagcaacaacaacatctacgtttgcttttggtggtggtggtggtagtgaggaagtggttggtcaaggaggatctttcttcttctctggctcttctaactcttcatctgaacttctccaccttagtcaaagttgttcggagatgaagcaagaaagcaacaacatgaacaacaagaggccatacgagtcccacatcggattcagtaacaacagatcagatggaggacacatcctgaggcccttctttgacgattggcctcgttcttcgctccaagaagctgacaatagttcaagccccatgagctcagccacttgtctctccatctccatgcccgggaactcttcctcagacgtctctctgaagctgtccacaggcaacgaagagggagcccggagcaacaacaatgggagagatcagcaaaacatgagctggtggagcggtggaggttccaaccaccatcatcacaacatgggcggaccattggccgaagccctgagatcttcttcctcatcttccccaaccagtgttctccatcagcttggtgtctcgacacaagcctttcattgaccagtgtaaaaccaacacaacaatgcggtttttactgtgtttttggtttttatccaaatttcctgtataaagagg

SEQ ID NO: 4140 - DNA, 1956 bp, Artificial Sequence
  P1410 (35S::G303)
aacgtagccattaacttttatgcattaactccttcatttctttttgtgctcgtttggttgagagagagagaggctatatatgatgttccaacaagattaccctcatggcttttcactcgtggaaacatccttaagttacgaaatgttggattactttcaaaacatcgtcgtttcgaactctgaagacgtggcgtcacagcaaaattccatttcgtcctcttcttattcatcagcgacactctcctgctccataacagagcaaaaatctcacttaactgaaaagttatctcctctacgagaaagatatggttgcggtgactttctgtcgcggaagaggagaaggagaagtgaaaaaacgattgtagataaagagaatcaaaggatgaatcacattgccgtcgagcgtaaccggagaaaacagatgaatcattttctgtctatcctcaagtctatgatgcctctctcttattctcaacctgtgagtttctttctatctttaatttagcttataggatataagcaggctaagcaatgttgataatttgatatgttcggttaaaatttagtttagacaaagagtgttaaggttccttattaaaagtaagccgttaattaaataatagtaatttagtatatttgtttttgaatcaattactaaataaaattgcgaattgataaatttttgggtttttcctataatagaatgaccaagcatcaatcatagaagggaccattagctatctgaagaagctagaacaacgtctccaatctctcgaagcccaattaaaagctactaaactcaatcaatcaccaaatatattttccgacttcttcatgttccctcaatactccaccgccactgccactgccaccgccactgcctcctcatcctcctcgagccaccaccatcacaagcgactagaggtggttgctgacgtggaggttacaatggtagaaagacatgccaacattaaagtgttaacgaagacacagccaagattgctcttcaagattatcaatgagtttaactctttaggtttaagtactcttcatctcaacctcacaacttccaaagacatgtctctcttcacttttagcgtcaaggtaatctattctcttcctctcttgttttaggggaaaaagataatatatatgattatagaagttgttagttaacataaatttatatgaaataactaaaataaggcttcttgttttaaaagtcaactatatatgctcaaaatgattggtctctgtattaggtagaggcagattgtcaattgacgccttctggtaatgaggtcgcaaatacggtgcatgaagtcgttagaagagttcacaaggaacgttgaattttgtttacatactagctaactttgaaattctattttattgtataaacaatctcttatgtgtgtaatttacatatatacaattaattaacattaaagttgtttagttttttttttttttttgttggtttactgagttaataacattgtgttgacgtctattaaattgaggatataaaatacaagcatgatgaattgatgagtatatgtaatcagttgagttttaaaaaaatatttgtgtattcttttatacactagtaaaatttggttatattcaagaaacatcagatatttaatattatggaagagctaattttaagcgcaatataataagattcacacgatgggccttctcattacaagaaatgggcctttgaaacatatctcgtatttagatcagtaaaaccggacgcggatgcgattcaattttgcataaccggatcattgttcctcgagattactgaaagctcgtgtagattacgaaatacgaacgagcctcgtctacaattaaacgctagtatcggtgaccgaaacatctgaaaaagcatgccttcattgagcggcccaacttacaaaatttctctagtttacattattcggatgg

SEQ ID NO: 4141 - DNA, 1254 bp, Artificial Sequence; identical to SEQ ID NO: 561
  P1414 (35S::G728)

SEQ ID NO: 4142 - DNA, 1538 bp, Artificial Sequence; identical to SEQ ID NO: 475
  P1417 (35S::G597)

SEQ ID NO: 4143 - DNA, 982 bp, Artificial Sequence
  P1420 (35S::G1521)
accgaacaatctctatctccggtcatgcctccattaccgtcctccacggcgccttcgtcttcgagacatcttcgatcgccggaaagtatcgcgaaatttgcagggagagcaatatttcctgctttacaggggaaatcgtgtccgatatgcctcgaaaatctaaccgagcgaagatccgccgccgtgatcacggtgtgcaagcacggatactgccttgcttgtattcggaagtggagcagcttcaagaggaattgtcctctttgtaacactcgttttgattcctggtttatcgttagtgattttgcttctagaaaataccataaggagcaattaccaattcttcgtgatcgtgagactttaacttatcatcggaataatccttccgatcgccggaggataattcaaaggtcgagggatgttttggaaaactctagctcaagatcaaggccattgccatggcggagatcatttggacgaccaggttcagttcctgattctgttatcttccagcgaaagcttcagtggcgagctagcatatacactaagcaattacgagctgttcgattacattcaaggcgcttggaactaagtttggcggtgaatgattacaccaaagcaaagataactgaaagaattgagccatggattagaagagagcttcaggcagtccttggagatcctgatccctcagttattgttcattttgcgtcagctcttttcatcaaaaggcttgagagagagaataatcgacaaaccgggcagaccgggatgttggtggaagatgaagtctcctctcttcgaaaattcttgtctgataaggtggatatattttggcatgaactaagatgttttgcggagagtatactcacgatggagacttatgatgcagtggttgaatacaatgaggtggagtaatagcagtaaaaaaaacagataaccgagcactatgctctcgtcaaatgaagtaaatagacagacttac

SEQ ID NO: 4144 - DNA, 2896 bp, Artificial Sequence
  Artificial sequence
  P1423 (35S::G1089)
aagagagcttcttaaggaagaagaagatgggttgtgctcaatcaaagatcgagaacgaagaagcagttactcgttgcaaagaacgaaaacaattgatgaaagacgccgtcactgctcgtaacgctttcgccgccgctcactcagcttacgctatggctcttaaaaacaccggagctgctctttccgattactctcacggcgagtttttagtctctaatcactcgtcttcctccgcagctgcagcaatcgcttctacttcttctcttcccactgctatatctcctcctcttccttcttccaccgctccggtttctaattcaaccgcttcttcttcctccgctgcggttcctcagccgattcctgatactcttcctcctcctcctcctccaccaccgcttcctcttcaacgtgctgctactatgccggagatgaacggtagatccggtggtggtcatgctggtagtggactcaacggaattgaagaagatggagccctagataacgatgatgatgacgatgatgatgatgatgactctgaaatggagaatcgtgatcgtttgattaggaaatcgagaagccgtggaggtagtactagaggaaataggacgacgattgaagatcatcatcttcaggaggagaaagctccgccacctccccctttggcgaattcacggccaattccgccgccacgtcagcatcagcatcaacatcagcaacagcaacaacaacctttctacgattacttcttccctaatgttgagaatatgcctggaactactttagaagatactcctccacaaccacaaccacaaccaacaaggcctgtgcctcctcaaccacattcaccagtcgttactgaggatgacgaagatgaggaggaggaagaggaggaagaggaggaggaagaggagacggtgattgaacggaaaccactggtggaggaaagaccgaagagagtagaggaagtgacgattgaattggaaaaagttactaatttgagagggatgaagaagagtaaagggatagggattcccggagagaggagaggaatgcgaatgccggtgactgcgacgcatttggcgaatgtattcattgagcttgatgataatttcttgaaagcttctgaaagtgctcatgatgtttctaagatgcttgaagctactaggctccattaccattctaattttgcagataaccgaggtaattttgattcgataaatgtctgagagaaacaaaatgattggtttagctaagattgatgtgttgttgttgtaacaggacatattgatcactctgctagagtgatgcgtgtaattacatggaatagatcatttagaggaataccaaatgctgatgatgggaaagatgatgttgatttggaagagaatgaaactcatgctactgttcttgacaaattgctagcatgggaaaagaagctctatgacgaagtcaaggtaactatatcaaaacttgtctcttttttatgcttgtgcttgtttagtgaagctgaaagattttaactttttgaggaaagattcttgcaaccatgtttagtctttttgggtaatcttctctcctgagaaaagcccctttgattgttttgggtagttttatgagcaaaaatgatatatttttctcttgagagtctaattttgggatacacttcttgttggatataggctggcgaactcatgaaaatcgagtaccagaaaaaggttgctcatttaaatcgggtgaagaaacgaggtggccactcggattcattagagagagctaaagcagcagtaagtcatttgcatacaagatatatagttgatatgcaatccatggactccacagtttcagaaatcaatcgtcttagggatgaacaactatacctaaagctcgttcaccttgttgaggcgtaagtttcgcttcttggtagatattttttcctatgatgttttagacaaattgattttgagttcttatgcaaatttttttgcaggatggggaagatgtgggaaatgatgcaaatacatcatcaaagacaagctgagatctcaaaggtgttgagatctctagatgtttcacaagcggtgaaagaaacaaatgatcatcatcacgaacgcaccatccagctcttggcagtggttcaagaatggcacacgcagttttgcaggatgatagatcatcagaaagaatacataaaagcacttggcggatggctaaagctaaatctcatccctatcgaaagcacactcaaggagaaagtatcttcgcctcctcgagttcccaatcccgcaatccaaaaactcctccacgcttggtatgaccgtttagacaaaatccccgacgaaatggctaaaagtgccataatcaatttcgcagcggttgtaagcacgataatgcagcagcaagaagacgagataagtctcagaaacaaatgcgaagagacaagaaaagaattgggaagaaaaattagacagtttgaggattggtaccacaaatacatccagaagagaggaccggaggggatgaatccggatgaagcggataacgatcataatgatgaggtcgctgtgaggcaattcaatgtagaacaaattaagaagaggttggaagaagaagaagaagcttaccatagacaaagccatcaagttagagagaagtcactggctagtcttcgaactcgcctccccgagctttttcaggcaatgtccgaggttgcgtattcatgttcggatatgtatagagctataacgtatgcgagtaagcggcaaagccaaagcgaacggcatcagaaacctagccagggacagagttcgtaagaactaatgtaagatcagagtaatgtcttcttcttctttgatcttgaatatttaagcacacacatacatacaacgtatagctaaat

SEQ ID NO: 4145 - DNA, 682 bp, Artificial Sequence
  P1441 (35S::G485)
tcctctctgatccaacggacccaaaacatctatctctctttctcgaccttttgtctcctcgatctaaagatggcggattcggacaacgattcaggaggacacaaagacggtggaaatgcttcgacacgtgagcaagataggtttctaccgatcgctaacgttagcaggatcatgaagaaagcacttcctgcgaacgcaaaaatctctaaggatgctaaagaaacggttcaagagtgtgtatcggaattcataagtttcatcaccggtgaggcttctgacaagtgtcagagagagaagaggaagacaatcaacggtgacgatcttctttgggcgatgactacgctagggtttgaggactacgtggagcctctcaaggtttatctgcaaaagtatagggaggtggaaggagagaagactactacggcagggagacaaggcgataaggaaggtggaggaggaggcggtggagctggaagtggaagtggaggagctccgatgtacggtggtggcatggtgactacgatgggacatcaattttcccatcatttttcttaattgtaaaatgataaaagcaaattttcatttttattaattaatgatatatatatatatatgtttaacttttagtataatgtttacagaattttttttttaaaactaggttcaacccactaacgtaaca

SEQ ID NO: 4146 - DNA, 626 bp, Artificial Sequence
  P1446 (35S::G1248)
catcattcgttgttgtgaatcatactgaaacgaacccctcaccaaacaagatttatagatcctctgctttaattataagattctgatggcggggaattatcattcgttccaaaatccaatccctcgataccagaattacaacttcgggagcagctcatctaatcatcaacatgaacatgatgggttagtggtggtggtggaggatcaacagcaagaagaaagcatgatggtaaaagaacaagacaggctacttccgatagcaaacgtaggaaggatcatgaagaacatcctcccagcaaacgcaaaggtctctaaagaagccaaagagactatgcaagaatgtgtgtccgagttcattagcttcgtcacgggagaagcatccgataaatgccacaaggagaagcgaaagaccgttaatggagacgatatctgttgggctatggctaatctagggtttgatgattacgccgcccagctcaagaagtacttacatcgttaccgagttctcgaaggtgagaaacctaatcatcacggcaaaggaggacctaaatcctcgccagataattaaaattcttccatcgctttttgattttccttgattaatctccatgtcatcatcttcctct

SEQ ID NO: 4147 - DNA, 998 bp, Artificial Sequence; identical to SEQ ID NO: 231
  P1447 (35S::G258)

SEQ ID NO: 4148 - DNA, 963 bp, Artificial Sequence
  P1450 (35S::G1641)
atccgttgacttgtcggcatgatttgttcttacttaccgtaaaaaaaacagagctaggttttagttttcggacatggaggttatgagaccgtcgacgtcacacgtgtcaggtgggaactggctcatggaggaaactaagagcggcgtcgcagcttctggtgaaggtgccacgtggacggcggcagagaacaaggcattcgagaatgctttggcggtttacgacgacaacactcctgatcggtggcagaaggtggctgcggtgattccggggaagacagtgagtgacgtaattagacagtataacgatttggaagctgatgtcagcagcatcgaggccggtttaatcccggtccccggttacatcacctcgccgcctttcactctagattgggccggcggcggtggcggatgtaacgggtttaaaccgggtcatcaggtttgtaataaacggtcgcaggccggtagatcgccggagctggagcggaagaaaggcgttccttggacggaggaagaacacaagctatttctaatgggtttgaagaaatatgggaaaggagattggagaaacatatctcggaactttgtgataacgcgaacgccaacacaagtagctagccacgcccaaaagtacttcatccggcaactttccggcggcaaggacaagagacgagcaagcattcacgacataaccaccgtaaatctcgaagaggaggcttctttggagaccaataagagctccattgttgttggagatcagcgttcaaggctaaccgcgtttccttggaaccaaacggacaacaatggaacacaggcagacgctttcaatataacgattggaaacgctattagtggcgttcattcatacggccaggttatgattggagggtataacaatgcagattcttgctatgacgcccaaaacacaatgtttcaactatagctaatgaagatccatctctctaa

SEQ ID NO: 4149 - DNA, 1072 bp, Artificial Sequence; identical to SEQ ID NO: 885
  misc_feature (46)..(46): n is a, c, g, or t
  misc_feature (61)..(61): n is a, c, g, or t
  misc_feature (63)..(63): n is a, c, g, or t
  P1453 (35S::G1267)

SEQ ID NO: 4150 - DNA, 754 bp, Artificial Sequence
  P1457 (35S::G1749)
caacacttctcagtgaccgtgagcaacgaattattttcagttcaacgactccgcggaaatggaaaattcagaaaatgttccctcttacgatcaaaacatcaatttcactcctaatttgacgagagatcaagaacatgtgatcatggtctctgctttgcaacaagtaatatccaacgtcggaggtgacacgaactcgaatgcatgggaagctgatcttccacctttgaacgctggcccttgtcctctttgtagtgtcaccggctgctacggttgcgtcttcccacgacacgaggcgataattaagaaggagaagaagcacaaaggagtgaggaaaaaaccatcaggtaaatgggcggcggagatatgggatccgagtttgaaagtaaggagatggcttggaacgtttccaacagcggagatggcggctaaggcttacaacgatgcggcggctgagtttgtcggaagaagatcagcaagacgtggcacaaagaacggagaggaagcatctaccaagaagacgactgagaaaaattaacggagaaggagcacgtatagaaaggcaggaagaggcatcttacttgcttcacaagtaaatcagaatttttttgaaaagtaaaaacgttattttgtttggtaataaaataaagtaaaacaaaatattgctaacgcaagacttatcaagttcagtcgtgactgtgagtgtgtttttatgtatcttacttcattttttgtctttcaattgtgtgtgtgtgtg

SEQ ID NO: 4151 - DNA, 1930 bp, Artificial Sequence
  P1459 (35S::G186)
ctttcaaccaaacccctaaacaaaaaaaaaatacattttctgatctctctaaaaatctttctccttcgttaatctcgtgatctctttctttttctatatatggacagaggatggtctggtctcactcttgattcatcttctcttgatcttttaaaccctaatcgtatttctcataagaatcaccgacgtttctcaaatcctttggcgatgtctagaattgacgaagaagatgatcagaagacgagaatatcaaccaacggtagtgaatttaggtttccggtgagtctctcaggtattcgtgatcgtgaagatgaagatttttcatctggcgttgctggagataatgaccgtgaagttcccggcgaagtggatttcttctccgacaagaaatctagggtttgtcgtgaagacgacgaaggatttcgtgtgaagaaggaagaacaagatgatcgaacggacgtaaataccggtttgaatcttcgaacaactggtaatacaaagagtgatgagtcaatgatcgatgatggagaatcttccgaaatggaagataagcgtgcgaaaaatgagttggtgaaattacaagatgagttgaagaaaatgacaatggataatcaaaagcttagagaattgcttacacaagttagcaacagttacacttcacttcagatgcatcttgtttcactaatgcagcaacagcaacaacagaacaataaggtaatagaagctgctgagaagcctgaggagacgatagtaccaaggcaatttattgatttaggccctacgagagcagtaggtgaggccgaggatgtgtcaaattcttcatccgaagatagaactcgttcggggggttcttctgcagccgagaggcgtagtaacgggaagagacttgggcgtgaagaaagccccgaaactgagtccaacaaaattcagaaggtgaattctactaccccgacgacatttgatcaaaccgctgaagctacgatgaggaaagcccgtgtctccgttcgtgcccgatcggaagctccgatgataagcgatggatgtcaatggagaaaatatggccagaagatggccaaagggaatccttgtccgcgggcatattaccgctgcacgatggccacgggctgtcccgttcgcaaacaagttcaacgttgcgcggaagacagatcaattctgattacaacctacgagggaaaccataaccatccgttgccgccagccgcggtagccatggcttctaccaccacggcggcggctaacatgttgctatccgggtcaatgtctagtcacgacgggatgatgaaccctacaaatttactagctagggctgttcttccttgctccacaagcatggcaacaatctcagcctccgcgccgtttccaaccgtcacattagacctcacccactcacctccgcctcctaatggttccaatccttcctcttccgcggctaccaacaacaaccacaactcactgatgcagcggccgcaacaacaacaacagcaaatgacgaacttacctccgggaatgctacctcatgtaataggccaggcattgtataaccaatccaagttctcggggctgcagttctctggtggctctccctcgacggcagcgttttctcagtcacacgcggtggctgatacaataacggcactcacagctgacccgaatttcacggcggctcttgcagccgttatttcttctatgatcaatggtacgaaccaccacgacggcgaaggaaacaacaaaaatcaatagaaaaatattacattttttttttgggtatctacattttttttccaactgggttataggaaacagagagtttatttcattgattcacatttgttctgtttcgtaccaaaatcccagtaaatatacaaaagcaaactatactcaagttcatattcgtaaacactataaatag

SEQ ID NO: 4152 - DNA, 1012 bp, Artificial Sequence
  P1461 (35S::G1760)
ccctaaaaaagagaagaaccagaggagattcaattagaggataaaattgatgggaagagggaagattgtgatccaaaggatcgatgattcaacgagtagacaagtcactttctccaaacgaagaaagggccttatcaagaaagccaaagagctagctattctctgtgatgccgaggtcggtctcatcatcttctctagcaccggaaagctctatgactttgcaagctccagcatgaagtcggttattgatagatacaacaagagcaagatcgagcaacaacaactattgaaccccgcatcagaagtcaagttttggcagagagaagctgctgttctaagacaagaactgcatgctttgcaagaaaatcatcggcaaatgatgggagaacagctaaatggtttaagtgttaacgagctaaacagtcttgagaatcaaattgagataagtttgcgtggaattcgtatgagaaaggaacaactgttgactcaagaaatccaagaactaagccaaaagaggaatcttattcatcaggaaaacctcgatttatctaggaaagtacaacggattcatcaagaaaatgtggagctctacaagaaggcttatatggcaaacacaaacgggtttacacaccgtgaagtagctgttgcggatgatgaatcacacactcagattcggctgcaactaagccagcctgaacattccgattatgacactccaccaagagcaaacgaataacagagagattgaagttggaagataccatgatgttgaagaacactccaaaggccttggtttgaataaggttcttgaactggaaacctctatacaccaagccacgtacgataagcagcatggttcttctaacatagtcatattttcaatcctaaatataattaaagcatatataattaaaatccggtgttgttatactcatcttgagtattaatattgtacttgtttataaccatagattcgtcaattaatagagaaaaatcatatgaattattatcc

SEQ ID NO: 4153 - DNA, 913 bp, Artificial Sequence
  P1465 (35S::G344)
tcaaatatggattcgcttcgctcctcctttatttaaaatacttgtagtgctttcatacggctagagacaaaaatggagtgtgtagaagcatttctcggtgatttttccgtcgacgatcttctcgacctctctaacgccgacacttctttagagtcgtcttcgtcacaaagaaaagaagacgaacaagaacgtgagaaatttaagagcttttctgaccaaagtacccgtctttcaccgccagaggatctcttatcttttcccggcgacgctccggttggtgatttggaggacttagagtggttatccaacttcgtggaggattctttctcagaatcgtatatttcgagtgatttcccggtgaatccagtcgcgtcggtggaggttcggagacagtgcgttcctgttaaacctagaagcaaacgccgccgcaccaacggccgtatctggtctatggagtctccatctcctctgctatccaccgctgttgccagaaggaagaagagagggagacagaaggtggatgcatcgtacggtggcgtagtccagcagcagcagctgaggcggtgctgcagccattgtggagtccagaagacgcctcaatggagaatgggtccattaggtgcgaagacactgtgtaatgcttgtggggtccggtttaagtcgggtcgacttttacccgaatatagacccgcttgtagcccaacattcaccaacgagattcactctaactctcaccggaaagtgttggagctacggctcatgaaagtggcggatccggctcgggtttaagccatttttttctatcttgaaattttatcaatgccatgtgcattgtgtaatcttgtaaacagagaatcagagagagatccgtagactgttttcacattcatgaagttaagctataattagagac

SEQ ID NO: 4154 - DNA, 965 bp, Artificial Sequence
  P1468 (35S::G1512)
tttaaacatcttccaatctctgaaagcccctctcttttctccatttcgtgcttcatcatattcgtcgtcgcttcgggtcttacctctcatggaagggaacttcttcatcaggtctgatgctcaacgagcacatgacaatggcttcatagccaaacaaaaacctaatctcaccacggctccaacagcaggtcaagctaatgaaagtggctgttttgactgcaacatctgtttagacacagcccatgatccggtggtcactctctgcgggcaccttttctgctggccttgcatttacaagtggttacatgttcagttatcttctgtctccgttgatcagcaccagaacaattgccctgtttgtaaatccaacattactatcacctctttggttcctctctatggaagaggcatgtcttcgccttcttccacgtttggctccaagaaacaagacgcactgtccactgacataccccgcagacctgctccatcagccttacgcaatccgattacctcagcatcatctctgaacccaagcttgcaacatcaaactctgtctccttcatttcataatcatcagtattcccctcgtggcttcaccacaaccgaatcaaccgaccttgccaatgctgtaatgatgagtttcctctaccctgtgattggaatgtttggagacctggtctacaccaggatattcgggaccttcacaaacacaatagctcagccttaccaaagccagaggatgatgcagcgtgagaagtctcttaatcgggtatcgatattcttcctttgttgcatcatcctttgcctccttctcttctagctctctctctctctctctctctctctctctctctctctctctctctctctctctctctctctctctcttcgtgtatagtacgtgatgtacataggctgtaaaactcgaatttactgtggtataaccactactgcagacaccgttc

SEQ ID NO: 4155 - DNA, 1472 bp, Artificial Sequence
  P1475 (35S::G988)
gaaaaagactcatttgatcgagagagaaaaagaatcatttgaaccaaaagcatctttttctatcttttcaaatgcttacttccttcaaatcctctagctcctcctccgaagatgccaccgctaccaccaccgagaatcctcctcctttgtgcatcgcctcctcctcggccgcaacctccgcctcacatcacctccgtcgtcttcttttcaccgctgcgaatttcgtctcccagtcaaacttcaccgccgctcaaaacttactctcaatcctctcccttaactcttctcctcacggcgactccaccgagcgacttgtacacctcttcactaaagccttgtccgtacgaatcaaccgtcagcaacaagatcagacggctgaaacggttgccacgtggacgacgaacgaaatgacgatgagtaactccacggtgttcacgagcagtgtatgcaaagaacagttcttgtttcgaaccaagaacaacaattctgacttcgagtcttgttactatctttggctaaaccaactaacgccgtttattcggttcggtcatttaacggcgaaccaagctatcctcgacgcgacggagacaaacgataacggagctctacatatacttgatttagatatatcacaaggacttcaatggcctccattgatgcaagccctagcagagaggtcatcaaaccctagcagtccacctccatctctccgcataaccggatgcggtcgagatgtaaccggattaaaccgaactggagaccggttaacccggttcgctgactctttaggtctccaattccagtttcacacgctagtgatcgtagaagaagatctcgccggacttttgctacagatccgattgttagctctctcagccgtacaaggagagaccattgccgtcaattgtgttcacttcctccacaaaatatttaacgacgatggagatatgatcggtcacttcttgtcagcgatcaagagcttaaactctagaatcgttacaatggcagagagagaagctaatcatggagatcactcgttcttgaatagattctctgaggcagtggatcattacatggcgatctttgattcgttggaagcgacgttgccgccaaatagccgagagagactaaccctagagcaacggtggttcggtaaggagattttggatgttgtggcggcggaagagacggagagaaagcaaagacatcggaggtttgagatttgggaagagatgatgaagaggtttggtttcgttaacgttcctattggaagctttgctttgtctcaagctaagcttcttcttagacttcattatccttcagaaggttataatcttcagttccttaacaattctttgtttcttggctggcaaaatcgtcccctcttctccgtttcgtcgtggaaatgatccaaagagaaggacaaaaaaacctatatatctaggtatatagtagacaaaaaaaaagatcga

SEQ ID NO: 4156 - DNA, 1719 bp, Artificial Sequence
  P1476 (35S::G1767)
caaagtattaaatcttagatattgtgggtctccctttcttctattcattttcttattcattaaaaaaaaaaaatggatactctctttagactagtcagtctccaacaacaacaacaatccgatagtatcattacaaatcaatcttcgttaagcagaacttccaccaccactactggctctccacaaactgcttatcactacaactttccacaaaacgacgtcgtcgaagaatgcttcaactttttcatggatgaagaagacctttcctcttcttcttctcaccacaaccatcacaaccacaacaatcctaatacttactactctcctttcactactcccacccaataccatcccgccacatcatcaaccccttcctccaccgccgcagccgcagctttagcctcgccttactcctcctccggccaccataatgacccttccgcgttctccatacctcaaactcctccgtccttcgacttctcagccaatgccaagtgggcagactcggtccttcttgaagcggcacgtgccttctccgacaaagacactgcacgtgcgcaacaaatcctatggacgctcaacgagctctcttctccgtacggagacaccgagcaaaaactggcttcttacttcctccaagctctcttcaaccgcatgaccggttcaggcgaacgatgctaccgaaccatggtaacagctgcagccacagagaagacttgctccttcgagtcaacgcgaaaaactgtactaaagttccaagaagttagcccctgggccacgtttggacacgtggcggcaaacggagcaatcttggaagcagtagacggagaggcaaagatccacatcgttgacataagctccacgttttgcactcaatggccgactcttctagaagctttagccacaagatcagacgacacgcctcacctaaggctaaccacagttgtcgtggccaacaagtttgtcaacgatcaaacggcgtcgcatcggatgatgaaagagatcggaaaccgaatggagaaattcgctaggcttatgggagttcctttcaaatttaacattattcatcacgttggagatttatctgagtttgatctcaacgaactcgacgttaaaccagacgaagtcttggccattaactgcgtaggcgcgatgcatgggatcgcttcacgtggaagccctagagacgctgtgatatcgagtttccgacggttaagaccgaggattgtgacggtcgtagaagaagaagctgatcttgtcggagaagaagaaggtggctttgatgatgagttcttgagagggtttggagaatgtttacgatggtttagggtttgcttcgagtcatgggaagagagttttccaaggacgagcaacgagaggttgatgctagagcgtgcagcgggacgtgcgatcgttgatcttgtggcttgtgagccgtcggattccacggagaggcgagagacagcgaggaagtggtcgaggaggatgaggaatagtgggtttggagcggtggggtatagtgatgaggtggcggatgatgtcagagctttgttgaggagatataaagaaggtgtttggtcgatggtacagtgtcctgatgccgccggaatattcctttgttggagagatcagccggtggtttgggctagtgcgtggcggccaacgtaaagggttgtttttattttttcataaggaattcgcaagttcgatttttacttg

SEQ ID NO: 4157 - DNA, 867 bp, Artificial Sequence
  P1477 (35S::G1841)
tctacatttttgaagacgaccctgtggttgataggttcaataggtttggcacggagatgtctgccatggtctcggccttgacacaggtggtttctgctcgctctcagactgaggctgaaggtgctcactctcagactgaggctgaaggtgctcactcttcttcctcttcggctggacataaaagaggatggcttggaatcgattctgctcctattccctcatcatttgctcgtgtagactcttcacataatccgatcgaagaatccatgagcaaggcatttccagaggaagcaagggagaaaaaaaggaggtacagaggagtaaggcagagaccatggggcaaatgggcagctgagatacgtgatccacatagagccgctagggtttggctcgggacgtttgatacagcggaggccgcggctagagcctacgacgaggctgcactccggttccgtggaaataaagcaaagctaaatttcccagaggatgtaaggattcttcctcctccccctcctcttcttcgttcaccagctgacacggtggcgaataaagcagaagaggatctgataaattattggagttatacaaagttgttgcaaagttcaggccaacggtcatttctcgagcgaggacaagaagagagtagtaacatatttgaacattcaccaatggaacaacctctgcctccttcaagttctggtccaagttcctctaattttcctgcaccttctctacctaatacatagtttcacttttattaaagctctacaaatacaattaaatacatagctaaatgaaaatgattttcttgtctgtataccttcttaagtgctaaacaatatattgtactctttgttttccttaact

SEQ ID NO: 4158 - DNA, 2321 bp, Artificial Sequence
  P1479 (35S::G158)
gaagaagaagagattttgattttggtttaatatatagttggggattaacaggatgggaagggtaaaattgaagataaagaagttagagaacacaaatggacgccaatctacatttgctaaaaggaaaaatgggatcttgaaaaaggctaatgagctatctattctttgtgacattgatattgttcttcttatgttctctcctactggcaaggctgcaatatgttgcggtacacgaaggtaatctatctaatgtgtcttcctttgttttgtttgttgtcaacataatcattgtctctcttggattgtgttatctgaatgtattatgattgttcttcagtagcatggaagaggtgattgctaagttttctcaagtaacaccgcaggaaagaacgaaaaggtttggtgttttcttatcgatatgtttttgtttgtttctccggcaatggttggtcttgttttactcattggtttcatcttttttgaatacaggaagttcgagagtcttgaagtaagtttattttcacataatcaaatgaagtttttggttaattttgatccttgagaatctctgattttagatgtttctctttcgaaagctcagaacttgaagaaaactttccaaaagttggatcacgatgtaaatatacgcgaatttatagcctcaaggtatgtccggaaacagttttatatcaaaatctcttgcaagaaactctatatgaatattaacttcttttcttctctcttgtttgcttttggttctttggtttcagtaattcaacagtagaggtattggttttaagactctctttccatttctaacgtctatgacatttgccaaagcctaaatttatacaaaacaaccttttttcaggacttgagtactcaagcaaggattctgcaggctcggatttctgagatacatggaagattaaggtaaagatcttgctgaggatgatagttctttgttctcttgatgtctgtgctcttttttatacttgttagtgtcatgttctgcagttattggacggaaccagataagattaacaatgttgaacacttgggacagctcgaaatttcgattaggcaatcccttgatcaattgcgtgcacacaaggtatcttttgtttaaaacttttccatttcacttcatccgcgaaacaaaaaactaaaaactcttctgttgataggaacattttgggcagcagcaacaggcaatgcaaatagaaaacgcaaactttgttaaggattggtcaacatgctcggtaatttactcgaatgactcttctttagttctcatttgtaacaaaacaaattgtaaacccggctgtacaactttcagatgcaagatgggattcagattcctttagaacaacagcttcaatctatgtcatggattcttaatagcaacaccaccaacattgtcaccgaggaacacaattcaatcccgcagaggttagtgaaaactctcaccgagagaacttttctttcttttaatattgaatcatatcttaaaaccaaatctttgtctatcctcaaaagggaagtcgagtgctcagcgagttcttcattcgggagctatccaggctactttggaacagggaaatctcctgaaatgacaattccgggtcaagaaacaagctttcttgatgaactaaacaccggacagctgaaacaggacacaagctcgcagcagcagttcactaataataataatatcacagcatacaatcccaatcttcacaatgatatgaatcatcaccaaacgttgcctcctcctcctcttcctcttactcttccgcatgctcaggtgtatattccaatgaatcagagagagtatcatatgaatggattctttgaagcaccaccacctgattcttctgcttacaacgacaacaccaaccaaaccaggtttggttctagcagcagctccttgccttgctcaatctcaatgttcgacgaatacttgttttcccaggtaaccaaaacaaaactttctcagagattctaaatgggtttttgttttgtagactgatttgacaatttgttcttctttcttatagatgcagcagccgaactgagagagatttgatgaatgatgataaaacatctcactgaagaaactcaaaccaatattttttttcagaaacagcaagaaagctaaaactctgccgatttctgaattggttccaagaagaaaaaaaccagtggtaatccctggtagattgtgcaaccaaaccacacacaatacgtgttcatttattttttctatatcttcaatagatgtcacttaattcttttctatacataatttctcagtcaga

SEQ ID NO: 4159 - DNA, 1270 bp, Artificial Sequence; identical to SEQ ID NO: 1339
  P1482 (35S::G2059)

SEQ ID NO: 4160 - DNA, 3131 bp, Artificial Sequence
  P1489 (35S::G585)
gttctacaactcaagacaaggttctctaggtttttcttgattccattgattttttcttataaactcatataaggtttcttgatcttctttaaaagttcaattttttttctcttcttcttgaagttcttgattagttcaagaaaatgttttgtttgttttctttattcgatttgatatttgtttttgtttttctatatataaaaagagttttagaatggggagatggatactataatggagatatcaaaacgaggaagacgattcaagcttcggagatcaaagctgatcagcttggtctacggaggagcgagcagcttagcgagctttacgagtctctctccgtcgctgaatcttcttcttcaggcgttgctgccggatctcaagtcaccagacgagcttccgccgccgcactttcaccggaagatctcgccgacaccgagtggtactatttggtttgtatgtctttcgtcttcaacattggtgaagggtaattccgtcttttcctctatcagcattgacatttattatgtgtcatgatcgtgttgatctttgccagttttaaacaacgtgccaaaatatacttttaatactagtaggtccaaggatttcgacttttatggttcagtttaggtttgttagatttcagggttctgcaggaaaaaagtatgagctagaaccaattttttagtttcagtttggtttcaaaatttaatgtccggatttggtcggtttcagattacaaaagaaaaagttaaaacataattaattttaaataataatgtgtatatatatgcattagtatgtttaactctattctacatctaataaattttattaattcggtttggttgcagtatatttgtgttcgattcgagtttagttcggtttatttatcatcacaaaagtttgtttctgtccggattaattaaaaaattcgtttcattttggtctttatgaacacggctaattaactttcaataattatgaatatgttaggaagaaaaaatgtggaaaaattaagcttagaatgcattgctgctttctaaatgaacctgtctttttgcagaatgcctggacggacgtttgcaaacggtgaaccgatatggttgtgcaacgctcatacggcggatagtaaagtgtttagccgttctcttctagcaaaagtaagttgtagtattgatgtagttgctatgtaacacttttttgcgatttgaaaacactaaaatcgttcgtttttgtttgcgttttgtggtggtttagagtgctgcggttaagacagtggtttgcttcccgttccttggaggagtcgttgagattggtaccacagaacatgtaagccaatatttgtgttttctgcttccaatgttttagaataattattatgaaaatcctttattaagaaaaaaagaataattataaaattaccacaatgtattctaacatttcaatttgacccttcaatctgtcgaataacggtatagacaccaagaacacacaaactaatattttagtagtctcgatttttaaagatttccacggtttggttatgacaaaacgcgaaaatacggcttttgtactttttactagctcgttggtatagttataattgaaaactttttcaaggctttttcttggtgtgtttcgtctcgtagattacggaagacatgaatgtaatacaatgcgtgaagacatcattcctcgaagcccctgatccgtacgctacaatattaccagcaagatccgattatcacatcgacaacgttcttgatccgcaacagattctaggcgacgagatttacgcgcctatgttcagtacggagccttttccaacagcttctccgagcagaactaccaacggtttcgatcaagaacatgaacaagtagcagatgatcatgattctttcatgaccgaaagaatcactggaggagcttctcaggtgcaaagctggcagctcatggacgacgagcttagtaactgcgttcaccagtcgctaaattccagcgattgcgtctctcaaacgtttgttgaaggggcggctggacgggttgcttacggtgcaagaaagagtagagttcaaagactagggcaaattcaagagcaacagagaaatgtgaagacattgtcatttgatccaagaaacgacgacgttcattaccaaagtgtgatctcaacgatttttaagaccaaccatcagttaattctcggaccgcagtttcgaaactgcgataaacagtcaagcttcactaggtggaagaaatcatcgtcatcatcatcaggaaccgccacggtcacggcaccatcacaaggaatgttaaagaaaattattttcgatgttccgcgagtgcaccagaaagagaagttaatgttggactcaccagaagccagagatgaaactgggaaccatgcggttttagagaagaagcgccgcgagaaattgaacgaacggttcatgaccttgagaaaaatcattccgtcaatcaacaaggtatatttatataatcgattcttcaaaatttcaaatccatatatatcgcgaggtaactaatcttatgtttaacattttcgatagatcgataaagtatcgattcttgacgatacgatagagtatcttcaagaactcgagagacgggttcaagaactagaatcttgcagagaatcaaccgatacagagactcgtgggacgatgacgatgaagaggaagaaaccatgcgacgcaggagaaagaacatcagctaattgcgcaaataatgaaacaggaaatgggaagaaggtgtcggttaacaatgttggtgaagccgagccagcagataccggttttactggtttaaccgataatttaaggatcggttcgtttggtaatgaggtggttattgagcttagatgtgcttggagagaaggagtattgcttgagataatggatgtgattagtgatctccatttggattctcattcggttcaatcctcgaccggagacggtttgctctgcttaaccgtcaattgcaaggtatactctctaacctacttttggcttaaccaggatttggttaacctagattgacatgaaatgtgttggtttcagcacaaggggtcaaaaatagcgacaccaggaatgatcaaagaagcacttcaa

SEQ ID NO: 4161 - DNA, 1243 bp, Artificial Sequence; identical to SEQ ID NO: 1283
  P1492 (35S::G1938)

SEQ ID NO: 4162 - DNA, 809 bp, Artificial Sequence
  P1496 (35S::G1888)
gaaaatagaaagatgaagatttggtgtgctgtttgtgataaagaagaagcttcggtgttttgttgtgcggatgaagcagctctttgtaatggttgcgatcgccatgttcatttcgccaataaactagccgggaaacatctccggttctctctcacttctcctactttcaaagatgctcctctttgtgatatttgcggggagaggcgtgcattattattttgccaagaagacagagcaatactatgcagagaatgtgacattccaatacatcaagctaatgagcacactaagaaacacaatagattcctccttaccggcgttaagatctctgcctccccgtcagcctacccaagagcctccaattccaactctgctgctgcatttggtcgagccaaaacccgaccaaaatcagtatcgagcgaggtcccgagctcggcctccaatgaggtatttacgagctcttcttcgacgaccacgagcaattgctattatgggatagaagaaaactaccatcacgtgagcgattcggggtcgggatcgggttgtacaggtagtatatccgagtatttgatggagacattaccgggttggagagtggaggatttgcttgaacacccttcttgtgtctcctatgaggataacattattactaataacaataacagtgagtcttatagggtttatgatggttcttcacaattccatcatcaagggttttgggatcacaaacccttctcttgaacttatttctgtcgaattatagtcttttttttataagttggggtttgtaatcatgaatccaaaccaac

SEQ ID NO: 4163 - DNA, 977 bp, Artificial Sequence
  P1497 (35S::G325)
agaagtatggaggctcgatgtgacttttgtggaaccgaaaaagcattaatctactgcaaatctgattcggctaaactttgtttaaactgtgacgttaatgtacactcagcgaatcctctgtctcaaagacacacgcgatctctactctgcgagaaatgttccttacaacccacggcagtacactgtatgaacgaaaatgtttctctttgccaaggatgtcagtggaccgctagtaactgcactggtttaggacacagacttcagagtctgaacccttactctgattgtccttctccatcagatttcggcaagatctggtcttcaactttagaaccttctgtcacaagtttggtctctccattttctgataccctgctccaggaattagacgattggaatggttcatcaacttccgtggttacacaaactcagaaccttaaagactattcttctttctttcctatggaatctaatcttccaaaagtgatagaagaggtgacgtgttgtttaagtaatatatcaaaatgtttcatttatgataaagaagaatgtttttcatttatattccgttctatatgcaggaatgttctggtttggatctatgcgaagggataaacttagatgatgcgccgttgaatttcaacgcaagcaatgatataatcggatgttcatcacttgacaataccaaatgttacgagtacgaggattcttttaaggaagagaataacattggccttccttcattactgcttcctactttatccgggaacgttgtaccgaacatgtcactttcgatgtctaacctcacaggagaaagcaatgcgactgattaccaagattgcggaatttcaccagggtttctcataggagattcgccatgggaatcgaatgttgaagttagttttaatccaaaattaagggatgaggctaaaaagagatacaaacaaaagaaatcaaagcgcatgtaagtttttgag

SEQ ID NO: 4164 - DNA, 673 bp, Artificial Sequence
  P1498 (35S::G362)
acccatcgataaacacatacgttcacacatatatgtctataaatccgacaatgtctcgtactggcgaaagttcttcaggttcgtcctccgacaagacgataaagctattcggcttcgaactcatcagcggcagtcgtacgccggaaatcacgacggcggaaagcgtgagctcgtccacaaacacgacgtcgttaacagtgatgaaaagacacgagtgccaatactgcggtaaagagtttgcaaattctcaagccttaggaggtcaccaaaacgctcacaagaaggagaggttgaagaagaagaggcttcagcttcaagctcggcgagccagcatcggctattatctcaccaaccaccaacaacccataacgacgtcatttcagagacaatacaaaacgccgtcgtattgtgcattctcctccatgcacgtgaataatgatcagatgggtgtgtacaacgaagattggtcgtcgaggtcgtcgcagattaacttcggtaataatgacacgtgccaagatcttaatgaacaaagcggtgagatgggtaagctgtacggtgttcgaccgaacatgattcagttccagagagatctgagttctcgttctgatcagatgagaagtattaactcgctggatcttcatctaggttttgccggagatgcggcataacaaat

SEQ ID NO: 4165 - DNA, 1285 bp, Artificial Sequence
  P1499 (35S::G375)
aaaaactctcactctccctcaaactaaacaaacatacagaacacaaaatgggtctcacttctcttcaagtttgcatggattctgattggctccaggaatccgagtcatcaggaggaagcatgttagactcttcaacgaattctccgtcagcagccgacatactagcagcttgcagcactagaccacaagcctcggccgtggctgtagccgctgcagctctgatggacggtggaaggaggctgcgtccacctcacgaccatcctcaaaagtgtcctcgttgcgagtcaacacatactaagttctgttactacaataactacagcctctctcagcctcgttacttctgcaagacttgtcgccgttactggacaaaaggcggaactctaaggaatattccggttggtggtggatgccgtaaaaacaagaaaccatcttcctctaattcctcctcctccacttcttccggcaaaaaaccatccaacatcgttaccgccaatacctctgatcttatggctttagcacattctcatcaaaattaccaacattctcctctagggttttcacattttggtgggatgatggggtcttactcaactccggagcatggtaacgttggtttcttggagagcaagtatggcggtttgctttcgcagagccctagacctattgatttcttggacagtaagtttgatctcatgggagtgaacaatgacaacctggtcatggttaatcatggaagtaacggagatcatcatcatcatcataatcatcacatgggtctgaatcacggtgtaggtcttaacaacaacaacaacaatggtggatttaatgggatttctacgggaggcaatggaaatggtggtggtctcatggatatatcgacatgccaaagacttatgctatctaattatgatcatcaccattacaatcatcaagaagatcatcaaagggtagcaacaataatggatgtgaagccaaatccgaagttgttatcgcttgattggcagcaagatcaatgctactccaatggtggtggtagcggaggcgcaggaaaatccgacggtggtggatacggcaatggtggttatatcaacggtttaggttcgtcgtggaatggtttgatgaatggctatggaacgtccactaaaacaaactccttggtttgataagttaatcagaacttcttttttcttgtcgtcatcaactagtagtagtagtaatagtagttggagactagagaagcacttcaaattatttatgggtttgtttgctaagccagttttac

SEQ ID NO: 4166 - DNA, 1381 bp, Artificial Sequence
  P1500 (35S::G1255)
tgttggttgtgtagactttgtatacaatgatgaaaagtttggcgaatgctgttggagcgaagacggcgagggcttgcgacagctgcgtgaagagacgtgcacggtggtactgcgcggccgacgatgcttttctttgccagtcttgcgacagtttggtccattcagcaaaccctcttgctcgccgccacgagagagtccgtttgaagacggctagcccggcggtcgtaaagcatagcaaccactcatcagcttctcctccacatgaggtcgccacgtggcatcacgggtttactcgtaaagctcgaacgccacgtggctctggtaagaaaaacaattcgtcgatatttcatgacttggttcctgatattagtattgaggatcagacagacaactatgagcttgaagagcagctgatctgtcaagtgccggttctagatccgttggtgtctgagcagttcttgaacgatgtcgttgagcccaagatcgagtttcctatgatcagaagtggtttgatgatcgaggaggaggaagacaacgctgaaagttgtcttaatggatttttcccgaccgacatggagcttgaggagtttgctgctgacgtggagactctgctcggtcgcgggttagacacggagtcgtatgccatggaggagctagggttatctaattcagagatgttcaaaatcgaaaaagatgagattgaagaagaagtagaagagataaaagccatgagcatggatatatttgatgatgatcgaaaagacgtggatggaacagtaccgtttgagctaagctttgattacgagtcgtcacacaagacgtccgaagaagaggtaatgaagaacgttgaaagtagtggtgaatgtgttgttaaggtgaaagaggaagaacataagaatgttctgatgctaagattaaactatgactcggtgatatccacttggggaggtcaaggtccaccgtggagttcaggagagccaccggaacgagacatggacatcagcggttggccagccttttccatggtggagaatggaggagaaagtactcatcagaagcaatacgttggtggatgtttaccatcaagtgggtttggagatggaggtagagaagctagagtttcgagatacagagagaagaggaggacaaggttgttttctaagaagatacggtacgaggtacgtaaattgaatgcagagaaaagaccacgaatgaaaggaagattcgtgaagagagcctcgctcgctgctgctgcttcaccattaggtgttaattactgaatagttaatatctattcatgttatatctcactttacaaatttcggtgaatcttttttcttctgaaacaacagaagttattttggcacttaattgtgctttg

SEQ ID NO: 4167 - DNA, 476 bp, Artificial Sequence; identical to SEQ ID NO: 757
  P1505 (35S::G1012)

SEQ ID NO: 4168 - DNA, 1818 bp, Artificial Sequence; identical to SEQ ID NO: 1173
  P1506 (35S::G1793)

SEQ ID NO: 4169 - DNA, 765 bp, Artificial Sequence; identical to SEQ ID NO: 1377
  P1507 (35S::G2115)

SEQ ID NO: 4170 - DNA, 1019 bp, Artificial Sequence; identical to SEQ ID NO: 1389
  P1508 (35S::G2130)

SEQ ID NO: 4171 - DNA, 947 bp, Artificial Sequence
  P1510 (35S::G974)
ttaattccctcctctcagaaatctacacagaggttttttattttataaacctctttttcgattttcttgaaaacaaaaaatcctgttctttactttttttacaagaacaagggaaaaaaatttctttttattagaaatgacaacttctatggatttttacagtaacaaaacgtttcaacaatctgatccattcggtggtgaattaatggaagcgcttttaccttttatcaaaagcccttccaacgattcatccgcgtttgcgttctctctacccgctccaatttcatacgggtcggatctccactcattttctcaccatcttagtcctaaaccggtctcaatgaaacaaaccggtacttccgcggctaaaccgacgaagctatacagaggagtgagacaacgtcactggggaaaatgggtggctgagattcgtttaccgaggaatcgaactcgactttggctcggaacattcgacacggcggaggaagctgctttagcttatgacaaggcggcgtataagctccgaggagattttgcgcggcttaatttccctgatctccgtcataacgacgagtatcaacctcttcaatcatcagtcgacgctaagcttgaagctatttgtcaaaacttagctgagacgacgcagaaacaggtgagatcaacgaagaagtcttcttctcggaaacgttcatcaaccgtcgcagtgaaactaccggaggaggactactctagcgccggatcttcgccgctgttaacggagagttatggatctggtggatcttcttcgccgttgtcggagctgacgtttggtgatacggaggaggagattcagccgccgtggaacgagaacgcgttggagaagtatccgtcgtacgagatcgattgggattcgattcttcagtgttcgagtcttgtaaattagatgttgccataggggtattttaggg

SEQ ID NO: 4172 - DNA, 1124 bp, Artificial Sequence
  P1511 (35S::G504)
cgtcgacctcttgacgatcatgagactgatttcgtgaaaatatcgtcattatatcaaattagaagttgatggaaaacatgggggattcgagcatagggccgggccatccgcatctccctcccgggtttcggtttcacccgactgatgaggaactagtagttcattacctcaagaagaaagcagattctgttccacttccagtctcaatcatcgcagagattgatctttacaagtttgatccttgggagcttccaagcaaggcgagttttggagagcacgagtggtacttctttagtcctcgggatcggaagtatccaaatggggttaggccaaaccgggcagcaacttccggttattggaaagcaacgggaaccgataaaccgatatttacgtgcaatagtcacaaggttggtgtcaagaaagcgcttgttttttacggtggaaagcctcctaaagggataaaaacagattggatcatgcatgaatatcgcctcactgatggtaaccttagcactgcggctaagccgcctgacttaaccacgacaaggaaaaactcactacggctagacgattgggttctatgtaggatctataagaagaatagttcacaaagaccaacaatggagagagtattacttagagaggatctaatggaaggcatgctctcaaaatcatctgctaattcttcttctacatcagtactagacaacaacgacaacaataataacaataacgaagaacactttttcgacggtatggtcgtttcttcagacaaacgttccttgtgtggtcaataccgaatgggccacgaggcctcaggatcatcttcattcggatctttcttatcgagcaagaggtttcatcatacaggtgatctcaacaatgataactacaatgtctcttttgtttcgatgcttagtgagattcctcagagttcggggtttcatgcaaatggtgttatggatacgacgtcgtctctagctgatcatggggttttaagacaggcgtttcagcttcctaacatgaactggcactcataatctatatagatatatatgtgtgtatcatatatgtatctatgcaggcctaatatagtttacacataaatcatctggggcggccgc

SEQ ID NO: 4173 - DNA, 2022 bp, Artificial Sequence; identical to SEQ ID NO: 713
  P1517 (35S::G958)

SEQ ID NO: 4174 - DNA, 1382 bp, Artificial Sequence
  P1520 (35S::G963)
tcccatatcatatcttcttcagagtctcatctttttaattatatatagtcaccttcatatgtcgtacgaacatcctaatcactttaattaatctctctcatctctttctctctcgttttctaacgcatacactttgaatggcgcccatgagtttgcctccaggattcaggtttcatcccactgatgaagaactggtggcttactatcttgataggaaggtcaacggccaagccattgagctcgagatcatcccagaagttgatctttataaatgcgagccatgggacttgcctggtacgatccaactctttatatctctctctatatatggttcagcttgtttatgtcaatctgacgttatagattacatatattggtcatgatgcattcatacatatgatattggaggttttatgagttatttatttggataatacgcggaacagaaaagtcatttttgccgggaaacgacatggaatggtacttttacagcacaagggataagaagtatccaaatggctctaggacgaaccgtgcgacccgagcgggttactggaaggccacggggaaagatcgtacagtagaatcaaagaagatgaagatgggaatgaagaagacactggtttattatagaggaagggctcctcatggccttcgtactaattgggtcatgcatgaatatcgtctcacgcacgctccttcctcctccttgaaggtaaattatttcccatgcacaaacttctattaacatatatatctatattcatttctgatctaatttttttttttttgataaaccatatcgactaatattaatgttgatctaaaacaggagtcgtatgcattgtgccgagtgtttaagaagaacatacaaattccaaagagaaaaggggaagaagaagaagcagaagaagagagcactagtgtaggaaaagaagaggaagaagaaaaggagaagaagtggagaaaatgtgatggtaattatattgaagacgagagcttgaaaagagcatccgcggagacatcttcatcagagctaactcaaggggtccttttagacgaagcaaacagctcatccatatttgctcttcatttctcatcttctcttctggacgatcatgatcatcttttctcaaactattctcatcagcttccatatcatcctcctcttcaactccaagatttccctcaactttctatgaacgaagcagagattatgtcaatccaacaagactttcaatgcagagactctatgaacgggacacttgacgaaatcttctcttcttccgccactttccccgcttccctttgataaatccatatctcatactatcatctagtacttcttttctcaacttatttaaatatactcgggtacttca

SEQ ID NO: 4175 - DNA, 982 bp, Artificial Sequence
  P1523 (35S::G1453)
cgtcgacgcgaaataaatcctagaaaataactatcaatatgatgaaggttgatcaagattattcgtgtagtataccgcctggatttaggtttcatccgacagatgaagaacttgtcggatattatctcaagaagaaaatcgcctcccagaggattgatctcgacgttatcagagaaattgatctttacaagatcgaaccatgggatctacaagagagatgtaggatagggtacgaggagcaaacggagtggtatttcttcagccatagagacaagaagtatccgactgggactaggacaaaccgagccaccgtggccggtttctggaaagcaacgggccgggacaaggcggtttacctcaactccaaacttatcggtatgagaaaaacgcttgtcttttaccgaggtcgagcgcctaatggccaaaagtccgattggatcattcacgaatactacagcctcgagtcacaccagaactctcctccacaggaagaaggatgggtagtgtgtagagcatttaagaaacgaacgaccatcccaacaaaaaggaggcaactttgggatccgaactgcttattctacgacgacgccactctcttggaacctctcgacaagcgagccagacataatcctgattttaccgccacaccgttcaagcaagaactactctccgaggccagtcacgtccaggatggagatttcggatctatgtaccttcaatgcatcgatgatgatcaattctcccagcttcctcagctcgagagcccctctcttccgtcggaaataactccccatagtactactttttctgagaacagtagccggaaagatgacatgagctccgagaagaggatcactgactggagatatctagataagttcgtggcgtctcaatttttgatgagtggagaagactaaaaaaggctttcctatgcatgcatgcactagaaacgtcgtcgcattttggatttacatgcggccgc

SEQ ID NO: 4176 - DNA, 1142 bp, Artificial Sequence; identical to SEQ ID NO: 997
  P1528 (35S::G1463)

SEQ ID NO: 4177 - DNA, 1066 bp, Artificial Sequence; identical to SEQ ID NO: 999
  P1530 (35S::G1465)

SEQ ID NO: 4178 - DNA, 1633 bp, Artificial Sequence
  P1533 (35S::G2505)
tatataatcaagaacttgtagctgcttagaaagaaaggcagtggttaaatgttttaagctgtctttagttggagacaagagaaggaaaacgtaaatcgaaatgggttcttcgtcgaacggaggagtgccacctggtttccggtttcatccgacggacgaagagcttctccattactacttgaagaagaaaatttcttaccaaaagtttgagatggaagtcatcagagaggttgacttaaacaagcttgagccttgggatttgcaaggtactcttttacttaaacatatcacaattcattcattgcttattaattggtatcattttttgagactttgataggtcttcttgacttcttaattattggatatatatatacatgaacagttcattgttatacaattctctaatttgtatgttatctttttattttttggaagagagatgcaagataggatcaacaccacaaaacgaatggtacttcttcagccacaaggacaggaaatatccgacggggtcaaggaccaaccgtgctactcatgcagggttctggaaggcgacgggacgtgacaagtgcataaggaactcttacaaaaagataggaatgaggaagacacttgtgttctacaaaggtagagctcctcatggccaaaagactgattggatcatgcatgagtaccgtcttgaagacgctgatgatcctcaagccaaccctagtgtatgtcttttatttgagcaatatttaaattataatatagatcattatcattattcaaacagtgaaatttcacagaatctctgatttccatactaggttttctaatattgttgttaaatatgaatataataaatgtcttttaataagtatctacaacaattttccgaagctttaaaaatagtttgagagtgcactgtatattatgctgcgttaaattcaatttattggttaggaaggtggtctattaaatttaatccatttgcaacatattttatacgatcatgtaggaagatggatgggtggtatgtagagtgttcatgaagaaaaatttgttcaaggtagtaaatgaaggtggctcaagcattaactcattggaccaacacaaccatgatgcatctaacaacaaccatacacttcaagctcgtagctttatgcaccgagacagtccataccagctagtacgtaaccacggagccacgacattcgaactcaacaagcctgaccttgctcttcatcaatacccaccaatcttccacaagccagcttcacttggatttgactactcttcaggacttgcaagagacagtgagagtgcggctagtgaagggttacaataccagcaagcgtgtgagccgggtttagacgttggtacatgtgagacagtggctagtcataatcatcaacaaggtctaggtgaatgggcaatgatggatagacttgtgacttgtcacatgggaaatgaagattcctctagagggattacgtatgaggatggtaacaacaattcttcctctgttgttcagccagttcccgcgacgaaccagcttacattgcgtagtgagatggatttctggggttattctaaatagatgtttatatgtctttcttatgagtctacgacaatataagtgttggtt

SEQ ID NO: 4179 - DNA, 929 bp, Artificial Sequence
  P1534 (35S::G1765)
cgtcgacaagaatgacttgattggtgttctaaagagatcgatgtagtgaagatgagtggcgaaggtaacttaggtaaggatcatgaagaagaaaacgaagcaccacttcctgggttcaggtttcatccgacggatgaagagcttttaggatactatcttcgaagaaaagtagagaacaaaaccatcaaactcgaacttatcaaacagatcgatatctataagtacgatccttgggatcttccaagagtgagcagcgtcggagaaaaggagtggtacttcttctgcatgagaggtaggaaatacaggaatagcgttcgaccaaaccgagtgaccggttcaggtttctggaaagccactggtattgataaaccggtttactccaatcttgactgtgttggtctcaagaaatctctggtttactatcttggttcagccggtaaaggcaccaaaaccgattggatgatgcatgaattccgcctcccctccaccacgaaaaccgactctccagctcaacaagcagaggtatggacactttgcagaatcttcaaacgagtcacatctcaaagaaacccaaccatcttaccaccaaaccgaaaaccggttatcactttaaccgacacttgttctaagaccagcagcttagattccgaccacacgagccaccgtacagtagattccatgtcccacgagccgccgcttccacagccacagaatccttattggaaccaacatatagttggttttaatcaaccgacatatactggtaatgataataacctcctgatgagtttctggaacggcaacggtggagatttcataggagactcagcaagttgggatgaacttagatctgttatagatggcaacactaaaccctagtaataaagtttccttttttcagctttgtacaaaaagataaaacaaacggc

SEQ ID NO: 4180 - DNA, 1822 bp, Artificial Sequence
  P1537 (35S::G1452)
gttctgtccaataatacataaccacgttatcatttttgtcctttactatctcattacactcttctgttattcgcccaattcttacagtcattgtccacgtcatcctttttccctctgaagccgccaaatatcaaaaaacacaaaacctttacccgaagcaaagtagctgcacacttgccatttataaggcatgtttcttcatctaaagcaaagtattttcgagttcctgagccaaaaagatcaaacaatgtctaaagaagctgagatgtcgatcgcggtgtcggctttgttccctggttttagattctctcctactgatgttgaacttatctcgtactatcttcgtcgtaaaatcgatggtgatgagaactctgttgctgtgattgctgaggtcgagatttacaagttcgagccgtgggacttgccaggttttacttcggttttctttctctttatgtttactttggttcactaatttgaatgtttgtgcctataaaacagaggaatcgaaactgaaatcggagaacgagtggttttacttctgcgcgagggggaggaagtacccgcacgggtcacaaagccggcgagccacacagctaggatattggaaagcgaccggtaaagagcggagtgttaaatccgggaaccaagttgttggaaccaagagaacgcttgtatttcatatcggtcgggctcctcgtggcgagagaacggagtggattatgcatgaatactgcatccatggagccccacaggttcttaaaactttcattttgaataggttgagttttaatgttttgagatatattgaaatttggatttcacaggatgcattagtggtgtgccggttaagaaaaaatgctgattttcgggctagttcgacccaaaaaatggaggatggtgttgtgcaagacgatggctacgttggccaaagaggtggtttggagaaggaggacaaatcctactatgaatctgagcatcagataccaaatggtgacatcgcagaatcatcaaatgttgttgaggtcagcttgcttttgaggaatgtgtcttttaacgatgtttaatactggtaaaattatccgctccaatcttaatcgaaaccacattaaattcaatatagttccgaaaacagaaccgattaagaaactaaaaccaaaccaacaccatagtaccatactataacggattcatagtacattagatttcactaaagttgttattttactaaagcagattctaaacttaaaacgtaacaaaccaatatatccaatgtttggtttttattttggctactaatattataactcaatagactaaaccaacacttgggctgaacatccttagttttcttgtactggtagagtttagagtttgtaactgaagttgatctctttctattgcgatgcaggatcaggccgataccgatgatgattgttacgccgagattctgaacgatgatataataaagctcgacgaagaagcgttgaaagctagccaagcgtttcgaccaactaatccaactcatcaagaaacaatatcaagcgagtcatcgagtaagaggtcaaaatgtggtataaaaaaagaatcaacggaaacaatgaattgttacgctttgttcaggatcaagaacgttgccggaaccgactccagctggagattcccgaacccgttcaaaatcaagaaagatgatagccagagattgatgaagaatgttctggccactactgttttcttggctatcttattttctttcttttggactgtattaatagctaggaactaaagctagttacgacatacatattatttatacataaat

SEQ ID NO: 4181 - DNA, 736 bp, Artificial Sequence
  P1540 (35S::G898)
cggctcaaggtgattatagcgatcatcgaatcaaattgattgaagaggtacaaaggttagttactttgagctgaaagatgaacacgtcagaggtgagagtacctcgaggaaatcgacggaggaaagctgtgattgatctgaatgcggtacctgttgatcaagaagggacctctgcttctgttagaactcttacggtgcctattacaccgtctcagcctgctcctacgatgattgatgtcgatgctattgaggatgatgttattgaatcatccgctagtgcttttgctgaagctaaaagcaaatcaagaaatgcacgtcggagacctttgatggttgatgtagagtcaggaggtacgactagattccctgccaacataagcaacaaacgcagaaggattccttctagtgaatctgtcatcgactgtgagcatgcctctgtaaatgatgaagtcaacatgtcttcgagagtgtctagatcaaaggctccagctcctccaccagaagagccaaagtttacatgtccaatctgcatgtgtccctttacggaggagatgtcaaccaagtgcggtcacatcttctgcaagggatgtataaagatggcaatatctcgccagggcaaatgccctacttgtaggaaaaaggttactgcaaaagagctgattcgagttttccttccaaccactagatgagtggtccggcaacatcaccagcaaccctgtctaatggtttatcagac

SEQ ID NO: 4182 - DNA, 1431 bp, Artificial Sequence
  P1541 (35S::G1531)
cctctaaacgtcttcagccaaggtatatatatttctccatttcgttaatcttaattatggttgtgtgtttttttttcttcttctgatttctcatattgatatctcactgatctgttgaaatttgggggataatattgttaacgggtgaccaatacagtactacagttacatgaaccaatatagttttgtaacggacccaaattcttgcaattttgttgaatacccttttgttctcatatattaaataaaaaatttgatttattttcgttcattctaaggtttgagaggtttaggccttggcgatgattgggccgtcatgtttatcgtatagagagtaggcctgttcagaaatctttgccatcaattacttactttatgtactcgtcgttggtctggaatttgagtctaagctcattaataagaggattgacaaataaacaaacgttttgatacgtatagttcaattttgattttctaatcatccaagtatccaactattttctatttggttttcttatgaatttgtttattgcataatttcttgatgaatgttgttttttggttaatgttgaaataatttagcttgagagaagcctaaagaaaatctaaaatgtgtgagtcaagcaacaaagtcagagtatcgccatacccgcttcggtcttcgaggaccgacaaacacaaggcgtcagagtcgcctattgagacaggttgggaggatgtgcggtgtgtaatctgcatggaaccacctcacaatgctgttcttttgacatgctcttcttcttctagtggatgtcatccttacatgtgcgatacgagtgttcgtcactccaattgtttcaagcagttccgcagaaaaaccataaaaaagcgcctataccccaagaccttacattgtcctctctgtagaggtgaagtatccgagacgacaaaggtgacgagcactgcaagaagatttatgaatgctaaaccgaggtcttgctccgtagaggattgcaaattctctgggacgttttctcagcttactaagcacttgaaaactgagcatcgcggtattgtgccaccaaaggtcgatccactgagacaacagagatgggaaatgatggagagacattctgaatacgttgaactcatgactgcagctgggatttcgcgtatggctgaggtgatgcaacaacagcttccccaggatcagaatcatcctcatgtgtttcaagtgaccgttaatggaaccatatggaatctaattgatccgagtcagggaaggaatggattaggcatcaccaactatagcgcaatgcagtttgtaccattaagcataaatcacagtagaactctgtgaagaattctaacttgtttagtgaaaacccaagtttaaagttttgatgatctcaatatcttactttcattagttgggatccataatgtttagaa

SEQ ID NO: 4183 - DNA, 1081 bp, Artificial Sequence
  P1549 (35S::G1835)
ctgcacaccactactaagaacaacagagctagagagacttgcaataattgtaaaacatgattggaacaagcttccccgaggatcttgattgtggcaacttctttgacaacatggatgatctcatggactttcccggtggagatatcgatgtcggtttcggcataggtgactccgactctttccctaccatctggaccactcatcacgacacgtggcctgccgcttctgatcctctcttctcttccaacaccaactctgattcatcacctgagctctatgttccgtttgaggacattgttaaggtggaaagacctccaagctttgtagaggaaacattggttgagaagaaggaagattcgttttcgacaaacactgattcatcatcttctcatagccaattcaggagctcaagtccagtgtcggttctcgagagcagctcctcctcgtctcaaaccaccaacacaacctcccttgttctccctggaaagcacggtcgtccacgcacaaaacgccctcgtccacctgtccaggataaagatagagtcaaagacaatgtgtgcggtggtgactcgcgcctcatcattagaataccgaaacagtttctctctgatcacaacaagatgatcaacaagaagaagaagaagaaggccaagattacttcttcctcttcttcgtccgggattgatcttgaagtcaatggaaacaacgtcgattcgtattcttcagagcaatatccgcttaggaaatgtatgcactgtgaggtcaccaagactccacagtggaggcttggtccaatgggtccaaagacactttgcaatgcgtgcggtgtacgttacaaatcagggaggcttttcccggagtaccgtccagctgctagtccaacatttactccagctcttcactcaaactcacacaagaaagtggctgaaatgagaaacaagagatgcagtgatggtagctacataaccgaagagaatgatctgcaagggctgattccgaacaatgcctacattggcgtagactaaaacatagagaagatgattcgatttccatgcgttgaagtgattagatatgccaggag

SEQ ID NO: 4184 - DNA, 2004 bp, Artificial Sequence
  P1554 (35S::G1777)
gtactttatcacctccgtcgttctataatactctcttccgtcaatcatatcatttgtcgacaatttcattctgatcagtttaaaaattgatccatggatgataatttaagcggcgaggaagaagattactattactcctccgatcaggaatctctcaacgggattgataatgatgaatccgtttcgatacctgtttcttcccgatcaaatactgtcaaggttattacgaaggaatcacttttggctgcacagagggaggatttgcggagagtgatggaattgttatcggttaaggagcaccatgctcggactcttcttatacattaccgatgggatgtggagaagttgtttgctgttcttgttgagaaagggaaagatagcttgttttctggtgctggtgttacacttcttgaaaaccaaagttgtgattcttccgtttctggttcttcttcgatgatgagttgtgatatctgcgtagaggatgtaccgggttatcagctgacaaggatggactgtggccatagcttttgcaataactgttggactgggcattttactgtaaagataaatgaaggtcagagcaaaaggattatatgcatggctcataagtgtaatgctatttgtgatgaagatgttgtcagggctctagttagtaaaagccaaccagatttagctgagaagtttgatcgttttcttcttgagtcgtatatcgaagataacaaaatggtgaagtggtgtccgagtactcctcattgtgggaatgccatacgtgttgaggatgacgagctctgtgaggttgaatgctcttgtggtttgcagttctgtttcagttgttcatctcaagctcactccccttgctcttgtgtgatgtgggaactatggagaaagaagtgctttgatgagtccgagactgttaattggataactgttcacacaaagccgtgtcccaaatgtcacaagcctgttgaaaagaatggtggatgcaatctcgtgacttgtctttgtcgacaatctttttgttggttgtgtggtgaagctactggaagggaccacacttgggctagaatctcgggtcatagttgtggtcggttccaagaagataaagagaaacaaatggagagagcgaaaagggatctcaagcggtatatgcattatcataaccgatacaaagcacatatcgactcctccaagctagaggctaagcttagtaataatattagtaaaaaggtgtctatttcagaaaagagggagttacaacttaaagacttcagctgggctaccaatggactccatcggttatttagatcaagacgagttctttcatattcataccctttcgcattttacatgtttggagatgagctgtttaaagatgagatgagctctgaggaaagagaaataaaacaaaatctgtttgaggatcagcagcagcagcttgaggctaatgttgagaaactttctaagttcttggaggaaccttttgatcaatttgctgatgataaggtcatgcagataaggattcaagtcatcaatttgtcagttgcggtcgatacactctgcgaaaatatgtatgaatgcattgagaatgacttgttgggttctctgcaacttggcatccacaacattactccatacagatcaaacggcatagaacgagcatctgatttttatagttcccagaattccaaggaagctgttggtcagtcttcggattgtggatggacgtccaggctcgatcaagctttggagtcagggaagtcggaagacacaagttgctcttccgggaagcgtgctagaatagacgaaagttacagaaacagccaaaccaccttactagatttaaacttgccagcggaagccattgagcggaaatgaacacttatccttcttcacctcccaataacaccctttttgtccaaataaagtgtgttacccggatatttatagctctaaacccaatcccctctgcttaatttgtcagtgaccttacctaaccctcttcag

SEQ ID NO: 4185 - DNA, 917 bp, Artificial Sequence
  P1556 (35S::G580)
ctattctgttctgttctccaatgttgtcatcagcaaagcataataagatcaacaaccatagtgccttttcaatttcctcttcatcatcatcattatcaacatcatcctccctaggccataacaaatctcaagtcaccatggaagaagtatggaaagaaatcaaccttggttcacttcactaccatcggcaactaaacattggtcatgaaccaatgttaaagaaccaaaaccctaataactccatctttcaagatttcctcaacatgcctctgaatcaaccaccaccaccaccaccaccaccttcctcttccaccattgtcactgctctctatggctctctgcctcttccgcctcctgccactgtcctcagcttaaactccggtgttggattcgagtttcttgataccacagaaaatcttcttgcttctaaccctcgctcctttgaggaatctgcaaagtttggttgtcttggtaagaaaagaggccaagattctgatgatactagaggagacagaaggtataagcgtatgatcaagaacagagaatctgctgctcgttcaagggctaggaagcaggcatatacaaacgaacttgagcttgaaattgctcacttgcagacagagaatgcaagactcaagatacaacaagagcagctgaaaatagccgaagcaactcaaaaccaagtaaagaaaacactacaacggtcttccacagctccattttgagaaaaatctactatttctttttgggggagtttcaagtgtttcttatgaagatgagaaaaacagaaaaagtttgtacattttagctaagttaaatttgtggtggtaagtaatgtaaaagaaaagtgtgtgtagaagaaaagtgtctagaaaaagaaagcaactaactttcttcttcttctctggtttcctatc

SEQ ID NO: 4186 - DNA, 1449 bp, Artificial Sequence
  P1557 (35S::G571)
caaacatcatcctatatatagacttctcttcatcatcatcaaatgcaaggtcatcaccagaatcatcatcaacacttatcatcatcctccgccacgtcttcccatggaaacttcatgaacaaagatgggtatgatattggagagatagacccatcactcttcctctatcttgatggacaaggacatcatgatcctccatcaactgctccttctcctttacatcatcatcacacaactcagaatttggcgatgagacctccaacatcgacgctcaacatctttccatctcagcctatgcacatagagccacctccttcttctacacacaataccgataatacaagattagttccggctgctcaacctagtggttccactcgaccagcttctgacccgtccatggacttgaccaatcattctcagtttcatcaacctcctcaaggttctaaatccatcaagaaggaagggaaccgcaagggtcttgcctcatcggaccatgacatacctaaatcgtcagaccctaaaacattgagaagactagcacaaaacagagaagcagcaagaaaaagcagattacgtaaaaaggcttatgttcagcaactcgagtcatgtaggatcaaactgacccaactagaacaagagattcaacgggccagatcccaaggcgtattctttggagggtctcttataggaggagatcaacagcaaggtggactacccattggccctggcaacatcagctctgaagcagcggtgttcgatatggaatatgcgaggtggctggaggagcagcagaggctattaaacgaactaagggtggcaacacaagaacacttgtccgagaacgagcttaggatgtttgtggacacatgtttagctcattatgaccatttgattaacctcaaggctatggtcgctaagaccgatgtcttccacctcatttctggagcatggaaaactccagctgaacgttgcttcttgtggatgggtggtttccgtccatcggagatcattaaggtgattgtgaaccagatagaaccattgacggagcaacagatagttgggatatgtgggctgcaacagtccacacaagaggccgaggaggctctctcgcaaggcctcgaggcgttgaatcaatcactttccgatagcattgtctctgactccctcccgcctgcctccgcaccacttcctcctcatctatccaatttcatgtcacacatgtccttagctctcaacaagctctctgctctcgagggcttcgttctccaggcggataatttgaggcaccaaacgatccataggctgaaccaattgttgacgacccgtcaagaagcacggtgtcttctagccgttgcggagtacttccaccgtcttcaagctctaagttctctctggctagcccgtcctcggcaagatggataatactaaaacaactgatgaaggaaa

SEQ ID NO: 4187 - DNA, 1431 bp, Artificial Sequence
  P1559 (35S::G1806)
ccatcatcttcttcttctaagaatcaacaacaatgcagagcagcttcaaaaccgttcctttcactcctgatttctactctcagtcttcttacttcttcagaggagatagttgtcttgaggagtttcatcaaccagtcaatggttttcaccatgaagaagctatcgatttaagtccaaatgtcactattgcttcagctaacttacactacacgacgtttgatacggttatggattgtggtggtggtggtggtggtggcttgagggagagacttgaaggaggagaagaggagtgtttggacacagggcaactagtgtaccagaaagggacaagattagtaggaggaggagtaggagaagtgaacagcagttggtgtgattcggtttcagctatggctgataacagtcaacatactgacacttccacagatattgatactgatgacaagactcagttgaatggaggtcatcaagggatgctattggctacaaattgttcagatcaatccaatgtgaaatctagtgatcaaaggacacttcgtcgacttgctcagaaccgggaggctgctaggaaaagtcggttgaggaaaaaggcatatgttcagcaacttgagaatagtcgaatcaggcttgcacagctagaggaagagctcaaaagagctcgccaacagggatctttggttgaaagaggagtttcagcggatcacacgcatttggcagccggaaatggtgtcttttcatttgaattggaatatacacgttggaaggaagaacatcaaagaatgatcaacgacttaagatcgggtgtgaattcgcagttaggtgacaacgatctacgcgttctagtggatgctgtgatgagtcactatgatgaaatattcaggctaaagggaattggtactaaagttgacgtctttcatatgctctcaggcatgtggaagacacctgccgagagatttttcatgtggttaggtggatttagatcatcagagttacttaagatattggggaaccatgtggatccattgacggaccagcagttgataggcatttgcaaccttcagcaatcgtctcaacaagcagaggatgcattgtcacaaggcatggaagctctacaacaatcacttctcgagacgctttcttctgcttcaatgggtccaaactcttcagcaaatgttgcagattatatgggtcatatggctatggctatgggcaaacttggcactcttgaaaacttccttcgccaggctgatttattgaggcaacaaactctgcaacagcttcacagaattctcaccacacgacaagctgctcgcgcctttttggtcatccacgattatatttctcggcttagagcacttagctctctatggttagccagacctagagactaaataaaaagcctgcatgagtcatgatgaccaaaggaaaagg

SEQ ID NO: 4188 - DNA, 1073 bp, Artificial Sequence
  P1560 (35S::G1322)
acattcgtcgatcatcttcccgcctcgagtatctctctctctctctctcttctctgttttctttattgattgcatagacaaaaatacacacatacacaacagaaagaaagatggagacgacgatgaagaagaaagggagagtgaaagcgacaataacgtcacagaaagaagaagaaggaacagtgagaaaaggaccttggactatggaagaagatttcatcctctttaattacatccttaatcatggtgaaggtctttggaactctgtcgccaaagcctctggtatgcttttttgcacgtattcaaatcatgttttgatgatgttttctatgtatataactaaattttgtttttattttgttaataaggtctaaaacgtactggaaaaagttgtcggctccggtggctgaactatctccgaccagatgtgcggcgagggaacataaccgaagaagaacagcttttgatcattcagcttcatgctaagcttggaaacaggtcttatatagtttcactaattagtacatgcatacgtaaatcaaatcttaaacctaattttatgttgctaagtaatattataatatgcattaggtggtcgaagattgcgaagcatcttccgggaagaacggacaacgagataaagaacttctggaggacaaagattcagagacacatgaaagtgtcatcggaaaatatgatgaatcatcaacatcattgttcgggaaactcacagagctcggggatgacgacgcaaggcagctccggcaaagccatagacacggctgagagcttctctcaggcgaagacgacgacgtttaatgtggtggaacaacagtcaaacgagaattactggaacgttgaagatctgtggcccgtccacttgcttaatggtgaccaccatgtgatttaagatatatatatagacctcctatacatttatatgccccagctgggtttttttgtatggtacgttatttggtttttctattgctgaaatgtcgttgcatttaatttacatacgaaaagtgcattaaatcattaaatcttcaatacatatggaggtggtgtttgag

SEQ ID NO: 4189 - DNA, 943 bp, Artificial Sequence
  P1562 (35S::G1789)
aaggactctgcgacatctgtgcaacatatcatttcctcagaatctctttcttttctaggtttattactacacaaaaccaaacatcatcaactttagttactaaacaatggcatcaggctcaatgtcttcttatggctctggctcatggactgttaagcagaacaaagcctttgagcgtgctctagcagtctatgaccaagacactccggaccgttggcacaatgttgctagagctgttggtggtaaaacaccagaagaagctaagagacagtatgaccttctagttcgtgacatcgaaagcatcgagaatggtcacgtgccattccctgactacaagactactacaggaaacagcaacagaggcaggctgcgtgatgaggaaaagaggtatatttgttgcaatctaataagacacaatttatgctaataacaagtaatcaactttgtttatccataatagcccactataagatacttctatagacaagttctattccaataccatgacaagaaaacataaagggcatgtctgtttcagcataaagcttgttactttacagagattctcttgactttctatcatattgagttataagaggctctaaatcagccaagtgttctcttctcagtgttcttcaggctttatcagaaccaaaactaaaagctcccacaacaaaaaatatgcctagaaatagaatcattccttgtcaatatggtatctaatattaatcgattcccaaatctttcccctaagaaacttccagaaacaaaaataaacccactcatcatcatgaaactcgaaccaacaacattttaacctgtttaacattttttttttttattgcaggatgagaagcatgaagctgcagtgagacaagaagcaacaaaacctaactacgtatgatcgtcaaaataaaagagaatcacttcagagagatgtgtt

SEQ ID NO: 4190 - DNA, 892 bp, Artificial Sequence
  P1564 (35S::G211)
actcatagagatcacgaaaccctagtggaaagagagaaagctttgttgaagacggcggagatgatgtcatgtggtgggaagaagccagtgtctaagaaaacaacgccgtgttgcacgaagatggggatgaagagaggaccatggacggtggaggaagacgagattcttgtgagcttcattaagaaagaaggtgaaggacggtggcgatcgcttcctaagagagctggtttactcagatgtggaaagagctgtcgtctacggtggatgaactatctccgaccctcggttaaacgtggaggaattacgtcggacgaggaagatctcatcctccgtcttcaccgcctcctcggcaacaggtggtcattgatcgcgggaaggataccgggaaggactgataatgaaattaagaactattggaacactcatcttcgtaagaaacttttaaggcaaggaattgatcctcaaacccacaagcctcttgatgcaaacaacatccataaaccagaagaagaagtttccggtggacaaaagtaccctctagagcctatttctagttctcatactgatgataccactgttaatggcggggatggagatagcaagaacagtatcaatgtctttggtggtgaacacggctacgaagactttggtttctgctacgacgacaagttctcatcgtttcttaattcgctcatcaacgatgttggtgatccttttggtaatattatcccaatatctcaacctttgcagatggatgattgtaaggatgggattgttggagcgtcgtcttctagcttaggacatgactagatacaggaagatatatagttgatcgaatcttgatgtcttctatatctaccatgcttcaagaaggggtcacagatgcgatgcg

SEQ ID NO: 4191 - DNA, 1818 bp, Artificial Sequence
  P1567 (35S::G1246)
ttgaatcggcaagggaagaagctatgatcatgtacggaggaggaggagcagggaaggacggtggatccaccaatcacttatcagacggaggagtgatattgaagaaaggtccatggacggcggcggaagatgagatacttgctgcgtacgttagagagaacggtgaagggaattggaacgccgttcagaaaaacacaggtttggctcgttgcggcaaaagctgccgtcttcgatgggccaatcacctccgaccaaatctgaaaaaaggctctttcaccggtgacgaagaacgtctcatcattcagcttcatgctcagcttggtaacaaatgggctcgcatggctgctcagttaccgggaagaacagacaacgagattaagaactattggaacacgagattgaaacgacttcttcgccaaggacttcctctttatcctccagatattatccctaaccatcaactccatccacatccacatcatcaacaacaacagcaacataaccatcatcatcatcatcatcaacaacaacaacaacatcaacaaatgtattttcaaccacaatcttcacaacgaaacacaccatcatcttcccctcttccatctccaacaccagcaaacgcaaagtcctcatcatccttcacttttcataccacgactgctaacctcctccatccacttagccctcacactccaaacacaccatctcaactctcttccacaccgcctccaccaccactttcctctcctttatgttcccctcgcaacaaccaatacccgacccttcccctctttgccctcccgcgttcccaaatcaacaacaacaacaacggaaatttcactttccctagacctccacctctccttcaaccgccttcatcactcttcgcaaaacgttacaacaatgctaacactcctcttaattgcatcaaccgcgtctcaaccgcaccattttcccctgtttcaagagactcctacacttcctttcttacattgccttacccttccccaaccgctcaaaccgctacttaccacaatactaataacccttactcttcctctccttccttctctttaaacccttcttcttcttcttaccctacatcaacttcttccccaagctttcttcactcccattacactccttcttccacctcatttcataccaacccagtttactccatgaaacaagagcagctcccttcaaaccaaattccccaaatagatggcttcaataacgtcaacaacttcacagacaacgagagacagaatcataaccttaacagttccggtgctcatagaagaagtagtagctgcagcctcttagaggatgtcttcgaagaggccgaagctttagcctctggaggcagaggccgacctccaaaacgaagacaactcacagcttctcttccgaaccacaacaacaacaccaacaacaacgacaacttcttctcggttagtttcggacattatgattcttctgacaacttatgttccttgcaagatttgaaatcaaaggaagaagagtctcttcaaatgaacacaatgcaggaggacatagctaagcttcttgattggggaagtgatagtggagagatctctaatggacaatcatctgttgtcactgacgacaatcttgttcttgatgttcatcaattagcttcactattcccggctgattctacagccgtcgtagccgcaacaaacgaccaacacaacaagaataataacaataattgttcctgggatgacatgcagggaataaggtagaaactatgtctgaaaagaatctacggccaagatcaagaactaacaaagc

SEQ ID NO: 4192 - DNA, 485 bp, Artificial Sequence; identical to SEQ ID NO: 7
  P1572 (35S::G2133)

SEQ ID NO: 4193 - DNA, 941 bp, Artificial Sequence
  P1576 (35S::G21)
ctctctaaagcttcttctctcataacaatggcaagacaaatcaacatagagagtagtgtttctcaagttacctttatctcctccgccatccccgccgtatcttcctcctcctccatcaccgcttccgcctcattgtcctcttcacctactacatcttcctcttcttcgtcatcaacaaattctaacttcattgaggaagacaactctaaaagaaaagcatctcgaagatcattgtcatcgttagtctccgttgaagacgatgatgatcaaaacggtggaggtgggaaacggcgaaagaccaacggtggagataaacatccgacgtatagaggagtgaggatgaggagttggggaaaatgggtgtcggagattagagagccgagaaagaaatcaagaatctggctcgggacttatccaacggctgagatggcagctcgagctcatgacgtagcggctttagccattaaaggtacaacggcttacctcaattttcccaagttagccggcgagcttcctcgtccagtcacaaattctcctaaagacattcaagccgccgcctctttagcggccgttaactggcaagattcggtcaacgatgtgagtaattctgaagtggctgaaatagttgaagccgagccgagtcgagccgtggtggctcagttgttttcttcggacacaagcacgacgacgacgactcagagtcaagagtattcggaagcttcgtgtgcttcgacttcggcgtgtacggacaaagacagtgaggaagagaagctgtttgatttgccggatttgtttaccgatgagaatgagatgatgatacgaaacgatgcgttttgctactactcgtccacgtggcagctttgtggagccgatgctgggtttcggcttgaagagccgttttttctatctgaatgactaaagtacccctctcgagagagctc

SEQ ID NO: 4194 - DNA, 539 bp, Artificial Sequence; identical to SEQ ID NO: 1399
  P1577 (35S::G2138)

SEQ ID NO: 4195 - DNA, 1561 bp, Artificial Sequence
  P1578 (35S::G1838)
cagattttcaactaggaaaaaagttacaatcttttttgatggctcctccaatgacgaattgcttaacgttttctctgtcaccaatggagatgttgaaatcaactgatcagtctcacttctcttcttcttacgacgattcttctactccttatctcatcgataacttctatgctttcaaagaagaagctgagatagaagctgctgctgcttcaatggcggattcaacaaccttatctacttttttcgatcattctcagactcagattccaaagctggaagatttcctcggtgattcctttgtccgttactctgataaccaaacagagacccaagactcttcttctctcactccattctacgatccacgtcaccgcaccgttgccgaaggagttacagggttcttctctgatcatcatcagccagatttcaagacgataaactcgggaccagaaatcttcgatgactcaacaacttccaacatcggtggtactcatctctccagtcacgtggtggagtcatcaacgacggcgaagttagggtttaacggtgattgcaccaccaccggaggagttttgtctctaggggttaacaacacatcagatcaacctttgagctgtaacaatggcgagagaggtggaaacagtaacaagaagaaaacagtttctaagaaggaaacatcagatgattcaaagaagaagattgtcgaaacattgggacaaagaacttcaatttatcgtggagtcacccgacatagatggactggaagatacgaagcgcatctatgggataacagctgtaggagggaaggtcaagccagaaaaggacgtcaagtgtacttaggtggatatgacaaggaagatagagcagctagagcctatgacttggcagctttaaaatactggggttctactgctactacaaattttccggtctcgagttattcaaaagaacttgaggaaatgaatcacatgaccaagcaagagtttattgcatctcttaggaggaaaagtagcggtttttcgagaggagcttcaatatatagaggtgtcacaaggcatcatcaacaaggtcgctggcaagcaagaatcggccgtgtcgcaggaaacaaagatctttacctcggaacctttgcaaccgaagaggaagcagcagaggcttatgacattgcagccataaagttcagaggaatcaacgcagtaactaactttgagatgaacaggtatgacattgaagctgtcatgaatagttctttacctgtaggaggagcagctgcgaaacgccacaaactcaaactcgctcttgaatctccttcttcatcatcctctgaccataacctccaacaacaacagttgcttccgtcctcttctccctcggatcaaaaccctaactcaatcccatgtggcattccatttgagccttcagttctctattaccaccagaacttctttcagcattatcctttggtctctgactctacaattcaagctcctatgaaccaagctgagtttttcttgtggcctaaccagtcttactaaatcatttggttcgttcttgcttagac

SEQ ID NO: 4196 - DNA, 1749 bp, Artificial Sequence
  P1581 (35S::G1919)
tctctagctctttactaatttatcgatttgtctttctgatttttgttttgtcattttcaagaaaacaatggagtacgatggacggagaccctactctgttctaacgagaaatgaaattaccgtaaagatgaagaaacagatcaatgaaatctctgacatcttcttcatatcaaactccgatgcgaccgtacttcttatgtatctccgatgggactcgcttcgtgtttcagagcgtttaggtgaaaacaaggagaaattattgatggattcaggtttgaaatcagtcatgatcgatcccagtccagattcatctagcgagattagcttggagactgatgtttatgagtttgatggtgataatgatttaatctccatgcccttttgttctcacaagttcgactcaaaatattggagagagtatcttgagaagaatttctactatgtggagaaaatccaaaccacaatctcttgtcctgatcaagattgtcgatctgcggttggaccagacacgattgagaaactaacagtacgtgatcaagagatgtacgagaggtacatttggagatcttacattgaaggaaacaaggtattgatgatcaaacagtgtcctgcacggaattgcgattatgttattgagtttcatcaagagaatgatgatgatgatgagtatagtttaaacgtggtgtgtatctgtggtcatatcttctgttggagatgcagacttgagtcacacagaccagtgagttgtaacaaggcctctgattggttgtgtagtgccacaatgaaaatatcagatgaatcatttagcctttatccgaccaaaaccaagacagtgacttgccctcattgcctctgttctctggagtctgatacaaaaatgccccagttcttgacttgtgtctgcaggtttcaccctaattttgacaattacatagaattggatttctctgtttaagtcttgatccttactcttttgtgttatcttgctttaggcttcgtttctgttcgaggtgtttgcggtcagaggaagcccacaaaattgaagcagtagactctggattctgtattaaaacagaagtggggattttatgtgaggatcgctggaacgtgtgtcagaagttactggagcaagccaaatccgatctagaagctttcgaggaaaccaacatcaagaaaccgagtgacttattaagggagcaagacattatgattataagagaagggttgatgttgattgttcaatgcagacgagtccttaaatggtgttgtgtgtatgactatttccacacagagtatgagaactcgaaggagtatctacgatacctccaaggaaatgcaatcgccacgctccagagttactcaaacactttacaagagcaaaaagatatcgtcctcgctgcagctacttatgaagagtgtactttcttcagacatacgatacctactgcgacaagcaacattggtaactacttttatgattttatgaaaactttacaagatggtttggtcgatgtaaaggtgaagtcatacaacggcgggactggtcctttctggtactgtgatcgctgcacgtatgcaaacacttgggaggataatgagtgtgagatgtgctatgatgatagtgcctctcttgtgggagagataagtgatttgtttcttaacaaagtttcttaaaaacacgagggaggcatgaaactttcaacttgtatattttacaattgttttgctctgcaatataataatcgagac

SEQ ID NO: 4197 - DNA, 1011 bp, Artificial Sequence
  P1582 (35S::G2084)
gcgcatccatcttcaccgtttcatacgaaactctttacgaggagtctctctttacttttctctctctctcaaagaaagaaagaaaagcctcttttaattttctccggccagagtgtgtgggatgcacaaggaaagagggaaaatgccggtttctagcaacagaaatagagtatcgccatacccgcttcgctcttgcaggaacaagaaacaaaaagaagtcgaggcgtcgtcgtcacctgttgagttagagagtgttagtgaatgggaggatgtgaggtgtgtgatttgtatggagcctcctcacaatgctgtcctcttgcaatgctcttctttctccaaaggatgtcgtgcttacatgtgtgatacaagcgctcgtcactccaattgtttcaagcagtaccgcagaagcaacagctcaagccgttgtagtggcaagactctacattgtccctactgcagaggagaggttcaggggactatgaagtcgacttgtgctcggagattcatgaatgctagaccgaggtgttgtactgttgacaagtgcgatttctcagggacctatgcgcagctgaaaaatcacttgaaaactgagcatcctggttttacaccgccaaagttagacccttgggagcaacacatgtgggagcagttggagagagaggcggagtacattgaaatgctcaacgctcgtcagagatgggatgcagaacagagattgttggcgacttctctccatcagcttccatatcgtcatcccatgattgatctcaactttgatgcgttggtgcataatctgtttcttggtgcgtccatggagagccgtgcaagcaccgacaattacccggctcacataccccgtctggagttccatgcccccatgtatcccagatggacgccatgaagattctgagtgccagagtctatgaggaattcttccaaaagttttgatgtctcttgatttttatcataatgtaatgttcttgtagcgacatcagttcttgttctaggcat

SEQ ID NO: 4198 - DNA, 1148 bp, Artificial Sequence
  P1584 (35S::G1917)
cttcactccaacgtgaaacctgcaaactgaacttatctcttcatattttctttagcttctcttaattttacacttagggttttcaaaccagtagagagagagagaagtgtgtaagagcgatgatgcagactccgtacactacttcaacgcaggggcaatattgtcattcttgtggaatgttccaccaccatagccaaagctgctgctacaacaacaacaacaactccaacgccggttcttactcgatggtcttctccatgcaaaacggtggcgttttcgagcagaacggtgaggactatcatcactcttcctccctcgttgactgcactctctctcttggaactccttctacgaggctttgtgaggaagatgagaaacgtagacgctctacttcatctggtgcttcttcttgcatctccaacttttgggacttgattcacaccaaaaacaacaactccaaaacggcaccgtacaataacgttccttctttctccgctaacaagccaagtcgcggttgttccggtggtggtggtggcggaggaggcggtggcggaggtgactctcttctcgctagacgctgtgccaactgtgacactacttctactccactatggaggaatggtcctagaggccctaagtccctatgcaacgcatgcggcattcgtttcaagaaggaagagagaagaactactgcggctacaggaaacaccgtcgtcggagctgcaccggttcaaaccgaccagtacgggcatcacaactctggctacaataattaccatgctgccactaataacaacaataataatggtactccgtgggctcatcaccactcgacgcagagggttccgtgtaattatccggcaaatgagatcaggttcatggatgattacggcagtggagtagcaaacaacgttgaatccgacggtgctcacggcggtgttccgttcctttcttggaggcttaatgtagcggatagggcaagtcttgtccatgactttaccagatgaaaggagaatagaaaacgacgttagattctcttaaaatttccatgtggtttaattatgtctaattaaaaaaaaaccaagaaaatatttctgaaaaaaatagaagtgtatatcgagagacgatgttgatgtttattgatagtg

SEQ ID NO: 4199 - DNA, 778 bp, Artificial Sequence
  P1600 (35S::G1471)
ttttacaaaacaaattgtaatggagaaccaatctatgtcttcatcaagctcctccacacacaaacatgatcaaaaactcaaaagttccgttgtggccatggaggtcctggaggagaaggagacagtgaacaatccgccccagtattataataagatctacatctgttacttgtgcaagagagcgttcccaacccctcatgcccttggcggtcacggaaccacccacaaggaggaccgagaattggagaggcaacagatcgagtcaaggctttctaacaaagacaagtctaacttgctctttggtgggtcttcacaagatgttttatcaaatgataatcaccttggactctctcttggtccattgaagtccatagaaggtagcagcagcagcaacaacgttaacccattgcttaatgttggagtccctagaggaaccacagatatgaacatgaacaactatagctcacatgctttatcaactgatgatattaatcttgatcttactcttggtccatctaagtccataggagatagcaacaatatcattaataacaacactaactcatccttcgatgggaatctgatcattcccgttcgtcctcgtgtgtctagataccattttgttgctgggaacccccttgattcaatctctagaaacattcctccttctattacttttcctcatctaaacatcaatctttctcatgattcgttttctttacaagagaatggttcgggctctagtcactcataaagtctcatctcaaatgggaaagaa

SEQ ID NO: 4200 - DNA, 948 bp, Artificial Sequence
  P1602 (35S::G1474)
caatattgtcatatacaatggagaaacctggtggcttctggatccccaagaaaagcaacaaagagtcatcttgggaagagctggcctttgcagaagacgatgccgccggatctttgtggccgccaagatcttatacgtgtagcttctgccggagagaatttaaatcggctcaagccctcggtggccatatgaacgttcaccgaagagacagagcacggcttaagcaagccgacgaccaatacttattccccaaatcttcttcgtctccagagtatccatctcataaagatagcgataatattcatgaaacctcttgctatactttggtttttaacaccaaacctaattattttaagactcaacactcttgtgttattgatctttcttcgtcttcttctttaccatatttgactccttctagggtttcttctggtttgcctggaaagcaacatacttcttcttctcctccttctttcgttgtagaaccttccaagaactctaaatatattccctcttcttccccatggtcgtgcccaagtactgttgtggagcaaaagagttgtgatctatatgaaattccggctatggaaggagaaaagaagagaaagactgagagtgatgtgccaaaaatcgggcataaagcaaaacttagtcttggaaacaccactgatctctcggtgagtatgaatctggtcatccaccaaagttttccgattactgctcacggtagcgatgaagagattggtagggtggatatccgtaaaagaagacgaagacatgagagtccgtcgcagcagtcgattttcatttcaagtttatcttgtaagagtgacataattacaagaaacgaggaaagcaaacacaaaggtgatcgctttgaggatttagatcttgagcttaggctagggactgatccaccaaaaggaatttgattgatggaccgatgaa

SEQ ID NO: 4201 - DNA, 480 bp, Artificial Sequence
  P1603 (35S::G1476)
tccctcgatcgatcgaggcaacacacacatatatatatatatatatggagtgtgagagatcatcgtcgtccacgtcatcagaaaccggagcagtcaggcaccgtcgtacgtcgtcgtcgtcagtctccaccgtgacgagacgaatgtacgagtgcactttctgcaaaagaggtttcacaaacgcacaagctttaggtggtcatatgaacatccatcgacgtgaccgtctcaacaaggccaaggtgcaaaacgatgctgacgtggcactctcgcaaactcatagatgtttccacgtggcgtctgaccttggaggctacgagcaagtagactccgtcgtgttgaggacgacgacctcgaactacatccaacacttacgaatcggctcgatggctacaaggagagaaaacgtcgtcgttgaaggaaatgaaatcgatttggagctgcgtcttggcttatgatcatcaacttcttaccctctat

SEQ ID NO: 4202 - DNA, 390 bp, Artificial Sequence
  P1605 (35S::G1478)
aaagatgtgtagagggtttgagaaagaagaagagagaagaagcgacaatggaggatgccaaagactatgcacggagagtcacaaagctccggtaagctgtgagctttgcggcgagaacgccaccgtgtattgtgaggcagacgcagctttcctttgtaggaaatgcgatcgatgggtccattctgctaattttctagctcggagacatctccggcgcgtgatctgcacgacctgtcggaagctaactcgtcgatgtcttgtcggtgataattttaatgttgttttaccggagataaggatgatagcaaggattgaagaacatagtagtgatcacaaaattccctttgtgtttctctgattttatgttttgtttttcgcgtaattaagatt

SEQ ID NO: 4203 - DNA, 1293 bp, Artificial Sequence
  P1606 (35S::G1480)
acgtgtcaacttttcattcgatctagatggatacccatggaccccacatggatagactcattgacacgctcatgtgaagccaatagtaacaccaaccacaaaagaaagagagagagagagacactgaaacatagagagaagaaaaagaagaggtttagagagagaaaaatggcgtcaaagctctgcgattcgtgcaaatcagcgacggcggcgttatactgccgaccagacgcagcgtttctatgcttaagctgcgattcaaaagtccacgcggcgaacaaactcgcgtcacgacacgcgcgcgtgtggatgtgtgaagtgtgcgagcaagcaccggcacacgtcacgtgcaaagcagacgcggccgcgttatgcgtcacgtgcgaccgtgatatccactcggctaatccgttagctcgccgtcacgaacgcgttcccgttactccgttttacgattccgtctctagtgacggttccgttaaacacaccgccgttaatttccttgacgactgttacttctccgatatagatggtaacggaagccgtgaagaagaggaggaagaagctgcttcgtggctgttacttcccaatccaaagactacaacgacggcgacggcggggatcgttgctgttacttcagctgaggaagttccgggagatagtccggagatgaacactggtcaacagtatttgttctcggatccggatccgtatctggatctggattatggaaatgttgatccgaaggtggaatcgttagagcagaatagctccggtactgatggtgttgttccggtggagaatcggacggttaggattccgacggtgaacgagaattgctttgaaatggattttaccggaggatctaaaggctttacttatggtggtggttacaattgcatcagtcacagcgtgtcatcatcgtcgatggaagtgggagtggtgccagatggtggttcggtggctgatgtatcgtatccttacggtggtcctgcaaccagtggagctgatccggggacacagcgggctgttccgctgacttcagctgagagagaagcgagggtaatgaggtacagagagaagaggaagaacaggaagtttgagaagactataaggtatgcttcaaggaaagcgtatgcggaaatgagaccgagaatcaagggacggtttgcgaagcggacggatacaaatgagagcaatgatgtggttggtcatggtggtatctttagtgggttcggacttgtacctacattttagatattgagagagggagagactctaaaatggaagaga

SEQ ID NO: 4204 - DNA, 1138 bp, Artificial Sequence
  P1608 (35S::G931)
tgacagacacatgtatcatcaatcttctctgttgaagcagagagagagagagctaattgttgcctctgagtcacatggataagaaagtttcatttactagctctgtggcacattcaactccaccataccttagtacttccatctcatggggacttccaaccaaatccaatggtgtgactgaatcactgagtttgaaggtggtagatgcaagaccagaacgtcttataaacacaaagaatatcagtttccaggaccaggattcatcttcaactctgtcctctgctcaatcttctaacgatgttacaagtagtggagatgataacccctcaagacaaatctcatttttagcacattcagatgtttgtaaaggatttgaagaaactcaaaggaagcgatttgcaattaaatcaggctcctccacggcaggaatcgctgatattcactcttctccttccaaggctaacttctcatttcactatgccgatccacattttggtggtttaatgcctgcggcttacctaccacaggcaacaatatggaatccccaaatgactcgagttccgctaccattcgatctcatagagaatgagcctgtctttgtcaatgcaaagcaattccatgcaattatgaggaggaggcaacagcgtgctaagctagaggcgcaaaacaaactaatcaaagcccgtaagccgtatcttcatgaatctcgacatgttcacgctcttaaacgacctagaggatctggtggaagattcctaaacaccaaaaagcttcaagaatctacagatccaaaacaagacatgccaatccaacagcaacacgcaacgggaaacatgtcaagatttgtgctttatcagttgcagaacagcaatgactgtgattgttcaaccacttctcgctctgacatcacatctgcttctgacagcgttaatctctttggacactctgaatttctgatatcagattgcccatctcagacaaacccaacaatgtatgttcatggtcaatcaaatgacatgcatggaggtaggaacacacaccatttctctgtccatatctgagccggtggaatctggtaatgtgtacgttcctacaaaaaaagggaagtcatccttggctgctacttcgcttattagct

SEQ ID NO: 4205 - DNA, 1177 bp, Artificial Sequence
  P1610 (35S::G2343)
taagttactatgaggagctactaatcatgggtcatcactcatgctgcaaccagcaaaaggtgaagagagggctttggtcaccggaagaagatgagaagcttattagatatatcacaactcatggctatggatgttggagtgaagtccctgaaaaagcagggcttcaaagatgtggaaaaagttgtagattgcgatggataaactatcttcgacctgatatcaggagaggaaggttctctccagaagaagagaaattgatcataagccttcatggagttgtgggaaacaggtgggctcatatagctagtcatttaccgggaagaacagataacgagattaaaaactattggaattcatggattaagaaaaagatacgaaaaccgcaccatcattacagtcgtcatcaaccgtcagtaactactgtgacattgaatgcggacactacatcgattgccactaccatcgaggcctctaccaccacaacatcgactatcgataacttacattttgacggtttcactgattctcctaaccaattaaatttcaccaatgatcaagaaactaatataaagattcaagaaacttttttctcccataaacctcctctcttcatggtagacacaacacttcctatcctagaaggaatgttctctgaaaacatcatcacaaacaataacaagaacaatgatcatgatgacacgcaaagaggaggaagagaaaatgtttgtgaacaagcatttctaacaactaacacggaagaatgggatatgaatcttcgtcagcaagagccgtttcaagttcctacactggcgtcacatgtgttcaacaactcttccaattcaaatattgacacggttataagttataatctaccggcgctaatagagggaaatgtcgataacatcgtccataatgaaaacagcaatgtccaagatggagaaatggcgtccacattcgaatgtttaaagaggcaagaactaagctatgatcaatgggacgattcacaacaatgctctaactttttcttttgggacaaccttaatataaacgtggaaggttcatctcttgttggaaaccaagacccatcaatgaatttgggatcatctgccttatcttcttctttcccttcttcgttttaaattaatgtttaaatcacagcaaataaactccgctaatt

SEQ ID NO: 4206 - DNA, 920 bp, Artificial Sequence
  P1613 (35S::G674)
tgtcaaagattgtcatcaccaatctacatatttttattcatcagtaccatacacgtatatataatatatctatttcaaatataaaaaaaaactttggaaaaataaaaatggtgtttaaatcagaaaaatcaaaccgggaaatgaaatcaaaggagaagcaaaggaagggattatggtcacccgaggaagatgagaagcttaggagtcatgtcctcaaatatggccatggatgctggagtactattcctcttcaagctggattgcagaggaatgggaagagttgtagattaaggtgggttaattatttaagacctggacttaagaagtctttattcactaaacaagaggaaactatacttctttcacttcattccatgttgggtaacaaatggtctcagatatcgaaattcttaccaggaagaaccgacaacgagatcaaaaactattggcattctaatctaaagaagggtgtaactttgaaacaacatgaaaccacaaaaaaacatcaaacacctttaatcacaaactcacttgaggccttgcagagttcaactgaaagatcttcttcatctatcaatgtcggagaaacgtctaatgctcaaacctcaagcttttcgccaaatctcgtgttctcggaatggttagatcatagtttgcttatggatcagtcacctcaaaagtctagctatgttcaaaatcttgttttaccggaagagagaggattcattggaccatgtggccctcgttatttgggaaacgactctttgcctgatttcgtgccaaattcagaatttttgttggatgatgagatatcatctgagatcgagttctgtacttcattttcagacaactttttgttcgatggtctcatcaacgagctacgaccaatgtaaatgttcggagagaggtccaagtaaata

SEQ ID NO: 4207 - DNA, 2461 bp, Artificial Sequence
  P1617 (35S::G2348)
cagaaattgaagactctcagatgtcttctctgtcgcaatcgccaccaccgccggagatggatatccaacccccggcattggttaacgatgatccttccacttattcctccgctttatgggattggggagatctccttgacttcgccgcagacgaacgccttctcgtcgatcaaattcatttccctcccgttctctctcctcctctaccgcctctgattccgacgcaaactccggcggaatctgaattagatccttctccggaagaatcgggttctggttcggatcgggttaggaagcgagacccgaggttgatttgttccaatttcattgaaggtatgcttccttgttcgtgtcctgagcttgatcagaaattggaagacgccgagcttccgaagaagaaacgggttcgcggcgggtcgggcgtggctcgatgtcaggttccggattgtgaagcggatattagcgagctcaaagggtaccataagaggcatagggtttgtctccgttgcgctaccgccagctttgttgtgcttgatggagagaataagagatactgtcaacagtgtggaaagtttcatttgctcccggactttgatgaaggaaaacgcagctgtcggagaaagctagagcgtcacaacaacagacggaaaaggaaacctgtagataaaggaggtgttgctgcagaacaacagcaagtgctttcacagaatgataacagcgtcattgatgttgaggatggaaaagatatcacatgctctagtgaccagagagctgaagaagagccttcattgatttttgaagatcggcatattaccactcagggttctgtaccttttacccgaagcatcaacgcagacaactttgtctctgttacaggttcgggtgaagctcaaccagatgaaggaatgaatgacacaaaatttgaacgttcaccttctaatggcgacaacaaaagtgcttactcaactgtgtgtccaactggtcggatctcttttaagctctacgattggaatccagcggagttcccacggagactacgtcatcaaatatttcaatggttggccaacatgcctgttgagctggagggctatatccgcccaggatgtacaattttgactgtctttatagcaatgccagagattatgtgggcgaagttatctaaagatcctgtggcatatctggatgaatttattcttaaacctggaaagatgctgtttggaagaggctcgatgactgtctatttgaacaacatgattttccgtcttattaaaggtggaacaactttaaagagagtcgatgtaaaattagagtcgccgaaacttcagtttgtgtatcctacatgttttgaagctggaaaaccaattgaactcgttgtatgtggacaaaaccttctgcaacctaaatgccggtttctcgtgtctttttctgggaagtacttgccacataactattctgttgtacctgcaccggaccaggatgggaagcgttcttgtaataacaagttctacaagatcaatattgtgaattctgaccctagtctctttggccctgcctttgtcgaggttgaaaatgaatctggcctatcaaatttcatacctctaattattggagatgcagctgtttgttccgaaatgaaactaatagagcagaagttcaatgctacactctttccagagggacaagaagttactgcttgctcttctttgacttgctgttgcagggattttggggagagacagagcacctttagtggcctcttgttagatattgcatggtcggtgaaggtaccctctgcagaacgcactgagcaacctgtgaaccgatgtcagataaaaagatacaacagagtgttgaattatctgatacagaataactcagcgtcgatcttaggaaacgtactgcacaatttggaaactttggtgaagaaaatggagccagacagtcttgttcactgtacctgtgactgcgacgtgaggcttctacatgaaaatatggatttggcgagtgatattcacagaaagcatcaaagccctatagagtcaaaggtgaatcctccttcgtcaggttgctgttgtgtgagtagtcagaaggacataccatcaagaatattaaacttcaataaggatcctgaagcaggattagattgtaaagagagaatacaggcagactgttcaccagatagcggcggaaaagagactgatcctctgttaaacaaagaggttgtcatgaacgtaaatgacataggagactggccaaggaagtcgtgtataaaaacgcactcagctttagcattcaggtcccgtcaaactatgttcttaatcgctacgttcgctgtctgttttgctgtctgtgcggttctctaccatccaaacaaggtcacacagcttgcagtggcaatccgaatgagattggtacacaaaatttgaatataagttcaacggcagagactctcattaacgtg

SEQ ID NO: 4208 - DNA, 761 bp, Artificial Sequence
  P1618 (35S::G2347)
atccaccatcatcttcccacgaatacaacttaaagctttaccagaaaatggagggtcagagaacacaacgccggggttacttgaaagacaaggctacagtctccaaccttgttgaagaagaaatggagaatggcatggatggagaagaggaggatggaggagacgaagacaaaaggaagaaggtgatggaaagagttagaggtcctagcactgaccgtgttccatcgcgactgtgccaggtcgataggtgcactgttaatttgactgaggccaagcagtattaccgcagacacagagtatgtgaagtacatgcaaaggcatctgctgcgactgttgcaggggtcaggcaacgcttttgtcaacaatgcagcaggtttcatgagctaccagagtttgatgaagctaaaagaagctgcaggaggcgcttagctggacacaatgagaggaggaggaagatctctggtgacagttttggagaagggtcaggccggagagggtttagcggtcaactgatccagactcaagaaagaaacagggtagacaggaaacttcctatgaccaactcatcattcaagcgaccacagatcagataaaccctcccgctctctctcttctgtcatctacatatgctctatctacactcttattagacaaataatggcatctaacaatgtcaagaaaagttggtcatggtattaaatcctacacggatatataactataaacctctagtcccctctatgctgtcctgtaatgaatat

SEQ ID NO: 4209 - DNA, 1143 bp, Artificial Sequence
  P1619 (35S::G1645)
gtcgacctcccaacactaactccatgtttataacggaaaaacaagtgtggatggatgagatcgtcgcaagaagagcttcttcttcttgggacttccctttcaacgacattaatattcatcagcatcatcatcgtcactgcaacacaagtcatgagtttgaaatcttgaagagtcctcttggagatgtagcggttcacgaagaagagagtaataataataaccctaatttcagtaacagcgagagtggtaagaaggagacaacagatagtggtcagtcttggtcctcgtcgtcttcaaaaccatcggtcttggggagaggacattggagaccagctgaagatgttaaactcaaagagcttgtctccatttacggcccacaaaactggaacctcatagctgaaaagcttcaaggaagatctgggaagagctgtagactacgatggtttaaccaattggacccgaggataaaccgaagagctttcacagaagaagaagaggagaggctgatgcaagcacataggctttatggtaacaaatgggcaatgattgcgaggcttttccctggtagaactgataattcagtgaagaaccattggcatgttgtcatggctcgtaagtatagagaacactcttctgcttaccgtaggagaaagcttatgagtaataatccacttaaacctcacctcaccaataatcatcatcctaaccctaaccctaattaccactcttttatctccactaatcattacttcgctcagcctttccccgagtttaatttgactcatcacctggttaataatgcccctatcacgagtgaccataaccagcttgtgttgcctttccattgctttcaaggttatgagaacaatgaacctccgatggttgtgagtatgtttggcaaccaaatgatggtcggcgataacgttggtgccacgtcagacgcgttatgcaatattccgcacattgaccctagtaaccaagagaaaccggagccaaatgatgcaatgcattggatcggaatggacgcggtagatgaggaggtgttcgaaaaggctaagcagcaaccacattttttcgattttcttggcttggggacggcgtgaatgttgaacaaattggtgttaatcagataacgacagtggc

SEQ ID NO: 4210 - DNA, 1159 bp, Artificial Sequence
  P1620 (35S::G2340)
ctacatctctttctctatctctagcttctatttttaatacattcaagaatcaagaatggtacggacgccgtgttgtagagcagaagggttgaagaaaggagcatggactcaagaagaagaccaaaagcttatcgcctatgttcaacgacatggtgaaggcggttggcgaacccttccggacaaagctggactcaaaagatgtggcaaaagctgcagattgagatgggcgaattacttaagacctgacattaaacgtggagagtttagccaagacgaggaagattccatcatcaacctccacgccattcatggcaacaaatggtcggccatagctcgtaaaataccaagaagaacagacaatgagatcaagaaccattggaacactcacatcaagaaatgtctggtcaagaaaggtattgatccgttgacccacaaatcccttctcgatggagccggtaaatcatctgaccattccgcgcatcccgagaaaagcagcgttcatgacgacaaagatgatcagaattcaaataacaaaaagttgtcaggatcatcatcagctcggtttttgaacagagtagcaaacagattcggtcatagaatcaaccacaatgttctgtctgatattattggaagtaatggcctacttactagtcacactactccaactacaagtgtttcagaaggtgagaggtcaacgagttcttcctccacacatacctcttcgaatctccccatcaaccgtagcataaccgttgatgcaacatctctatcctcatccacgttctctgactcccccgacccgtgtttatacgaggaaatagtcggtgacattgaagatatgacgagattttcatcaagatgtttgagtcatgttttatctcatgaagatttattgatgtccgttgagtcttgtttggagaatacttcattcatgagggaaattacaatgatctttcaagaggataaaatcgagacgacgtcgtttaatgatagctacgtgacgccgatcaatgaagttgatgactcctgtgaagggattgacaattattttggatgagttatattgatgatgatgaaaatttgcatttggcatgtaaatcaattagagtttgatttgctatggtgtttttagtttgtgtgtgtagtgtgtttcgaccgt

SEQ ID NO: 4211 - DNA, 1120 bp, Artificial Sequence; identical to SEQ ID NO: 1385
  P1625 (35S::G2124)

SEQ ID NO: 4212 - DNA, 812 bp, Artificial Sequence
  P1627 (35S::G2344)
ttattctaagtagcttgacttgtttagtttaaatatgaggttaatgattttgtggggatttgatagttctggttcttgagtttatttaaaataggtttaccaggatcatgtactgactctgttctttggaacttttcagaattctgcttcggacattaagctcatgagtcatgacttcttcaatccatgagctttctgataacattggaagtcatgagaagcaagaacagagagattctcatttccaaccaccaatcccttctgcaagaaattatgaatcaattgttacaagtttagtctactcagacccggggactacaaattccatggcacctggacaatatccatatccagatccttactacagaagcatatttgcaccgcctccacaaccgtataccggggtacatctacagttgatgggagtgcagcaacaaggcgttcctttaccatctgatgcagtcgaggaacctgtttttgttaacgcaaagcaataccacggtatactaaggcgcagacaatcaagagcaagacttgagtctcagaataaagtcatcaagtcacgtaagccgtatttgcatgaatctcggcatttgcatgcgataagacgaccaagaggatgtggcgggcggtttctaaatgccaagaaggaggatgagcatcacgaagacagtagtcatgaagaaaaatccaaccttagcgctggtaaatccgccatggctgcttctagtggtacatcttgagaaggtcctacaagtagctttgttgtattttggctctgtttggtctcagatcatctatgtcttttagtg

SEQ ID NO: 4213 - DNA, 794 bp, Artificial Sequence
  P1636 (35S::G1752)
aaaaaaaacttatggaatattcccaatcttccatgtattcatctccaagttcttggagctcatcacaagaatcactcttatggaacgagagctgtttcttggatcaatcatctgaacctcaagccttcttttgccctaattatgattactccgatgactttttctcatttgagtcaccggagatgatgattaaggaagaaattcaaaacggcgacgtttctaactccgaagaagaagaaaaggttggaattgatgaagaaagatcatacagaggagtgaggaaaaggccgtgggggaaatttgcagcggagataagagattcaacgaggaatggaattagggtttggctcgggacatttgacaaagccgaggaagccgctcttgcttatgatcaagcggctttcgccacaaaaggatctcttgcaacacttaatttcccggtggaagtggttagagagtcgctaaagaaaatggagaatgtgaatcttcatgatggaggatctccggttatggccttgaagagaaaacattctcttcgaaaccggcctagagggaaaaagcgatcctcttcttcttcttcttcttcttctaattcttcttcttgctcttcttcttcgtctacttcttcaacatcaagaagtagtagtaagcagagtgttgtgaagcaagaaagtggtacacttgtggtttttgaagatttaggtgctgagtatttagaacaacttcttatgagctcatgttgatcttgtaattgatttcagcaaaagccactattaaactttaattttgtgata

SEQ ID NO: 4214 - DNA, 851 bp, Artificial Sequence
  P1637 (35S::G917)
ttagggttttagaaagatagatcgattgaagatgaggaaaggtaagagagtgataaaaaagatagaggagaaaataaagagacaagtgacattcgcaaagagaaagaagagtctaatcaagaaggcatatgaactctctgttctctgcgatgtccaccttggtctcatcatcttctctcactccaacaggctctacgatttctgctccaactctaccagcatggagaatctcatcatgagataccaaaaggaaaaagaaggtcaaaccactgcagaacacagtttccactcggatcagtgttcagattgcgtgaagacgaaggaatcaatgatgagagagatagagaatcttaagctgaatcttcaattgtacgacggacatggcttgaatctcttgacctacgacgagctcctttcttttgagctccatctcgaatcttctctacaacatgctcgagctcgcaagtctgagttcatgcatcagcagcagcagcaacaaacagatcaaaagcttaagggaaaagaaaagggtcaaggaagctcttgggagcagctgatgtggcaagcagagagacagatgatgacgtgtcaaagacaaaaagatcctgcgccggcgaatgaaggaggagttccttttttacggtggggaacaacccaccgacgttcttcacctccttaagctaccacaaccaggcccaaatacaggcccataacttctctctatctataaaaaacaactgatagtaaaaagtattgacccggtttggttcggttatgttgataccagactattaattaacttcggttagacgtatttacgacttgatgctatctagacctttttgcccttc

SEQ ID NO: 4215 - DNA, 1913 bp, Artificial Sequence; identical to SEQ ID NO: 601
  P1650 (35S::G789)

SEQ ID NO: 4216 - DNA, 1817 bp, Artificial Sequence
  P1654 (35S::G807)
gtctctgtctctgtaaaagatatttgagcttgagaagaacagaagaaacttccaggatcaatcaatcgatcaactttagtgaactaactcttgatttttcattcgaagttatggaatcggttcccgaatccgtaccatcgccgaactcgaatacaccgtcaataccaccgccggtgaactccgtaccgcctttcttgagtaaaacctacgacatggttgatgatccgttgaccaatgaggtcgtttcgtggagcagcgggaacaacagcttcgtcgtctggagtgccccggagttctcgaaggtgctcttgcccaagtatttcaagcacaacaacttctccagcttcgtcagacaagttaaatacttatggtttcagaaaagttgatcctgaccgatgggaatttgcaaatgaaggatttcttagaggccgaaaacaactactgaagagtattgtcaggagaaaaccttcgcatgtgcagcagaatcagcaacaaactcaagttcagagctcatctgttggtgcttgtgtcgaggtggggaagtttggaatagaagaagaagtggaaagacttaagcgggataagaatgttcttatgcaagaactcgtcaggttaaggcagcaacagcaagctactgaaaaccaactgcagaatgtgggacagaaagttcaggtgatggagcaaaggcaacaacaaatgatgtcgtttttagcaaaggctgttcaaagtccaggcttcttaaaccagttagtacaacagaataataatgatggcaacagacaaattccaggaagcaacaaaaagaggagacttcctgtagatgagcaggagaatcgtggtgacaatgtggctaatggtcttaaccgccagattgttagatatcagccgtcgataaacgaagcagcacaaaatatgcttcgacagttcttaaatactagtacctcacctcggtatgaatcagtttcaaacaatcctgacagtttcctattgggtgatgttcccagttctacctctgtagacaatgggaacccttcaagtagagtttctggagtaacattggccgagttttcacccaacacagttcagtcagcaacgaatcaagtacccgaagcaagtttggctcatcatcctcaagctggtctggttcagccaaatataggtcaaagtccggctcaaggagcagcacctgcagactcttggagccctgaatttgatttagttggatgcgagacagatagtggagagtgttttgatccaataatggctgttttagatgagtcagaaggcgatgcaatttctcctgaaggtgagggcaagatgaatgagttactggagggagtccctaagctgcccggaatccaagatccattctgggaacagttcttttctgttgaactcccagcgattgcagatacagacgatattctatcaggatcagtggagaataatgacttggtattggaacaagaaccaaacgagtggacccgtaatgaacaacaaatgaagtatcttactgaacaaatgggactgctttcctcagaagcacagaggaaataaagattttcaggggaggttgcaaaaggagatatgaaggaacgaggaatatatcagatggtgtgtataccctttacatttttacttaaatgaaaaaaaaccagagagaagaaacataaaagatttaccaccaagcttgtgaatagttagtagagatcggtttttgtgttgtttatattatacttttgtgtgaaaacgttcatcttgttcaattatcatctcactagtacggtaatctgttggtcactgaccggttaataacc

SEQ ID NO: 4217 - DNA, 1320 bp, Artificial Sequence; identical to SEQ ID NO: 1291
  P1657 (35S::G1948)

SEQ ID NO: 4218 - DNA, 898 bp, Artificial Sequence
  P1671 (35S::G681)
gaggtggtgaaacgtggcaatattagattggttttttagtttggttggctggagaaaatggggaggacgacatggttcgacgtcgacgggatgaagaaaggagagtggacggcagaggaagaccagaagctcggcgcttacatcaacgagcatggcgtttgtgattggcgttccctccccaaaagagctggtttgcagagatgtggaaagagctgcagattaaggtggcttaactatctaaagcctgggattagaagaggcaaattcactcctcaagaagaagaagaaatcatccaacttcatgctgttctcggaaacaggtgggcagccatggcgaagaagatgcagaatcgaacagacaatgatatcaagaaccattggaactcttgtctcaagaaaagactttcgagaaagggaatcgaccctatgacccacgagcccatcatcaaacacctcaccgtcaataccactaacgcagattgtggtaactcttccaccacgacgtccccgtcgacgacggaaagctctccttcctccggctcgtctcgtcttcttaacaaactcgccgcaggtatctcatctagacaacatagtctcgataggatcaagtacatcttgtcgaattcaataatcgaaagcagtgatcaagcaaaagaggaagaagaaaaagaagaagaagaagaagaaagagattcaatgatgggtcagaagattgacggtagtgaaggagaagatattcagatttggggcgaggaggaagttaggcgtttaatggagattgatgcaatggatatgtacgagatgacttcgtacgacgctgtcatgtacgagagtagtcacatacttgatcatctcttttgacttaatatagtgtgactgtgtgagtgcatgcatgttg

SEQ ID NO: 4219 - DNA, 736 bp, Artificial Sequence
  P1677 (35S::G1818)
taggttgagattcatatatgtaaagagatcacttcttaatcttatcctaccatatcttatatacgcttaattttcctttatatatgcaaacctccacataaaaatatctcaaacccaaacacttcaaacaaaaaaaaaatggagaacaacaacaacaaccaccaacagccaccgaaagataacgagcaactaaagagtttctggtcaaaggggatggaaggtgacttgaatgtcaagaatcacgagttccccatctctcgtatcaagaggataatgaagtttgatccggatgtgagtatgatcgctgctgaggctccaaatctcttatctaaggcttgtgaaatgtttgtcatggacctcacgatgcgttcatggctccatgctcaagagagcaaccgactcacgatacggaaatctgatgttgatgccgtagtgtctcaaaccgtcatctttgatttcttgcgtgatgatgtccctaaggacgagggagagcccgttgtcgccgctgctgatcctgtggacgatgttgctgatcatgtggctgtgccagatcttaacaatgaagaactgccgccgggaacggtgataggaactccggtttgttacggtttaggaatacacgcgccacacccgcagatgcctggagcttggaccgaggaggatgcgactggggcaaatggaggaaacggtgggaattaatatttggattgggttttgtaaccgctgttgtgagaac

SEQ ID NO: 4220 - DNA, 1039 bp, Artificial Sequence
  P1678 (35S::G2007)
ggtgagcttaggtgcttataggcttttgacagaaatcttctaatttgtcaaatataaattaatgggaaggcagccatgttgtgacaagctcatggtgaagaaggggccgtggacggcggaggaagacaagaaactgataaactttatcttgaccaacggccactgttgctggagggctttgccgaagctggccggtctccgtcgctgtgggaagagctgccgtctacggtggaccaattatctccgacctgacttgaagagaggtcttctctccgacgccgaggaacagcttgtcatcgaccttcatgctcttctcggcaacagatggtccaagatcgctgcaagattaccaggaagaacagacaacgaaataaaaaatcattggaatactcatatcaagaagaagctccttaagatggaaatcgatccttcgacccatcaacctttaaacaaagtatttaccgatacaaacttagtcgataaatctgaaacttcatcgaaagccgacaatgtaaatgataataaaatcgtagagatcgatgggacaacgacaaatacaatagatgatagcattatcactcatcaaaatagttcaaatgatgattatgaattacttggtgatataattcataattatggagatttatttaatattctatggaccaacgatgaacctcctctagtcgatgatgcatcatggagcaatcataacgttggtattggaggaacagctgcagttgcagcctcagacaagaacaacactgctgccgaggaagatttcccggaaagatcatttgaaaaacagaacggcgaaagttggatgttcttggattattgccaagaatttggtgttgaagattttgggttcgagtgttaccatggttttggtcaaagctccatgaagacgggtcacaaggactagcatttgcaagaatacataacatatataccgatatactacataatatgtgtatataatttatacgtacgcataataaaagtaatgtaagaaaaatcatgtaaagcagtaaagaagcac

SEQ ID NO: 4221 - DNA, 915 bp, Artificial Sequence
  P1685 (35S::G1842)
agaaaaaaagcaaacacattttgggtccccggtggttaggatcaaattagggcacaaaccttatcggagaaagaagccatgggaagaagaaaagtcgagatcaagcgaatcgagaacaaaagcagtcgacaagtcactttctccaaacgacgcaaaggtctcatcgaaaaagctcgacaactttcaattctctgtgaatcttccatcgctgttgtcgccgtctccggttccggaaaactctacgactctgcctccggtgacaacatgtcaaagatcattgatcgttatgaaatacatcatgctgatgaacttaaagccttagatcttgcagaaaaaattcggaattatcttccacacaaggagttactagaaatagtccaaagcaagcttgaagaatcaaatgtcgataatgtaagtgtagattctctaatatctatggaggaacagctcgagactgctctgtcagtaattagagctaagaagacagaactaatgatggaggatatgaagtcacttcaagaaagggagaagttgctgatagaagagaaccagattctggctagccaggtggggaagaagacgtttctggttatagaaggtgacagaggaatgtcacgggaaaatggctccggcaacaaagtaccggagactctttcgctgctcaagtaatcaccatcatcaacggctgagctttcaccataaacttactcacagcctgattcagaagcttttacaaaattgtaaattataaaaagctgcataataatctcaacctttttatcttcctcgcgccaatgtggaaataaaggtaaaacaaaacgaagctcttttcttttatgcgaaagaattgtaaaactaagataaagctaccgatctttgttgtaccttagtagacaaatatcagagttcttgtgc

SEQ ID NO: 4222 - DNA, 2798 bp, Artificial Sequence
  P1687 (35S::G438)
cggggtacccaagccacgaccgtagaatcttcttttgtctgaaaagaattacaatttacgtttctcttacgatacgacggactttccgaagaaattaatttaaagagaaaagaagaagaagccaaagaagaagaagaagctagaagaaacagtaaagtttgagactttttttgagggtcgagctaaaatggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctgggatgaagcctggtccggattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtgtgattcgattgacagaaaaagactaatttaaatttacgttagagaactcaaatttttggttgttgtttaggtgtctctgttttgt

SEQ ID NO: 4223 - DNA, 702 bp, Artificial Sequence
  P1688 (35S::G859)
acattgtgggtctccggtgattaggatcaaattagggcaccagccttatcggaggaagaagccatgggtagaaaaaaagtcgagatcaagcgaatcgagaacaaaagtagtcgacaagtcactttctccaaacgacgcaatggtctcatcgagaaagctcgacaactttcaattctctgtgaatcttccatcgctgttctcgtcgtctccggctccggaaaactctacaagtctgcctccggtgacaacatgtcaaagatcattgatcgttacgaaatacatcatgctgatgaacttgaagccttagatcttgcagaaaaaactcggaattatctgccactcaaagagttactagaaatagtccaaagcaagcttgaagaatcaaatgtcgataatgcaagtgtggatactttaatttctctggaggaacagctcgagactgctctgtccgtaactagagctaggaagacagaactaatgatgggggaagtgaagtcccttcaaaaaacggagaacttgctgagagaagagaaccagactttggctagccaggtggggaagaagacgtttctggttatagaaggtgacagaggaatgtcatgggaaaatggctccggcaacaaagtacgggagactcttccgctgctcaagtaatcaccatcatcaacggctgagctttcaccttaaacttacagcctgatt

SEQ ID NO: 4224 - DNA, 772 bp, Artificial Sequence
  P1689 (35S::G1843)
caaattaggtcagaagaattagtcggagaaaacagccatgggaagaagaaaagtagagatcaaacgaattgagaacaaaagctctcgacaagttactttctgtaaacgacgaaatggtctcatggagaaagctcgtcaactctcaattctttgtgaatcctccgtcgctcttatcatcatctctgccaccggaagactctacagcttctcctcaggtgatagcatggccaagatcctcagtcgttatgaattagaacaggctgatgatcttaaaaccttggatctagaagaaaaaactcttaattatctttcgcacaaggagttgctagaaacaatccaatgcaagattgaagaagcgaaaagcgataatgtaagtatagattgtctaaagtccctggaagagcagctcaagactgctctgtctgtaactagagctaggaagacagaactaatgatggagcttgtgaagacccatcaagagaaggagaagctgctgagagaggagaaccagagtttgactaaccagcttataaagatggggaagatgaagaagtctgtggaagcagaggatgcaagagcaatgtcaccggaaagtagctctgacaacaagccaccggagactctcctgcttctcaagtaaccaccatcaccaacgactgattcgaaaaataaaaattgtaaaaattatgatttgtagttcataaggaaagctacatactgtatgttaaaaatcctcttcttccccctgctacggaaaagtcatccaaggaga

SEQ ID NO: 4225 - DNA, 825 bp, Artificial Sequence
  P1690 (35S::G1844)
ggggattagatgtgtcggaagagtgaagccatgggaagaagaagagtagagatcaaacgaattgagaacaaaagcagtagacaagtcactttctgtaagagacgaaatggtctcatggagaaagctcgtcaactctcaattctctgtggatcctccgtcgctcttttcatcgtctcttccaccggcaaactctacaactcctcctccggcgacagcatggccaagatcatcagtcgttttaaaatacaacaagctgatgatcctgaaaccttggatcttgaagacaaaactcaggattatctttcacacaaggagttactagaaatagttcaaagaaagattgaagaagcaaaaggggataatgtaagtatagaatctctaatttccatggaagagcagctcaagagtgctctgtctgtaattagagctaggaagacagagttattgatggagcttgtgaagaaccttcaggataaggagaagttgctgaaagaaaagaacaaggttctagctagcgaggtggggaagctgaagaaaattttggaaacaggggatgaaagagcagtaatgtcaccggaaaatagctctggccacagcccaccggagactctcccgcttctcaagtaaccaccaatcatcaacggctgatttttcatcatcctgattcaaaaaaggtaaaaaaaattcatgtgtaaaaatcataaagaagctacatgttttaaaatcctcttctccccctgcatacggataaatttatagaccaaaaatataatgttttccctcaaataagatatcgacctttgtgttaccttggaagacaggatc

SEQ ID NO: 4226 - DNA, 827 bp, Artificial Sequence; identical to SEQ ID NO: 1449
  P1692 (35S::G2291)

SEQ ID NO: 4227 - DNA, 673 bp, Artificial Sequence
  P1695 (35S::G1792)
aatccatagatctcttattaaataacagtgctgaccaagctcttacaaagcaaaccaatctagaacaccaaagttaatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagataatcacgattagttttgttttgatattttatgtggcactgttgtggctacctacgtgcattatgtgcatgtataggtcgcttgattagtactttataacatgcatgccacgaccataaattgtaagagaagacgtactttgcgttttcatgaaatatgaatgttagatggtttgagtac

SEQ ID NO: 4228 - DNA, 1500 bp, Artificial Sequence; identical to SEQ ID NO: 1375
  P1697 (35S::G2114)

SEQ ID NO: 4229 - DNA, 626 bp, Artificial Sequence
  P1699 (35S::G2113)
aacaaactcatcaaacttcctcagcgtttctttttcttacataaacaatttttcttacataaacaaatcttgttgtttgttgttgtcatggcaccgacagttaaaacggcggccgtcaaaaccaacgaaggtaacggagtccgttacagaggagtgaggaagagaccatggggacgttacgcagccgagatcagagatcctttcaagaagtcacgtgtctggctcggtactttcgacactcctgaagaagccgctcgtgcctacgacaaacgtgctattgagtttcgtggagctaaagccaaaaccaacttcccttgttacaacatcaacgcccactgcttgagtttgacacagagcctgagccagagcagcaccgtggaatcatcgtttcctaatctcaacctcggatctgactctgttagttcgagattcccttttcctaagattcaggttaaggctgggatgatggtgttcgatgaaaggagtgaatcggattcttcgtcggtggtgatggatgtcgttagatatgaaggacgacgtgtggttttggacttggatcttaatttccctcctccacctgagaactgattaagatttaattatgattattagatataattaaatgt

SEQ ID NO: 4230 - DNA, 840 bp, Artificial Sequence
  Artificial sequence
  P1701 (35S::G280)
aatccctcctcacacagattccttccttcatcacctcacacactctctacgcttgacatggccttcgatctccaccatggctcagcttcagatacgcattcatcagaacttccgtcgttttctctcccaccttatcctcagatgataatggaagcgattgagtccttgaacgataagaacggctgcaacaaaacgacgattgctaagcacatcgagtcgactcaacaaactctaccgccgtcacacatgacgctgctcagctaccatctcaaccagatgaagaaaaccggtcagctaatcatggtgaagaacaattatatgaaaccagatccagatgctcctcctaagcgtggtcgtggccgtcctccgaagcagaagactcaggccgaatctgacgccgctgctgctgctgttgttgctgccaccgtcgtctctacagatccgcctagatctcgtggccgtccaccgaagccgaaagatccatcggagcctccccaggagaaggtcattaccggatctggaaggccacgaggacgaccaccgaagagaccgagaacagattcggagacggttgctgcgccggaaccggcagctcaggcgacaggtgagcgtaggggacgtgggagacctccgaaggtgaagccgacggtggttgctccggttgggtgctgaattaatcggtacttatgcaatttcggaatctttagttactgaaaaatggaatctcttagagagtaagagagtgctttaatttagcttaattagatttatttggatttctttcagtatttggattgtaaactttagaatttgtgtgtgtgttgttgcttagtcctgaga

SEQ ID NO: 4231 - DNA, 1149 bp, Artificial Sequence
  P1702 (35S::G1063)
gttaaagaagatggatgggccacaagttgctatataaatccttccacttcttgttgtatactattgcttgagttctgattgggcacagtagtaccattgccatttctctcacacataccgtctctttctctcatcatcaatcatcaatcatccaaaagaaaaaaccctaaaatttcacttgtaagcttttcaccagtttctctccatacccattttatcagcttctccatatctttctctatggattctgacataatgaacatgatgatgcatcagatggagaagcttcctgagttttgtaaccctaattcctctttcttctctcccgaccacaacaacacttacccttttctctttaactccactcattaccagtccgatcactcaatgaccaacgaaccaggtttccgctacggttccggtttactcactaacccttcttctatctctcccaacacagcttactcttccgtttttcttgacaaaagaaacaacagtaacaacaacaataatggcacgaacatggcagctatgcgagagatgatcttccgtatcgccgtgatgcaaccgatccatatcgatcccgaggcggttaagccaccgaagaggaggaacgtcaggatctctaaagatcctcaaagcgtggcggctaggcatagaagggagagaataagcgagaggattcggattttgcaacggcttgttcctggtgggacgaagatggatacagcttcgatgctcgatgaagcaattcattatgtgaagtttttaaagaaacaggtgcagtctctggaggagcaggcggtggttactggcggagggggaggaggaggaggaagggttttgatcggtggaggtggaatgacggcggcgagtggtggtggtggcggcgggggagtggttatgaaagggtgtggaacagtggggactcatcagatggtgggcaatgcacagattcttagatgatgatgatttttaattttattattattatattaatgttggagaaaaagagaaaaatgattctggagagggaagccaagtaatttatgtgagagtctttaatttaactttattttcttgtttagataatgtgtaatgatggtttttaaagccaaagactctccatggttgttggagcgagtttgt

SEQ ID NO: 4232 - DNA, 1711 bp, Artificial Sequence
  P1703 (35S::G1064)
tccattgtctctctctttcttatcctctctttctcaatcaattccttcagacttatacactttattttttttcccctcttgtcgaaaacatcacatataaataaaaaaccaaaaaccctaatttataaaatatatataaaatagttatagctccccacttatatatgcaaaagccaacatcaagtatcttaaatgtcataatggacggtggagacagcgtcggaggaggaggaggagatgatcaccaccgtcacctccaccatcaccaccgccctactttcccttttcaactactcggaaaacacgaccccgacgacaaccatcaacaacaaccttccccttcctcctcctcctctctattttctctccatcaacaccaacaattatctcaatcgcaacctcaatcgcaatcgcaaaagtcacaaccgcagacaacgcaaaaagagttattacaaacgcaagaggaatctgcggtggtggcagctaaaaagccaccgttgaaacgagcgtcgacgaaagaccgacacacgaaagtagacggaagagggaggagaataaggatgccggcgttatgtgcagctagggtttttcagctaacgcgagagctaggtcataaatccgacggtgagacaatagagtggcttcttcaacaagctgaaccatctgtaatcgccgccaccggaaccggaacaatcccggcgaatttcacttctttaaacatctctctccgttcttcaggctcttccatgtctcttccttctcatttccgctccgccgcttccacttttagccctaataacatattttctccggcgatgcttcaacaacaacaacaacaacaacgtggtggtggtgttgggtttcatcatccccatctacagggacgtgcacctacgtcgtctttgtttcctggtattgataacttcacaccaacgacgtcgtttttgaactttcataatccaacaaagcaagaaggagatcaagattctgaagagttaaactcggagaagaaaagaagaatccaaacgacgtcggatttgcatcaacaacaacaacaacaccaacatgatcaaatcggaggatatacacttcaatctagcaacagtggatctacggccaccgcagccgccgcgcaacaaataccgggaaatttctggatggttgcggcggctgcggctgcaggtggtggtggtggtaataacaaccaaacaggtggtcttatgacagcttctattggtactggtggcggcggtggagagcctgtttggacgtttccttccattaacacggcagcggcagcgttatatagaagtggcgtttcgggcgttccaagcggcgcggtttctagcggtttacattttatgaatttcgcagcgccaatggcatttcttactggacaacaacagctagcaacaactagtaatcatgagattaatgaagatagtaataataatgaaggaggaagaagtgacggtggtggtgatcatcataatacacagagacatcatcatcatcaacaacaacatcatcataatattctctccggcttgaaccagtacggacggcaagtttccggcgactctcaagctagtggatcacttggaggtggtgatgaggaggatcagcaagattagacacacacaaaaacattttaatggtgggattttctgccgacggcggtagcggtgacggcgttcggcggctgtgtaaa

SEQ ID NO: 4233 - DNA, 1613 bp, Artificial Sequence
  P1704 (35S::G1128)
tgtctgaagaagcttgaatctgtcgtgatcatcaagattcaagttctgtctttttgagtctttttcttctacttctattgagtttctcttccttaattgtcggaatcagaatcttttcagatggaggagagagaaggaactaacatcaacaacatcccaaccagttttggtctgaaacaacatgaaactcctcttcctcctcctggttacccaccacggtctgaaaaccctaatctttttccggtgggtcaatccagcacttcctccgccgccgccgcggtgaaaccttctgagaatgttgctcctccttttagcttaacaatgccggtggagaattcttcttctgagttgaagaagaagagagggagaccaagaaagtataaccctgacggctcactcgctgtgactctctctcctatgcctatctcatcctccgttccgttgacgtcggagtttggttctcggaaacgaggaagaggtcgaggaagaggcagaggaagaggacgaggacgtggacaaggacaaggaagcagagagcccaataacaacaacaacgacaacaattggctcaagaatcctcagatgttcgaatttaacaacaacactcctacttctggtggaggaggacctgctgaaattgtcagtccaagttttacacctcatgtgctcacagtaaatgccggtgaggatgtgacaatgaagataatgacattctctcaacaaggctcgcgtgctatttgtattctttcagcgaacggtcccatatccaatgttacacttcgtcaatctatgacatctggtggtactctcacttatgagggtcattttgagattctttctttgacgggttcgtttataccaagcgagagtggaggaacccgaagcagagctggtgggatgagtgtctctcttgcaggacaagatggtcgtgtctttggtggtggacttgctggtctctttattgccgctggtcctgttcaggtaatggtagggagttttatagcgggtcaggaggaatcgcagcagcagcagcagcagataaagaagcaaagaagggaaagactcgggatcccgacaacaacacaagcttctaatatctcattcggtggctcagcggaagatcctaaggctagatacgggctcaacaagcctgttgttattcagccaccaccggtgtctgcaccacctgtgtccttttcgcatgaaccaagtactaacaccgtccatggttactatgcaaataacacagctaaccatatcaaggatctcttctcttccctccctggagaagatagggaagaagatgaggatgatttagaaggtgaagatgatgaagaattcggaggccatagcgaatctgacaccgaggttccaagctgatgatcgatggaaagaatccgacatatatgtgttatgaatcttgagttgttttatttcggtgtcttcagatttttttagagcgtaatggtattttttttctttcagattgttagttgttaaagtcttaaacagagatatttcactaaaagttagggtttactagaggatgtaatctttagggttctttgacttgtgtctttcttttaatcctcagatggttgttgtaggcttgt

SEQ ID NO: 4234 - DNA, 2688 bp, Artificial Sequence
  P1709 (35S::G275)
tctcgcctgtatcaggcgtacacgcgttgttatcatctgttgcttatatttgaaccatggcgcaaccaaggtacactaggatagataacaggaggccctcatcaaattattgctctacagtgacagtagttgtgtttgtggccctatgcttagtcgggatctggatgatgacatcatcttctgttggaccggctcagaatgttgatgaggtttctctggacaacaaagatgggataaagaaacagatgaccccacctgcagaggagggtaatggtcagaagtttgaagacgcacctgttgaaacaccgaacgaggataaaaaaggagatggtgatgcaagcttgcccaaagaggatgagagctcaagcaaacaagataaccaggaagagaagaaagaagagaaaactaaagaagagtttactccatccagtgagacgaaaagtgagaccgaaggtggggaagatcaaaaagatgactccaagtcagaaaatggtggtggaggtgatttagatgagaaaaaagatttgaaagacaactcagatgaagaaaatcctgacacaaatgaaaagcaaactaaaccagaaacagaggacaatgagttgggtgaggatggtgaaaaccaaaagcaatttgagtctgataacggtgagaaaaaatccattgatgatgataaaaaatccagtgatgatgataaagaaaacaagacaggcaacgaagatactgaaaccaagactgagaaggaaaacactgagacaaatgtggatgttcaagtagagcaagagggtcaatccaaaaacgagacctcaggtgatctttcacctcctggggcacaattagagctactgaatgaaactaccgcacagaatggttcattttcaacccaggcaacagagtccaaaaatgagaaagaagctcagaagggttctggtgataaacttgattacaaatgggcactatgcaatacaacagcaggacctgattacattccctgtctcgataatgtgcaagccattaggagtcttccgagtactaaacattacgagcatcgtgagaggcattgcccagacagcccacccacctgccttgttcctttgcctgatggatacaagcggccaattgagtggcccaaaagtcgagaaaagatctggtacaccaacgtccctcataccaagcttgctgagtataaggggcatcaaaattgggttaaagttaccggtgagtatctaacttttcctggtggaggaacccaattcaagcatggtgctcttcattacatcgatttcatacaggagtctgtccctgctattgcatggggtaaacgctctcgtgtggtcctggatgttggatgcggtgttgcaagctttggaggtttcctctttgacagagatgtgatcactatgtctcttgcacctaaagatgaacatgaagctcaggtgcaatttgctcttgagaggggcattcccgccatttctgcagttatgggcacgacaaggctacctttccctggcagagtttttgacatagttcattgtgctcgctgtagagtgccatggcacattgaaggtggtaaacttctcctggagcttaaccgtgtattgagacccggtgggttctttgtgtggtctgctactcctgtttatcagaagaagaccgaagatgttgaaatttggaaagctatgagtgaactcattaagaagatgtgttgggaactcgtatccattaacaaggacactatcaatggagtaggtgttgctacttacagaaagccaacttcaaatgagtgctacaaaaacagatcagaaccggtgcctccaatttgtgcagactctgatgatccaaatgcatcttggaaagtgccgcttcaagcatgcatgcacaccgcgccagaagacaaaacgcaacgtggatctcagtggcccgaacaatggccagcgagattagagaaagcaccgttctggttatcaagttcccagactggagtttacggaaaagcagcaccagaggatttcagtgctgattatgagcactggaaacgcgtagtgaccaaatcataccttaatggtttaggaatcaactgggcatctgttagaaatgtgatggacatgagagccgtttatggaggttttgcggcagctctaagagatctgaaagtgtgggtcatgaatgtggttccaatagattcaccagacacacttgcaataatctatgaacgaggactctttggtatctaccacgattggtgcgaatctttcagtacatacccgagatcatatgatctccttcacgccgaccatcttttctccaaactcaaacaaaggtgcaatcttactgcggtgatagcagaagtggatcgtgttttgagaccccacgcgtccggactagttctagacgatgcggaaacaatacagcaagtggaaggcatggtgaaagcgatgaaatgggaagttcgaatgacttattctaaggaaaaagaaggtttgctctctgttcaaaaatcaatctggcgacccagtgaagtggaaacactcacttacgctatcggttgagaagacttacttcaagtcccactcttttttgtacgtataaaaacactcttattaactccatatcatccctttttttgttggttcgtcttttaggaagttctttttttttagctgttgagtcatttgtttgtactattcgcac

SEQ ID NO: 4235 - DNA, 778 bp, Artificial Sequence
  P1712 (35S::G1011)
cttgtttagggtttcaatctttacagatcttgtggcagaaaaaatcaagtcaaagcaagaaaaatggttagaggaaagatagagatgaagaaaatagaaaacgcaacgagtagacaagtgactttctcaaaaagaagaaatggtttgttgaagaaagcttatgagctctcagtactctgcgatgctcaactctctctcatcatcttctcccagagaggaaggctttatgaattctctagctctgatatgcagaagacgatcgaacgctaccgcaagtacacaaaagatcatgaaaccagcaatcacgactcacaaattcacttgcagcaattgaaacaagaagcaagccacatgataacaaagattgaactccttgagtttcacaagcggaagctattgggacaaggaattgcttcttgttctctagaagagcttcaagaaatcgatagtcaactccaaagaagtctgggaaaggtccgagaaagaaaggctcaattgttcaaggagcagttggagaaactaaaagcaaaggagaaacaattgttagaagagaacgtcaagttacatcaaaagaatgttattaatccatggagaggatcatcgactgatcagcagcaagagaaatacaaagttatagatttgaatttggaagttgaaactgacttattcatcggtttgccaaatagaaactgctagtaacattatataatatgtttatttatttatcatgaaatattcaaaatcattcaataaattgtgaggtaatgatttgggatag

SEQ ID NO: 4236 - DNA, 3131 bp, Artificial Sequence
  P1713 (35S::G1206)
cacaggagattcatcgttgcagagttcttcgagcttgtttttttctgtgtttgtgttcatcataaggtaaaattgagttttcgatcttcttctgatttccaattctagactcaattgtctcttttgattgatttggttttaataatgttgtttggttttgattggaatcgattgatcatatactgttttattgcgattaattttgattatgatcgaagaactcgaatttgttgtctctgttttagatattcaaatctgcatgttcgttttgtttcaattttggtgtaagaatctgtttcatagatctgaattaccatcactggcgatttttgtttgcaggagctaaagaatggattctggagttaaattggagcatatgaattgtttccaattatcttatcaatattcgtggacgactaggaagaagagaactctgaaaccattcatgtcaaaaggttctagccctagtagtagtagtgatagtaggaaacggaagctttcgagagctgaagatagcgatgattcagcggttaaacggaatgcgaaacgaaggagaaagatatgcaaagtagaagaatattatgaagatgatgattgcatattaagtgattgggttcagaggaatactgcgaaaaggattgataagcgcaacgaagaagttgaagttatggttaagatagagtcaggtgatgattgcacaataggtaagtggttttctgatgttagtagtaaaaggaaagataaacgacaagtagaagttgatgaagatgaggaatgggaagaagaagttacactgtgttctaagatcaaggcaacgtcgtcgcgaagcagaacccatagtttaagtgctaacagtccagaaaatgttacagatgttattagtccttgtcgttcacggtctccagcttctaatgtatcagattccattcagaaaaatgactgcaccagtagtagaaaacagagtggcccaatttgtcatcagtgcttgaaaggggaaaggataacacttctcatttgtagtgaatgtgagaagacaatgttttgtcttcaatgtataaggaaatggtatccaaatctatctgaggatgatgttgttgagaaatgtcctttatgccgtcaaaattgtaattgtagcaaatgcttgcatttgaatggtttaattgagacatcgaagagggaactcgcgaaatctgaaagacgtcatcatctccagtatttgattacgttgatgcttccttttctgaataagttatccatattccagaagctagagattgaatttgaggcaactgttcaaggaaaactgccttctgaagttgaaataactgcggctataagctacactgatgaacgtgtatactgtgatcattgtgcaacttcaattgttgacttgcatcgaagctgtccaaagtgctcttatgaactttgtttgaagtgctgtcaagagattcgtgaaggatcgctttctgaacgccctgaaatgaagttccattatgttgatagaggacatcgatatatgcatggtttagatgctgcggaaccgagcttgtcttccacttttgaagacgaagaagctaacccatctgacgctaagtggagccttggtgaaaatggaagcatcacttgtgcaccagaaaagctaggtggttgtggtgaacggatgctagagcttaggcggatcctaccactcacgtggatgtcagatttagagcacaaagcagagactttcttatcatcatacaatataagccctagaatgttgaactgtaggtgttcttctttggagacagagctgacaaggaaatcagcttcgaggacaacatcaagtgacaactaccttttctgtcctgaatctctcggtgtcttgaaggaagaagagcttcttcattttcaagagcattgggcaaaaggcgaaccagtaatcgttaggaacgctcttgacaacacacctggtttaagctgggagccgatggttatgtggcgggctttatgcgaaaatgtgaattcaacatcaagctctgagatgtcccaagtcaaagcaattgattgcttagctaattgtgaggtggagatcaatactcgtcagttctttgaaggttatagcaaaggaagaacatatgaaaatttctggcctgagatgttgaagcttaaggactggcctccttctgataagtttgaagatcttctacctcgtcactgtgatgagttcatatccgcgttacctttccaggaatatagtgatcctagaactggaattcttaacattgcaacaaagcttcctgaaggatttatcaaaccagatttaggtccaaaaacttacatcgcctatgggattccagatgagcttggtagaggcgattccgtgactaagcttcactgcgatatgtcagacgcggtgaatattctaacgcatacggccgaagtgaccctaagtcaagaacaaatatcctcagtcaaagcactgaaacagaaacacaagttacagaataaggtcgataaacagagtactgaagactgtaacgaaaaggaagaagaagaagaagaagaattgaacatgccagagatttcgagcaatgaaaatgaagaaacgggcagtgctctttgggacatatttaggagagaagacgttcccaagttagaagagtatctaagaaagcattgcaaagaatttagacacacttattgtagtccagttacaaaggtaacaacacccacctgcatcaattttatgacgaatttatttccggtactgacggtttcttcttttcaggtttatcatccgatacatgaccaatcatgctatttaaccttagagcacaaaagaaaactcaaggcggaatatgggatcgagccatggacatttgtgcaaaagctaggtgaagcggtgtttattcccgcgggttgtcctcatcaagttcggaatctaaagtcgtgcacaaaagtcgcagttgactttgtgtcaccagagaacatccatgagtgtctgcgtttgaccgaagagtttcgccaacttcccaaaaaccacaaggccagagaggacaaactcgaggcaagtcttttatctctttgacatttctttctttcttttttttttgttcgttgtctgagcatactgtgcattgcttgctgcg

SEQ ID NO: 4237 - DNA, 1652 bp, Artificial Sequence
  P1717 (35S::G634)
cgtcgacctagagagaaagagagagtgtgtgtgtagaaaaagattgaaacatcatcaagattgatggagcaaggaggaggtggtggtggtaatgaagttgtggaggaagcttcacctattagttcaagacctcctgctaacaacttagaagagcttatgagattctcagccgccgcggatgacggtggattaggaggtggaggtggaggaggaggaggaggaagtgcttcttcttcatcgggaaatcgatggccgagagaagaaactttagctcttcttcggatccgatccgatatggattctacttttcgtgatgctactctcaaagctcctctttgggaacatgtttccaggaagctattggagttaggttacaaacgaagttcaaagaaatgcaaagagaaattcgaaaacgttcagaaatattacaaacgtactaaagaaactcgcggtggtcgtcatgatggtaaagcttacaagttcttctctcagcttgaagctctcaacactactcctccttcatcttccctcgacgttactcctctctccgtcgctaatcccattctcatgccttcttcttcttcttctccatttcccgtattctctcaaccgcaaccgcaaacgcaaacgcaaccgcctcaaacgcataatgtctcttttactcctactccaccgtatcaaccgccacccgcggtcactaaacgtgtggcggaaccaccattatcaacagctcaatctcaatcacaacaaccaataatggcgattccacaacaacaaattcttcctcctcctcctccttctcatcctcacgctcatcaaccagaacagaaacaacaacaacaaccacaacaagagatggtcatgagctcggaacaatcatcattaccatcatcatcaagatggccaaaggcagagattctagcgcttataaacctgagaagtggaatggaaccaaggtaccaagataatgtacctaaaggacttctatgggaagagatctcaacttcaatgaagagaatgggatacaacagaaacgctaagagatgtaaagagaaatgggaaaacataaacaaatactacaagaaagttaaagaaagcaacaagaaacgtcctcaagatgctaagacttgtccttactttcaccgcctcgatcttctttaccgcaacaaagtactcggtagtggcggtggttctagcacttctggtctacctcaagaccaaaaacagagtccggtcactgcgatgaaaccgccacaagaaggacttgttaatgttcaacaaactcatgggtcagcttcaactgaggaagaagagcctatagaggaaagtccacaaggaacagaaaagaagaccttgtgatgagagagctgattcaacaacaacagcaactacaacaacaagaatcaatgataggtgagtatgaaaagattgaagagtctcacaattataataacatggaggaagaggaagatcaggaaatggatgaggaagaactagacgaggatgagaagtccgcggctttcgagattgcgtttcaaagccctgcaaacagaggaggcaatggccatacggaaccacctttcttgacaatggttcagtaaaatcagaatcattgtttcaagaaaatgtacttatgtgtgcatagttttcgc

SEQ ID NO: 4238 - DNA, 1237 bp, Artificial Sequence
  P1721 (35S::G2156)
tcacatcaattaatacgacaccgtctcgggtgaagaatctctcctctcttgccctaaagcgagttagggtttaacacacaaagcataccctttagatttgtgtctcttagctctgtttttgtcggcttgtgtaaccgatcaactcaagctattggctcctcacctcctgaaatttgacttctccaatggatctcaaagtttctcttatatgaattctatcttcaccctcacaatatctttatatatatgagccacaagaacaagaagagtcagtagatgcggctgccatggacggtggttacgatcaatccggaggagcttctagatactttcacaacctcttcaggcctgagcttcatcaccagcttcaacctcagcctcaacttcaccctttgcctcagcctcagcctcaacctcagcctcagcagcagaattcagatgatgaatctgactccaacaaggatccgggttccgacccagttacctctggttcaaccgggaaacgtccacgtggacgtcctccgggatccaagaacaagccgaagccaccggtgatagtgactagagatagccccaacgtgcttagatctcatgttcttgaagtctcatctggagccgacatagtcgagagcgttaccacttacgctcgcaggagaggaagaggagtctccattctcagtggtaacggcacggtggctaacgtcagtctccggcagccggcaacgacagcggctcatggggcaaatggtggaaccggaggtgttgtggctctacatggaaggtttgagatactttccctcacaggtacggtgttgccgccccctgcgccgccaggatccggtggtctttctatctttctttccggcgttcaaggtcaggtgattggaggaaacgtggtggctccgcttgtggcttcgggtccagtgatactaatggctgcatcgttctctaatgcaactttcgaaaggcttccccttgaagatgaaggaggagaaggtggagagggaggagaagttggagagggaggaggaggagaaggtggtccaccgccggccacgtcatcatcaccaccatctggagccggtcaaggacagttaagaggtaacatgagtggttatgatcagtttgccggtgatcctcatttgcttggttggggagccgcagccgcagccgcaccaccaagaccagccttttagaattgaaaattatgtccgtaacatagctgtaaccaaatttc

SEQ ID NO: 4239 - DNA, 1348 bp, Artificial Sequence
  P1722 (35S::G2157)
cccatgtcttgtgtgtctgcttcatgcaacatgttggtttggatttggttaatctaaaagtttaagataaggttttcggattctcttcctgtcttgtaatagtttcttgtcggagagccatcaacaccaacttcaacaaaaaaaacaagaaaaagaaaaagattctctttctcgttttatttccattagagaagaaaaaaagaatggcgaatccttggtgggtagggaatgttgcgatcggtggagttgagagtccagtgacgtcatcagctccttctttgcaccacagaaacagtaacaacaacaacccaccgactatgactcgttcggatccaagattggaccatgacttcaccaccaacaacagtggaagccctaatacccagactcagagccaagaagaacagaacagcagagacgagcaaccagctgttgaacccggatccggatccgggtctacgggtcgtcgtcctagaggtagacctcctggttccaagaacaaaccaaagagtccagttgttgttaccaaagaaagccctaactctctccagagccatgttcttgagattgctacgggagctgacgtggcggaaagcttaaacgcctttgctcgtagacgcggccggggcgtttcggtgctgagcggtagtggtttggttactaatgttactctgcgtcagcctgctgcatccggtggagttgttagtttacgtggtcagtttgagatcttgtctatgtgtggggcttttcttcctacgtctggctctcctgctgcagccgctggtttaaccatttacttagctggagctcaaggtcaagttgtgggaggtggagttgctggcccgcttattgcctctggacccgttattgtgatagctgctacgttttgcaatgccacttatgagaggttaccgattgaggaagaacaacagcaagagcagccgcttcaactagaagatgggaagaagcagaaagaagagaatgatgataacgagagtgggaataacggaaacgaaggatcgatgcagccgccgatgtataatatgcctcctaattttatcccaaatggtcatcaaatggctcaacacgacgtgtattggggtggtcctccgcctcgtgctcctccttcgtattgattagttagataggcggtggttggtgcgttctttttactggaatgattatattttccattaggatggttaggcttttgtttattaaagctatcaagtttcttttttttttacggataattcggatgacaattagctagtgtttgtttgtttgttttgtggcggcttttctgacttgactattttgatcgcggatagctttgtatgaaagtgaa

SEQ ID NO: 4240 - DNA, 1050 bp, Artificial Sequence; identical to SEQ ID NO: 1495
  P1724 (35S::G2383)

SEQ ID NO: 4241 - DNA, 1118 bp, Artificial Sequence
  P1725 (35S::G2085)
gttctttctctatatccttcaatcaatgtgaaaaaaaagctctcccttttggcagtttccgatgtttggtcgccattcgattatcccaaataaccagattggtaccgcctctgcttccgctggtgaagaccatgtctctgcctccgctacgtctggtcacattccttacgacgatatggaagaaatccctcatcctgactctatctatggtgctgcctccgatttgattcccgatggctctcaattggttgctcaccgatccgatggctctgaattacttgtttctcggccaccggaaggggcgaatcagcttacgatctcgttccgtggacaagtttacgtttttgatgccgttggtgctgacaaggtggatgctgtgttgtcgctgttgggtggttctactgagcttgctcctggtccgcaggtgatggaactagctcaacagcagaatcatatgcctgttgtagaatatcagagccgctgtagccttccgcaacgggcacaatccttggataggtttcggaagaagaggaatgctagatgtttcgagaagaaagtaagatacggtgttcgccaagaagttgccttaagaatggcacgtaataaaggtcaattcacctcttcaaagatgacagatggggcttataactctggcacagatcaagattctgcccaagatgatgcccatccagaaatatcgtgtactcattgcggcattagttccaaatgtacaccaatgatgcgacgtggcccttccggccccaggactctctgcaatgcctgtggacttttttgggctaacaggggtacattgagggatctctcaaagaaaacagaagagaatcagttggctttaatgaaaccggatgatggtgggagtgttgctgatgctgctaacaacttaaacactgaagctgcaagtgttgaagaacacacttccatggtttctcttgccaatggggataattctaatctgttaggtgatcactaaatactgtgataagaatcagaagatagaaatctttgtagaatcagatggtcttctctatgaatttatcttttcaccatcacatgtattatagaaaccgtaaccgaacctcaaatcaaataccatacag

SEQ ID NO: 4242 - DNA, 1235 bp, Artificial Sequence
  P1726 (35S::G1779)
tagcttggatccttctttacttgtccctgatctctcctaatctctcgtcttccctctcttttgtgcttcatcgatctctatcggtcatgggttccaattttcattacacaatagatctcaatgaagatcaaaaccatcagccttttttcgcttctcttggatcctctcttcatcatcatctacaacaacaacaacaacaacaacaacattttcatcaccaagcttcttctaatccctcttctttgatgtcaccgtctctttcctactttcctttcttgataaactctcgccaagatcaagtatatgttgggtacaacaataacacttttcatgatgttcttgatacccatatctcccaacctctcgagaccaagaactttgtatctgatggtggttcatcatcaagtgatcaaatggtgcccaagaaggagacacgactaaaattgacgataaagaagaaagataatcatcaagaccaaaccgatcttcctcaatccccaataaaagacatgacaggaactaactcgctcaagtggatatcttcgaaggtgagattaatgaagaagaaaaaggcgattattaccaccagcgacagcagcaaacaacacactaataacgaccaatcctcaaacctaagcaattcggaaagacagaatggttataacaacgattgcgtgattaggatttgctccgattgtaacacaaccaagactcctctttggagaagtggtccgagaggtcccaagtctctttgtaacgcttgtggaataaggcaaaggaaggccaggcgggccgctatggccacggcaaccgcaaccgcagtctctggcgtatccccaccggtcatgaagaagaagatgcaaaacaagaacaagatatcaaatggagtttataaaatcttatctcctttgcccctaaaggtaaacacgtgtaagagaatgatcacactagaggagaccgcattagccgaggatttggagacccagagcaactccacgatgttatcatcttcagacaatatctatttcgatgatctagcattactgttgagcaaaagttcagcttatcagcaagttttccctcaagatgagaaggaggctgccattttactaatggctctatcgcacggaatggttcacgggtgattattttaagtattttaattataactcgcatgcttaagaaataaaatataaaccataccataagccctcatagctagtaatatctagatt

SEQ ID NO: 4243 - DNA, 1775 bp, Artificial Sequence
  P1727 (35S::G957)
aagttgtaaccatttccactcgtaatcatacaacttctctactcttctagagcaaaaacccaaaaatatattgctatcttcgttaatggctgataataaggtcaatctttcgattaatggacaatcaaaagtgcctccaggtttcagattccatcccaccgaagaagaacttctccattactatctccgtaagaaagttaactctcaaaagatcgatcttgatgtcattcgtgaagttgatctaaacaagcttgagccttgggatattcaaggttaaaccctaaatatgaaaaaaaactctttcatttctacgaactctctatttctttgttctttatttttgaaccattttggtatgcaaatgcagaggaatgtagaatcggttcaacgccacaaaacgactggtacttcttcagccacaaggacaagaagtatccaaccgggaccaggacgaaccgggcaacagtcgctggattctggaaagctaccggacgtgacaaaatcatctgcagttgtgtccggagaattggactgaggaagacactcgtgttctacaaaggaagagctcctcacggtcagaaatccgactggatcatgcatgagtatcgcctcgacgatactccaatgtctaatgtaagtatatatagcaatcatcaatttgcagtttaggttagaataaacaaattacaaacttatagtcaaagaattagctagattcgtttcatgctataaaaggttttggttcatttagtacgcactagagccttcttttagcatctgcaattaaagtaatcgaacatgattctctgagttacaataagataatttcttatgaaattaacacatcatatatacatttatataaaaagattttttcacaaggcttaaaatagtttaacacggctctacaaacaatacgtagttaactagttatggttgcatatccaaaagaaaaaccaacataaaagatttttttttttgtttcaaaataaaagttgcatttttacatcatcaagatttaatcatctcttattgcatttcataagatcgatttgtgttccattatcagggctatgctgatgttgttacagaagatccaatgagctataacgaagaaggttgggtggtatgtcgagtgttcaggaagaagaactatcaaaagattgacgattgtcctaaaatcactctatcttctttacctgatgacacggaggaagagaaggggcccacctttcacaacactcaaaacgttaccggtttagaccatgttcttctctacatggaccgtaccggttctaacatttgcatgcccgagagccaaacaacgactcaacatcaagatgatgtcttattcatgcaactcccaagtcttgagacacctaaatccgagagcccggtcgaccaaagtttcctgactccaagcaaactcgatttctctcccgttcaagagaagataaccgaaagaccggtttgcagcaactgggctagtcttgaccggctcgtagcttggcaattgaacaatggtcatcataatccgtgtcatcgtaagagttttgatgaagaagaagaaaatggtgatactatgatgcagcgatgggatcttcattggaataatgatgataatgttgatctttggagtagtttcactgagtcttcttcgtctttagacccacttcttcatttatctgtatgattatctatacatacacatacacaaaatataaaataaagtttgttaaaaaatgtctcatgttctattgatagtacgtcttgat

SEQ ID NO: 4244 - DNA, 1311 bp, Artificial Sequence
  P1735 (35S::G2535)
tagacatactttggttagttataaactcgttctattttcttctcctttttctatctttagcaatgaacatatcagtaaacggacagtcacaagtacctcctggctttaggtttcacccaaccgaggaagagctcttgaagtattacctccgcaagaaaatctctaacatcaagatcgatctcgatgttattcctgacattgatctcaacaagctcgagccttgggatattcaaggttcatcatttatcttttattcttgatgaaacgtattaatagggcttgtatatattaattaaattagttttttaatgcatgtgttgagtcaagaactaaagctctgaattcaggaaattttgcagagtaatatatactttttgtgataataaaatttgcagtaacaaaattcagtcaaaacttaacacaactcttgttttttctatgtagagatgtgtaagattggaacgacgccgcaaaacgattggtacttttatagccataaggacaagaagtatcccaccgggactagaaccaacagagccaccacggtcggattttggaaagcgacgggacgtgacaagaccatatataccaatggtgatagaatcgggatgcgaaagacgcttgtcttctacaaaggtcgagcccctcatggtcagaaatccgattggatcatgcacgaatatagactcgacgagagtgtattaatctcctcgtgtggcgatcatgacgtcaacgtagaaacgtgtgatgtcataggaagtgacgaaggatgggtggtgtgtcgtgttttcaagaaaaataacctttgcaaaaacatgattagtagtagcccggcgagttcggtgaaaacgccgtcgttcaatgaggagactatcgagcaacttctcgaagttatggggcaatcttgtaaaggagagatagttttagaccctttcttaaaactccctaacctcgaatgccataacaacaccaccatcacgagttatcagtggttaatcgacgaccaagtcaacaactgccacgtcagcaaagttatggatcccagcttcatcactagctgggccgctttggatcggctcgttgcctcacagttaaatgggcccaactcgtattcaataccagccgttaatgagacttcacaatcaccgtatcatggactgaaccggtccggttgtaataccggtttaacaccagattactatataccggagattgatttatggaacgaggcagatttcgcgagaacgacatgccacttgttgaacggtagtggataacggaaatggaagagaggaagtgactaagtgagtg

SEQ ID NO: 4245 - DNA, 1548 bp, Artificial Sequence
  P1740 (35S::G2153)
gcaatttgtcttgtgtttctcacaacacaaaaacttgtaaaagtgttaaaaaatcaagatctgaaaaatcttatcaccgcttctaggtttttcagttttttttcttccttttcctgatctaaattaacttatatttcttagggtttcacttcttgaaacatttaatcagaattaattaacctctctagggctttcatggcgaatccatggtggacaggacaagtgaacctatccggcctcgaaacgacgccgcctggttcctctcagttaaagaaaccagatctccacatctccatgaacatggccatggactcaggtcacaataatcatcaccatcaccaagaagtcgataacaacaacaacgacgacgatagagacaacttgagtggagacgaccacgagccacgtgaaggagccgtagaagcccccacgcgccgtccacgtggacgtcctgctggttccaagaacaaaccaaagccaccgatcttcgtcactcgcgattctccaaatgctctcaagagccatgtcatggagatcgctagtgggactgacgtcatcgaaaccctagctacttttgctaggcggcgtcaacgtggcatctgcatcttgagcggaaatggcacagtggctaacgtcaccctccgtcaaccctcgaccgctgccgttgcggcggctcctggtggtgcggctgttttggctttacaagggaggtttgagattctttctttaaccggttctttcttgccaggaccggctccacctggttccaccggtttaacgatttacttagccggtggtcaaggtcaggttgttggaggaagcgtggtgggcccattgatggcagcaggtccggtgatgctgatcgccgccacgttctctaacgcgacttacgagagattgccattggaggaggaagaggcagcagagagaggcggtggtggaggcagcggaggagtggttccggggcagctcggaggcggaggttcgccactaagcagcggtgctggtggaggcgacggtaaccaaggacttccggtgtataatatgccgggaaatcttgtttctaatggtggcagtggtggaggaggacagatgagcggccaagaagcttatggttgggctcaagctaggtcaggattttaacgtgcgttaaaatggtttttaatttacagaagttaacaataagattataatgatgtttattatgatgatgaaaaccagtcagttgctacttgttactagtgagctatatagtttgtggacattatattatgttctctcttgactatgattattatttgctaaatttcacttagcttacttgtgtttttatgatgttttattaaaagtttttctctttgttggattctccaattttttatagtgaggttaagtgtgcatacatatatacatgtgtacatgattgacgatcctcattaaattagaacaccttggggttgaccctttttcaaatatgattagcatatacagactatatataatttgaaaatgataaaatttcaagtgcttggtgtaattcctttcgaa

SEQ ID NO: 4246 - DNA, 780 bp, Artificial Sequence
  P1742 (35S::G2155)
ctcatatataccaaccaaacctctctctgcatctttattaacacaaaattccaaaagattaaatgttgtcgaagctccctacacagcgacacttgcacctctctccctcctctccctccatggaaaccgtcgggcgtccacgtggcagacctcgaggttccaaaaacaaacctaaagctccaatctttgtcaccattgaccctcctatgagtccttacatcctcgaagtgccatccggaaacgatgtcgttgaagccctaaaccgtttctgccgcggtaaagccatcggcttttgcgtcctcagtggctcaggctccgttgctgatgtcactttgcgtcagccttctccggcagctcctggctcaaccattactttccacggaaagttcgatcttctctctgtctccgccactttcctccctcctctacctcctacctccttgtcccctcccgtctccaatttcttcaccgtctctctcgccggacctcaggggaaagtcatcggtggattcgtcgctggtcctctcgttgccgccggaactgtttacttcgtcgccactagtttcaagaacccttcctatcaccggttacctgctacggaggaagagcaaagaaactcggcggaaggggaagaggagggacaatcgccgccggtctctggaggtggtggagagtcgatgtacgtgggtggctctgatgtcatttgggatcccaacgccaaagctccatcgccgtactgaccacaaatccatctcgttcaaactagggtttcttcttctt

SEQ ID NO: 4247 - DNA, 1289 bp, Artificial Sequence
  P1743 (35S::G2522)
tcgaccggttgcatgttgttatcttgctcttgaagtctatcgaacccttttagattctgattttgttctcttcttatccctcctcctataagttagccatttagggtccccatcgaattttactaagttaaagtcagagtctttttggttaagctatggatcgaagagacgcaatggcgttatccgggtcgggttcttactatatccaaagaggaatccccggttctggtcctcctcctcctcaaactcaaccaacgtttcacggatcacaaggatttcatcatttcaccaattccatctctccttttgggtcaaacccaaacccaaatccaaaccctggaggtgtctctactggattcgtgtctcctcctttacccgttgactcttctccggctgattcgtcagcggcggcggcgggagctttggttgctcctccttcaggtgacacgtctgtgaagcggaagagaggacggcctagaaaatatggacaagatggtggttctgtttcgttggcattgtctccttctatctccaacgtttccccgaactctaacaaacgtggccgtggaagacctcctggctccggcaagaagcaacggctatcttccattggtgaaatgatgccttcatcaactgggatgagcttcacaccgcatgtaatcgtagtttccattggtgaagacattgcttcaaaggttatatcgttctcgcatcaaggtccacgagcgatatgtgtcttatccgcaagtggtgctgtctctactgcaactcttcttcagccagcaccttctcatggaactattatatacgagggtctattcgagctcatatctctctcaacttcttatctgaacacaactgacaatgactacccaaaccgcactggaagtctagcggtctcacttgctagccccgatggtcgtgtcattggtggtggaattggaggtcctctaatagcagcaagccaagtccaggtcattgttggcagcttcatttgggcaattccgaaagggaagattaaaaaacgtgaagaaacttctgaagatgtccaagatactgatgctttggaaaacaacaacgataacacagcagcaacgtcacctcctgttcctcagcaaagtcagaacattgttcagactcctgtaggcatttggtcaactggttcaaggtcaatggatatgcatcacccccatatggacattgatctaatgcgtggatgattcatgtatatataagcattgaatctaggagaagaagaagaaacttgagctaacctccctgaaacaaag

SEQ ID NO: 4248 - DNA, 1199 bp, Artificial Sequence; identical to SEQ ID NO: 703
  P1744 (35S::G937)

SEQ ID NO: 4249 - DNA, 712 bp, Artificial Sequence
  P1750 (35S::G347)
ttcgattccttacccttctccaatcgaagtttttggctttgaattggatttgggtttcgttccaaaatcagctctttttgttaatcagcagatatgcaggaccagctggtgtgtcatggttgtaggaatttattgatgtatcctagaggagcatctaatgtgcgttgtgcgttatgtaacactatcaacatggttcctcctcctcctccacctcacgacatggcacacattatatgtggtggttgtagaacaatgcttatgtatacgcgtggggctagtagcgtaagatgctcttgctgtcaaactacgaaccttgtgccagcgcactccaatcaggttgcccatgctccttccagtcaggttgcgcagatcaattgtgggcattgtcggacgaccctcatgtatccttacggtgcatcatccgtcaaatgcgctgtttgtcaattcgtaactaacgttaatatgagcaatggaagggtacctctcccaactaaccggccaaatggaacagcttgtcccccctctacatcaacttcaacaccaccctctcagacccaaaccgttgttgtagaaaaccccatgtccgttgatgaaagcggaaagttggtgagcaatgttgttgttggagtgacaactgacaaaaagtaatcaagaatgagtgagatcttaaagatcaaatccaaattcttcctctattcctgcgtttggtttg

SEQ ID NO: 4250 - DNA, 1341 bp, Artificial Sequence
  P1755 (35S::G1389)
acaaagcaagtgggcaacaaaaacggcacgcaagtttttcttccaagttaaaacaactcttggaatgtcattttgaaaggtaaaaaaataatgggacttaaaggatatagcgtcggagaaggaggaggagagatagttgaggttcaaggcggtcacataatccgagccactggacgcaaagaccgtcatagcaaagtgttcacatcaaagggtccacgtgaccggcgcgtgagactctcagctcacacggcgattcaattctacgatgtgcaagaccggttaggttatgaccggcctagcaaagccgttgattggctcatcaagaaagccaaaaccgctattgataagcttgaactcggggagactactactactactactcgtcaagaaccggtgaatactaaaccggaatctcccactttggttttccaaagagagaacaatgaccaaacgcagttcgtggcggccaatcttgatcctgaagacgcaatgaaaacgtttttcccggcgacgacaacaacaaacggtggtggtggtacaaacatcaatttccaaaactaccctcatcaggatgacaacaacatggtctcaagaacaacaacaccaccaccaaaccttagccaagatcttggtctctctcttcacccatttcaagggaacaacaacacagtcgtagttcccgagaccaacaatttcaccacgactcatttcgacacgttcgggagaatctctggatggaatcatcacgacttaactatgacgtcatcatcctcatcagaacatcaacaacaagaacaagaagaaaggagtaatggtggtttcatggtgaatcatcatcctcaccatcatcatcatcaaccgtcgatgatgacattgcttaatagtcagcaacaacaagtgtttcttggtggccaacaacaacaacaacaaaggggtacccttcagtccagtttattccctcattcgtttcgttcttgggatcatcatcaaacgacgtcggatcatcatcatcatcagaatcaagcttcttcgatgtttgcttcatcatcacagtatggttctcatgggatgatgatgatgcaaggccttagtttccccaacactacaagactactccacggagaagaagctactcaaccaaactcttcttcttctcctccaaactcacacctctaaactaaggtttgcttcttctttttaatgtatttatatattttaagtataataggttattaatcaagaaaccagacaataattaaatctttcataattaaattaccacatgtatttctttcagacaaccatggaggttcaaattcatgatgacatgcattgaacaag

SEQ ID NO: 4251 - DNA, 576 bp, Artificial Sequence
  P1762 (35S::G354)
ttcaaaatggttgcgagaagtgaggaaattgtgatagtggaagaagatacgactgcgaaatgtttgatgttgttatcaagagtcggagaatgcggcggcggctgcgggggagatgaacgtgttttccgatgcaagacttgtcttaaagagttctcatcgtttcaagctttgggaggtcatcgtgcaagccacaagaaacttatcaacagtgacaatccatcacttcttggatccttgtccaacaagaaaactaaaacgtctcatccttgtccgatatgtggagtgaagtttccgatgggacaagctcttggtggtcacatgaggagacataggaacgagaaagtctcaggctcgttggttacacgttcttttctaccggagacgacgacggtgacggctttgaagaaatttagtagtgggaagagagtggcttgtttggatttggacttagattcgatggagagtttggtcaattggaagttggagttgggaagaacgatttcttggagttaagtttttgggttgtatacagtttcacatgattttgtaatctttgttgatccaattatcgtaccg

SEQ ID NO: 4252 - DNA, 745 bp, Artificial Sequence
  P1763 (35S::G355)
cgttcaggtttcttttctaacaagcaaaaactccaacctttactttatttttgttttgttttgtaaccctctcagatcttaattctcaaagaagtatgaagagagaaagatctgatttcgaagaatccctcaagaatattgacattgctaaatgtctgatgatactagcacaaacctccatggtcaaacagatcggtttgaaccaacataccgagagccatacaagcaaccaattcgaatgcaaaacatgtaacaagagattttcttcgtttcaagcccttggtggccaccgggcaagccataagaagccaaagctcaccgttgagcagaaagatgtgaaacatcttagcaacgattataaaggaaatcattttcacaagtgttccatatgcagtcagagttttgggaccggacaggctttaggtggtcacatgagacggcataggtcaagcatgacggtcgagccatcgttcatctctccgatgattccatccatgccggttttgaaacgatgcggtagtagtaagaggattttgagtttggatttgaatctgactccgttagagaatgatcttgaatatatctttgggaagacatttgtcccaaaaatagatatgaagttcgttctttagttttttttttctttatctttaagaagacatttgtcccaaaaatgattcatttgtattgtaattcctattcttttaattcttcaaacgttaatgtcaacaaacttcatggtata

SEQ ID NO: 4253 - DNA, 1241 bp, Artificial Sequence
  P1767 (35S::G2123)
gaaatgcccaaaattactcttgtatacgaagaaatcagtgtagcaactttatccatctttctataaccttataagaagtaactaagcggttgttgtggcagatgtgatgaaatcgatgagaaaagtatgtgagcttgatatagagctaagtgaagaggaaagagacctactaacaactggatacaagaatgtcatggaggctaagagagtttcattgagagtaatatcatccattgaaaaaatggaagactcgaaaggaaacgaccaaaatgtgaaactgataaaaggacaacaagaaatggttaaatatgagtttttcaatgtttgtaatgacattttgtctctcattgattctcatctcataccatcaactactactaatgtcgaatcaattgtcctttttaacagagtgtaagtcatattccgttatcataatcatgatcaactctttttttttttttttttttaattagcattttgttatattgtttcttggtatgtgtaggaaaggagattattttcgatatatggcagagtttggttctgatgctgaacgtaaagaaaatgcagataattctctagatgcatataaggtcttctttcaatcatgtttaccctcaactttaatattttattttcccctattttcttcgaaatattagtttggaaaaagcatggaaaaacatgaaaaaggcatatattttgtaggttgcaatggaaatggcagagaatagtttagcacccaccaatatggttagacttggattggctttaaatttctcgatattcaattatgagatccataaatctattgaaaggtaatatcacatttgcttataaataaaataagtgcggcgtttcaaaatctatcaaaaactttgtatatataataactaatttatattttcattgccaattaattttaatgaacagttttttacagttttttgaatatcttagtttcttacagttaactaatagtaattttatatgtgaatttatacagcgcatgtaaattggttaagaaagcttacgatgaagcaatcactgaactcgatggccttgacaagaatatatgcgaagagagcatgtatatcatagagatgcttaaatacaatctttctacgtggacttcaggcgatggtaatggtaataagacagacggttagaaaatgtaatttgaggcgatatgatgaaggtaaatcattgatcgtgtttatcaggtttaatagtttacataa

SEQ ID NO: 4254 - DNA, 1411 bp, Artificial Sequence
  P1768 (35S::G989)
cctgtcattactctctcgaaccctttctcttttcgaatctccacttttttttctatcttctgcttcttcttcttctctcttcaatgattccactctcacaaaatctccatgactacaaaacgcatagacagagatctcccatcttccgacgatccttcctccgctaaacgccgtatcgaattccccgaagaaacactcgaaaacgacggtgctgccgcaatcaaactccttagcttactcctccaatgcgccgaatacgtagctactgatcatctccgtgaagcttcaacacttttatccgaaatctccgagatatgttctccgttcggttcctcgccggagcgagtcgtcgcttacttcgctcaagcgctacaaacgcgcgtgatcagctcttacctctccggcgcgtgttctcccctctccgagaaaccactcactgttgttcagtctcagaaaatcttctccgccttgcagacttataactccgttagtcctctgatcaaattctcacatttcacggcgaatcaagccatttttcaggcgcttgacggagaagattccgttcatatcatcgatctcgatgttatgcaaggtcttcaatggccggctctatttcacatcctcgcttcacgtcctcgaaaactccgatcaattcgaatcaccggatttggttcctcctccgatctactcgcttcaactggccggagactcgccgatttcgcatcatcgttaaacctccctttcgaatttcatccaattgaaggcataatcggaaacctaatcgatccgagccaactcgcaacgagacaaggagaagctgtggtggttcattggatgcagcaccggttatatgatgttacagggaacaatctcgagacgttggagattctacggaggctgaaaccgaatctgatcacggtggtggagcaagaattgagctacgacgatggaggaagctttttaggaagattcgtggaggctttgcattattatagcgcgttgtttgacgcgctaggagatggattgggtgaagagagtggtgagagattcacggtggagcagattgttttggggacggagataagaaacattgtggcgcacggaggaggaagaaggaagagaatgaagtggaaagaagaactgagccgggtcgggtttagacctgtttcgcttcggggtaacccggcgacacaagcgggtttattgttgggtatgttaccgtggaatggatatactttggttgaagagaatggaaccctccgtcttggctggaaggatctctcgcttttgactgcctctgcctggaaatctcagccgttcgattgattttatttttattttataatgcaaactgcaaagtgatcattaagattttttgttttgaaaatatttccaaacaaattacgataat

SEQ ID NO: 4255 - DNA, 1863 bp, Artificial Sequence
  P1770 (35S::G910)
gtcaccaatctctgatctttttagttctcttatcggtaaaaacttattcttctctttttgttcgatctgtgatctctaataaactaatttgatattttttttgatgtaacagggaggaatcttttatatgttatgtataataataattgagaatatggaaagagtatgtgagttttgtaaagcgtatagagcagtggtttattgtatagctgatacagcaaatctttgtttaacatgtgatgcaaaggttcattcagctaattcactctcgggacggcatttacgtacggttttatgtgattcttgtaagaatcagccttgtgttgttcgatgttttgaccataaaatgtttctttgccatggatgtaatgataagtttcatggtggtggctcttctgagcatcgtagaagggatttgaggtgttatacgggttgtcctcctgctaaagatttcgcggttatgtggggttttcgagttatggatgacgatgatgatgtttcgttagagcaatcttttcgaatggttaaacctaaggtttgatgcttgttttgtatacatatttacagtttcttataaccggtgtaagatctcgggtcgaaagtagactaatacacccgaggcttgtagaaagccgtctacaatggccaaaagagaaccacaacgatctgtggccttaaaccatagggcgagtctttcacctacttgaacaaaccactggaccatacgctctttagtttttttttgtatatctttttatagctttgtagatgaatagatctctttatagctgatgtaccgatgattttgatggtttcaggtgcaaagagaaggtggttttatcttggaacagattcttgaattggagaaggttcagctcagggaagagaatggtagttcttccttgacagaacgaggtgatccatctccattggagcttcctaagaaacccgaagaacagttaatcgatcttccgcagaccggaaaagagctggttgttgatttttcacacttgtcctcatcttccacacttggtgattccttttgggaatgcaaaagtccatacaataagaacaatcaggtttggtttaaatatcacacagtacatagtcttagtgggaaccattagttacatgagattagctctgtttctgcagttgtggcatcaaaatatacaagacattggagtatgtgaagatacaatctgcagtgacgatgacttccaaatacctgacattgatctcactttccggaactttgaagagcaatttggagctgatcctgagccaattgcagatagtaacaacgtgttctttgtttcttcccttgacaaatcacatgaggtttgaaatctttcatccactactatagagtctagttcagtaaccactatatatgttttattgttatataacctaagatctctctacctttgatgtgtgttcagatgaagacattttcttcttcattcaataatcccatatttgcacctaaaccagcttcatcaactatctcattctcaagcagtgaaaccgataacccttatagtcactcagaggaagtaatctcattttgtccctccctctctaacaatacacgtcaaaaggtcatcacaaggctcaaggagaagaagagagcaagagtgtaagtcttaaacaccgatgatcctaattcacattaaatagtatatcttaaacttttcataatgtaactagcattttcttaattcagggaggagaaaaaagcttaatatggtcccaagaaaatggcagagtaacacaatttcttgcaatgcctttgtacataagacactaatctacctcttcatctattttacatggctcagtttcttgcatgtaactgtg

SEQ ID NO: 4256 - DNA, 474 bp, Artificial Sequence
  P1772 (35S::G1929)
cttctttcctcaatatcacccagaagaaagagaaagtgaaacagatcaagaaagagattgagaaaaatgtgtagaggcttgaataatgaagagagcagaagaagtgacggaggaggttgccggagtctctgcacgagaccgagtgttccggtaaggtgtgagctttgcgacggagacgcctccgtgttctgtgaagcggactcggcgttcctctgtagaaaatgtgaccggtgggttcatggagcgaattttctagcttggagacacgtaaggcgcgtgctatgcacttcttgtcagaaactcacgcgccggtgcctcgtcggagatcatgacttccacgttgttttaccgtcggtgacgacggtcggagaaaccaccgtggagaatagaagtgaacaagataatcatgaggttccgtttgtttttctctgattattagatttttttggtgtaagctataaatattctagggtt

SEQ ID NO: 4257 - DNA, 1033 bp, Artificial Sequence
  P1774 (35S::G738)
cagggattaattactgtaattgaagctcacatcatggaccatcatcagtatcatcatcatgatcaataccaacatcagatgatgactagtactaacaataattcctataacaccatcgtcacaacacaaccaccaccaacaacaacaacaatggattcaacaacagcaacaactatgataatggatgacgagaagaagttgatgacgacaatgagcactaggccgcaagaaccaagaaactgtccaagatgcaactcaagcaacaccaagttttgttattacaacaactacagcttagcacagcctaggtacttgtgtaagtcttgtcggagatattggactgaaggtggctctctccgtaacgtccccgtaggcggaggttctagaaagaacaagaagcttccatttcctaattcctctacttcttcttccaccaagaacctcccggatctcaaccctcctttcgtcttcacatcatcagcttcatcatcaaaccctagcaagacgcatcaaaacaataatgacctcagcctatccttctcctcccctatgcaagacaagcgagctcaagggcattacggtcatttcagtgagcaagttgtgacaggagggcagaactgtcttttccaagctcctatgggaatgattcagtttcgtcaagagtatgatcatgagcaccccaaaaagaatcttgggttttcattagacaggaacgaggaagagattggtaatcatgataacttcgttgttaatgaggaaggaagtaagatgatgtatccttatggagatcatgaagaccgtcaacaacatcaccatgtgagacacgatgatggtaataagaagagagaaggtggttcaagcaatgagctatggagcggaatcatcctaggtggtgatagtggtggaccaacatggtgatatgaatattgtcaaaaaggacaagatgataaagacaaaaacaaatagttacgagcaaaaatatgtgattatatttggaattttcagacccggaatagtcgccttgggagggagg

SEQ ID NO: 4258 - DNA, 1494 bp, Artificial Sequence
  P1778 (35S::G1895)
cacataacacaaatctaatctcatactccatcttcttttctgtcttatgtcttcaaagattggtatgtctcaagttagagatactccggttaaattgtttggctggacaattacaccggtttctcatgatccatactcttcttcgtcccatgttcttcctgattcttcctcgtcttcctcgtcttcttctctatcacttcgaccacacatggtatgtttcatggtcttacctttatttgttaagaaatgctaaagatttaatattttctctagtccttgtatcagtttgaaactagttcatgatgttaatcctaatccaagttccttcaatttttttcagatgaataaccaatctgttactgacaatacaagtcttaagctgtcatctaatcttaacaacgagtcaaaagaaacatctgagaacagtgatgaccaacacagcgagatcacaacaattacatcggaagaagagaaaacaactgaactgaagaaaccagacaagattcttccatgtccgagatgcaacagcgcagacaccaaattctgttactacaacaactacaacgttaaccagccacgtcacttctgtagaaaatgccagaggtattggaccgctggtggatccatgaggatcgtcccggttggctcaggccgtcgcaagaacaagggatgggtttcttcagaccagtacctgcacatcacttccgaggatactgacaattacaatagctcctcaacaaagattctaagcttcgagtcttcggactctttggtaactgagaggcctaagcatcaatcaaacgaagtgaagataaacgctgaacctgtttcacaagaacccaacaacttccaagggttacttcctccccaagcatcccctgtttcgcctccttggccttaccaataccctccaaaccctagtttctaccacatgcccgtctactggggctgcgcgataccggtttggtctaccctcgacacttctacatgtcttgggaaaaggacaagagacgaaacttctcatgaaactgttaaagagagtaaaaatgcttttgagagaacaagcttgcttttggaatctcagagcatcaaaaatgaaacaagtatggctacaaataaccatgtgtggtatccagtaccgatgacccgcgagaagacacaagaattcagctttttcagtaatggagctgaaacaaagagcagcaacaacagattcgtccctgaaacgtatcttaacctgcaagcaaaccctgcagccatggcaagatctatgaacttcagagagagcatataacgttaaaggagaaaagaaactttgtagatacctttttttgtgtgatgaattaacttttaatatctatcttatttatataccacaatccccattttgtagattatccaaacagatggaaatgctgaagtgtaatgtcttttttggtaaatgtggttcgaaaatattgtttactccattatttgtattttgtagtactagtg

SEQ ID NO: 4259 - DNA, 1120 bp, Artificial Sequence; identical to SEQ ID NO: 621
  P1786 (35S::G818)

SEQ ID NO: 4260 - DNA, 1440 bp, Artificial Sequence; identical to SEQ ID NO: 1073
  P1787 (35S::G1560)

SEQ ID NO: 4261 - DNA, 1605 bp, Artificial Sequence; identical to SEQ ID NO: 1287
  P1788 (35S::G1946)

SEQ ID NO: 4262 - DNA, 1683 bp, Artificial Sequence
  P1791 (35S::G839)
atcttcatgcaagattgataattctacaagaagaagaagaagagaaaatggctactttgactgagccatcatcatctttgagtttcacatcttctcatttctcttatggttctattgggtccaatcacttctcatcaagctcagcttctaatcctgaagttgttagtctaaccaaactcagctccaatcttgagcagcttcttagtaattcagattgtgattacagtgatgcagagatcattgttgatggtgttccagttggtgttcatagatgcattttagctgcaagaagtaagtttttccaagatttgtttaagaaagaaaagaaaatttcgaaaactgagaaaccaaagtatcagttgagagagatgttaccttatggagctgttgctcatgaagctttcttgtatttcttgagttatatatatactgggagattaaagccttttccattggaggtttcgacttgtgttgatccagtttgttctcatgattgttgtcgacctgccattgattttgttgttcaattgatgtatgcttcctctgttctccaagtgcctgagctagtttcatcttttcagcggcggctttgtaactttgtggagaagacccttgttgagaatgttcttcccattcttatggttgctttcaattgtaagttgactcagcttcttgatcagtgtattgagagagtggcgaggtcagatctttacaggttctgtattgaaaaggaagttcctcccgaagtagcagagaagattaaacagcttcgacttatatccccgcaagacgaagaaaccagtcccaagatttcggagaaattgcttgaaagaatcggtaaaattctcaaggccttggattcatatgatgttcttcattttgctgcgatgcgtagagagccatcgatcattatatcgcttatcgataaaggcgccaatgcatctgagtttacatctgacggacgtagcgcagttaatatattaagaagactgacaaatccaaaggattatcataccaaaacagctaaagggcgtgaatctagtaaagccaggttatgcatcgatatcttggaaagagaaatcaggaagaaccccatggttctagatacaccaatgtgttccatttctatgcctgaagatctccagatgagactgttgtacctagaaaagagagtggggcttgctcagttgttctttccaacggaagctaaagttgctatggacattggtaacgtagaaggtacaagtgagttcacgggtttgtcacctccttcgagtgggttaaccggaaacttgagtcaggttgatttaaacgaaactcctcatatgcaaacccaaagacttcttactcgtatggtggctctaatgaaaacagttgagactggtcgaaggttttttccatatggttcagaggttctagataagtacatggctgagtatatagacgacgacatcctcgacgatttccattttgagaagggatctacacatgaaagaagattgaaaagaatgagatatagagagcttaaggatgatgtccaaaaggcatatagcaaagacaaagagtctaagattgcgcggtcttgtctttctgcttcatcttctccttcttcttcttccataagagatgacctgcacaacacaacatgaaactgcaccataagtcaaatgtaattagatatct

SEQ ID NO: 4263 - DNA, 1410 bp, Artificial Sequence; identical to SEQ ID NO: 1325
  P1797 (35S::G2030)

SEQ ID NO: 4264 - DNA, 1362 bp, Artificial Sequence
  P1813 (35S::G2011)
cacaccccaatttctcactctctctctcactaaaacccgtaaattttctactatatcaaatgagcccaaaaaaagatgctgtttctaaaccaactccaatttcagtacccgtttcgagacgatccgatatacccgggtctctctacgtcgacactgacatgggtttctctgggtcaccacttcccatgccactagacatcttacaagggaatccaattccaccttttttatccaagacttttgatttggttgatgacccgactcttgacccggtcatctcttggggactgaccggagctagcttcgtagtttgggatcctctagagtttgccagaatcatacttccaaggaatttcaaacacaacaatttctccagcttcgtcagacagcttaacacttatggatttcgaaagattgatactgacaagtgggaattcgctaacgaggctttccttagaggcaagaagcatcttctgaagaacattcatcgtcgtcgatcaccacaatccaaccaaacttgctgcagtagcactagccaaagccaagggtcacctactgaggttggaggagagattgagaagctgaggaaagagcggcgtgcattgatggaggaaatggttgagcttcagcagcaaagcagaggcacagctcgacatgtggacactgtaaaccagaggctgaaagctgcagagcaacgtcagaagcaattgctctctttcttggctaagttgtttcagaaccggggtttcttggaacgcctgaagaacttcaaaggaaaagaaaaaggaggagctcttggattggaaaaggcgagaaagaagttcatcaagcaccaccagcagcctcaagattctccaacaggaggggaggtggtgaagtatgaagctgatgattgggagagattgctaatgtatgacgaagagactgagaacaccaagggtttaggagggatgacttcaagcgatccaaaaggcaagaacttgatgtatccatcagaagaagagatgagcaaaccagattacttgatgtccttcccatctcctgaaggacttattaaacaagaagagacgacatggagcatgggtttcgatactacaataccgagtttcagcaacaccgatgcatggggaaacacaatggactataatgatgtctcagagtttggttttgctgcagaaacaacaagtgatggtttgcctgatgtctgctgggaacaatttgctgcaggaatcacagagactggattcaactggccaactggtgatgatgatgataatacgccaatgaatgatccttaggatcttttcatatatagtttagaccaaaaacccgtttcttatcgggtgaactattaattcatta

SEQ ID NO: 4265 - DNA, 832 bp, Artificial Sequence; identical to SEQ ID NO: 1539
  P1829 (35S::G2512)

SEQ ID NO: 4266 - DNA, 828 bp, Artificial Sequence
  P1830 (35S::G2513)
tttcaacagtaatttaagttaaccggagtctctttttgttttccggcgaatttttggtactttgagttatgaataatgatgatattattctggcggagatgaggcctaagaagcgtgcgggaaggagagtgtttaaggagacacgtcacccagtttacagaggcataaggcggaggaacggtgacaaatgggtctgcgaagtcagagaaccgacgcaccaacgccgcatttggctcgggacttatcccacagcagatatggcagcgcgtgcacacgacgtggcggttttagctctgcgtgggagatccgcatgtttgaatttcgccgactccgcttggcggcttccggtgccggaatccaatgatccggatgtgataagaagagttgcggcggaagctgcggagatgtttaggccggtggatttagaaagtggaattacggttttgccttgtgcgggagatgatgtggatttgggttttggttcgggttccggctctggttcgggatcggaggagaggaattcttcttcgtatggatttggagactacgaagaagtctcaacgacgatgatgagactcgcggaggggccactaatgtcgccgccgcgatcgtatatggaagacatgactcctactaatgtttacacggaagaagagatgtgttatgaagatatgtcattgtggagttacagatattaagtgggactcacatatctactatacataatatttagcttttatgtaagaggtatttatgtgagttttaagattgtagatgtgtcccaggcgttagaagtttccttgatggtatggaatctttgtacctata

SEQ ID NO: 4267 - DNA, 820 bp, Artificial Sequence
  P1831 (35S::G2107)
accacaaaacagagcaacacacaacacaaagcttcatttcaattctgtttcgagaaccctttgagaaccagatcggagatggaaaacgacgatatcaccgtggcggagatgaagccaaagaagcgtgctggacggaggattttcaaggagacacgtcacccaatctacagaggcgtgcggcgtagggacggcgacaaatgggtatgcgaagtccgtgaaccgattcatcagcgtcgagtctggctcggaacttatccgacggcagatatggccgcacgtgctcacgacgtggcggttcttgctctgcgcgggagatccgcgtgtttgaatttctccgattctgcttggaggttgccggtgccggcatccactgatccggacacgatcaggcgcacggcggccgaagcagcggagatgttcaggccgccggagtttagtacaggaattacggttttaccctcagccagtgagtttgacacgtcggatgaaggagtcgctggaatgatgatgaggctcgcggaggagccgttgatgtcgccgccaagatcgtacattgatatgaatacgagtgtgtacgtggacgaagaaatgtgttacgaagatttgtcactttggagttactaaaatacgtatgtgttaaaaaaccaaagatcgtatgtgtatgtatgcataataaatgggcttaatgatgggcatagatatgataggtccagcctatatgttaaatgtgttttattttttggtttatctagtttcctaggtatttaccaaattgtattagtataagttttattaagaaataatcaaaaatgttgttgcc

SEQ ID NO: 4268 - DNA, 931 bp, Artificial Sequence; identical to SEQ ID NO: 1547
  P1833 (35S::G2517)

SEQ ID NO: 4269 - DNA, 1004 bp, Artificial Sequence
  P1835 (35S::G2131)
ctctcaatcttttattcttctcattcaccggtaatggcaaaagtctctgggaggagcaagaaaacaatcgttgacgatgaaatcagcgataaaacagcgtctgcgtctgagtctgcgtccattgccttaacatccaaacgcaaacgtaagtcgccgcctcgaaacgctcctcttcaacgcagctccccttacagaggcgtcacaaggcatagatggactgggagatacgaagcgcatttgtgggataagaacagctggaacgatacacagaccaagaaaggacgtcaagtttatctaggggcttacgacgaagaagaagcagcagcacgtgcctacgacttagcagcattgaagtactggggacgagacacactcttgaacttccctttgccgagttatgacgaagacgtcaaagaaatggaaggccaatccaaggaagagtatattggatcattgagaagaaaaagtagtggattttctcgcggtgtatcaaaatacagaggcgttgcaaggcatcaccataatgggagatgggaagctagaattggaagggtgtttggtaataaatatctatatcttggaacatacgccacgcaagaagaagcagcaatcgcctacgacatcgcggcaatagagtaccgtggacttaacgccgttaccaatttcgacgtcagccgttatctaaaccctaacgccgccgcggataaagccgattccgattctaagcccattcgaagccctagtcgcgagcccgaatcgtcggatgataacaaatctccgaaatcagaggaagtaatcgaaccatctacatcgccggaagtgattccaactcgccggagcttccccgacgatatccagacgtattttgggtgtcaagattccggcaagttagcgactgaggaagacgtaatattcgattgtttcaattcttatataaatcctggcttctataacgagtttgattatggaccttaatcgtattttctacaagttttgttttgatt

SEQ ID NO: 4270 - DNA, 662 bp, Artificial Sequence
  P1839 (35S::G2094)
cactagttcacgaatcacgatctgcggttcctgaagctggtaatgctagatcccaccgagaaagtaatcgattcagaatcaatggaaagcaaactcacatcagtagatgcgatcgaagaacacagcagcagtagcagtaatgaagctatcagcaacgagaagaagagttgtgccatttgtggtaccagcaaaacccctctttggcgaggcggtcctgccggtcccaagtcgctttgtaacgcatgcgggatcagaaacagaaagaaaagaagaacactgatctcaaatagatcagaagataagaagaagaagagtcataacagaaacccgaagtttggtgactcgttgaagcagcgattaatggaattggggagagaagtgatgatgcagcgatcaacggctgagaatcaacggcggaataagcttggcgaagaagagcaagccgccgtgttactcatggctctctcttatgcttcttccgtttatgcttaacgaattttctggatcttaagttttaaggtgaaataataattaattttgtaggatgtgtaacgaattaatgtgtaatttttgtatgcgtttttttggtgttgtttgaattaactaaattttgaaatttttgtatcttgtttatgtgatctctggtgaagaatgaatgaatg

SEQ ID NO: 4271 - DNA, 1281 bp, Artificial Sequence
  P1840 (35S::G2147)
gtcaagagtttgaacacacaaagaagaaagaagaactcaacatttcaagcaagaagaaagagagaagagagaaggtccaataatagagagaacaaaaaaaaagagagcttaattgtcagtttattctctgcaaacgtgcggcctaagtaacacatgtcgaattatggagttaaagagctcacatgggaaaatgggcaactaaccgttcatggtctaggcgacgaagtagaaccaaccacctcgaataaccctatttggactcaaagtctcaacggttgtgagactttggagtctgtggttcatcaagcggctctacagcagccaagcaagtttcagctgcagagtccgaatggtccaaaccacaattatgagagcaaggatggatcttgttcaagaaaacgcggttatcctcaagaaatggaccgatggttcgctgttcaagaggagagccatagagttggccacagcgtcactgcaagtgcgagtggtaccaatatgtcttgggcgtcttttgaatccggtcggagcttgaagacagctagaaccggagacagagactatttccgctctggatcggaaactcaagatactgaaggagatgaacaagagacaagaggagaagcaggtagatctaatggacgacggggacgagcagcagcgattcacaacgagtccgaaaggagacggcgtgataggataaaccagaggatgagaacacttcagaagctgcttcctactgcaagtaaggcggataaagtctcaatcttggatgatgttatcgaacacttgaaacagctacaagcacaagtacagttcatgagcctaagagccaacttgccacaacaaatgatgattccgcaactacctccaccacagtcagttctcagcatccaacaccaacaacaacaacaacaacagcagcagcagcagcaacaacagcagcaacagtttcagatgtcgttgcttgcaacaatggcaagaatgggaatgggaggtggtggaaatggttatggaggtttagttcctcctcctcctcctccaccaatgatggtccctcctatgggtaacagagactgcaccaacggttcttcagccacattatctgatccatacagcgcctttttcgcacagacaatgaatatggatctctacaataaaatggcagcagctatctatagacaacagtctgatcaaacaacaaaggtaaatatcggcatgccttcaagttcttcgaatcatgagaaaagagattagtctagcgacctagtattattgatccat

SEQ ID NO: 4272 - DNA, 1444 bp, Artificial Sequence; identical to SEQ ID NO: 717
  P1852 (35S::G962)

SEQ ID NO: 4273 - DNA, 938 bp, Artificial Sequence
  P1856 (35S::G2371)
tcctctctctctctctcactccaagaaaccaaaaaaaaagatgtcagtcaaccattaccacaacactctctcgttgcatcatcaccaccaaaacgacgtagctatagcacaacgagagtctttgttcgagaaatcactcacaccaagcgacgtcggaaagctaaaccgcttagtcataccaaaacaacacgccgagaaatacttccctctcaataataataataataatggcggcagcggagatgacgtggcgacgacggagaaagggatgcttcttagcttcgaggatgagtcaggcaagtgttggaaattcagatactcttattggaacagtagccaaagctacgtgttgaccaaaggatggagcaggtacgtcaaagacaaacacctcgacgcaggcgacgttgttttctttcaacgtcaccgttttgatctccatagactcttcattggctggcggagacgcggtgaagcttcttcctctcccgctgtctccgttgtgtctcaagaagctctagttaatacgacggcgtattggagcggcttgactacaccttatcgtcaagtacacgcgtcaactacttaccctaatattcaccaagagtattcacactatggcgccgtcgttgatcatgctcagtcgataccaccggtggtcgcaggtagctcgaggacggtgaggctttttggcgtgaacctcgaatgtcatggtgatgccgtcgagccaccaccgcgtcctgatgtctataatgaccaacacatttactattactcaactcctcatcccatgaatatatcatttgctggggaagcattggagcaggtaggagatggacgaggttgatgactgacattcaaaaagaagtgacaactttctagatttttaactttagaatttagattatgggcccatacttggcccaattgtcatagagaaa

SEQ ID NO: 4274 - DNA, 1997 bp, Artificial Sequence; identical to SEQ ID NO: 1507
  P1857 (35S::G2430)

SEQ ID NO: 4275 - DNA, 1223 bp, Artificial Sequence; identical to SEQ ID NO: 1527
  P1858 (35S::G2465)

SEQ ID NO: 4276 - DNA, 2324 bp, Artificial Sequence; identical to SEQ ID NO: 853
  P1891 (35S::G1190)

SEQ ID NO: 4277 - DNA, 2334 bp, Artificial Sequence
  P1897 (35S::G2543)
taaatggtccattagtagtttgtggttgggtgaaaagtaaagagattaaagactgttttactgtcttttcgaaacattaattaaaaaaaatgagtttcgtcgtcggcgtcggcggaagtggtagtggaagcggcggagacggtggtggtagtcatcatcacgacggctctgaaactgataggaagaagaaacgttaccatcgtcacaccgctcaacagattcaacgccttgaatcgagtttcaaggagtgtcctcatccagatgagaaacagaggaaccagcttagcagagaattgggtttggctccaagacaaatcaagttctggtttcagaacagaagaactcagcttaaggctcaacatgagagagcagataatagtgcactaaaggcagagaatgataaaattcgttgcgaaaacattgctattagagaagctctcaagcatgctatatgtcctaactgtggaggtcctcctgttagtgaagatccttactttgatgaacaaaagcttcggattgaaaatgcacaccttagagaagagcttgaaagaatgtctaccattgcatcaaagtacatgggaagaccgatatcgcaactctctacgctacatccaatgcacatctcaccgttggatttgtcaatgactagtttaactggttgtggaccttttggtcatggtccttcactcgattttgatcttcttccaggaagttctatggctgttggtcctaataataatctgcaatctcagcctaacttggctatatcagacatggataagcctattatgaccggcattgctttgactgcaatggaagaattgctcaggcttcttcagacaaatgaacctctatggacaagaacagatggctgcagagacattctcaatcttggtagctatgagaatgttttcccaagatcaagtaaccgagggaagaaccagaactttcgagtcgaagcatcaaggtcttctggtattgtcttcatgaatgctatggcacttgtcgacatgttcatggattgtgtcaagtggacagaactctttccctctatcattgcagcttctaaaacacttgcagtgatttcttcaggaatgggaggtacccatgagggtgcattgcatttgttgtatgaagaaatggaagtgctttcgcctttagtagcaacacgcgaattctgcgagctacgctattgtcaacagactgaacaaggaagctggatagttgtaaacgtctcatatgatcttcctcagtttgtttctcactctcagtcctatagatttccatctggatgcttgattcaggatatgcccaatggatattccaaggttacttgggttgaacatattgaaactgaagaaaaagaactggttcatgagctatacagagagattattcacagagggattgcttttggggctgatcgttgggttaccactctccagagaatgtgtgaaagatttgcttctctatcggtaccagcgtcttcatctcgtgatctcggtggagtgattctatcaccggaagggaagagaagcatgatgagacttgctcagaggatgatcagcaactactgtttaagtgtcagcagatccaacaacacacgctcaaccgttgtttcggaactgaacgaagttggaatccgtgtgactgcacataagagccctgaaccaaacggcacagtcctatgtgcagccaccactttctggcttcccaattctcctcaaaatgtcttcaatttcctcaaagacgaaagaacccgtcctcagtgggatgttctttcaaacggaaacgcagtgcaagaagttgctcacatctcaaacggatcacatcctggaaactgcatatcggttctacgtggatccaatgcaacacatagcaacaacatgcttattctgcaagaaagctcaacagactcatcaggagcatttgtggtctacagtccagtggatttagcagcattgaacatcgcaatgagcggtgaagatccttcttatattcctctcttgtcctcaggtttcacaatctcaccagatggaaatggctcaaactctgaacaaggaggagcctcgacgagctcaggacgggcatcagctagcggttcgttgataacggttgggtttcagataatggtaagcaatttaccgacggcaaaactgaatatggagtcggtggaaacggttaataacctgataggaacaactgtacatcaaattaaaaccgccttgagcggtcctacagcttcaactacagcttgacacacaccattaaaagctctcttccctctttcttctgggtgtctctttctcttcaatgatggaacagagaagggaa

SEQ ID NO: 4278 - DNA, 1668 bp, Artificial Sequence
  P1898 (35S::G922)
gttaagagtctctcaaagtttaaatctttctttacaaaaaaggttacttttggttctgagtaaatcaaaatcaagcttttggccttcaatggtggctatgtttcaagaagataatggaacatcttctgtagcttcatcaccacttcaagtcttctcaactatgtcactcaacagaccgactctcctcgcttcttcatctccgtttcattgtctcaaagatctcaaaccagaggagcgtggtctctacttaatccacctcttgctaacttgtgccaaccacgtggcttcaggtagcctccaaaacgctaacgcagcgctcgagcagctctctcacctcgcttctcctgacggcgacacgatgcagcgaatcgctgcttacttcaccgaagcgcttgctaacagaatccttaagtcctggcctggtctttacaaggctcttaacgcaactcagacaagaactaacaatgtctctgaggagattcatgttagaagactcttctttgagatgttcccgatactcaaagtctcttacttgctcactaatcgagctatactcgaggctatggaaggagagaagatggttcatgtgattgatctcgatgcttctgagccagctcaatggcttgctttgcttcaagcttttaactctaggcctgaaggtccacctcatttgagaatcactggtgttcatcaccagaaggaagtgcttgaacaaatggctcatagactcattgaggaagcagagaaactcgatatcccgtttcagtttaatcccgttgtgagtaggttagactgtttaaatgtagaacagttgcgggttaaaacaggagaggccttagccgttagctcggttcttcaattgcataccttcttggcctctgatgatgatctcatgagaaagaactgcgctttacggtttcagaacaaccctagtggagttgacttgcagagagttctaatgatgagccatggctctgcagctgaggcacgtgagaatgatatgagtaacaacaatgggtatagccctagcggtgactcggcctcatctttgcctttaccaagttcaggaaggactgatagcttcctcaatgctatttggggtttgtctccaaaggtcatggtggtcactgagcaagactcagaccacaacggctccacactaatggagaggctattagaatcactttacacctacgcagcattgtttgattgcttggaaacaaaagttccaagaacgtctcaagataggatcaaagtggagaagatgctcttcggggaggagatcaagaacatcatatcctgcgagggatttgagagaagagaaagacacgagaagcttgagaaatggagccagaggatcgatttggctggttttgggaatgttcctcttagctattatgcgatgttgcaggctaggagattgcttcaagggtgcggttttgatgggtatagaatcaaggaagagagcgggtgcgcagtaatttgctggcaagatcgacctctatactcggtatcagcttggagatgcaggaagtgaatgatatattacagtttgtcttctattttggttatgagcagagtccctttcttttttgtatacatggggacacaatcttagttgttttgtgatggtgactttctgtctctttatgctattttggcttaaat

SEQ ID NO: 4279 - DNA, 1501 bp, Artificial Sequence; identical to SEQ ID NO: 347
  P1900 (35S::G427)

SEQ ID NO: 4280 - DNA, 914 bp, Artificial Sequence
  P1905 (35S::G2143)
caccagcttctccatatctctcaaagaaaaaacaaaccctataaattccacaaaaaaggaggatggataactccgacattctaatgaacatgatgatgcagcagatggagaagcttcctgaacacttctctaactcaaaccctaaccctaatccccataacattatgatgctttctgaatccaacacccacccgttcttcttcaaccccactcattctcatctcccatttgaccaaaccatgcctcaccaccaacccggtttaaatttccggtacgccccctccccgtcatcatctctcccggagaagagaggaggctgcagcgacaacgccaacatggcggcgatgagagagatgatctttcgaatagccgtgatgcagcctatacatattgatccggaatccgtaaagccaccaaagagaaagaacgtgaggatctctaaggatccacagagcgtggcagctcggcatcgaagggagaggataagcgagcggattcggattcttcagcggcttgttcccggtgggactaagatggatacggcgtcgatgctcgatgaggctatccattacgttaagtttctcaagaagcaagtgcagtcgctggaggaacatgcggtggttaacggcggaggaatgacggcggtggccggaggagcacttgcgggtactgttggtggaggatatggaggaaaagggtgtggcattatgcggtctgatcatcaccagatgcttggaaatgcacagattcttagatgatgatgatgttgatttttaaatatatatcatatgtttattaatatgacgggaaaaaatattatcgagggagttgaatttagtatcatgaaactatgagagcattttttttaaatgtttttatctttccgggtttcgataatgtttgggatggttaat

SEQ ID NO: 4281 - DNA, 1335 bp, Artificial Sequence
  P1906 (35S::G2144)
gctgaatttggtttcgattattggtgttattgttttcgaagatttccagtgagtttccgtttatggatctgactggaggatttggagctagatccggcggtgttggaccgtgccgggaaccaataggccttgaatcgctacatctcggtgacgaatttcggcaactagtgacgactttacctcccgagaaccccggcggttcgttcacggctttgcttgagcttccacctacacaagcagtggagcttctccatttcactgattcttcgtcttctcaacaagcggcagtgacagggatcggtggagagattcctccgccgcttcactctttcggtgggacattggcttttccttctaactcagttctcatggagcgagcagctcgtttctcggtgattgccactgagcaacaaaacggaaatatctccggggagactccgacgagctctgtaccttccaattcaagtgctaatctcgacagagtcaagacggagcctgctgagaccgattcatctcagcggttgatttctgattcagcgattgagaatcaaatcccttgccctaaccagaacaatcgaaatgggaagaggaaagatttcgaaaagaagggtaaaagctcgacgaagaagaacaaaagctctgaagagaacgagaagctgccatatgttcacgttagagctcgtcgtggtcaagcaaccgatagccatagcttagcagaacgagcaagaagagagaagataaatgcacgaatgaagctgttacaggaactggtcccaggctgtgataagattcaaggtaccgcgctggtgctggatgaaatcattaaccatgtccagtcattacaacgtcaagtggagatgctatcaatgagacttgctgcggtaaaccccagaatcgacttcaatctcgacaccatattggcttcagaaaacggttctttaatggatgggagcttcaatgccgcaccaatgcagcttgcttggcctcagcaagccattgagaccgaacagtcctttcatcaccggcaactgcaacaaccaccaacacaacaatggccttttgacggcttgaaccagccggtatggggaagagaagaggatcaagctcatggcaatgataacagcaatttgatggcagtttctgaaaatgtaatggtggcttctgctaatttgcacccaaatcaggtcaaaatggagctgtaagttgggaaaacggtagagatcatgaatgtgtatatacatcgtataagctcgtttctctctatataaatataatcataaatatagatatctgttaagaaggtatcagtcatttgattcagagagacaacactgg

SEQ ID NO: 4282 - DNA, 816 bp, Artificial Sequence
  P1933 (35S::G1808)
ccccttctaatttctctcatctctctattagaaaaattattagcaattatgttgtccactgcaccggccttttcattctccgaaccgggtttggttaatcaattctcgggtttccaaaccgggttcactccttgggaatgggattgctctgatctctttttcgtggaccaaatgtctcttgaaccggccatccctagtccttgttatggtgaatccgacactggttccgtcaaaattaattccggttctcatgacatgaaaaccggttctgacgaatcttgtgccggtttcgtcaaaattaatcctcgttgtgacgacgccgacatatcaaacgatctaccgtgctctcaagcagatgaaccggactcggacgacacaaaacaattgacagccatcacaaatttcggttcgggagagaataaccataaccggaaaaaaatgatccaaccggagatgaccgacgagcggaagaggaagaggatggagtcaaaccgggaatcagcgaaacggtcaagaatgcgtaaacaaagtcacattgataacttacgagagcaagtaaaccggttggatttagaaaaccgtgagctcgggaaccgactccggttagttttacaccagcttcaacgagtgaattccgacaataaccggctcgtgacagaacaagagatactccggctaagattgtcggagatgcgtcggattctgatcattagacaacttcaacaacagcaacaatgggaactacataaccggagaatgatcatgactgaacaaaaccaccctcatcttcaatgatagatcaaaatatttaagaag

SEQ ID NO: 4283 - DNA, 557 bp, Artificial Sequence
  P1935 (35S::G2070)
cattctctagctttaacacaaattataccaatatcttttgccacttacatcaatgttttatactaatatggagacggttcataactgcttcaatgatgctacgataaccggtgatgaaatcattgatatattggcgtttcttcaatcagacgagtcggacaatccaagcggtataaacgaggtagtaccggtggatgataagaagagaagacggacgatatcaaaccgggaatcggccaagagatcgaggatgaaaaagaagaaacgttttgaagagttaactgaagaggtgaaccggttaaacataagaaatcaggagctgaaaaaccggttagctaatgttgttagttgtggtaattttatatctagggagaataaccggttgaaaaccgaatcggtttgccttgagataaggcttttagagttgtaccgttttttagtggccatgcaatcgccaatctcaacgagtgtaaattacatcacaacgctcgagatttaagtttgaaacaaaataaacagaaaaacgatgccaagtaactttgagcatttttgtaaag

SEQ ID NO: 4284 - DNA, 1536 bp, Artificial Sequence; identical to SEQ ID NO: 1359
  P1937 (35S::G2105)

SEQ ID NO: 4285 - DNA, 508 bp, Artificial Sequence
  P1939 (35S::G2117)
catacttgtcaacaaaaattttcttaaagaacgcataactgtttttttcatggctggttctgtctataaccttccaagtcaaaaccctaatccacagtctttattccaaatctttgttgatcgagtaccactttcaaacttgcctgccacgtcagacgactctagccggactgcagaagataatgagaggaagcggagaaggaaggtatcgaaccgcgagtcagctcggagatcgcgtatgcggaaacagcgtcacatggaagaactgtggtccatgcttgttcaactcatcaataagaacaaatctctagtcgatgagctaagccaagccagggaatgttacgagaaggttatagaagagaacatgaaacttcgagaggaaaactccaagtcgaggaagatgattggtgagatcgggcttaataggtttcttagcgtagaggccgatcagatctggaccttctaatcgtctcgtaagcttgttggttttttgttgtttatttaaagg

SEQ ID NO: 4286 - DNA, 3003 bp, Artificial Sequence
  P1944 (35S::G2192)
ggaaagagatcaaccaacgatagaggagaagaagaacttgcatacgcaaaaaaactttcccgggaaaattccagaaactgctttggaaaaatgtgcgagcccgatgataattccgctagaaacggcgtcactactcaaccttcgaggtcaagggagcttctaatggatgttgacgacttagatcttgacggttcatggccactagatcaaatcccttacttatcctcatcgaatcgcatgatttctccgatttttgtctcctcttcctctgagcagccttgctcgcctctctgggctttctccgacggtggaggaaatggttttcaccacgcaacctccggtggcgatgatgagaagatcagctctgtctccggtgttccttctttccgtctcgccgagtatcctctcttcctcccttactcttctccatcagcagctgagaacacaacagagaagcataacagtttccagtttccgtctccattgatgagcctagtcccaccagagaacacagacaactactgtgtgatcaaagagaggatgactcaggcgcttcgatacttcaaagaatcaaccgaacaacacgttttggctcaggtctgggctcctgtgagaaagaatggtcgtgatttgctgacgactttgggtcaaccttttgttcttaatcctaatggtaatgggcttaatcaatacaggatgatctctctcacatatatgttttctgtggatagtgaaagtgacgtagagctcggactcccgggtcgagttttccgtcagaaattgcctgaatggactccaaatgttcagtactattccagcaaagaattctcgcggcttgatcacgccttgcactacaacgtgcgtggtacactggccttgcctgtctttaatccctctggtcagtcctgcataggtgttgtggaacttataatgacctcagagaagattcactatgcacccgaagtggacaaagtttgcaaagcccttgaggcggtaaatctgaaaagctcggaaatacttgatcaccaaacaacacagatatgcaatgagagtcgccaaaacgcgcttgctgagattctcgaagtgctgacagttgtatgtgagacccataacttgcctctcgctcagacttgggttccatgtcagcatgggagcgttcttgccaatggtggcggtctaaagaaaaactgcaccagctttgacggtagctgcatgggtcaaatctgcatgtctacaaccgacatggcctgctatgtcgtggatgctcatgtctggggctttagagatgcctgtcttgaacaccatctccagaaaggccagggagtcgctggacgagcttttctcaatggtggctcatgtttctgcagagacatcaccaagttctgcaaaacgcagtacccactagtccattatgcgctcatgttcaagttgaccacttgttttgcaatatctctccagagctcttacacgggcgacgacagttacattcttgaattttttcttccttcgagtataacagacgaccaagagcaagatttgctgttgggttctattttggtgacaatgaaagaacattttcagagtctgagggttgcatctggggttgactttggtgaagatgacgacaaattgtctttcgagatcatccaagcattaccggacaagaaggttcattcaaaaatagaatccattcgagttcccttttctggttttaagtcaaatgcaacagagacgatgttgattcctcagcctgtggttcagtcttctgatccagtaaatgagaaaatcaacgtggccactgttaacggtgtggttaaggagaagaagaaaacagagaaaaagcgtgggaagactgagaaaacaatcagtctagatgtacttcagcagtatttcactggaagtctcaaagacgctgcaaagagcctaggagtttgcccgacgacaatgaagcgaatttgcaggcaacacggaatctcgcggtggccatcgaggaagatcaagaaagtgaatcgttcaatcacaaagctgaaacgagtcatcgaatctgttcaaggtactgatggaggcctcgacctgacttccatggccgttagttccatcccttggacacacggtcaaacatcagcacagccactaaactcacccaatggttccaaaccacctgagctaccaaacaccaataattcacctaaccattggtcaagtgatcacagtccgaacgagccaaatggttcgcctgagttaccaccaagcaatggtcacaagcgatcacgaacggtggatgagagcgctgggactccaacctctcatggctcatgtgacggtaaccaattagatgaaccgaaagtcccaaatcaagatccgctcttcacggttggtggatcacccgggctcctttttccaccttattctagagatcatgatgtatctgcagcttccttcgcaatgccgaacaggcttcttggttctatagaccatttccgaggaatgctcattgaagacgctggaagttcaaaagatctgagaaatctctgccccactgcagcatttgacgataagtttcaagacacaaactggatgaacaatgataataatagcaacaacaacttatacgctcccccaaaggaagaggccattgcaaatgttgcatgcgaaccatcaggctcagaaatgagaacggtaacaatcaaagcaagttacaaagacgacataatacggttcagaatatcctcgggttcaggtataatggaattgaaggatgaagtggctaagaggctgaaagttgatgcaggaacgttcgatatcaagtatcttgacgatgataacgaatgggttttaatagcttgtgatgctgatcttcaagaatgtctcgagatccctagatcctcccgcacgaaaatcgtaaggctcttagttcatgatgtaacgacaaatctagggagctcctgcgagagcactggagaattgtgacctgataattcattcgaactcttttgtaaatag

SEQ ID NO: 4287 - DNA, 883 bp, Artificial Sequence
  P1948 (35S::G2215)
gagctatatacatagaggtctcatggtcttgtttgttctgtagatgtactcaattcatacagctctgcgtcatggaacgaaacagagcaaaacagaggagatggcgcttcatcggagaagaagagggaaaatggaacagtgaaagagacaactaagaagaggaaaatcaatgagagacacagagaacatagcgtgagaatcatcagcgatattactacctacacaactagttcagctccaacgacattgtcaaaggaaactgtctctcgctacttctacatgcccataactcaggctgcaatagcacttaacgttggtttaactctactaaaaaggagatgtcgcgaattgggtattcgccgatggcctcatcgtaaacttatgagcttaaacactttgatcagtaacgtcaaggtatgtagaacaaggcactacacttaatattattgttttcagataattgaactcaaatgttttatcatatgaataggagctgcagaagatggaaggcgaagagaatgcagaaaaactgcaggacgcgttggagatgcttgagaaggagaagaggacaattgaggatttgccggatttggagtttaaggacaagacaaagaggctaagacaagcttgtttcaaggctaaccacaagaggaagaagaagagaagtctcaagtccgatcagtctcaagtaccctcgtgttcaagcagcggatcagttcctagtgatgagtcggttgatgaagcaggaatggagagtgatgaagaaatgaagtatctcttgtgtggtttctcaagtgaatttactagtggtttgtgaaatctgtttttagtgagaaattggggattgtaaagccaaatgctttttgactaattcaatgaacag

SEQ ID NO: 4288 - DNA, 1263 bp, Artificial Sequence; identical to SEQ ID NO: 1487
  P1949 (35S::G2373)

SEQ ID NO: 4289 - DNA, 799 bp, Artificial Sequence; identical to SEQ ID NO: 1491
  P1951 (35S::G2379)

SEQ ID NO: 4290 - DNA, 758 bp, Artificial Sequence
  P1958 (35S::G162)
acgagaggttctctcttattcgtaccgttttagcaaacaaatgggtcggagaaagatcaagatggagatggttcaggacatgaacacacgacaggttaccttttcaaaacggaggactggtttgttcaagaaggcgagcgagttagccacgctctgcaacgctgagttgggcatcgttgtcttttcaccaggaggcaagcctttctcctacgggaaaccgaatcttgattctgttgcagagcgattcatgagagaatatgatgattcagacagtggcgatgaagaaaaaagtggtaattacaggcctaaactgaagaggctgagtgaacgtctcgatttgctcaaccaagaggttgaagctgagaaggaacgaggcgagaagagtcaggagaagcttgaatctgctggggatgagagattcaaggagtccattgagacgcttaccctcgatgaactcaatgaatacaaagataggcttcagacagtccatggtaggattgaaggtcaagtcaatcacttgcaggcttcgtcttgcctcatgcttctctccagaaaatagctagaccgacttgttagagttacattctattttttgtatcagcctacagaacttaccaacacatgaaagttattgctggtgtagaattttctgtcatctatggggtgtgactttctatttgacatcaaatgaaaatgtacctggaaatttgtctgtattaatctcaagtgtacttgctaaacttgatcagctttttcgc

SEQ ID NO: 4291 - DNA, 2390 bp, Artificial Sequence
  P1959 (35S::G1225)
tcagaagtacccttccatgatagtaccgatcacaatcaaataatgtctcacatgtacacacactcagagcaccatagcttcaacgtttgtcaagaaaaaaatttccttttaatcattgccttttattttttcgaaaatgtcgttttcgcccgcaaatatttataacctttatatatttttttcgaaaacaataaattaaagatttggaatgttgctatataaatcaatgatacttagtaattcaataaggaataaacttcgtgaagagaaatgactctagaagctttatcatcaaacggtcttttaaactttttgctctctgaaactctttcaccaactccattcaagtctctcgtcgatctcgagccattgccggaaaatgatgtcatcatatcgaagaacacaatttcggagatatctaatcaagaaccgccaccacagcgacaaccaccagctacgaatcgagggaagaagcggcggaggaggaagcctagggtttgcaaaaacgaggaagaagctgagaatcaacgaatgactcacattgccgtcgaaagaaatcgaagaagacaaatgaatcaacatctctctgtcttgcgatctctcatgcctcaaccttttgctcacaaggtttaacttttatggatatatattctttttaatgtttgtaaagtttcaagtagggtttcaatttttatggataatttttttaaatggtttactatttcgatttgggtttcaattaatatttacaattcactgaaaaagattaaattttcatcttgagttttattttttatgaaagattcattctaacggtttaaatctatttgattttcaatatttatggccaattctaaaaaattgattttttattaaatatatatttgggtttttatttgtttacttatatgttgttttggtggatttatttgtttccccatgaaagggtgatcaagcttcaatagttggtggagccatagatttcatcaaagaacttgaacacaaattactatctcttgaagctcaaaaacatcataatgctaaattaaaccagtcggttacttcttcaacaagtcaagactcaaatggtgaacaagagaatcctcatcaaccatcttcactatctctatcgcagttctttcttcattcatacgatccgagccaagagaataggaacggctcaacaagctcggtgaaaacccctatggaagatcttgaggtgactctaatcgaaactcatgctaacatcagaatcttgtcgagaagaagaggtttccggtggagcacgttggccaccaccaaaccgccgcagctttcgaagctggtggcttctctacaatcgctgtccctctccattcttcaccttagtgtcacaacattggacaattatgctatttactccatcagcgctaaggtaataaaattaaaaccctatcatctgaaccggactaaaccggattagtttcaatgcaatttgtgcggtatttagatcaaacagattacaagataggacatttatgctatttactctatcagtaactgatgaaaaaaaaaaaaaaactctatcagtaactagggtgatacaaaccggagctaaaccggatttgttcaaatgcgacttgaggggtattttgggaatatatgttaggaatttaaagctagacggtcgattatgtgcggtccaagggacagagcatataaaaggaatgtctatgagctcttaactagatttggtccaacatttattaccatacttggtggagtcatttttcttatttttcacccatttcttgaaaacaggttcaattattgccacgtgggttataaaaattgtaacaatttgaagcttttttcaaattcacattatgctatttttgtaaaatcattttcttattggatgttgaaaggtggaagagagttgccagctaagttcagtagatgacattgcaggagcagttcaccacatgctaagtatcattgaagaggagcctttttgttgctcatcaatgtcagaattaccatttgacttctctttgaatcactcaaatgtcactcattctctctgagaaatctcttttttgttgttgttattccttcttttaattttatcacatagcacatctttagtttttttttttcagaatgaagaaacacataagctttcttttaaaatcctaggttctttttctgactttgtaaaggctaaatgtgaatttataatggcacataacatattagttgttttactcttaattttatgcattttctgatagtaattaagttataaattagtacacttgtgagtgtttgaattgttttatatatataactggattcttatatatacaaatcatcaaaaaatttagctaggctctcgatcttggatatta

SEQ ID NO: 4292 - DNA, 1466 bp, Artificial Sequence
  Artificial sequence
  P1960 (35S::G1649)
caaagtgtgaagtccgaatctctctgattctacaattcacaaaaaccggaaaaaaaaaaagacaagtaaagaaagctttgttcagtttacttcaatggaagcaaaacccttagcatcatcatcatctgaaccaaacatgatttctccatcatcaaacattaaaccaaaattaaaagatgaagattatatggagctggtgtgtgaaaatgggcagattcttgcaaagattcgaagaccaaagaacaacggttcttttcaaaagcaacgtaggcaatctctcctggatttgtatgagaccgagtacagcgagggtttcaagaaaaacatcaagattcttggagacacacaagttgttccggtgagtcagtctaagccacaacaagataaagaaaccaatgaacaaatgaacaacaataagaagaagctaaagtcctccaaaatcgaatttgagagaaatgtttcgaaaagcaacaaatgtgttgaatcatcaacattaattgatgtttctgctaaaggtccaaagaatgttgaagttactacagctcctcctgatgagcaatctgcagctgttggtagatccacggaattgtattttgcttcttcatcgaagttttctcgaggaacttcgagagatctaagttgttgttctttaaagaggaagtatggagatattgaagaagaagaatcaacctatttaagtaataattcagatgatgaatcagatgatgcgaagacacaagttcatgcgagaacaagaaagccggtgactaaaagaaaacgaagcacagaagtccataagttatatgaaagaaaacgaagagatgaattcaacaagaaaatgcgtgctttgcaggacctactaccaaattgttacaaggatgataaggcttcattgttggatgaggctatcaaatatatgcggacccttcaacttcaagttcagatgatgagtatgggaaatggattaataagaccacctacgatgttgccaatgggtcattactctcccatgggtctaggaatgcatatgggtgcagcagcaacaccaacatcaataccgcaattcctgcctatgaatgttcaagcaaccggttttccggggatgaacaatgcaccaccacaaatgctaagctttcttaatcacccaagtggactaattccaaacactcctatcttttctccattggaaaattgctctcagccattcgtggtgccttcgtgtgtttctcagactcaggctacttcttttactcaattcccaaagtctgcgtccgcctcaaacttagaagatgcaatgcaatatagaggaagcaacggttttagttattatcgctcgccaaactaatgatttgtagaaagttgatgttttctccaactaactaactttaagcaaaaaaaaatgatcgtctactctgtgttgttagtctatgggcttttgggccttgattcttggaacgatttgaact

SEQ ID NO: 4293 - DNA, 2025 bp, Artificial Sequence
  P1961 (35S::G1662)
aactcttgttccaccaggacaataaataccatcttctgatcacacgtcatctttccatattcaagaaaacttcattttccatcggaagattcgtttaggagagaaaatggaaagtggcttttattcagattggaaagatacttcttcttcttcgttctttggatcagagaatatggaggaagagttggaagatggagttcttagagctgaagagcttttctcatcgattcctcaacctcagacacctaaagagccaatggagtttctgtctagatcctggagtctctctacttctgaaatctccaaagcacttgctctcaaacatagacaacaacaagatcagttttgtgttggccagaacagtcctcctgttttgttccctgatgctgctgcagatccactcgtggtacgatccttttatcccttttccaaattccaatgaaaccctttttccaactatttcttagaattatgatgagccttaaaagtcagagacttttcaattgtatatgattgccattgcaccagttcctaacatagttcttgggaattggaatggataataatagtggactcttttcatattttacaactttgggattttgattctaggctgggaagatcatgaactctgttggcacacgtagagcagggacattgtctaaatggtttcaccacaacaaggaacacagcaccagcagtactactaccaatctcaagaagaaagataaagtgcgtgtggagaacgcccacgtgcattctgccgtctctatagcggctctggctgcaggtttagcctctgtgacatctgctagcaattgcaaagggtcaggctccaagatggcactggctttagcctcagccactgaactgttggcctcacactgtgttgagatggctgagcgagccggtgctgaccatgcacgtgttacttccacggttagatcttctgtggatatccacagccccggtgatctcatgactctaacagccgctgctgcaactggtaaggctttgttgcagcttcacaaggctttttcagtttcgttgatatgcatttgatctgactttgtttaaactgacactagctttgagaggagaagcggctctgaaggcgaggcagccaaaggaagcaaggaaaaatgcagctattaccccttttgagagaagtttctctgattctcattggcatgcaaattttcagtatagattggaagaaccaaatcttccatttgaaggcgaactgatgcaatgtgcacgaaatggtaattgtcttctgtcaccgagtctgatcactttaagagttcactggatctgagataagacagagagcttaactcttcttccttgtgctttaacttgcaggagtgcagcgaactaagcgtgtctgtgtctatatcaacaagaagtctcaggtatagcagatttgattagtatctatatataacacataacacaactcagttcacttttgattcaatgcttattatgctacttatgattttgcaggtaatgatcaaactcaaaagcaaacatgttggaggggcattctctaagaaaatcaaatgtaagcatttactaatctttcagtttggataaattacctgaaagacgacactctgaacttgttcttcctttctgaaggcgttgtctatggagtctgcgatgagaaatcagcttggccttacaggaaagagagggaaaattcagaagaagtctacttcggtctgaaaaccggacaaggtcttttggagttcaagtgcaagagcaagattcacaagcagagatgggttgatggggttcagtctcttctccgccaagtaaattgctttgaggctgccaaatgctcgctgggatctctgaatctcactggtcacacgtgatgcaggatcctgtatatatttgattatattcatatatataatatccaaatttttgctgttgtgaggtatttgcaaaacctggcaatgtaacctcagaagacttttggataaaacaaagcaggttgttcaaatgatcacaaca

SEQ ID NO: 4294 - DNA, 1114 bp, Artificial Sequence
  P1964 (35S::G1482)
accaccatctctatctctctcttaatcgatcgatgaagatcaggtgcgacgtctgcgataaagaagaagcgtcggtgttttgcacggccgacgaagcatctctctgcggcggctgcgaccaccaagtccaccacgctaacaaactcgcctctaaacatctccgtttctctctcctttatccttcttcttccaacacctcctctcctctctgcgacatctgtcaggataaaaaagctctgttgttctgtcaacaagatagagctattttatgcaaagattgcgattcatcgatccacgctgcgaacgaacacacaaagaaacacgataggtttcttcttacaggggttaagctctctgcaacatcgtctgtttacaaacctacttcgaaatcttcttcttcttcttcaagcaaccaagatttctctgtccctggatcatcaatctctaatcctcctcctctcaagaaacctctctcagctcctcctcagagcaacaagatccaacccttttcgaagatcaacggcggtgatgcgtcggtgaatcagtggggatccacaagcacgatttctgagtatttgatggatacgttacctggttggcacgttgaggatttcctcgattcctctcttcctacttatggtttctctaagagtggtgatgatgatggagtgttaccatatatggaaccagaagatgacaacaacactaagagaaacaacaacaacaacaacaacaacaacaacaatacagtgtcacttccatctaagaatttagggatttgggtccctcagattccacaaactcttccttcttcatacccaaatcaatacttttctcaagacaacaacatacagtttgggatgtacaacaaagaaacatcaccagaagtagtgtcttttgctccaatacaaaacatgaaacaacaaggacagaacaacaagagatggtatgatgatggtggcttcactgtcccacagatcactcctcctcctctttcttctaataaaaagtttagatctttctggtaattttactatctccctaaatgggggagttttttttttgtttgtttgtttctccttcatttctcccaactttgatctcagaattaggc

SEQ ID NO: 4295 - DNA, 1117 bp, Artificial Sequence
  P1967 (35S::G1594)
attttgcaagaagacaattcaagaaagcgatttagaagacggaggagtttttaccggagatcttatacttatggatggaatgtacaatttccattcggccggtgattattcagataagtcggttctgatgatgtcaccggagagtctcatgtttccttccgattaccaagctttgctatgttcctccgccggtgaaaatcgtgtctctgatgttttcggatccgacgagctactctcagtagccgtctccgctttgtcgtcggaggcggcttcgatcgctccggagatccgaagaaatgatgataacgtttctctaactgtcatcaaagctaaaatcgcttgtcatccttcgtatcctcgcttacttcaagcttacatcgattgccaaaaggtcggagcaccaccggagatagcgtgtttactagaggagattcaacgggagagtgatgtttataagcaagaggttgttccttcttcttgctttggagctgatcctgagcttgatgaatttatggaaacgtactgcgatatattagtgaaatacaaatcggatctagcaagaccgtttgacgaggcaacgtgtttcttgaacaagattgagatgcagctacggaacctatgtactggtgtcgagtctgccaggggagtttctgaggatggtgtaatatcatctgacgaggaactgagtggaggtgatcatgaggtagcagaggatgggagacaaagatgtgaagaccgggacctcaaagataggttgctacgcaaatttggaagccgtattagtactttaaagcttgagttctcaaagaagaagaagaaaggaaagttaccaagagaagcaagacaagctcttcttgattggtggaatctccattataagtggccttaccctactgaaggagataagatagcattagctgatgcaacggggttagaccaaaaacaaatcaacaattggtttataaaccaaaggaaacgtcattggaagccatcagagaatatgcctttcgctatgatggatgattctagtggatcattctttaccgaggaatgaatttatttatggtacttatttaacgttgattaaaagatggatgtataattctgccttgctttg

SEQ ID NO: 4296 - DNA, 1644 bp, Artificial Sequence
  P1968 (35S::G1587)
caacaacaaaagacctattttgtgaatcttttctctaaattaagagttattagggcaaatttctacatagcatgggctacatctccaacaacaacctcatcaactatttgcccctctctactactcaacctcctcttcttctcacccactgtaataaaatccttacttcttcatttatagacttaattcatatcaatgtgttaatatttttgtttttttcaggtgatattaacggcaatgatcaccatcagctcataaccgcatcatcaggagaacacgatattgatgaacggaaaaacaacattcctgcggcggcgactttgagatggaatccgacgccagagcagatcacgacgctagaagagctttacagaagcggaacacggacgccgacgacggaacagatccaacagatagcatctaagcttcgtaaatatgggagaatcgaagggaagaacgttttctattggtttcagaatcataaggctagagagagactaaaacgccgccgtcgtgaaggtggtgctattatcaaaccacataaagacgtcaaggattcatcatcaggtacgataaatatttagttcggtttatatctagagatttaaatacccatctccttcggttctgaatatttctttaaaaatggttaagaggatataaagttttggtttgtatcaaaattgatgaaatttgatggaacgttccttaaaacttaaaagtggatatacatgctaatttcggagatatatgtaagatgacgtgacaattgcaggtggtcatcgagttgatcagacaaagctctgcccatcttttccacacacaaaccgaccacagccacaggtattttctttgaattatgtttacgtgtaatagttatatgtaaaaagatactcacaaatcatgcatgcataaataaataggtgaccaaaacaatacatagatgtatatataagtgtaaataactaaatatgtgtggaaagttggggagacaagtaaatagggtgcagaatagagttatagagaagctttttctatcatatgttgggacttgagaacaataaggaaattaacaaagatgttttcaaaaggccataatttttttttttttaatccatttcatcatatgttgggacttgatatgtattatcatttcactttagaatagttaataggcgtctcccgaaaataatttattattttgttgtagtatctagctcatgaaggaatttgctcatcctaaaagaattaattatttcgtatttttctgcttagcatgaattagatcctgcgagttacaataaagacaacaatgctaataatgaagatcatgggacgactgaagaatctgatcagagggcatcagaggttggtaaatacgccacatggagaaatcttgttacttggtcgataactcaacaaccggaagagattaatatcgacgaaaatgtcaacggagaagaagaagaaacgagggacaaccggactttaaatctctttccggttagggagtaccaagagaaaacaggccggttgatagagaagacgaaagcatgcaactactgttactactacgagttcatgcctctgaagaactgaaacaaaaaacccatgtgtgaataataaataggactttaatgaagg

SEQ ID NO: 4297 - DNA, 2332 bp, Artificial Sequence
  P1970 (35S::G1855)
ttgtttctgtctcagtctctatcttagataaagattcagtctttgcactcaagaatggcgaaagagaacagtggtcatcatcaccaaacagaagcaagaagaaagaaactaactttgattcttggtgtaagtggactctgcattttgttctatgttttaggtgcatggcaagccaataccgtcccatcttctatctcgaagctcggatgcgagacgcaatcaaacccttcttcgtcctcttcctcttcctcatcttcagagtcagctgaactagatttcaaaagccataatcagattgagttaaaggaaacaaaccaaaccattaagtactttgaaccatgtgaattatctctcagtgagtacactccttgtgaagaccgacaaagaggaagaagattcgataggaacatgatgaaatatagagaaagacattgtcctgtaaaagatgagcttctttattgtttgattcctcctccaccaaactacaagattccatttaaatggccacaaagtagagactatgcttggtatgacaatatccctcacaaggaacttagtgttgagaaagcagttcaaaactggattcaagttgaaggtgaccgctttagattccctggtggtggtactatgtttcctcgtggagctgatgcttatatcgatgatattgctaggcttattcctcttactgatggtggaatcagaacagctattgacactggatgtggtgtaagtgtttcattgtaagagtatacgtatacacttctttttgatcattgtttgattcaatatctgttttttatattaggttgcaagttttggtgcttacctcttgaagagagacattatggctgtgtcttttgctccaagagacactcatgaagctcaggtacagtttgctttagaacgcggagttcctgcgataatcgggattatgggatcaagaagacttccttatccagctagagcttttgatcttgctcattgttctcgttgtttgatcccttggtttaaaaatggtaatgatttgactctgtttctgttcatagctgaggaagaaacataacactgaaatcttttgtagatggtttgtaccttatggaggtcgaccgggttttaagaccgggcggttactggatcctctcgggaccaccgattaactggaaacagtactggagagggtgggagagaacagaggaggatttgaagaaagagcaagattcaatagaagatgtagcaaagagtctttgctggaagaaagtaactgaaaaaggtgacttatcaatttggcaaaagcctctcaatcacattgagtgtaaaaagctcaaacaaaacaataagtcacctccgatatgcagctcagataacgcggattccgcttggtaatactaatttacatctcgaaaatgtagtcttaactttgtgaaagaacaatgtcaaaacttggttttctctgttttaggtacaaagacttggaaacttgtataacaccattaccagaaacaaacaatccagatgattcagcaggcggtgcactcgaggattggccagaccgagcattcgcggtacctccaagaatcatcagaggaactataccagaaatgaacgcggagaaatttagagaagacaacgaggtttggaaagagagaatagcacattacaagaagatagtccctgagctttcacatggaagattcaggaacattatggacatgaacgcttttctcggcggattcgctgcttccatgctgaaatatccctcatgggtcatgaacgttgtcccggtcgatgcagagaaacaaacgttaggtgtgatctacgaacgtggattgatagggacgtatcaagattggtgtgaaggattctcaacgtatccaagaacttatgatatgattcatgcaggaggattgttcagcttatacgaacataggtaaagtttcatggtcttccaactcaaaactatatccgtgaaacgcgactaatggaatgttctttgtgtatgttttaaggtgtgatttgacgttgatattgttggagatggatcgaattttgagaccagaaggaacagttgtgttgagagataatgtggagacgttgaataaggtagagaagatagtgaagggaatgaagtggaagagtcaaattgttgatcatgagaaaggtccttttaatcctgagaagattcttgttgctgttaaaacttattggactggtcaaccttctgacaagaacaacaacaacaacaacaacaacaacaactagtgttccaactctctaggaactcttcactcttttgttgttgttgtgttttttttactttacgcagattctgatt

SEQ ID NO: 4298 - DNA, 1888 bp, Artificial Sequence
  P1975 (35S::G312)
gtttggcagtggtttttatagaccgccgggagggttagatctaggcgttaagaatggcttacatgtgcactgatagtggcaatctaatggctattgctcaacaagtcatcaaacagaagcagcaacaagaacaacaacagcagcaacatcatcaagaccatcagatttttggtattaatcctttgtctcttaacccatggcccaatacttccctcgggtttgggctttcaggttcggcttttcccgacccgtttcaagttaccggcggcggagattccaacgatcctggctttccttttcctaacttagaccaccaccacgccacaaccaccggcggtgggttcaggttatctgatttcggcggtggaaccggcggcggcgagtttgagtccgacgagtggatggagactcttatcagcggtggagactccgttgcagacggtcctgattgtgacacctggcatgataatcccgattacgtaatctacggtcctgatccattcgatacttacccgagtcgactcagtgtccaaccgtcagatctaaaccgagtcattgacacgtcgagtccgcttcctccgccgaccttgtggcctccttcttcgccattatcgattcctccgcttactcatgagtcaccaaccaaagaagatccagagactaacgactccgaagacgatgacttcgacctagaaccacctctcctcaaagctatatacgactgtgcacggatctcagactctgaccctaacgaagcttccaagacgcttcttcagatccgagaatctgtatcggagctaggtgatccgacggagcgagttgcattttacttcacggaagctctctccaacagactgtctcctaattcgccggcgacgtcgtcttcttcttcatctacggaggatttaatcttatcttataaaaccctaaacgacgcttgtccttactccaaattcgcacatttgacggcgaatcaagcgattctagaagcgacggagaagtcgaacaagattcacatcgtcgattttggaatcgttcaaggtatacaatggcctgctcttcttcaagctctagctactcgtacttctggtaaacccactcaaatccgggtctcgggtatacccgctccatctctcggtgaatctccggaaccgtcgttaatcgccaccggaaaccgcctccgtgatttcgccaaggttctggatctgaatttcgatttcatcccaattctcactcccatacatttacttaacgggtcaagtttccgggtcgacccggatgaagtactggccgtgaatttcatgctccagctctacaaattactcgacgagacgccgacgatagttgacaccgcactacggctcgccaaatcgttgaacccgagggtcgtcactctcggagaatacgaagtgagcttaaaccgggtcggtttcgctaaccgggtaaagaacgcgcttcaattctattccgcggttttcgaatcccttgaaccgaacttggggcgtgattcggaggagagagtgagagttgagcgagagttgttcggccggagaatctcgggtttgattggaccggagaaaaccggaattcatagagaaagaatggaagagaaagagcaatggcgggtattaatggagaatgccggttttgaatcggttaagctgagtaattacgcagtgagccaagcgaagattctattgtggaattacaattacagcaatttgtattcaattgttgaatctaagcctggcttcatctctttggcctggaacgatttacctctcctcactctttcttcctggcgataaccaaaccaaaccgatccggtattcttagttttgttttgttttcaatgttatttttggttaggcaaatattcaattgttaa

SEQ ID NO: 4299 - DNA, 1455 bp, Artificial Sequence
  P1982 (35S::G2713)
tggagtctctcatcttagtctgaagctctttttttttggatttgagcatttctggtttgagaagaatcttgtggaaaccaaagagaaatgtcgtttcgaggcattgttcaagatttgagagatgggtttgggagcttgtcaaggaggagtttcgattttaggctctcgagtcttcataaagggaaagctcagggttcttcgttccgtgagtattcgtcatcccgtgatctcttgtcgcctgtgatagttcagacaagtagatgggctaatcttcctccagagttactctttgatgtgatcaaaagattagaggaaagtgagagtaattggcctgcaagaaaacatgttgtggcttgtgcttcggtttgtcggtcttggagagctatgtgccaagagattgttttggggcctgaaatctgtgggaaactcactttccctgtttccctcaaacagccagggcctcgtgatgcaatgattcagtgtttcatcaaaagggataaatcaaagctaacatttcacctttttctttgtttaagtcccgctctattagtggagaatgggaaatttcttctttcagctaaaagaactcgtagaactactcgaaccgagtacattatctccatggatgctgataacatctcaagatccagcaactcttacctcggaaagctcagatcaaacttccttgggacaaagttcttggtgtacgacacgcaaccaccaccaaacacatcttcgagcgcacttatcactgatcgaacaagccgaagcaggtttcactccagacgagtttctcctaaagtaccatccggaagctacaacattgctcaaatcacctatgagctcaacgtgttgggcacacgcgggccacgacgaatgcactgcatcatgaactccatcccaatttcatcgctcgaaccaggcggttcagtccctaaccaacccgagaaactcgtccctgcaccatactctctcgacgactcattccgcagtaacatctccttctccaaatcatcatttgaccaccgctccctcgatttcagcagttctagattctccgaaatgggaatatcctgcgacgacaacgaagaagaagcgagtttcagaccgttgattctaaagaacaagcagccaaggtggcacgagcagttgcaatgctggtgtttgaatttccgcggacgtgtgacagttgcatcggttaagaatttccagcttgtagcagcaagacagccgcagcctcaagggacaggtgcagcagcagcaccaacaagtgcacctgctcaccctgagcaagacaaggtgattctccagtttggtaaagtagggaaagatatgttcacaatggactataggtatccattatcggcgtttcaggcgtttgcgatatgcttaagcagctttgacaccaagcttgcttgtgaatagaagaaaccactcgtctccttgatcattcat

SEQ ID NO: 4300 - DNA, 2516 bp, Artificial Sequence
  P1984 (35S::G416)
agggtaagatcttatatgaaatgatttgctaagaggactataagtctcggtgatcggggaattcgatatggaggagagtgaaacaaaggggagaatcagtcaagaaactgataaggcttgtgtttcagttgagagaattgggtctactttactctcatcatttgtgaagaaaggtaaagaagtatcaaataagagaaattctaagcagaataagcgaaaagcggaagaagaactctgttcgaaatcaagaaccaagaagtactctcggggatgggtccgttgtgaggaaatggaggaggagaaggttaagaaaacaagaaagaggaaaagtaagagacagcaaaaggataataaggttgaggttgatgattctttaaggttgcaaaggaggacaaggtatttgctcattaagatgaagatgcagcagaatcttatcgatgcatacgcaactgaaggttggaaaggtcagagccgggaaaagataagaccagacaaggagcttgagagagcccggaaagagatcttaaactgcaagcttggactacgcgacgccattcgccaactggatctgcttagttctgtgggaagcatggaagagaaagtgatagcttcagatggatctattcatcatgatcatatattttgtgcagaatgcaattctcgagaagcttttccagacaatgatataatactttgtgatggaacgtgtaatcgagcatttcaccagaaatgccttgaccctcctttggaaacagaaagcatacctcccggagatcagggctggttttgcaaattttgtgattgcaaaattgaaattatcgacacaatgaatgcacaaattggaactcatttccctgtggacagcaactggcaggatatcttcaatgaagaagctagtcttcctattggatctgaagctacagttaacaatgaagcagattggccttcggatgactccaaggatgatgattatgaccctgaaatgagggaaaacggtggaggaaacagcagcaacgttagtggtgatggtggtggtgataacgatgaagaaagcatttcaactagcttgagcttatcatctgatggtgttgccctttcaacgggatcatgggaaggccatagactcagcaatatggtggagcagtgcgaaacaagtaatgaagaaactgtatgtgggccaagacagcgaaggactgttgactatacacagttgtactatgaaatgtttggaaaggatgcagttttgcaagagcaaggtagtgaagatgaagactggggtccgaatgacagaaggaagagaaaaagggaatctgatgcaggaagcacacttgtaactatgtgtgaaagcagtaagaaagatcaagatgttgtagaaacgctagaacagagtgagagagattctgtctctgtggaaaataaaggaggtcgaaggcggatgttcagactcccaagaaatgcagttgagctacgtcaagtatttgcagagactgagcttccctcaaaagctgtgagggatcgtcttgcaaaagagctgagtcttgatccagagaaggtcaataaatggtttaaaaatactcggtatatggcactgcggaataggaagactgagagcgtgaaacaacctggggattctaagacagtctctggaggagattctggaccagaagcagtcatggagaacaacactgaaacaaatgaagttcaagatactttggatgacactgttccacccggatttgacgctacaaatcaaaacatactctccccatgtaataacaaccaggaggaatttcaacaggaaaatgtctcttttccttcacccacagatgaaagtcaacagtatctggaacaaaacgattcttctttcgttctagtgccacatgaaaagcaaagcagcgaaattagcttaaagacggctgtagaggagaatgagacagaaagcaagatgatgaaagagccacatgaagagctaagcagtgaaatgagcctaaagacggctgctgaggagaaggagacagagagcaagatgatagaagagccacatgaagagctaagcagagaaatgagcttaaagacggctgtagaggagaaggagacagagagcaagatgatggaagagccacatgatgagctaaacagcgaaatgagcttaagtacagcggtagaggagaaggagacagggagcaagatgacggaagagtcacatgaagagctaagcaacgaaatgagcttagaagagaaggagacggggagaaagatgacggaagaggaagaattggaagcagtaatggagatgctttgtagaacagaaaacaagttactggacgtgacgcagaggcttgatagatttaaaacaccaaaaggccgaaaaaagttaggcaattcttcttctcctttacttgaagaagactcagtagtgtatgttccaatagcagagatcaaggagaaaaggtaacaatatatatatatatatcaagaaaagaaaaaagtcctttgcagaagttttggtattgtta

SEQ ID NO: 4301 - DNA, 1928 bp, Artificial Sequence
  P1987 (35S::G550)
aaagtttccgctttttgctcgctggagaagaaagaaagaaagaagtgaaaaggaatcattaccatggctgatccggcgattaagctctttggaaagacgattcctttacctgagcttggtgttgttgattcttcttctagctataccggatttttaaccgaaactcagattcctgttcggttatcagattcgtgtaccggcgatgatgatgatgaagagatgggtgattccggtttaggacgagaagaaggtgatgatgttggtgatggtggaggagagagcgagactgataaaaaggttagttttttttggaacttgtgaattgattttgatttgttaaatggaaatgattgatgggtttatgttagattggtcaaatcttagttttattgataaagttatgatttttggtttgtttatgtaagaactaggttttcagagcttttggggattcgaaaattgtaaatctggattctcaaatgagtttttttttttccttttgttataaagtgatttgagatcttaattagttccatttggttttgattgatggttataggttttgatattgatttgcttaagaacttttcagggttttagcttctctgtgattggaatcaagtctttgatccctgtagcttctagcttctgtttgttgtttgtttgattaggatacataacaacgatctgactctggttcttatgttattcttcaggaagaaaaagatagtgagtgtcaggaagagtcattgaggaatgaatctaatgatgttactactactacatcgggtataactgaaaaaacggaaacaacaaaagctgcaaagacgaatgaagagtcaggtggtactgcttgctctcaagaggggaagttaaagaaacctgataagattctaccgtgtccgcgatgtaacagcatggaaaccaagttctgttactacaacaactataatgttaaccaacctcgccatttctgcaagaaatgtcagagatattggacagctggtggaacgatgaggaatgttccggttggtgctgggagacgtaagaataagagtccagcttctcattataaccgtcatgtaagtataacatctgcggaagctatgcagaaggtggcgagaactgatcttcaacatcctaatggtgcaaatcttctcacttttggctctgattctgtgctttgtgaatctatggcttctggattgaatcttgttgagaagtcattgttgaagacacaaactgtattgcaagaacccaatgaaggcttgaagattacggttccgttaaaccagacaaacgaagaagctggaacagtcagcccgttaccaaaagttccatgctttccaggaccaccaccaacttggccttacgcttggaacggagtttcgtggacgattttaccgttttaccctccaccggcttactggagctgcccgggggtttcaccgggggcatggaacagcttcacatggatgccacaacccaattcaccatctggttccaatccaaattctcctacactaggtaaacattcacgtgacgagaacgctgctgaaccaggaaccgcttttgatgaaaccgagtcacttggtagggagaaaagcaaacccgagagatgcttgtgggttcccaagacgctgaggattgatgatccagaggaagctgctaaaagttccatctgggaaacattagggatcaaaaaagacgaaaatgcggatactttcggagctttcagatcatcaaccaaagaaaaaagcagtctttctgaaggaagacttccgggaagaagaccggagttgcaagcgaatcctgctgctctttctaggtcagcaaacttccatgagagctcatagaaagaagaagaatctaagcagctgatttgattgtttttgggttcagtcttgtgttccaagaaagcaggtgag

SEQ ID NO: 4302 - DNA, 1026 bp, Artificial Sequence
  P1989 (35S::G1142)
tttaggacagaacccaccgaaagctccacaaaccccattaattaacaaaaaaccaaaagaaggcggcgcaaacaaaagataatgcaaccagagacctcagatcagatgttgtactcgtttcttgccggaaacgaagtcggcggtggagggtactgcgtctccggcgactacatgacgactatgcagagcttatgtgggtcttcgtcgtcgacgtcatcgtattacccactggcgatctccggcatcggagaaacgatggctcaagacagagctttagctgctttgaggaaccacaaagaagctgagagaagaaggagagagaggatcaattctcatctcaacaagcttcgtaacgtactctcttgtaattctaagaccgataaagccacactgctcgccaaagtagttcaacgagtcagagaacttaaacagcaaaccctagagacctccgactccgaccaaacattattaccatcagagaccgacgaaattagtgttctacactttggagactattcaaacgacggtcatataatcttcaaagcctctctatgttgtgaagatagatcagatctcttgccggaccttatggagattctcaagtctcttaacatgaagactctccgagctgagatggtaaccattggtggtcggacaagaagtgttcttgtcgtagctgctgacaaagagatgcacggcgtcgagtctgtgcattttttgcaaaatgctctcaagtcgctgcttgagcggtcaagcaagtcgttgatggaacgtagttctggtggtggaggaggagaacggtcaaagcggcgtcgtgcgctggatcacatcataatggtgtgaaatgatgagaattgagcacactaaaaagtctataattgattaatatatatagggtatgatcataattaacttggttataattaccaaaaccttttttattcctctttaataatatatatgttatatggttttagttactaagtcttgggagtgtaagcaaatgttgtaagtaggtttggtgtg

SEQ ID NO: 4303 - DNA, 1453 bp, Artificial Sequence
  P1993 (35S::G2557)
tcgacttcctgtgaactcatctgtttgttctcttcttccggtttcactttttcatgtcctgccgttattacaacgaggattgtgtttgatccgatggaaggattggaatctgtgtacgctcaagctatgtatggaatgacacgagagagcaaaatcatggagcatcaaggatcagatttgatttggggaggaaatgagctaatggctcgagaactctgttcttcttcttcttatcaccaccaactcattaatccgaatcttagcagctgtttcatgtctgatcttggagtcttaggtgagattcaacagcagcaacatgttggcaacagagctagctcgatagatccatcatcactcgattgtttgttatctgcgacgtcgaatagcaacaacacctcgacggaggacgatgaaggaatatctgtgcttttctcagattgtcagactctttggagctttggtggagtctcatctgcagagtctgagaacagagagatcactactgagacgacaacaacgataaagcctaagcctttgaagagaaacagaggaggagatggaggaactactgagactacaacaacaacaacaaaacctaagtctttgaagagaaacagaggagacgagacaggaagtcactttagtcttgttcatcctcaagatgattcggagaaaggaggtttcaagcttatatacgatgagaatcaatcgaaatcaaagaaaccaagaacagagaaagaacgaggcggttcttcgaacattagtttccaacattcaacttgtttgtctgacaatgtcgagcccgatgctgaggcgattgcacaaatgaaggagatgatatacagagcggctgcatttagaccggtgaatttcgggttagagattgtggagaagcctaagaggaagaacgtcaagatatcgacggatcctcaaacggttgcagcgagacagagaagggagaggataagtgagaagattagggttttacaaacattggttccaggtgggacgaagatggatactgcatcaatgcttgatgaagctgctaattatctcaagttccttagagcacaagtaaaagctttagaaaacttgagacccaagcttgaccaaaccaatctctctttctcttctgctcctacatcgtttccattattccacccatcttttcttccattgcaaaatcctaatcaaatccatcatccagagtgttgacagattataaacttttgagtttcatcatcatcaacagaatcatggcgtcttgattgttttagcagttctcaagaaaggcaacttctgtgacaagggtggtgtcgggcagtgttgtttacactttccagtctttgttttgcatttctttttatataaagtttgtattttatatagaatctgtggaattcgagggttgaaatattgtgaaaaacagagccgcaagaggttaattacagtc

SEQ ID NO: 4304 - DNA, 1069 bp, Artificial Sequence
  P1998 (35S::G2571)
cttatactccacgaaacgtctggttgagaaaaaatggaagaaagcaatgatatttttcagaacaatttcagtcctaaaatctcagaaatcagagcatctctgtctcagatcatattagcaggaggaccaaacacactcgactcaatcttctcacttctcactccctcctccgtagaatccgccacaacatcattcaacactcacaatcctccgccaccgccgcagctcgggtcctccgtctatctccgccaacgagatatcatcgagaagttccaccttcagaacagagcaatctccactcctcatcctcctctgttttcctcaacgtacgatcatcatcaaacttccgagctaatgctccaagcggcggccgggtctccagccgccgctttcgccgctgcgttagcggctgggagggtgacgaaaaagaagaaactttacagaggagtgaggcagagacattggggaaaatgggttgcggagataagattgccgcaaaacagaatgagggtttggttaggtacttacgacacggcggaagccgccgcttacgcttacgatcgcgccgcctataagctccgtggagaatacgctcgtctcaattttcctaatctcaaagacccgagtgagctactcggactcggagattcctctaagctaatagctctcaagaacgccgtcgacgggaagatccaatccatttgccagagagtcagaaaagagagagcaaaaaagagcgtaaaagtgagcaaaaactcgtcggccacggcggattcttcgtgtttgtcatcgccggagattctgtcgtcgtctccggtgacgacaactactactgcggttacttcagaggatagttattgggtttcacctatgggtttgtgtaacagtgaaaatagttctccggtatcagtttcggtccctagtgaagtaccggcgacggcggaggaagaggcaatgatgggagtggacactgatgggtttttattagcgaggatgccatcgttcgatccagagctgatttgggaagttcttgccaattaatactacacaaagaatgtgaattttgatc

SEQ ID NO: 4305 - DNA, 653 bp, Artificial Sequence; identical to SEQ ID NO: 1589
  Artificial sequence
  P2002 (35S::G2583)

SEQ ID NO: 4306 - DNA, 1378 bp, Artificial Sequence
  P2004 (35S::G2589)
aagaaaagaaaaataaagataatgaggacgaagactaagttagtactcatacctgatagacactttcggagagccacattcaggaagaggaatgcagggataaggaagaaactccacgagctgacaactctctgtgacatcaaagcatgtgcggtaatctacagtccgttcgagaatccaacggtgtggccgtcaaccgaaggtgttcaagaggtgatttcggagttcatggagaagccggcgacagaacggtccaagacgatgatgagtcatgagactttcttgcgggaccaaatcaccaaagaacaaaacaaactagagagtctacgtcgtgaaaaccgagaaactcagcttaagcattttatgtttgattgcgttggaggcaagatgagtgagcaacagtatggtgcaagggaccttcaagatttaagtctttttactgatcaatatcttaatcagcttaatgccaggaagaagttccttacagaatatggtgagtcttcttcttctgttcctcctctgtttgatgttgcgggtgccaatcctcctgttgttgcagatcaagctgcggtaactgttcctcctttgtttgctgttgcgggtgccaatcttcctgttgttgctgatcaagctgcggtaactgttcctcctctgtttgctgttgcgggtgccaatcttcctgttgttgcagatcaagctgcggttaatgttcctactggatttcataacatgaatgtgaaccagaatcagtatgagccggttcagccctatgtccctactggttttagtgatcatattcaatatcagaatatgaacttcaatcaaaaccaacaagagccggttcattaccaggctcttgctgttgcgggtgccggtcttcctatgactcagaatcagtatgagcccgttcactaccagagtcttgctgtcgcgggtggcggtcttcctatgagtcagttgcagtatgagccggttcagccttatatccctactgtttttagtgataatgttcaatatcagcatatgaatttgtatcaaaatcaacaagagccggttcactaccaagctcttggtgttgcaggtgccggtcttcctatgaatcagaatcagtatgagccggttcagccctatgtccctactggttttagtgatcattttcagtttgagaatatgaatttgaatcaaaatcaacaggagccggttcaataccaagctcctgttgattttaatcatcagattcaacaaggaaactatgatatgaatttgaaccagaatatgagtttggatccaaatcagtatccgtttcaaaatgatccattcatgaatatgttgacagaatatccttatgaataagcgggttatgttggagagcatgcac

SEQ ID NO: 4307 - DNA, 1090 bp, Artificial Sequence
  P2005 (35S::G2590)
cacacaccaaagaaaagaaaaacaaagataatgaggtcgaaaattaagttatcactcatagctaataagacctcaaggagaaccacattcaggaagaggaagggagggataacgaacaaactccatgagctaacaactctctgcggcgtcaaagcatgtgcggtaatctccagtccgtacgagaatccagtggtgtggccgtcaaccgaaggtgttcaagaggcggtttccatgtttatggagaggccggcgacagaacaatccaagctgatgatgagtcatgagacctacttgcaggacaaaattaccaaagaaacaaagaaactggagagtctacgtcgtgaaaaccgagaatctcagcttaggcaatttatgtttgattgtgttgaaggtaagatgagtgagcatcagtatggtgcaagggaccttcaagatttaagtctttatattgatcactatatcaatcagcttaattcaagtgtcatgctccttacaaacaatggtgcgtcttcttcttcctttcctcctccgcttcatacttcagttgcgggtgcgggtgcgggtgcgggtgctgctcctcttgttgttgcgggtgcgggtgcggctcctcttgctgttgcgggggcgggtgcgagtcctcttgctgttgcgggtgtgggtgcggctcctcttgctgttgcgggtgccggtcctcctatggctcagaatcagtatgagccgattcagccctatatccctactgcttttagtgataatattcaataccaagctcctgtggattttaatcatcagatccaacatggaatctatgataatctcagtttggatccaaatcatcagtatccgtttcaagatgatccattcatggagatgttgatggaatatccttatgaacaagtgggttatgctgcagagcatgcacacatccctttcatgaacggaaactactacaactaccaccaaccaccaaccgttggtcttactaccaccggtcacatgccttccaacaacgccaccaccaccaccaccaccaacaccaccgttgtgtgatgtgtttcagtagtttgcatttgtgttttgtccatttcaa

SEQ ID NO: 4308 - DNA, 1329 bp, Artificial Sequence
  P2009 (35S::G2719)
tgcagttaggaaagctggtacaaaccaaatttcattttttttcttttaattaattttggccaaaaagaaaaaaaaatcgaaactttttttgtgtaaatggaaggagaaactcatcaatcggagccgttacctttagcatctggagattccgatgaagggatcagtgctgcgattgaggcggagcttgctgagttagctgctggagattcaagcggcggtggtggttgcggcggcggaggaggagggattaggagtaaagtcaaaggaccttggtctacggaggaagacgcggttcttacgaagcttgtgaggaaactaggaccgaggaattggagtttgatcgctcgtggaatccctggtcgttctggtaaatcttgtcgattgcgttggtgtaatcagcttgacccttgtctcaagcgtaaacctttctctgatgaggaagatcgtatgataatttctgctcacgcggttcacggaaacaaatgggcagtgattgcgaaactgttaactggaagaacagataacgctatcaagaaccattggaactcaactcttagacgtaaatacgcagatctatggaataatggtcaatggatggctaattcagttactaccgcttccgtcaaaaacgaaaatgtcgatgaaacaactaatcctccatcctcaaaacaacagttgcctcaaggagatatcaattcctccccgccaaagcctccacaagtgagtgatgttgtaatggaagaggcagctaatgaacctcaagaacctcaagaacaacaagaacaagctccaccggtagtgagtaacgttccaacagaaaataacgtgtttcgccccgtggctcgcgttggtgcattcagtatctataacccaaccagccagaaaaatggttacagagactacaatatagttccatgtgagggaccgttgattcaagcagctaaacccgattcattggctggtaaatttctacaatctctttgtgatgaacctcaaatcccgtcaaaatgtggtcacggctgctctactcttccagctgaaactaagttctcacgtaactcggtgttgggacctgagtttgtggattatgaagagccttctgcggttttcaaccaagaactaatatctatagcaaccgatttgaacaacattgcatggataaagagtggccttgacaatgctgttgtcagagaagcagaacagagtttgaagatggataattacaattataatgatcctcgaatcaagtttactggaatgatgcctagacaagatttcttctgtgcaagaagctgaaactcaaaagtagggcttgagattcatcaaccc

SEQ ID NO: 4309 - DNA, 646 bp, Artificial Sequence
  P2011 (35S::G2631)
aacttcgcggtctagatcttccggtaatctgattttccttttgaattctgatcatgtagatttaaaactatggatccgatggatatagttggaaaatcaaaggaagatgcttcgcttccgaaagctaccatgacgaaaattataaaggagatgttacccgcagatgttcgtgttgctagagatgctcaagatctattgattgagtgttgtgtagagttcataaatcttatatcgtcggagtcgaatgaagtgtgtaacaaagaggataaacgaacaatagcccctgagcacgtactcaaagctttacaggttcttggctttggggaatacgtagaagaagtttatgccgcgtatgagcaacataaatatgaaaccatgcaggattcgcagagaagtgtgaagatgaatagcggagcagagatgacggaagaagaggcggcagcggaacaacagaggatgtttgcagaagctcgagcaagaatgaatggaggtgttacagttcctcaaccagagcaactagaagaaccccaacaacaacaacaaacaagtctacaaagctaatcaacaaaaccgcaaaggaatcccttattttaacattatccttttgacttctttttctttctagcaatatctctgtaaagtgcaa

SEQ ID NO: 4310 - DNA, 864 bp, Artificial Sequence
  P2012 (35S::G2701)
gtgtttgtagttgaaacttattcttccctttttttgtttttaggtatggagactctgcatccattctctcacctacctatctctgaccaccggttcgttgttcaagagatggtgagcttacacagctcgagtagcggtagctggactaaagaagagaacaagatgttcgaacgagctcttgcgatatacgctgaagactcgcctgatcgctggtttaaagttgcttccatgatccctggaaagactgtttttgatgttatgaagcaatatagtaagcttgaagaagacgttttcgatattgaagcaggacgtgttcccattcctggttatcctgcagcttcttctcccttggggtttgacacggacatgtgtcgtaaacggcctagtggagctagaggatctgatcaagatcgaaagaaaggagtcccttggacagaggaagaacacaggagattcttgttaggccttctcaagtacggtaaaggagattggagaaacatatcgagaaacttcgtggtgtcaaagacgccaacgcaagtggcgagccacgcccaaaagtattaccagagacagctctccggagccaaggacaaacgcaggccaagtatccatgacatcacaaccggcaatcttctcaatgccaatctcaaccgttccttttccgatcatagagatattctccctgatttagggtttatcgataaggatgatacggaggagggagtaatatttatgggtcagaatctctcttcagaaaatctgttttctccatcaccaacttcattcgaagctgccattaacttcgccggagaaaatgtcttcagtgccggagcttaaggcaacatagaatccccaaactcagcg

SEQ ID NO: 4311 - DNA, 756 bp, Artificial Sequence
  P2014 (35S::G2724)
aagtagaacagaattcgcaaactgtaaaacccttataaatcataaagaagaagtcgaagaagtcgagaaaaagatggaaatagaaataaggagaggtccatggactgtggaagaagacatgaagctcgtcagttacatttctcttcacggtgaaggaagatggaactccctctctcgttctgctggactgaatagaacggggaaaagttgcagattgcggtggctaaattatctccggccggatatccgccgtggagacatatcccttcaagaacaatttatcatccttgaactccattctcgttggggaaatcggtggtcaaagattgctcaacatttaccgggaagaacagataacgagataaagaattattggagaacacgtgttcaaaagcatgcaaaacttctaaaatgtgacgtgaacagcaagcaattcaaagacaccatcaaacatctctggatgcctcgtctcatcgagagaatcgccgccactcaaagtgtccaatttacctctaaccactactcgcctgagaactccagcgtcgccaccgccacgtcatcaacgtcgtcgtctgaggctgtgagatcgagtttctacggtggtgatcaggtggaatttggaacgttggatcatatgacaaatggtggttattggttcaacggcggagatacgtttgaaactttgtgtagttttgacgagctcaacaagtggctcatacagtaggcatttcatgggtttattaatgaatgtaatgt

SEQ ID NO: 4312 - DNA, 1235 bp, Artificial Sequence
  P2016 (35S::G2893)
cccaaatcataaaagcctctctcttagtctatttttatctcacggctctctctcccctctctacacacacaaacacaaataaagcgtaaaactgaaatattttaattacaattagaaagagaacatattaatatgtcaaatataacaaagaagaagtgtaatggaaatgaagagggtgcagagcagaggaaagggccttggacactcgaggaagacactcttctcaccaattacatttcccataacggtgaaggccgatggaatctgctcgctaaatcttctggtaatattcttttcttttatgttttctttgtactattccaacaaaatgcaattggtgaaaatgtcttcctcccacttcatatttttgtattaaaagtttgatctctttttacaaaaaaacaaaaaaacagggctaaagagagcaggaaaaagttgtagattgagatggttgaattaccttaaacccgacataaagcgtgggaatctcactcctcaagaacaacttttaatccttgagctccattctaaatggggtaataggtaagttagttactcaaatgctctctttagctttataattttcttataatctaacgtgtaacatgttgcttcttaattaggtggtcaaaaatttcgaagtatttaccaggaagaacagacaacgatatcaaaaactactggagaactagagtccagaaacaagcacgccagctcaacatagattccaatagccacaagttcatagaagttgttcgtagcttttggtttccaagactgatcaacgagattaaagacaactcatacaccaacaatattaaagctaatgctcctgatttacttggaccaattttacgagacagcaaagatttgggtttcaacaacatggattgttccacttccatgtcagaagatctcaagaaaacttcacaattcatggatttttctgatcttgaaaccacaatgtccttggaaggatcacgagggggtagtagtcaatgtgtgagtgaggtttatagctccttcccttgcctagaggaggagtacatggtggccgttatgggcagttcagacatttcagcattgcatgattgtcacgtggctgattccaagtacgaggatgatgtgacacaagatctaatgtggaacatggatgacatttggcagtttaacgagtatgcacactttaattaggttatattatatttatgtacttcttacaacttggaggggtt

SEQ ID NO: 4313 - DNA, 1119 bp, Artificial Sequence
  P2017 (35S::G478)
agagagatcttcctcgggattgcaacatgttggactacgaatgggataatccttcctccatcgttctctccggagatgaaagaaacccggactctgacccgacccggtcatccttctcctttttcgaccccatctcccattacaacaacgaccaccgtcacatcaccatttctcctcccctcctctcttccttctctaaccaacaacaacagcatcacctcaccctctacggtcagaccaacagcaacaaccagtttcttcatcatcaccatcaccaccactccttgtacgggtccaccaccaccaccactccttacggcgcctccgatcccatctaccatccccactcttccgctccgccagcctccttgttctcctacgaccagacaggaccgggctcgggatccggatcttcctacaacttcctcatccccaagacagaagtggatttcacgtccaacaggatcgggctgaacctgggaggccgtacgtacttctcagcggcggacgacgacttcgtgagcaggctatacaggaggtctcgaccaggtgagtcagggatggcgaactcgctgagcacgccgcggtgccaagcagagggatgcaacgcggatctgagccacgcgaaacactaccacagaaggcacaaagtgtgcgaattccactcaaaagcatcgacggttgtagccgccggactaagccaaaggttttgccagcaatgcagcaggttccatttgctgtcggaattcgacaacgggaaacggagctgccgtaagcgacttgctgaccataaccgccgccgccgtaaatgtcaccaatcagcctccgccacccaagacaccggcaccggcaagactactccaaagtcaccgaacgattcgggtgttaaagcgtcatcgtcaccgtcgtccaacgcgccgcctacgatatcactggagtgcttccggcaaaggcagttccaaacgacagcgtcttcatccacgtcagcgtcttcgtcttcaaattcaatgtttttctccagcggatagttataagctttactcatatgatatattatgcttaaaatgagaaatcaaaggactcttcaatatcactagttaatgctagctgtctatcatc

SEQ ID NO: 4314 - DNA, 2361 bp, Artificial Sequence
  P2020 (35S::G1331)
agaatgagttggtggggagtgaaaggaggaggatggggaatggtggaagaagtttggagaaagggtccatggaccgccgaagaagaccgtcttttgatcgaatacgtccgtgttcacggtgaaggtcgttggaactctgtctctaaactcgcaggtaccaccactttctgtgtaatgcatgttttaatatatgtttttttttcttcaaatgaatgaatgattgattcatgaatgttttgatcgttaggattgaaaaggaatggcaaaagctgcagactaagatgggtgaattaccttagaccagacctcaagagaggacagatcactccacatgaagaaagtataatacttgagctacacgctaagtggggaaataggtaaaaatacctcaaaacgaaaacaaacaacctcaagtcttttttttgtttttttaggtttgtcgatggcttttatcttaagtattagggttttgtataggtggtcaacaattgcacgtagtttaccaggaagaacagacaatgagatcaagaactattggagaacccatttcaagaaaaaggcaaagcctacgactaacaatgcggagaagataaagagtcgtctcctaaaaaggcaacacttcaaggaacagagagaaatagagttgcaacaagaacagcagttgtttcagttcgaccaactcggtatgaaaaagatcatctctttactcgaagaaaacaatagcagtagcagtagcgatggcggtggtgatgtgttctattatcctgatcaaataacacattcatcaaaaccctttggctataactctaattcattagaggagcagttacaaggtagattttctcctgtaaacatacctgatgctaatactatgaacgaagacaatgccatatgggacgggttttggaacatggatgttgtaaatggacatggtgggaacttgggtgttgtggctgctactgctgcttgtggcccaaggaagccctatttccataacttggtgattccattttgttaagtatggtctacttttggacttcggttttctgtcttttcaggtttggttactagtttctatgctatgaacctataagtcgtttgtgatgaagtgtgtgtgtgtgatgtaagaggaatattgtaagttcaagattataaaaaaaaaaacttcaaacgtaagttaatgagcagggaaccatgattcttggatttttatgaatttgtttttgtgtccaatcacaaaaaaaaaaaactcatattagctttgatttgtgatttagatagacaaatccgatttgagttaagcctctaaaattagccgaaatccgtcaaaacaggtgatccagtcatatacacaaagcccacttaataaaaagatttagtcaaaatttgattaattattaggacttcaatttgactaaatgttaaattacaaattaaattgtaagagatttgtttccatttgaagcttgtttccagttttctttgtcaaacttatggaaaagcatttatcttattttctttctatctaatatgaattaaaagtacactatttttgttctttctcttttttttttccttaatttattgataaattatattaaaacaaaaaatcaacgtttttttacataaaatgcaaacttttctttataaagattacaaaatatctctatccgtgatgttctcgcgatgcaaaccacatttgcaatattataatcatatatatgaaagttggacaactctctctatatgattgacacatcatcacttttacatttgccatgtgtccactaaataattaatgtaagctcttcaacttttaataatgtatttattatttaattttacatatttaattgtactaatactaaatttattttgttattacatgtttttcaataaaattattttattggttttctcgtactcaaatatttttttctgtaatcttaactcaaattatgagtgtatagtagtcatggattagttaatagtttgaatagtttgcatattgttatatatctatataataaatcgtcgagggtgaagagtatgtatgaagtttaatcatcaaatttttaggtttcgataatcccaatattaccctctatttaattagtttaagacgaacattgtttaggaatagtgtgtataatgtattgttgataatgttgttagaaaaaaatactttaatactaagaataattacttattatataagtaaatgattagataattaaaaattatatttaaattaaacgatacaaaaaatctgaaaataccgcagtgtaacgcaggtgattacctagtaaaataaaaagaggtcacaaaactttctgatgcacaaagaaactcaatgtcaag

SEQ ID NO: 4315 - DNA, 1661 bp, Artificial Sequence
  P2022 (35S::G1304)
cataacaatattcgtgttatagctagtaataatggggcgatcaccatgttgcgatgagaatggtctaaagaaagggccatggacacaagaggaggatgataaactgatagatcacattcaaaaacatggccatggcagctggagagctcttccaaagcaagccggtttaaaccgatgcggaaagagttgtagattaagatggaccaactacttgagacctgacatcaagagaggaaatttcactgaagaggaagaacaaactattatcaacctccattcccttcttggaaacaagtaatcaattactttttcactttataattccttgctttgttttaaaaaccatcgaatgttaattctttctagtcaaatcattaattatatctcataaaaagttagtgtgaaacgatctaggatgaagtttataactagaattaagagtagtgtgatatatgaaatatataataacatatatattagtatatagtttatggatgaaagaatataattgacatatatacctactacactggttttctctaggtgcatacgtctgtagccgtttttcaatcttgaaaagtaaatcttgttacgactaaagcaagacaatattaggtatatattagtcttagactaatccactgccataatatcaatttgattaatgtttaattatttcgtatatgttttggaaggtggtcgtcgatagccggtaatcttcctggaagaacggacaatgaaataaaaaactattggaacacacatttgagaaagaaacttctccaaatggggattgatccggtgacccataggccaagaaccgaccatctaaacgttttagcagctctcccgcagcttatagccgccgcaaatttcaacagcctcttgaatctcaaccaaaatgtgcaactggatgcaacaactcttgctaaagctcaactgctacacactatgattcaagtccttagcaccaataacaacaccaccaatccttctttttcttcatcaactatgcaaaacagtaacaccaatctctttggccaagcttcttacttagagaaccaaaatctttttggtcagtctcaaaacttctctcacattcttgaggatgagaatttgatggtcaaaacccaaattattgataaccctttggactctttttcttcccccatacaacccggttttcaagatgatcataattcactccctctattggttccggcgtctcctgaagaatctaaagaaactcaaaggatgatcaagaacaaagacatcgtcgattaccatcatcatgatgcttcaaacccttcatcatcaaactcaacgtttacacaagatcatcatcacccatggtgtgacactattgatgatggagcaagtgattctttttggaaagagataatagagtaagtcctatcagtactctcccacatagattgaattttatagttaccacatgaatgcattcagtgaatatggacgatttggctagtctaatgttataattctccgttttgcaggcaaacttgttcggaaccatggccatttcctgaatagacaagattgaaaaatgattaaagagagagtatatttatttttcttgttatttgttgtcgatagagttaaaagcatatttattcttcactaatccttaccgtgtt

SEQ ID NO: 4316 - DNA, 948 bp, Artificial Sequence
  P2023 (35S::G2452)
ttgccttggtcactcaagactctcttcttcactctctgttttttgtcctcttctaaaatttagagaaaaaaacgaaagttttcaccaaaaacagaggaggagctatgtcatcgtcgacgatgtacagaggagttaatatgttttcaccggcaaacacaaactggatttttcaagaagtcagagaagccacgtggacggcggaggagaacaaacggttcgagaaagctctcgcttatctggacgacaaagacaatcttgagagctggtccaagatcgcagatttgattcccggcaaaacagtagctgacgtcattaaacgatacaaggagctagaggatgatgtcagcgacatcgaagccggacttatccccattccgggatacggcggcgacgcctcctccgctgcaaacagtgactatttctttggtctagaaaactccagctacggttatgattacgtcgttggaggaaagaggagttcgccggcgatgactgattgttttaggtctccgatgccggaaaaggagaggaagaaaggagttccgtggaccgaggacgaacacctacgatttctgatgggtttgaagaaatatggaaaaggagattggagaaacatagcaaaaagctttgtgacgactcgaacgccgacgcaagtcgcttcacacgctcagaaatattttcttcgacaactcacagatggtaaagacaaaagacgatcaagtattcacgatatcaccactgttaacatccctgacgcagacgcatccgcaaccgccacgaccgctgacgtagcactctctcctactccagccaattcttttgacgttttccttcagccaaatcctcattacagtttcgcgtctgcgtctgcgtctagctattataatgcgtttccgcagtggagttaaatcacttagaaattatctagagtttgtggtctcctataga

SEQ ID NO: 4317 - DNA, 819 bp, Artificial Sequence
  P2024 (35S::G1305)
cgatgatgatgacaaaagttacatgtccccataagattctctaaaattaaaagtggggtgtgatggggaatagaagagcaccatgctgtgacaaaagccaagtgaagagagggccatggagtgatgaagaaagtgaaagactcagatcttttatcctcaaaaatggtcatcaaaattggcgatctcttcccaaactcgctggattgatgagatgcggaaagagttgtcgtctaagatggataaactatctgagaccaggtctcaaacgaggcaacttcaccaaggaggaggaagataccattatccaccttcaccaagcttatggaaacaagtggtctaagatcgcatccaacttcccgggaaggacagacaacgagatcaagaatgtatggaacactcatctcaagaagcggttggtgaagaggagcatttcatcatcatcatccgatgttaccaatcattcagtgtcttctacctcttcttcctcttcctcaatctcgtcagtcttgcaggacgttattattaagagtgagaggcctaaccaggaagaggagtttggggaaatcttggtggagcaaatggcatgtggatttgaggtggatgcaccacaatcactagaatgtctctttgacgatagccaggttcctcctcctatatctaaaccagactcactacaaacccatgggaagtcatcagatcacgaattttggagccgactgattgaaccagggttcgatgattacaatgagtggctcattttcttggataaccaaacttgctagtgctagaacacacaaggagttgacccatcatgtctta

SEQ ID NO: 4318 - DNA, 1589 bp, Artificial Sequence
  P2025 (35S::G2346)
ctattctcctccgtccttactatttccagagttcagtacttagaaagaaagagagtgatgagcagaagcatctctttctctgtctgagtaagaggaagccaaaaccataatggagttgttaatgtgttcgggtcaggccgagtcaggtggttcttcttccaccgagtcttcttcactcagtggtggactcaggtttggtcagaagatctacttcgaggatggatccggatccagaagcaagaaccgggtcaataccgttcgtaagtcgtctaccacggcgaggtgccaagtggaaggttgtagaatggatctaagcaatgttaaagcttattactcgagacacaaagtttgttgcattcactctaaatcatctaaagtcattgtctctggtcttcatcaaaggttttgtcaacaatgtagcaggtttcccccttttttcttcttccttttatttactcattttgccatttccggtgatcggaatagttctaagggaaccatagctttacgcttttttcaggttttatgttccttttgagctttttgagttttggctcttaacgtcattgaagagtcttatcaaaacttaaactttacagctagttattatgtggtcttgtctcttgtcttatgcattatttaggttgcttttctttgaagctttcttttctttatatcaaatcaggtttcaccagctttctgagtttgacttggagaaaagaagttgtcgcagaagactcgcttgtcataacgaacgacgaagaaaaccacaacccacaacggctcttttcacttctcattactctcgaatcgctccatctctttacggttagatcccaatatacacagcccttttcagctcaatgagtctcaaaaacaagttattgaatttcctgtgtgtcaggaaaccccaatgctgcaatgattaaaagcgttttgggagatcctactgcgtggtcaaccgcaagatcagtgatgcagcggcctggaccgtggcagattaatccagttagggaaacccatccacacatgaatgttttatcacatggaagctcaagctttactacatgtccagagatgataaacaacaatagcacagattcaagctgtgctctctctcttctgtcaaactcatacccaattcatcagcagcaacttcagacaccaacaaatacatggcgaccatcttctggtttcgactcgatgatctcattctccgataaggttacaatggctcagccaccgcccatttcaacccatcagccgcccatctcaacacatcagcagtacctcagccaaacttgggaagtcatcgcgggcgaaaagagcaattcacattatatgtctcctgtgagtcaaatctcggagccagcagatttccagataagcaatggcaccacaatgggtggatttgagctgtatcttcatcagcaggttctgaagcaatacatggaacccgagaacacaagagcttatgactcctctcctcaacatttcaattggtctctttgagtctaatctctttcaccttttaagatcttcatcagtttgttactaaaatcttatcaactatctcttgtgtgctactt

SEQ ID NO: 4319 - DNA, 849 bp, Artificial Sequence
  P2026 (35S::G1332)
aacagcctcactcacttgcaaaactgtggaagaaaaaataaaagatggaatgcaaaagagaagaagggaagtcttacgtgaagagagggttgtggaaaccagaagaagatatgatattaaaaagctatgttgagactcatggtgaaggaaactgggcagacatttctcgtagatccggttcgatttccaaatttttgtgtttactagtaaaggggagatgggattttgggacattaaagaatttgtgtttctgcatgatgtttttttcagggttgaagagaggaggaaaaagctgtaggctgagatggaagaactatctaagaccaaatatcaaaagaggaagcatgtcaccacaagaacaagaccttatcatccgcatgcataagcttcttggaaacaggtctttcctctttcaccactgatcatccctctcataagtttaccgatactaacttcttattcttttccatcagatggtcgttgatcgctggtcgccttccaggtcgtactgacaatgaagtgaagaactactggaatactcatttgaacaagaaacctaattcccgaagacagaatgcacctgaatcaatcgtcggcgccactcctttcacggataagccagttatgtctacagaactgagaagaagccatggagaaggaggagaagaggagagcaatacctggatggaggagaccaaccactttggctatgacgtccacgtaggatctcccttgccacttatttcccactacccagacaacactctcgtgtttgacccatgtttttcctttaccgatttctttcctctgctttaggactttcctggatttatctcgaaggataaattc

SEQ ID NO: 4320 - DNA, 1626 bp, Artificial Sequence
  P2027 (35S::G1313)
tccggagttagggtgggagcttgatgtctaaattgttactgtcagtggtttaattagaaaagagatgagttacacgagcactgacagtgaccataatgagtcaccagctgctgatgataatggaagtgactgcagaagtagatgggatggtcatgctctcaagaaaggcccttggagttcagctgaagatgatattcttattgactatgtgaataagcatggtgagggtaactggaatgctgtgcagaaacacaccagcttgtttcgttgtggtaaaagctgtcgtctaagatgggctaatcatctgaggccaaatttgaagaaaggagcttttagtcaagaagaagaacagcttatcgttgaattgcatgccaagatgggtaatagatgggcacgtatggctgcacatgtaagtgttttgtttctgataaggatatggttccttttgtaaaagtgtgtttcgagactaatttcatagagtttttgtttgctccagttgcctggccgaacggataatgagataaagaattattggaacactcgtatcaagaggcgacaacgagctggtttgccactttatcctcctgagatgcatgttgaggcacttgagtggagtcaagagtatgccaagagtagagttatgggagaagatagaagacatcaagatttcttgcagctggggagttgtgaatctaatgtcttctttgatactcttaattttaccgacatggtacctggtacttttgatctagcagatatgactgcctacaaaaatatgggtaactgtgcaagttctcctcgatatgaaaacttcatgacaccaacaatcccctcctcgaagcgactttgggaatctgagttgttgtatcctgggtgtagcagtaccataaagcaagaattctcgtcgcctgaacaattccggaacacatctccacaaacgatttccaaaacttgcagcttctcagttccttgtgatgttgagcatcctctctatggaaaccgacattcacctgttatgattccagatagccatacccctacggatggcattgttccttattctaagcccttatatggggcagtgaagctggagctcccttcattccaatattcagaaacaacatttgaccagtggaagaaatcgtcatctcctccacactctgatctccttgatccctttgatacttacattcagtctccaccaccaccaacggggggagaagagtcagatttatattcaaattttgatactggtctgctcgatatgttgcttctggaagccaagatcagaaataatagtacaaagaacaatttgtacaggagctgcgcttcaactattccatcagctgatcttggccaggttactgtatcccaaactaaatccgaggagtttgacaattcccttaagagcttcttggttcattccgaaatgtccacacaaaatgcagatgaaactccaccaagtgagttactattcaccttaccatcacttgaaatagtttgttgaagatttcatctttttccctagaattctatttggtatcctgattttactttttgagaatcatcacttgcattaatttgtttcttatagccgagattttgagctgatcaagaactcaccta

SEQ ID NO: 4321 - DNA, 1727 bp, Artificial Sequence
  P2029 (35S::G1927)
ctcgttgaccccgatcgagatggttgattcttctcgtgattcgtgtttcaaagctggtaagtttagtgctccaggttttcgatttcaccctactgatgaagagcttgtggtttattatcttaagaggaagatctgttgtaaaaaacttcgagtcaatgccattggtgtcgttgatgtttacaaagtcgatccttctgaattgcctggtctatcgatgttgaagacgggagatagacagtggttctttttcactccaaggaataggaagtatcctaacgcagctaggtcaagtagaggtactgcaactggttattggaaggcgacaggaaaggatcgagtcattgagtacaattcaagatctgttggactcaagaagactcttgttttctatagaggtcgtgctcctaatggtgagagaactgactgggtgatgcatgagtacactatggatgaagaagagctagggagatgtaagaacgctaaggagtattatgctctttataagctttataagaagagtggggctggtcctaagaatggtgaacagtatggtgctccgttccaagaagaagaatgggttgatagtgatagtgaagatgcagatagtgtcgctgtaccggattatcccgtggtccgttatgagaatggtccttgtgtggatgatactaaattttgcaatcctgtcaaacttcagttagaggatattgagaagcttctcaatgaaatcccagatgcacccggggttaaccaaagacagtttgatgagtttgttggtgttccacagggtaatagtgcagaagtgatacagagcacattgctgaataattcttctggagagtatattgaccctcggacgaatggaatgttcttgccaaatggccagctatacaacagggactcgagttttcagtcccatttgaattcatttgaggctacctctggtatggcacctcttctagataatgagaaggaggagtacattgaaatgaatgatcttctgatccctgagctcggtgcttcttcaacagagaaatccacagagttcttgaaccatggtgaatttggtgatgttaatgaatacgaccaattgttcaatgacatatctgtttttcagggaacttctacagatctgtcttgtctgagtaattttactaataacacatcaggccaaagacagcaattactttatgaacagttccagtaccagacacctgagaaccagcttaataactacatgcatcctagtaccactcttaatcagttcactgacaatatgtggtttaaagatgatcaggctgctctctatgttcaaccaccacaatcttcttctggagcattcacttcacagtcaacaggtgtgatgcctgagtctatgaatcccactatgagtgtaaatccccaatacaaggaaggacaaaatggtggtggaacaaggagccagttctcatcagctctgtgggaattattggaatcaataccatcaacaccagcctctgcctgtgagggtcctcttaaccagacctttgtgcgtatgtctagcttcagccgcatcaggttcaatggaacgtcagtgactagtagaaaagtcactgtagcaaagaagcgtatcagtaacagaggttttcttctgttatcaattatgggtgctttgtgtgctatcttctgggtgttcaaagccaccgttggagttatgggaagacctctcttgtcgtgaacctagactcttg

SEQ ID NO: 4322 - DNA, 977 bp, Artificial Sequence
  P2030 (35S::G2531)
gatcagtaaaataagaaggatgagttggtgtgatggttcagatgataactacgatcttaatcttgaaagagtatcgaacactgatcatccatcggttcaactcaaagaccaatctcaatcatgtgtaacgagccgtccagattccaagattagcgctgaaactcccatcacgacttgtccttcttgcggacacaagctccatcatcaccaagacgaccaggttggtagcatcaaagatttaccaagcttaccggcaggagtcaaattcgatccgtcggataaagagatccttatgcatttggaggcgaaggtatcatccgataagcgaaaacttcatccgttgattgatgaatttatacctacgcttgaaggagagaatggaatttgttatacgcatcctgagaaacttcctggagtaagcaaggacgggcaagtacggcacttcttccaccggccatcaaaggcttatacgaccggaacacgaaaacgaagaaaagtgagcacagatgaggaaggccatgaaacaaggtggcacaaaacaggcaagactcgacctgttttgtctcaatcaggagaaaccggtttcaagaagatcctagtgctctacaccaactatggtcgccagaagaagcctgagaagacgaattgggtgatgcatcagtatcatttaggtagcagcgaggacgaaaaagacggtgaaccagtcctctctaaagtcttctaccaaacacagcctaggcaatgcggttcgatggaacctaaaccgaaaaatctcgtaaacctaaaccggtttagttatgaaaatattcaggccggtttcgggtatgagcatggtggtaaaagtgaagagacgacgcaggtgattcgagagttggtagttcgtgaaggcgatgggtcatgttcgtttcttagttttacttgtgatgcaagtaagggtaaagaaagcttcatgaagaatcaatagaacataacatata

SEQ ID NO: 4323 - DNA, 1042 bp, Artificial Sequence
  P2032 (35S::G2053)
atggagaatccggtgggtttaagattccgtccgaccgacaaggagatcgtcgtcgattacctccgaccaaaaaactccgatagggacacgagtcatgttgatcgagtcattagcacagtcactatccgtagcttcgacccttgggagttaccttgccagtctaggatcaaactgaaagatgagtcttggtgtttcttcagccctaaggagaacaaatatggcagaggtgatcaacaaattagaaaaacgaaatctggttactggaagattactggcaaaccaaagcctatcttgcgtaaccgccaagagatcggtgagaaaaaggttttgatgttttacatgagtaaggaacttggtggatccaaatccgactgggttatgcacgagtaccatgctttctctcctactcagatgatgatgacatatacaatatgtaaagttatgtttaagggtgacgtgagagagatttcttcttcttctgcttcttatggtagtgaaattgagcagagtcgtgactctttaatccctcttcttgtgaacgattctgaggaagaagctcaaatcgaggatgctataccaatagaggaatgggaaacatggttgactgatgatggtgttgatgagcaggtgaatcatattatgaatatgaaagatgatcgcaacaaccacaggcctcaaaagccattgactggtgtcttgattgacgatagtagtgatgatgatgatgattctgatttgctatctccaacaacaaattctattgaaaattcgagcacttgtgatagttttggtagctcagaccaaatcaacttagtgtcactaactcaagaggtgagccaagctctgataaccagtattgatacacccgagaagattaagagtccttatgatgatgcacaagggactggggctggagggcaaaaattgggtcaagagactcgagagaagaaacgagctggtttctttcacaggatgatacaaatattcgtcaagaaaattcaccaatgttcttctatctcaagaacataatagcagtaaatga

SEQ ID NO: 4324 - DNA, 621 bp, Artificial Sequence
  P2038 (35S::G2510)
ataacaaactctttaatgtcaccacagagaatgaagctatcatcaccaccagttaccaacaacgaaccaaccgccaccgcttctgccgttaaatcttgcggcggaggaggtaaagaaaccagctcatcgaccacgaggcatccagtgtaccacggagttcgcaaacgccgatggggaaaatgggtttctgagatcagagagccccggaaaaagtctcggatttggctcggatcttttccggtgccggagatggctgctaaggcctacgacgtggcagcgttttgtctaaaaggtagaaaagctcagctgaatttccctgaagaaatcgaggatctacctcgaccgtccacgtgtactcccagagatatccaagtcgcagcggccaaagcagccaacgccgtgaagatcatcaaaatgggagatgatgacgtggcaggaatagacgacggagatgatttctgggaaggcattgagctgcctgagcttatgatgagtggaggtgggtggtcgccggagccttttgttgccggagatgatgccacgtggcttgtcgacggagacttgtatcagtatcagttcatggcgtgtctgtgagtgttgctgtcgattgtgtcgtattcg

SEQ ID NO: 4325 - DNA, 1183 bp, Artificial Sequence
  P2039 (35S::G2509)
atatattccctctttcattctccttcttcgtcttttctttgtttctcatattcaagacatcctcaattccaaatcttaaaccctaaatttacagacacaatcgagatcacctgaaaaaagaggtttaaagattttagcaaagatggcgaattcaggaaattatggaaagaggccctttcgaggcgatgaatcggatgaaaagaaagaagccgatgatgatgagaacatattccctttcttctctgcccgatcccaatatgacatgcgtgccatggtctcagccttgactcaagtcattggaaaccaaagcagctctcatgataataaccaacatcaacctgttgtgtataatcaacaagatcctaacccaccggctcctccaactcaagatcaaggtatatttacatatatagttgacaaattagttaccatatttatgggatgatatatgtgaatgaaaaaatgagcataatgttttataatagcagttgaatttgtgctctggacgacgaatatatccatgtagtatatatgagaaatatatcaagtatatatacgaatgttttctcttgttgattagggctattgaggaagaggcactatagaggggtaagacaacgaccatggggaaagtgggcagctgaaattcgggatccgcaaaaggcagcacgggtgtggctcgggacatttgagactgctgaagctgcggctttagcttatgataacgcagctcttaagttcaaaggaagcaaagccaaactcaatttccctgagagagctcaactagcaagtaacactagtacaactaccggtccaccaaactattattcttctaataatcaaatttactactcaaatccgcagactaatccgcaaaccataccttattttaaccaatactactataaccaatatcttcatcaaggggggaatagtaacgatgcattaagttatagcttggccggtggagaaaccggaggctcaatgtataatcatcagacgttatctactacaaattcttcatcttctggtggatcttcaaggcaacaagatgatgaacaagattacgccagatatttgcgttttggggattcttcacctcctaattctggtttttgagatcttcaataaactgataataaaggatttgggtcacttgttatgaggggatcatatgttttct

SEQ ID NO: 4326 - DNA, 949 bp, Artificial Sequence
  P2042 (35S::G2295)
gtaatatataacaataactcaggttacaaaggatggttccgaaagtggtcgacctacaaaggatagcgaacgataagacaaggataacaacttacaagaagaggaaagctagtctttacaagaaggcacaagagttctcaactctctgcggcgtcgagacatgtctcatcgtctacggtcccacgaaggctaccgatgtggtgatttccgagccagagatatggccgaaggacgagaccaaagtcagggccatcatacgcaagtacaaagacacagtgtcgaccagctgcaggaaagaaaccaacgtggagactttcgtcaacgatgtagggaaaggaaacgaggtggtgactaaaaagagagtgaagcgtgagaataagtattctagttgggaggagaagctagacaagtgttcacgagagcaactacatgggattttctgtgccgtggatagcaagttaaatgaagctgtaacgagacaggagcgtagtatgtttagggttaatcatcaagccatggacacaccattcccgcagaatttaatggaccaacaattcatgccacagtattttcatgagcagccacagtttcaaggcttccctaataatttcaataatatgggtttctcgttgatttcacctcatgatggtcagattcaaatggacccaaatctcatggagaagtggaccgacttggctttgactcaaagcttgatgatgtcaaagggaaacgatggtactcaattcatgcagaggcaagaacaaccatactataatcgtgaacaggttgtatcgaggtctgcaggtttcaatgttaacccgtttatgggatatcaagtcccgtttaatattcctaattggagattatcgggaaatcaagttgaaaattgggagctttcagggaagaaaacgatatgatttgaattacggagctttattagtttttaggg

SEQ ID NO: 4327 - DNA, 1005 bp, Artificial Sequence
  P2043 (35S::G2290)
ctttctcttccaatcaagaacaaaccctagctcctctctttttctctctctacctctctttctctatcttctcttatcactacttctctcgccgatcaatcatcatgaacgatcctgataatcccgatctgagcaacgacgactctgcttggagagaactcacactcacagctcaagattctgacttcttcgaccgagacacttccaatatcctctctgacttcggttggaacctccaccactcctccgatcatcctcacagtctcagattcgactccgatttaacacaaaccaccggagtcaaacctaccaccgtcacttcttcttgttcctcatccgccgccgtttccgttgccgttacctctactaataataatccctcagctacctcaagttcaagtgaagatccggccgagaactcaaccgcctccgccgagaaaacaccaccaccggagacaccagtgaaggagaagaagaaggctcaaaagcgaattcggcaaccaagattcgcattcatgaccaagagtgatgtggataatcttgaagatggatatcgatggcgtaaatatggacaaaaagccgtcaagaatagcccattcccaaggagctactatagatgcacaaacagcagatgcacggtgaagaagagagtagaacgttcatcagatgatccatcgatagtgatcacaacatacgaaggacaacattgccatcaaaccattggattccctcgtggtggaatcctcactgcacacgacccacatagcttcacttctcatcatcatctccctcctccattaccaaatccttattattaccaagaactccttcatcaacttcacagagacaataatgctccttcaccgcggttaccccgacctactactgaagatacacctgccgtgtctactccatcagaggaaggcttacttggtgatattgtacctcaaactatgcgcaacccttgaggtaagcttggtacgtagcaatagctaaggaggtgct

SEQ ID NO: 4328 - DNA, 733 bp, Artificial Sequence
  P2046 (35S::G2136)
acaaaaatctcttgttcttcttgtcttcaatatggaggatggggaagcttcaacaatcactttcttaccaaccacggaaccaaaacccctacaaaaccctaacttgctggccaaaccaaaaaaagagactaaacaaaaaaaacctaaaaccaccaaaggtcgacagaagatagagatcaaggagatcatgctggagacccgaaggcaagtgacgttttccaaacgacgatccgggcttttcaaaaaagcggcagaattaagcgttctctgcggcgcacagattggtatcataacgttttcacgttgcgataggatctactcgtttggtaacgtgaactcactcatcgataaatacttgcgtaaggctccggtgatgctgaggtcacatcccggtggtaacgtggcaaacggagaggaagataacgacggtttgatgtggtgggagagagcggtggagagtgtgccggaggagcatatggaagagtacaagaatgccttgagtgtgttaagggagaatttgttgacgaggatctaccagatgagtggtgatcggacggttgagaatcttccggcatttccaaatgagatggctatggctgactggaaattaacgaatgaaaatctgatggctaggaacgatcgaggttatggaggtaacaatggtgatttggagtttgcgtttatgcctcaaaacggtagacagtgaggtgttttttctttaatttattattac

SEQ ID NO: 4329 - DNA, 2366 bp, Artificial Sequence
  P2048 (35S::G2110)
gagagctaataaaaaatttatcaaagaagactaatatggagaaggacgatttcttgaggagtggtcatggaagagaagaaagccatgatgagatgagaaaacttgattcatctcacgatgattctcatcaagaacacgaccatattataagatccaaggtatcataaatttccttttgtatagttttcaaatatttagacgtcatttataaatcgcataaatcaatccttggaattacatacatgtatctttcataatcttatcacatagatggtttgttttatccaaaatccatttttattaattgattgattagtcttaatcaatgaatcttaatttgaattctaaaatcatactaaattagatcttcaaatctcttgtcagtttcataattttctgtctttgcggaggtttttacgaagaatttgctcatctatatatcacaagtacaataattatgagaaagaaagaaaaaaatatgtattggatttttgaggcatgcatatataatttgaggaaagatcaaccaaacgatagatatttgtatatttgttaagcatatcgtgattaaccatatcttataaacgtatgatgagatcagttggactcaactaaagtcgaaatggatgaggctaaagaggaaaatcgaagactaaagtcatcattgagtaaaatcaagaaagattttgacatccttcaaacacaatacaaccaattaatggccaaacataacgaaccaaccaagttccaatcaaaagggcatcatcaagacaaaggcgaagatgaagacagagaaaaagttaacgaacgtgaagaacttgtctcgttgagcctaggcagacggttaaattcagaggttccaagtggttcgaataaagaagaaaaaaataaagatgttgaagaagcggaaggtgacagaaattatgatgataatgaaaaaagcagtattcaagggttgagtatggggattgaatacaaggctttgagtaatcctaatgagaagttagagattgatcataatcaagaaaccatgtcgttggagattagtaacaataataagatcagatcacaaaatagttttgggtttaagaatgatggagatgatcatgaagatgaagatgagattttgcctcaaaaccttgttaagaaaactagggtttcggtgagatcaagatgtgagacaccaacggttagtacattttattcatatctttaatttaattagtatatacatctatgaatgctaacagtataatccttccttttttctcacttctatttttataagaaaaaaaaacttctcaaagagtatattccacaagaacagaatcaaagtttgtgttttaatttcttgggctatatattgtctctgtagatgaacgacggatgtcaatggaggaaatatggccagaaaatagctaaaggcaatccatgtccccgagcttactatcgttgcaccattgcagcttcttgtccagtaagaaaacaggtaaaagtactaaactgataattatattctaaatagtcctatgttattaaagaaccatatatatatcatatcaactcttttatttaggtgcaaagatgttcagaagatatgtctatacttatctcaacgtacgaaggaacacataaccatccacttcccatgtcagcaactgccatggcctctgccacttccgctgccgcctccatgcttctctccggcgcctcctcctcctcatccgccgcagctgatcttcatggccttaacttctctctttccggcaacaacatcactccaaaacctaaaactcatttcctccaatccccttcttcttctggccatccgaccgtcactctcgacctcacaacctcctcctcgtcgcagcaaccgttcttatcaatgctcaatagattcagctctcctccaagtaatgtctcacgatctaatagttatccttcaaccaatctcaacttttcaaacaacaccaacacattgatgaattggggtggtggtggtaatcccagtgatcaataccgtgcagcttacggcaacattaacacccatcagcaatcaccttaccacaaaatcattcaaacccgaaccgccgggtcatctttcgatccgtttggaagatcatcttcatcacattctccacaaataaatcttgatcatatcggaatcaagaacatcatcagtcaccaagtgccatctttaccggctgaaacaatcaaggcaatcacgacagatccaagtttccaatcggctttggcgacagctctatcttccatcatgggcggcgatttaaagattgatcacaatgtgactagaaatgaagctgagaagagcccttaaagagaattgttatatatatgttcttata

SEQ ID NO: 4330 - DNA, 1243 bp, Artificial Sequence
  P2051 (35S::G1794)
taagtttcagaggaggaggatttagaaggagggttttgtatgtgtgtcttaaaagtggcaaatcaggaagataacgttggcaaaaaagccgagtctattagagacgatgatcatcggacgttatctgaaatcgatcaatggctttacttattcgcagccgaagacgaccaccaccgtcatagcttccctacgcagcagccgcctccatcgtcgtcgtcctcatctcttatctcaggtttcagtagagagatggagatgtctgctattgtctctgctttgactcacgttgttgctggaaatgttcctcagcatcaacaaggaggcggtgaaggtagcggagaagggacttcgaattcgtcttcttcctcggggcagaaaaggaggagagaggtggaggaaggtggcgccaaagcggttaaggcagctaatactttgacggttgatcaatatttctccggtggtagctctacttctaaagtgagagaagcttcgagtaacatgtcaggtccgggcccaacatacgagtatacaactacggcaactgctagtagcgaaacgtcgtcgtttagtggggaccaacctcggcgaagatacagaggagttagacaaagaccatggggaaagtgggcggctgagattcgagatccatttaaagcagctagagtttggctcggtacgttcgacaatgctgaatcagcagcaagagcttacgacgaagctgcacttcggtttagaggcaacaaagccaaactcaacttccctgaaaacgtcaaactcgttagacctgcttcaaccgaagcacaacctgtgcaccaaaccgctgctcaaagaccgacccagtcaaggaactcgggttcaacgactacccttttgcccataagacctgcttcgaatcaaagcgttcattcgcagccgttgatgcaatcatacaacttgagttactctgaaatggctcgtcaacaacaacagtttcagcaacatcatcaacaatctttggatttatacgatcaaatgtcgtttccgttgcgtttcggtcacactggaggttcaatgatgcaatctacgtcgtcatcatcatctcattctcgtcctctgttttccccggctgctgttcagccgccaccagaatcagctagcgaaaccggttatctccaggatatacaatggccatcagacaagactagtaataactacaataatagtccatcctcctgatgacttgcttcattttatttgtttcact

SEQ ID NO: 4331 - DNA, 782 bp, Artificial Sequence
  P2052 (35S::G2298)
cactatactgtcagctccaaaacatacctgaataagtgaatatacattaaaacctaatctatcatcatatccatctctttccctctctgcatttagagatatggatgcatccccaaagtacacaggtgtacggaagaggaagtggggaaaatgggtggctgagattcgtctccccaacagccgtgacaggatctggttaggctctttcgactctgctgagaaggcggcgcgtgctttcgacgcggctctttactgtcttcgtggccccggagcacgcttcaacttccccgacaatcctccggagattcccggtggtcgttctctgacgccgcagcagattcaggtcgtagctagccgtttcgcctgcgaggaggagctactaccaccggaacaacatcatccgtcaccgccacgtggcgaccataataccgaggaagaagtgataatttcggcacgtggggaaattaatagtggtagtggtgggcctacgttagggcaagttggggaagataataacaacgagggtaatagtaatgacacgtcgtcgtattggcctttaatatgggaggaggagaattttgtaggtcctcctaactcagatcatgagttcggttttttcacagatgattcaaccaatttgtacttcccgacacaacaacaacaacaacatcagctctcgtctgatttttactatgatggagcttgtgaagatgatttctctcattacaatattaacctttggaatttctgagatccatttttttggtgatcttggaccaaat

SEQ ID NO: 4332 - DNA, 1048 bp, Artificial Sequence
  P2053 (35S::G1796)
ttgtcctcaaaccaaaaccctagaaaccaaaaatggaaaaagccttgagaaacttcaccgaatctacccactcaccagaccctaatcctctcacaaaattcttcactgaacctacagcctcacctgttagccgcaaccgcaaactgtcttcaaaagataccactgtaaccatcgccggagctggcagcagcacgacgaggtaccgcggcgtacgccggaggccgtggggacgatacgcggcggagatacgtgacccaatgtcgaaggagagacgttggctcggaacatttgacacggcggaacaagccgcttgtgcttacgactctgcggctcgtgcctttcgtggagcaaaggctcgtactaattttacttatccgacagctgtcattatgcctgaaccaaggttttctttttccaacaagaaatcttcgccgtctgctcgttgtcctcttccttctctaccgttagattcctctacccaaaacttttacggtgcaccggcagcgcagaggatctataatacacagtctatcttcttacgcgacgcctcgtgttcctctcgtaaaacgactccgtataataactctttcaacggctcatcatcttcttactcagcatcgaaaacggcatgcgtttcttattccgaaaacgaaaacaacgagtcgtttttcccggaagaatcttctgatactggtctattacaagaggtcgttcaagagttcttgaagaaaaatcgcggcgttcctccttctccaccaacaccaccgccggtgactagccatcatgacaactctggttatttctctaatctcactatatactctgaaaatatggttcaagagactaaggagactttgtcgtcgaaactagatcgctacgggaattttcaagctaatgacgacggcgtaagagccgtcgcagacggtggtttatcgttgggatcaaacgagtgggggtatcaagaaatgttgatgtacggaactcagttaggctgtacttgccgaagatcgtggggatagctagatattcatcatgattatgttttgag

SEQ ID NO: 4333 - DNA, 1036 bp, Artificial Sequence
  P2055 (35S::G904)
ctctcctctcatcaatggaatctctcatcaatcccagccatggcggaggaaaactacgattctcactcttcttctctcgatagtctcaaaccaagcgtactagtcatcattctcattctcctcatgactcttctcatctccgtttccatttgcttcctcctccgctgtctcaatcgctgtagccaccgctccgttctccctctttcatcttcctcttccgtcgcaaccgtaacttccgattcccgacgattctctggacatcgagtctctcccgaaacagaacggtcctccgtgcttgattcgcttccgattttcaaattctcctccgtcactcgccgatctagctccatgaattccggagattgcgccgtttgtttgtcgaaattcgaatcggaggatcagctccgtcttcttcctctctgttgtcacgcttttcacgccgattgtatcgatatctggctagtctctaaccagacttgtcctctctgtcgctctcctctcttcgcttcagaatctgatctcatgaagtctctcgccgtcgtcggctcaaacaacggcggaggagaaaacagcttccgtctcgaaatcggatccatcagccgtcgtcgtcaaacaccgattccagaatccgttgagcagcatcgaacttactcaatcggttcgttcgattacatagtagacgacgtagattcagaaatctcagagtcaaatttcaaccgtggaaaacaggaagacgcgactacaacaactgccacagcaacggcggttacgactaatccgacgtcgtttgaagctagtttagcggcggatataggtaacgatggttctagaagctggctcaaggattacgttgacagactctcacgaggtatatcgtcgcgtgcaatgtcgtttagaagctctggtagattttttactgggagtagtcgtcggagtgaggaattgacggtgatggatttagaagcgaatcatgccggagaagagataagtgagcttttccggtggctctcaggggtgtgagtgacaggtgagttgg

SEQ ID NO: 4334 - DNA, 1033 bp, Artificial Sequence
  P2058 (35S::G2789)
tttagggacaccaaatctattcaacctaaaagccttcttttcccctatattgaccaactttttagcgaatcagaagaggaatggatgaggtatctcgttctcatacaccgcaatttctatcaagtgatcatcagcactatcaccatcaaaacgctggacgacaaaaacgcggcagagaagaagaaggagttgaacccaacaatataggggaagacctagccacctttccttccggagaagagaatatcaagaagagaaggccacgtggcagacctgctggttccaagaacaaacccaaagcaccaatcatagtcactcgcgactccgcgaacgccttcagatgtcacgtcatggagataaccaacgcctgcgatgtaatggaaagcctagccgtcttcgctagacgccgtcagcgtggcgtttgcgtcttgaccggaaacggggccgttacaaacgtcaccgttagacaacctggcggaggcgtcgtcagtttacacggacggtttgagattctttctctctcgggttcgtttcttcctccaccggcaccaccagctgcgtctggtttaaaggtttacttagccggtggtcaaggtcaagtgatcggaggcagtgtggtgggaccgcttacggcatcaagtccggtggtcgttatggcagcttcatttggaaacgcatcttacgagaggctgccactagaggaggaggaggaaactgaaagagaaatagatggaaacgcggctagggcgattggaacgcaaacgcagaaacagttaatgcaagatgcgacatcgtttattgggtcgccgtcgaatttaattaactctgtttcgttgccaggtgaagcttattggggaacgcaacgaccgtctttctaagataatatcattgataatataagtttcgtcttcttattctttttcactttttacctttttcactttcttaggttttgttttaacgtttgattaatacctgaaggtttttggaaaattttcgatcggataaaaggatttatgttgcgagccgaaac

SEQ ID NO: 4335 - DNA, 1879 bp, Artificial Sequence
  P2062 (35S::G2140)
tctcttaactttcgtttcttctcctaccttcttttaccaacctttcctttctcttacacacatatatatatacatatatagagagagagaagaggacaaagagttgaaagatgaagactctcatgtcttcatagaaacaagtgatatgtgcgctaagaaagaagaagaagaagaagaagaagaagacagttctgaagccatgaacaacatacaaaattaccaaaatgacctcttctttcaccaactcatctctcatcatcaccatcatcatcatgatccttctcaatctgaaactttgggagcatccggtaacgttggatctggtttcactatcttctctcaagattccgtctctccaatatggtctctacctccacctacctcgatccaaccaccatttgatcagtttcctcctccttcttcttctccagcatctttctacggaagtttcttcaacagaagtcgagctcatcatcagggattacagtttgggtacgagggttttggtggagccacgtcagcagcacatcatcatcatgaacaacttcggatcttgtcggaagctttaggtccggtagtacaagccgggtccggtccttttgggttacaagctgagttagggaagatgacagcacaagagatcatggacgctaaagctttggctgcttcaaagagtcatagtgaagctgagagaagaagaagagagagaatcaataatcatctcgctaagctccgtagcatattacccaacaccaccaaagtaagtccaaaatttttataacataaattttcatacataagtaaaaacattcatcaatcacacaccgtttaagttttttgtaaataaaaaataatactaaaacaatgtagagtttaagtggaaaaacatagtagctgcgacatgaaagtttatgtcacattttgtctctttttatttttttacatttaggttttataaaaggagaagtaagttattcaaaggttttctgttttgatcaatgatcttgtgggtatttgttaaagtcccgagagagaatcagtcagagactgtagtataaataaaaaagcaaggaatatggaacgtctatgtcgtcgtttggttaattgatgtaataaagagaaacaaccggcgctgcttaaaaagcataaaaagtcttattgccggaccaaatcataacttctacgaccacataattttctcctcgaaactatacaaatatgttttttcttcgttttttttaatgcagacggataaagcgtcgttactagctgaagtgatccaacatgtgaaagagttgaagagagagacttcagtgatctcagagacaaatcttgtcccaacggaaagcgatgagttaacggtagctttcacggaggaggaagaaaccggagatggcagatttgtaattaaagcgtcgctttgctgtgaagacaggtcggatctcttgcctgacatgattaaaacattgaaagctatgcgtctcaaaacgctcaaggcggagataaccaccgttgggggacgagtcaagaacgttttgtttgttaccggagaagagagctccggtgaggaagtggaggaagagtactgtatagggacgattgaggaagctttgaaagcggtgatggagaagagcaatgtagaggaatcatcttcttctggaaatgctaagagacagagaatgagtagtcacaacactatcactatcgtcgaacaacaacaacaatataatcagaggtaatcaattttttacttaaatcgctttttttttcttactttcggtgtatctactacgtgtgttgtttgctggttatggaaatgaatgttgtacgtcacgttatactatagatatatgtgtgtttgtgtgtatgtataacggaa

SEQ ID NO: 4336 - DNA, 1176 bp, Artificial Sequence
  P2064 (35S::G2145)
aagaaaggcaagagttgatcagttagagcgatggacgtttttgttgatggtgaattggagtctctcttggggatgttcaactttgatcaatgttcatcatctaaagaggagagaccgcgagacgagttgcttggcctctctagcctttacaatggtcatcttcatcaacatcaacaccataacaatgtcttatcttctgatcatcatgctttcttgctccctgatatgttcccatttggtgcaatgccgggaggaaatcttccggccatgcttgattcttgggatcaaagtcatcacctccaagaaacgtcttctcttaagaggaaactacttgacgtggagaatctatgcaaaactaactctaactgtgacgtcacaagacaagtaagtggaagatccaatatataatgtttactttcattcactactactacgcaataaactaaataaaatatcattaatttgtgggatataggagcttgcgaaatccaagaaaaaacagagggtaagctcggaaagcaatacagttgacgagagcaacactaattgggtagatggtcagagtttaagcaacagttcagatgatgagaaagcttcggtcacaagtgttaaaggcaaaactagagccaccaaagggacagccactgatcctcaaagcctttatgctcgggttagaaaacatactttatattacttcggtctcaaaaccaaatgacaatgagtaaagtcgttcttaagtgtgttatcaattgttgcagaaacgaagagagaagattaacgaaaggctcaagacactacaaaaccttgtgccaaacgggacaaaagtcgatataagcacgatgcttgaagaagcggtccattacgtgaagttcttgcagcttcagattaaggtatgtagattgttaaaaggattttttgtttttagtcagaatcttatcataactcatgttcaagttaactaaccaaaatgcatattttataaatgtagttgttgagctcggatgatctatggatgtacgcaccattggcttacaacggcctggacatggggttccatcacaaccttttgtctcggcttatgtgaaggacttacaagttacaatgtcaatgtaaagaaacccatttagaacatatatatccctatttgagccaaactaaagagatctacgctaagat

SEQ ID NO: 4337 - DNA, 1219 bp, Artificial Sequence
  P2066 (35S::G2520)
atactcaccaagccacaatcatttctctcttctctatctctctggttttgaatcggcgacgactgagtcaactcggtgttgttactggtttcgtcgtatgtgttgtaactgattaagttgatggatccgagtgggatgatgaacgaaggaggaccgtttaatctagcggagatctggcagtttccgttgaacggagtttcaaccgccggagattcttctagaagaagcttcgttggaccgaatcagttcggtgatgctgatctaaccacagctgctaacggtgatccagcgcgtatgagtcacgcgttgtctcaggcggttattgaaggtatctccggcgcttggaaacggagggaagatgagtctaagtcggcgaagatcgtctccaccattggcgctagtgaaggtgagaacaaaagacagaagatagatgaagtgtgtgatgggaaagcagaagcagaatcgctaggaacagagacggaacaaaagaagcaacagatggaaccaacgaaagattatattcatgttcgagctagaagaggtcaagctactgatagtcacagtttagctgaaagagcgagaagagagaaaataagtgagcggatgaaaatcttgcaagatcttgttccgggatgtaacaaggttattggaaaagcacttgttctagatgagataattaactatatacaatcattgcaacgtcaagttgagttcttatcgatgaagcttgaagcagtcaactcaagaatgaaccctggtatcgaggtttttccacccaaagaggtgatgattctcatgatcatcaactcaatcttctccatttttttcacaaaacaatacatgtttctatcgaggtattctcggggtaggagtctcgatgtttatgcggttcggtcatttaagcattgcaataaacggagtgacctctgtttttgctcctgctccccaaaaacagaacttaagacaactatattttcacaaaacatgacatgtttctgtcgatattctcgagtaggagtcgctattagttcatctaagcattgcaatgaaccgtttggtcagcaagcgtttgagaatccggagatacagttcgggtcgcagtctacgagggaatacagtagaggagcatcaccagagtggttgcacatgcagataggatcaggtggtttcgaaagaacgtcttgataaagaaacaacacttggtcatcatcttactaca

SEQ ID NO: 4338 - DNA, 1504 bp, Artificial Sequence
  P2068 (35S::G2552)
atgcatgacattacaagacgtaactgaataaactaatatcaaccaactatcaagagtacatttctttaaatttgttttaattgatttcttaacttattatgttaattaatacagtttatttcatactcactctattatataaactcattttgtctctctttcgttgtcaacaacttttcttcattgacaaaaacacacaaatggaaggaagagtcaacgctctgtcaaacataaacgatctcgaacttcacaatttcttggtcgatccaaacttcgatcagttcataaacctcataagaggagatcatcaaaccattgacgaaaacccagttcttgatttcgatcttggtccattacaaaacagcccctgtttcatagacgagaaccagttcatcccaacacctgtcgatgacctcttcgacgaattgcctgacttagactccaacgttgctgaatcattccgtagcttcgacggtgatagtgttagagccggtggtgaagaagatgaagaagattacaacgacggtgatgattcttcagccactactacgaataatgatgggacccgtaagacgaagactgatcggtctaggactttgatctctgagagaagaaggagagggcgtatgaaggataagctttatgcattgagatctcttgttcccaatattactaaggtaagtcacaacattttcaagatttggtaatgactaatgaaactgtaaatattgatgaagtatgtgtgtgttggcatttagatggataaagcatccattgttggagatgcagtgttgtatgttcaagaacttcagtcacaagcgaagaaactcaaatccgatatcgcgggtcttgaagcttctttaaactctactggagggtaccaagaacatgctcctgatgctcaaaagactcaaccttttcgcggtatcaatcctcctgcttccaaaaaaatcattcaggtaataacctaaaaaaaccaatcaatcttcttgaaacatcaaagtgtttaaagtttgtatgttttgttgtgttagatggatgttatacaagtggaggagaaagggttttatgtgagattggtgtgtaacaaaggagaaggtgttgctccatctctttacaagtctttggagtctcttacaagtttccaagtgcagaactctaacctaagctctccttctccggacacatacctcttaacatataccttagatgtaaatcaacttgtgcccttttactttgttttgtttccgagtataccgtttacttaccgagttttcttgtgtggtggaaacaggggacatgcttcgaacagagcttaaacttgcctaacctgaagctgtggatcactggatcacttttaaatcaaggttttgaattcatcaagtcatttacttgattctataacgcttgctctaacgtgagtcaaatccggttctgcactatattgattgtgtacctttcttacatgtttcataacttccagggctctaatttctattctagt

SEQ ID NO: 4339 - DNA, 2197 bp, Artificial Sequence
  P2069 (35S::G2555)
aaagacaacaatcggagaacaatctggtctgctgctaaaatttaataaattgttttgtctaattgtctccacccataaaaaagcgcgaattcaattcaccgactaaagacattctccggtggagaccccgatgcaatccactcatataagcggcggaagtagcggtggtggtggtggaggaggaggagaggtgagtcgaagtggattatctcggatccgttcagctccagctacttggattgaaaccctactcgaagaagatgaagaagaaggtttaaaacctaacctttgtttaacagagctgcttactggtaataataactctggaggagtgataacgagtcgtgacgactcgttcgagttcctgagttctgttgagcaaggattgtataatcatcatcaaggtggtggctttcaccgtcagaatagttctccggctgattttcttagtgggtctggttctgggactgatgggtatttctctaattttggtattccggcgaattatgactatttgtcgaccaacgttgatatttctccgactaaacggtctagagatatggaaacacagttttcttctcagctggtaagactctgtttccattaaattcagataaaaatgcgaactttaatggaaagataaacttttttttgttgcttactttaatgtcaagttgtgtgaatttgtggtcaaaatggtgaggttaggttctattttggggattgatacggttttagtttaattgggtgtttgaattcttcagttgtggagacaataaagatgtaaaagagttgtcttgtctaatttgacaacttgcatttgtttgaaacaaattcccctgcaagttgcagttgttttttctttgtttccctgtggctgtgaaagtgaatgttgcataaagtttgtattagtagatgggcaaacaaaaagagccttcattggttagatatgtatcgatcttgtaactttagaagtttctgaatcatgacttttgtgaaatgaaacatgttttcatgtgtgcatatggtttgtgagttaactaataactcttcccttttggtttgtgagtagaaagaagagcaaatgagtggtgggatatcaggaatgatggatatgaacatggacaagatttttgaggattcagttccttgtagggttcgtgctaaacgtggttgtgctactcatcctcgtagcattgctgaacgggtaattacttaaaagtttgtgctagatgctttgcagtactaattctgtttctgcctcattcttgttttgtcattaagcttttctctgttcattttgttaggtgagaagaacgcgaataagtgatcggattaggaggctgcaagagcttgttcctaacatggataaggtaaattctttttacaaggcagattggttttaagttttctttgaagtttttaaaaagaattaccaaatgggtccaagattagatatgcttaaagcttaaggttagagcattattgtgaaggcattattggttcttaaggtaggagctagtgcttagccgtaaagtaaaggaatttggatgttaactgttgatgattgtgaaggcattattggaacttcaaaactacttactccttaatccataaactatggttgtgcagtcttttagaagattcaatgcatgatagtccgggagagttataacgcgaagattcgtttttttttgtattttctttgttgcagcaaaccaacactgcagacatgttggaagaagctgtggagtatgtgaaggctcttcaaagccagatccaggtttatctacagatactaattgattagaaacacaaatttatgtttaataaaatatgttaggattttggatttttttgatcattttatttggttttgatgatggattcaggaattgacagagcagcagaagagatgcaaatgcaaacctaaagaagaacaataatgtatcctttaggatttgatatatctgtattttatttttgtactatctaaaaatggtgatgatctgttcgaaaattcgaaacatgatcttatatattgaactagaaaaaatagatatatatgaattttagctgtaaaatttttgtacaataaggagaaaaagatttagaagagtcaataaaaagatgatgtttacaagtcgagaatatatattttgttagttttgtttatcaatttatgctcaaggtttca

SEQ ID NO: 4340 - DNA, 1728 bp, Artificial Sequence
  P2071 (35S::G720)
agcggcggtgttggccgcaaaaacgatgcaaaaccagctatggtcattaccgctaacgatttatcaaaatgggaaaattttcctaaaggacttaaggttcttcttctcctcaacggctgtgacagcgacggagatggctcctcagccgccgagactcgatcagagctcgaatcaatggactatatcgttactacattcaccgatgaaactgaagcactctctgcggttgtcaagaacccggagagcttccacattgccatcgtcgaggtgaatatgagcgctgagagtgagagtttcaagtttcttgaggctgccaaagacgttcttcctactataatgatttcaaccgatcattgcatcactactacaatgaaatgcatagcgcttggtgcagttgagttcctacaaaaaccgctctcaccggagaaattaaagaacatttggcagcatgttgttcataaggcattcaatgatggtggaagtaatgtttcgatatcacttaagccagtgaaagaatccgttgtctcgatgcttcatcttgagaccgacatgacaatcgaggagaaagatccagcgccatcaacaccgcaattgaaacaagattcacggttactagacggtgattgccaagagaacataaatttctcgatggaaaatgtaaattcctcgaccgagaaagataacatggaagatcatcaagacatcggtgaatctaaatcagtcgacactacaaaccgcaaattagatgacgacaaagtggttgtcaaagaagagagaggagacagtgaaaaagaagaagaaggtgaaaccggagatctcataagcgagaagacagattcagttgatattcataagaaagaagatgagactaaaccgattaataaatcatccgggatcaagaacgtgtctggtaacaaaactagtcgaaagaaggtggattggacaccagagctgcacaagaagtttgtgcaagcagttgagcaactcggcgttgatcaagcgataccctcgcggattcttgagttgatgaaagtaggcaccttaacaagacacaatgtagctagtcaccttcagaaatttcggcagcataggaagaatattcttccaaaggatgatcataaccatagatggatacaatctagagagaaccatagaccaaatcaacgtaattataacgtttttcaacagcaacaccgtcccgtgatggcttatcccgtttggggtcttcccggtgtttatccgccaggagcgattccacctttgtggccaccgccgctgcagtccattggtcaaccacctccgtggcattggaaaccaccttatccaacggtgagcggtaatgcatggggttgtccggttggaccgcctgtgaccggatcatatattactccttcgaatactaccgccggcggatttcaatatcccaacggagctgaaaccggcttcaaaataatgccggcgagtcagccggacgaggaaatgttagatcaagtggttaaagaagcgataagcaaaccgtggctgccgctaccgctcgggctaaaaccgccgtccgcggagagcgttttggctgagctaacgcgtcaaggcatctcagccgtcccttcttcttcttgtctaatcaacggctctcatcgtctccgctgacgtgtccatgatgaaacagaacccgcagatatgatgacgtcatgcgtggcgtacttgtccgtgtctgacgatccgaagcgg

SEQ ID NO: 4341 - DNA, 618 bp, Artificial Sequence
  P2074 (35S::G2063)
tttttataaccaataaactcataattgtttttttctccaaaatgaatcccaagaaaaccaaaggaaaacaaaagattaacatcaagaaaattgaaaaagatgaaggcagatcggtcacattctctaagcgtctaaatggtatctacactaaaatcagtgagctttctattctctgtggtgttgaagttgcgtttatcgggtattcttgctctggaaaaccatacacttttggcagtccatccttccaagccgtggcggagcggtttctcaacggcgatgcctcgtcgtcttcttcatcatcattggtcatgaatgctcacaagcaagcgaagattcaagagctttgcaaaaaatacaatagattggtggaggagttaaaggtggacgaagtcaaagtcaagaaggcagctgcattggcggagacgagggtcgtgaataaggatgtgtggtggaaagtggatccaaatgacgtgaaggatcacgaaaaggcgaagaagatgatggagaagtatcaagagctctatgataaactgtgtgagcaagctgcttcaaggatcaagagaggacatgatgagaataataacaaatgattcataatcaagattttaattagtagat

SEQ ID NO: 4342 - DNA, 1172 bp, Artificial Sequence
  P2076 (35S::G2436)
tacaatctctccttttgccaacaatcattgcttaaaaaacacataccttcttctttagttataaaaatgttgaaagaagagagtaatgagagtggtacttgggcacgagcatgtgacacttgtcgttcagccgcctgcactgtctactgtgaagccgactctgcctacttgtgcaccacctgtgatgctcgagttcacgcagccaaccgtgttgcttctcgccatgaacgtgttcgtgtctgtcagtcatgtgagtctgccccagctgcgtttttgtgtaaagcagacgctgcgtctctttgtacagcttgtgatgcagagattcattccgcaaacccactagctagacgtcatcagcgagttccgattcttccattatctgcaaactcttgcagctccatggccccaagtgagactgatgctgataacgatgaggatgatcgagaggttgcttcgtggttactccctaatccagggaaaaacatcggtaatcagaataatgggttcttgtttggtgttgagtaccttgatcttgtggattacagctccagcatggacaaccaattcgaagataatcagtacactcactaccagaggagctttggaggagatggagttgtgccgcttcaagttgaagaatcaacaagtcacctgcaacaaagccaacaaaactttcagttgggtatcaactatggattctcctcaggagctcactacaacaacaactccttaaaggacctaaaccatagcgcatccgtttcatcaatggacatcagtgttgtgccagagtcaactgcaagtgacataacagtccaacacccaagaactactaaagagacgatagaccaactatctggtcctcctactcaggtggtgcaacagcttactccaatggagagggaggctagggtcctgagatacagagagaagaagaagacaaggaaatttgacaagacaataagatatgcttcaagaaaggcatatgcagagataagaccacggatcaagggcagattcgcaaagaggatagaaactgaagctgaggctgaagaaatcttctcaacatcgctaatgtctgagactggatatggaattgtcccttccttctaaactcctatggcgaagatagactagattgcatgctgtaaattacttctagtttggatttctac

SEQ ID NO: 4343 - DNA, 1053 bp, Artificial Sequence
  P2085 (35S::G1945)
ctttatacaccataccatttcccaaagggatttacgaaaagtccctctcctctatcatctctttattcaccccataccaacaacctctacatcttcttcttcttcttcctcctcttttattttctttttaaatcatttacacaaaaatccaaagacaaatctgaaatctctaataaacaaatccataaaataagaaaaacaaagatgaaaggtgaatacagagagcaaaagagtaacgaaatgttttccaagcttcctcatcatcaacaacaacagcaacaacaacaacaacaacactctcttacctctcacttccacctctcctccaccgtaacccccaccgtcgatgactcctccatcgaagtggtccgacgtccacgtggcagaccaccaggttccaaaaacaaacctaaaccacccgtcttcgtcacacgtgacaccgaccctcctatgagtccttacatcctcgaagttccttcaggaaacgacgtcgtcgaagccatcaaccgtttctgccgccgtaaatccatcggagtctgcgtccttagtggctctggctctgtagctaacgtcactttacgtcagccatcaccggcagctcttggctctaccataactttccatggaaagtttgatctcctctccgtctccgcaacgtttctccctcctccgcctcgtacttccttgtctcctcccgtttctaacttcttcaccgtctctctcgctggacctcaaggacaaatcatcggagggttcgtcgctggtccacttatttcggcaggaacagtttacgtcatcgccgcaagtttcaacaacccttcttatcaccggttaccggcggaagaagagcaaaaacactcggcggggacaggggaaagagagggacaatctccgccggtctctggtggcggtgaagagtcaggacagatggcgggaagtggaggagagtcgtgtggggtatcaatgtacagttgccacatgggtggctctgatgttatttgggcccctacagccagagctccaccgccatactaaccaatccttctttcacaa

SEQ ID NO: 4344 - DNA, 1126 bp, Artificial Sequence
  P2093 (35S::G2690)
gtccttttcttgatttttgtatttttttgttatggatatggacgagatgagcaatgtagccaagacaacgacagagacttcaggcttaactgactctgtcttgagcctcacgaaacgcatgaaacctactgaggttacgaccaccacaaaacctgccttgtccaacacgacgaaattcaaaggagttgttcagcaacagaacggtcattggggtgctcagatttacgcagaccatcgaaggatttggcttggaactttcaaatccgctcatgaagccgctgctgcttacgatagcgcatcgattaagcttcgaagctttgatgctaactcgcaccggaacttcccttggtctgattttaccctccatgaaccggactttcaagagtgctacacgacagaagctgtgttgaacatgatcagagacggttcttatcaacacaagttcagagattttctcagaatccggtctcagattgttgcgaatatcaacatcgtgggatcaaaacaagtcttaggaggaggagaaggtggtcaagaatcgaacaagtgtttctcgtgcacgcagctttttcagaaagaactgacaccgagcgatgtagggaaactgaataggcttgtgatacctaagaagtatgcagtgaagtatatgcctttcataagcgatgatcaaagcgagaaagagacgagtgaaggagtagaagatgtggaggttgtcttttacgacagagcaatgagacaatggaagtttaggtattgttactggagaagtagccagagctttgtcttcaccagaggatggaatggtttcgtgaaggagaagaatctcaaggagaaagatattattgtcttttacacttgcgatgtccccaacaatgtgaagacattagaaggccaaagcaagaccttcttgatgattgatgttcatcacttttcaggcaacggtttcgtggttcccgaggaagtaaacaagacggttcatgagatttctgatgaagagatgaaaacagaaaccctctttacctcgaaggtagaagaagaaaccaaatcagaggagaagaaaggagggtttatgctgtttggtgttaggatccaatagctagctacttggttcttaggttttttatat

SEQ ID NO: 4345 - DNA, 979 bp, Artificial Sequence
  P2095 (35S::G2686)
cagaatctaaaccagaaaatgttttcaaacatcgatcacaaggctgtggcagcactccttcatggccagggatgcgctaacatcctcaagacggtcctcgacaactgtaaagttagctctgtttcaacagaacctctcattaacaccattcttgattccttttcactagctctatcttctgtgaattctcctaatcgtcaaccacaccatgagtcttcttctcgagacatggcaggtcttgtgcctcaaagatcatcaaagaagtaagttaccatttaccaacaaaaagctaaacactcggtgcgtatgttataaacaaagttcatgagtttatactacaacatcgcaggaagatttgcggagtaaaaggtttagagatttacagagatgattcccccaatccccgccttgatgacggcttcacctggaggaaatatggacaaaaaaccatcaaaacctctttgtaccaaaggttagtcaattaggtagactacaaaaacagagcaaatggcatgtacataaaaaaacagagtcaatgctcttctctgttctatggaaagacatgtaattacaagtgtgataatttacaggtgttactatcgttgtgcctatgcaaaagaccaaaactgctatgctacaaagcgggtgcagatgatccaagacagtcctccagtttacagaaccacttatttgggacaacatacatgtaaagcctttggggtgcatgataatacgtatggctctgaaatgataaacttcgaccaagttgtatctgaatcggttatgcgtcaacttgcaacaattggtgaacaagctgttctcatggaggacgaagctaaccatatcatgaaccaagaatatgatattaatgattatttggtggatgatgaagtcttttgggggaatgaatttcctctattttcatcggaagacctgatgttgttttgaaaacgttgatgcttttgattagaaacctttc

SEQ ID NO: 4346 - DNA, 1114 bp, Artificial Sequence
  P2096 (35S::G2587)
tacctcaaactcaaacacaagaaatggtttccaacattgatcacaaggctatggaagcactcctccgtggccaaggatgcgctaacaacctcaagattctccttgaaaacggcgaaataagctcagtttcaacagaaccactcatccacaccattctcgattctttctcacttgctctgtcttttatggattctcctaatcatccaccataccatgaatcctcttctcataacatggcaagtcatatgtcccggagatcatctaagcagtaagttaccaacaaaattctaaactcaaattgtatatgtcgtatgcaaattttcataagttcaaaatcaagtgaagtcgcacatgtttttttttttatgttactttatcatatcttctataaccttcgattcaagtgtctcctatattcttgataattcctagagtacaacatcgcagaaaactttgtgtagcagaaggtttagtgaattacaatcacgattcccggactatgtgccccaatgatggcttcacctggaggaaatatggacaaaaaaccattaaagcctcagcgcacaaaaggttagtcaattaggtaaattagaaaaacagagccaatgctctgttttatgaaagacatgtaaatagagtaccggctatttatttattttaagcagcgatagatataaaagtgctatatttacaggtgttactatcggtgtacctatgcaaaagaccaaaactgcaatgctacaaagcgggtgcagaagatcaaagacaaccctccagtgtacagaaccacttacttgggaaaacatgtgtgtaaagcttttgcagttcatgatgatacatatagttccacgatgattcgattcgaccaagttgttcctgaaccgattatgccgcagctcacaacaattgaccaccaagtaattaccgtggaggaaaactccgcagaacatatcatgaaccaagaatgtgatattaatgattatttggtggatgatgacccattttgggctagtcaatttcccccgtttccatcgagtgacacaatgttcttggaaaacatttctgcttttgattagaaccttatccaggttttgaacaacaaatctatcaagct

SEQ ID NO: 4347 - DNA, 908 bp, Artificial Sequence
  P2102 (35S::G134)
ggcacgaggagagagaaagagatagagagagaaagatgggtagaggaaagatcgagataaagaggatagagaacgcaaacaacagagtggtgacgttctcaaagaggaggaatggattggtgaagaaggctaaagagatcacagttctttgtgatgcaaaagttgccctcataatctttgcaagtaatggtaagatgattgattactgttgtccttccatggatcttggtgctatgttggaccaataccagaagttatctggcaagaaactatgggatgctaagcatgagaaccttagcaatgagattgataggatcaagaaagagaatgatagcttacaactggagctcaggcatttgaagggagaagatatacagtctctcaacttgaaaaatctgatggctgtcgagcacgccattgaacatggcctcgacaaagtccgagaccaccagatggagatccttatatcaaagaggagaaatgagaagatgatggcggaggagcaacggcaactcactttccagctgcaacaacaggagatggctatagcaagcaacgcaagaggaatgatgatgagagatcatgatgggcagtttggatatagagtgcaaccgattcagccaaatcttcaggaaaagattatgtctttggtcatcgattgatcatcgagattttataatctcatcctgatcaactcctatctataatatcgtggtctttagtttgtctttatcaatctgtgtgtcttaatctcgagcaacatatatactcgctatcagactttttacttaagctatatgtgtgttgtttgcttatgacctctatgtattggttgtgttgtgtgcttaaacgtttcgaactaattgatctgtgtgaaacttattattctgtgataagctatttgtgat

SEQ ID NO: 4348 - DNA, 825 bp, Artificial Sequence
  P2103 (35S::G135)
cttcatataatttagttattttaagagaaatgggaaggggtagggttgaattgaagaggatagagaacaagatcaatagacaagtgacattctcgaaaagaagaactggtcttttgaagaaagctcaggagatctctgttctttgtgatgccgaggtttcccttattgtcttctcccataagggcaaattgttcgagtactcctctgaatcttgcatggagaaggtactagaacgctacgagaggtattcttacgccgagagacagctgattgcacctgactctcacgttaatgcacagacgaactggtcaatggagtatagcaggcttaaggccaagattgagcttttggagagaaaccaaaggcattatctgggagaagagttggaaccaatgagcctcaaggatctccaaaatctggagcagcagcttgagactgctcttaagcacattcgctccagaaaaaatcaactcatgaatgagtccctcaaccacctccaaagaaaggagaaggagatacaggaggaaaacagcatgcttaccaaacagataaaggagagggaaaacatcctaaggacaaaacaaacccaatgtgagcagctgaaccgcagcgtcgacgatgtaccacagccacaaccatttcaacacccccatctttacatgatcgctcatcagacttctcctttcctaaatatgggtggtttgtaccaagaagaagaccaaacggcgatgaggaggaacaatctggatctgactcttgaacccatttacaattaccttggctgttacgccgcttgaatagactacatcgatctatatcaatctc

SEQ ID NO: 4349 - DNA, 895 bp, Artificial Sequence
  P2104 (35S::G136)
ggatcaatggaggaaggtgggagtagtcacgacgcagagagtagcaagaaactagggagagggaaaatagagataaagaggatagagaacacaacaaatcgtcaagttactttctgcaaacgacgcaatggtcttctcaagaaagcttatgaactctctgtcttgtgtgatgccgaagttgccctcgtcatcttctccactcgtggccgtctctatgagtacgccaacaacagtgtgaggggtacaattgaaaggtacaagaaagcttgttccgatgccgtcaaccctccttccgtcaccgaagctaatactcagtactatcagcaagaagcctctaagcttcggaggcagattcgagatattcagaattcaaataggcatattgttggggaatcacttggttccttgaacttcaaggaactcaaaaacctagaaggacgtcttgaaaaaggaatcagccgtgtccgctccaaaaagaatgagctgttagtggcagagatagagtatatgcagaagagggaaatggagttgcaacacaataacatgtacctgcgagcaaagatagccgaaggcgccagattgaatccggaccagcaggaatcgagtgtgatacaagggacgacagtttacgaatccggtgtatcttctcatgaccagtcgcagcattataatcggaactatattccggtgaaccttcttgaaccgaatcagcaattctccggccaagaccaacctcctcttcaacttgtgtaactcaaaacatgataacttgtttcttctcctcataacgattaagagagagacgagagagttcattttatatttataacgcgactgtgtattcatagtttaggttctaataatgataataacaaaactgttgtttctttgcttc

SEQ ID NO: 4350 - DNA, 948 bp, Artificial Sequence
  P2105 (35S::G137)
aaagtggaaattaaggtaacaaaaagaaatgggaagaggaagagtagagctgaagaggatagagaacaaaatcaacagacaagtaacgtttgcaaagcgtaggaacggtttgttgaagaaagcttatgaattgtctgttctctgtgatgctgaagttgctctcatcatcttctccaaccgtggaaagctctatgagttttgcagctcctcaaacatgctcaagacacttgatcggtaccagaaatgcagctatggatccattgaagtcaacaacaaacctgccaaagaacttgagaacagctacagagaatatctgaagcttaagggtagatatgagaaccttcaacgtcaacagagaaatcttcttggggaggatttaggacctttgaattcaaaggagttagagcagcttgagcgtcaactggacggctctctcaagcaagttcggtccatcaagacacagtacatgcttgaccagctctcggatcttcaaaataaagagcaaatgttgcttgaaaccaatagagctttggcaatgaagctggatgatatgattggtgtgagaagtcatcatatgggaggaggaggaggatgggaaggtggtgaacagaatgttacctacgcgcatcatcaagctcagtctcagggactataccagcctcttgaatgcaatccaactctgcaaatggggtatgataatccggtatgctcagagcaaataactgcgacaacccaagctcaggcgcagcagggaaacggttacatcccggggtggatgctctgagagtcatgtgctgtgttaaagctcaccaacaaaagatcttttatatatataaaagtatagacacaagactttggatttgtagacataagtggctatatataatggtcctgaggatcttcaagacatttgtatcttttgggaatccttgcttatattaagaattc

SEQ ID NO: 4351 - DNA, 1034 bp, Artificial Sequence
  P2106 (35S::G138)
agagttttcagttgggttttggtttcttggtgagagaagagagaaaaagagaggatgggaagagggaaagttgagctgaagaggatagagaacaagatcaatagacaagttacttttgcaaagagaagaaatggtttgctcaagaaggcttatgagctttctgtcctttgtgatgctgagattgctcttctcattttctctaaccgtggcaagctctacgaattctgcagcagccctagtggtatggcgaggacggttgataagtatagaaaacatagttatgcaacaatggatccaaatcaatcagctaaagacttgcaggataagtatcaagactacttgaagcttaaatcaagagttgagatccttcaacattcacaaaggcatttgctaggtgaagagctatccgagatggatgtgaatgagcttgagcatctcgaacgccaagtagatgcatcactaagacaaataagatctaccaaggctcggtctatgcttgatcaactatctgacctcaaaactaaggaggaaatgttattggaaaccaatagagatcttaggagaaagttggaggacagtgatgcagcacttactcaatcgttttggggaagttctgctgcagaacaacaacaacaacatcaacaacagcaacaaggcatgagctcttatcaatcaaaccctccaattcaggaagcaggtttcttcaagcctctacaaggcaatgtagcattgcaaatgagtcattacaatcacaatcctgcaaatgcaaccaactctgcaacaacatcacagaatgttaatggattcttccctggatggatggtctgaaaacaatacatatctatatatgtacacatatgtgtgttttatagatcaaagatcattgcttgtgtcatttgatttttgccagagaaacatagttcattattacaaaactttgttatataatcaaggctctaatgtcaaacaccagattattacttttttgttctttgttttttggctctcttgaaatataaaatattgttttggga

SEQ ID NO: 4352 - DNA, 2170 bp, Artificial Sequence
  P2109 (35S::G142)
atttatcgtgtacgatactttattccttttatctattcttgaaaaaaagttaccaattcttgagaagaagaagaaatcagaatcaagagaaggagagagaaagatgggaagagggagagtggagatgaagaggatagagaacaagattaatagacaagtgaccttctcaaaaagaagaaacggtttgctgaagaaagcttatgagctttctgttctttgcgatgccgaagttgctctcatcatcttctcaagccgtggcaagctctacgagtttggtagtgttgggtatatatatctttgctcctttgaaccaacttttgtgctatatatattaagattcatccaataaagctatgttttttatatgaaaattgattaataaatgggttcatttgctacttgttacatcgtacgattcaagagtcggatcatgttttgatcttgtggttattcttaatggttgtatcgtttatcctgtggtaattagggttcatcgttatatcgtgtctccctcttggatcctttatcataagctaataggtccttccgtacgttataatttgttgatttcccattcatgaattcctttgattctttaatcttacagatgacaggtttcaaatgggtttaattctagctttaaaaaaaaaaaaaacaaacaaactagggttttcccttttagatcagtgtgtaagatatataacttgagttcttgtcgtaagaagaatctttatttgttgaatcgagctaatgatctcccatttttgttttaattgaatttgtagaattgaaagcacaatcgaacggtataatcgttgttacaactgctctctaagcaataataagcctgaagagactacacaggcaagtgtgtgtacgtactttgaatatatttacaattattgtttctgatgataatgattctagctaactctattttctcaaattctcatgttactatatatatgcatttcatataatctatatggtgcagagttggtgtcaggaggtgacaaagcttaaatccaaatacgaatctcttgttcgtactaacaggtctagtaattaagagttttctataaccccttgaaattaaatcgttattgtcatcttccattatatatgtatagttacaaatctattgttatgggtgttgataattgctaattataaaaggaatttgcttggagaagatcttggagaaatgggtgtgaaggaactgcaagcgctcgagaggcagctcgaagccgctcttaccgcgactcgacagcgcaaggtcacatgatctagactggtcttgtttcattaaaaatatattcataactaaaacattcaactaaaatatgcagacacaagttatgatggaagaaatggaagaccttaggaaaaaggcaagttatataaaaatgtttcataccaaactgcaaaacatatatgcatatcaatcaatctatgtttgaaatggcaggagaggcaactaggagacataaacaaacaactcaagattaaggtttttatttctagacatcgcaaaattatattataacttctcatataattaattatgacatttggatcttaactaaacataaattttcaatagtttgaaacggaaggccatgctttcaaaacctttcaagacttatgggcaaactcggcggcatcggtggccggggatccaaacaattctgaatttccggtagagccttctcatcctaatgtattggattgcaacaccgaaccctttttacaaatagggtaagaatataccatttttcccggcccttacaaataaatggatagaaataagatatgattataagacttgtttggtatttggattaggtttcaacaacattactacgtgcaaggtgaagggtcttcggtatcaaagagtaacgtggcaggtgagactaatttcgtccaaggttgggttctttgactctctgttgattagaccacgatgccacggtcaggccaatttcagctctctacagttgttcttttttcaaattagatttctgggtttttttttcctataagaaaaacttttgcactagatgtttgtcatttaatttccagctcgtgtgaatctatattcgcatgtatgtgctttgaagaatttctcctcttactcctacttgatctaaaacattatttttcttttggg

SEQ ID NO: 4353 - DNA, 905 bp, Artificial Sequence
  P2111 (35S::G146)
acgagagcaaattctcaggatgggaagaggaaagatagaaataaagaggatagagaactcaacaaatcgacaagtgacgttttgcaaaagaagaaatggacttctgaagaaagcctatgagctttcggtcctttgcgatgcagaagttgcgctcattgttttctccactcgtggccgtctctatgaatacgccaataacaacataagatcaaccattgagaggtacaagaaagcttgttctgatagcaccaacactagcactgtccaagaaatcaatgccgcgtactatcaacaagaatctgctaagctgagacaacagatccaaacgattcaaaactccaacaggaatctgatgggagactctttgagttccttaagtgtcaaggaactaaaacaagttgagaatcgccttgagaaagctatctctaggatcaggtccaagaagcatgagttgcttttagttgaaatcgaaaacgcgcagaaaagggagattgagcttgacaatgagaacatctatctaagaactaaggtagcagaagtggagaggtatcaacaacaccatcatcaaatggttagtggttcagagattaatgcaattgaagctttagcctcacgcaattactttgctcatagcattatgactgctggttctggatctggtaatggaggttcttactctgatcccgacaagaaaattcttcatctcggataatctcgtctgcgaaaaaccgagctgcaataactctctgcatgcatctggggattctttgctcagatttatctctacataaaatatgttttggtgcaaaataattcaaagtacaatgaaggtattggtccttcaagactcattgcaatttgtgttgtgtaatgattaagacatactctagtttttattgcttcgt

SEQ ID NO: 4354 - DNA, 861 bp, Artificial Sequence
  P2113 (35S::G151)
ttctctctgttcaattttgggggaaaatgggtcgtggaaaaatcgagataaagaggatcgagaatgcgaatagcagacaagtcactttttccaagaggcgttctgggttacttaagaaagctcgtgagctctctgttctttgtgatgctgaagttgctgtcatcgtcttctctaagtctggcaagctcttcgagtactccagtactggaatgaagcaaacactttccagatacggtaatcaccagagttcttcagcttctaaagcagaggaggattgtgcagaggtggatattttaaaggatcaactttcaaagcttcaagagaaacatttacaactgcagggcaagggcttgaatcctctgacctttaaagagctgcaaagccttgagcagcaactatatcatgcattgattactgtcagagagcgaaaggaacgattgctgactaaccaacttgaagaatcacgcctcaaggaacaacgagcagagttggaaaacgagaccttgcgtagacaggttcaagaactgaggagctttctcccgtcgttcacccactatgttccatcctacatcaaatgctttgctatagatccaaagaacgctctcataaaccacgacagtaaatgcagcctccagaacaccgattcagacacaactttgcaattagggttgccgggagaggcacatgatagaaggacgaatgaaggagaaagagagagcccgtcaagcgattcagtgacaacaaacacgagcagcgaaactgcagaaagaggggatcagtctagtttagcaaattctccacctgaagccaaaagacaaaggttctctgtttagtcctagaaaagtatgggagaaggctact

SEQ ID NO: 4355 - DNA, 372 bp, Artificial Sequence
  P2116 (35S::G173)
agaagaaaccaaacttgtctatgagagaagatacaatgtttaagaaagccctcgagctttcaactctgtgcgatatcgaagtctgtgtcatactttatagtcgtgacggagaactcatcaagacatggccggaggatcaatccaaggttcgagacatggcagagaggtttagcaaactacacgagagagagcgacgcaagaaaagaaccaacctttctctgtttctacgtaagaagatcctcgacaacagtaagctctcggagaaagtcttagagatgaaggattcattagaaagtggtctacgggtactacaagataagcttctgttactacaacccgagaaaaaccagaccgagttaggtcagatccccg

SEQ ID NO: 4356 - DNA, 997 bp, Artificial Sequence
  P2117 (35S::G1384)
atttcaggaaactccgatggcggatctcttcggtggtggccacggcggcgagcttatggaagcacttcaacctttttacaaaagtgcttccacgtctgcttcaaatcctgcgtttgcgtcctcaaacgatgcgtttgcgtctgccccaaacgacctattttcttcttcttcttactataatcctcatgcatctttattcccttcacattccacaacctcttacccggatatttattctggatccatgacctatccatcttcattcgggtcggatcttcaacaacccgaaaactaccaatctcagttccattaccaaaacactatcacttacactcaccaagacaacaacacttgcatgcttaacttcattgagccgagccaaccgggttttatgacccaaccgggtccgagttcgggttcggtttcaaaaccggctaagctctatagaggagtgaggcaaagacattggggaaaatgggtcgcggagatccgtttacccaggaaccgaacccgactttggctcggaacattcgacacggctgaagaagccgcgttggcttatgatcgcgccgcgtttaagcttcgtggtgactcggctcggcttaacttcccagctctccgataccaaaccggctcgtctccgtctgataccggcgaatatggtcctattcaagctgccgtagacgctaaactagaagccatattagctgagccgaagaatcagccgggcaaaacggagaggacgtcgaggaaacgagctaaagccgcggcttcttcagctgagcagccgtcagcgccacaacaacattccgggtcgggtgaaagtgatgggtcgggttcaccgacttcggatgttatggtgcaggagatgtgccaagagccagagatgccatggaatgaaaatttcatgctcggcaagtgtccttcttatgagatagattgggcttcaattttatcgtgaaaaattaggattcaattcatttttattcattttaac

SEQ ID NO: 4357 - DNA, 1080 bp, Artificial Sequence
  P2118 (35S::G1846)
tctgtttgacattttgtcgaacacttggacggcatcacaaaaagctctaaactttctgactaccaatggcggattcgtcttccgacaaggagaagaaggaaaataataagcagcccgtgtatcgtggagtccgtatgaggagctggggaaaatgggtatcggagattcgcgaaccgaggaagaaatcgagaatctggctcgggacttttccgacggcggagatggctatgcgtgctcacgacgtggcggctatgagtatcaaaggaacttcagccattctcaatttccctgagctctctaaacttcttccccgacccgtttcgctcagccctcgtgacgtcagagctgcggcgaccaaagctgctctcatggacttcgatacgacggcgtttcgttcggatactgagactagcgaaacgacgacgtcgaataaaatgtcagagagtagtgagagtaacgaaacggtgtcgttctcatcgtcgtcttggtcctctgttacgagcattgaggaaagtacagtctccgacgatcttgacgagatcgtaaagttaccgagtctaggaacgagcctaaacgagtcgaacgagttcgtgatatttgactcgttggaggatttggtgtacatgcctcggtggttaagcggtacggaagaagaagtttttacgtataataacaatgattcttcgttgaattactcatcagttttcgaatcttggaaacattttccctgagaaaagaaagaagccatattttctctctctttttcgccatttttggttttaagttttttgatgggattctctctgtttttgctatgcgtgagatatctctctttgtggaatagataacttttctgttgaaaatctcctaagtctgtgaaatgaacgacgatggaaatgtaagtgtgtatattagcccgaaataatgactgtatacattcttttttgcaagatcattagaaaaaaataaataggaaatgtggtttgtattagagtatagaattgattaagatcggtttagatcatcaatatcggtttaatgtctgtgaaccagaaccctctcattgtataagaggcttca

SEQ ID NO: 4358 - DNA, 1315 bp, Artificial Sequence
  P2176 (35S::G2382)
ccctccaagatattcctctattaggtgcaaaaatcaggtaaatctctatctgtccgatttgaaaccctagatctgcctttcttctctcttcttttgcttttctgggttttgctcaaagatgggtgacagcgaagatgaaacaggatacccaaaaaagttttactctttgaatcggcaaaaccatccaatgtatagtagaccaatacctaagcgtcacgcgtattacaatgaagaagaagacgaagatgaagtcgaaggagaagaggaagatccacaaggaggatacattcgtggaaatgagaggtttcagaagagacagaaaccaaacaaagtagtttctgggtttgaatttgctggtcctagtgatgctaaagttgcgtatgattggagagagcaagaagcttttgtgttgcttgaagtttggggagataggtttttgcaattgggtagaaggagtttgaggaacgaggattggaatgaagtagctgagaaagtgagtgaggagctaaggatggagaaatctgagacgcaatgtaggagaatgattgatgacttgaagaggaagtatagaaaagagaagattaaggttgagaaatcaggtttaggttcaagtaaatggtcgtttttcaataagttggatatgttgctttgtgtttcgcccaagtcggatttaggtttagcttgtggtgttgattcaggtgagtttgtgtttatgaacactaaggtttatttagataagtctaatgggtttgatgagatgatggatagtcctggtgattctgaagaggaggaggatgaggatgatgaggttgagtacgagaggaagaaggttaatgacgctgcttcgtataagatgttggcggattctgttgagaggtttgggaaggtttatgagaagatggagaagagtaagaaagagcaaatgaaggagttggagaagatgagagctgattttcagagagatttggagttgcagaagaagcagattgttgatagagctcagagtgagattgctaggttacgtgaagaggaggagaatcatcatggtggtggtgatgatgatgagagtgaagatgaagaaatggagaatgattctgatgttaatctcagtgatgagtaagttataaactatgtaggtttgtgttgtttgtagatgcaacaaaatatgttctgtttttttttttggttttagggaattcagaacttaagtcttataagttttgtaatttgtgtttggtctttgcaactttagtcgaggttatttgcagtttatcttgaaacttaaattaatgcataaacatatttccttcttaaa

SEQ ID NO: 4359 - DNA, 891 bp, Artificial Sequence
  P2360 (35S::G1995)
cgcccagtctttttatctctctgactctctctctatggacgaggctaccggagaaacagaaactcaagatttcatgaacgtcgaatccttctctcagcttcctttcattcgccgtcctaaagataagaaccctaaacccattcgtgtcttcggaaaagatttcaccggcagagatttctctattactaccggtcaagaagactacaccgatccttaccagaccaaaaacaaagaagaagaagaggaagaagaccaaaccggagacaacagtacggacaataatagcatcagccacaacaggagattcgagtgtcactattgctttagaaattttcctacttcacaagccctaggtggacaccaaaacgctcacaaacacgaacgtcagcttgccaaacgcggtgtttcctcttacttttatcatcctgacaataacccttacagttaccgtcattacccgtcgtggaccaatggtccgttaaccgcggctaggtcctatggaggattttcttctggtcctaagccgtcggggtattatacacgacccagctatgggagtcagttaggactatggcgtctaccgcctcgcgttcaaggcgtttataactcaaacgcagcgtttactagtaatggctcttcttcttcttctaattcgactttaccgttgttgacccgttctcaaactcaactatcatcgcaagtgggtggctccgctgctcagaacagaatgtcatcgtacggttacggattgagccctaacgtgcaagatcatgtgagtctcgatcttcatctttaaagatttgaaaacaaaataaaactcttattgagtgttatgtaacttagtgcaagaaaaaacaacctaagttattgaatattacgtaatctttaacg

SEQ ID NO: 4360 - DNA, 1314 bp, Artificial Sequence
  P2368 (35S::G2969)
ctccaatggtaaaatctctcattcactaactttctctgcttctctctatctttctctgtgcataccaactctaaagtctctcatcaatggcggctcgaaaactagggtcgttgttacgtcaatactttttctctctatgcttcctcttcctcggttgcttcttcttccctaaagacgcagactataaacaaaagagaagaaagaagaagcttagaagagtttcttcttcttctggttcatctctatcctcttcttggacgtatttaaaacgagttttcttatccacgacaaggatatccaaatcccgtaaccaaacacatcctaacgttactttaacatccgcaagatcatctcaaaactccctcgtcactctcgtccaacccgataccacaaaccaacccgacccggaaacacgtattcatcagcaaaccgaattcgagatctcctcttccgacgagattttcccttgtaactcgtgtggcgagattttcccaaaaatcaatctcctcgagaatcacatcgcgatcaaacacgccgtgtcggagctaatcgccggagaatcaagcacgaacatcgtcaagatcatattcaaatctggttggccggagcaaggtaattacaaatctccggtgatcaatcgaatcttaaaaatccacaacagttcaaagattctcaccagattcgaagagtatcgtgagttcgtgaaagctaaagccgctcggagcaacggcggtggaagacggtgggacgatgaacgttgcgtcgccgacggaaacgaacttttacgattttactgctcgacgtttatgtgtgatttagggcaaaacggtaaatcaaatctctgtggtcatcagtattgtagtatctgtggtatcatcggatctggattctcgccgaagctcgacgggatcgcgacgttggcgacggggtggagaggacacgtggcggttccggaggaggttgaagaagagtttgggtttatgaatgtgaaacgggccatgttggtttgtcgggttgtagcgggtcgggtcgggtgtgatttgattgatgatgatgacgtggataagagtgatggtggagggtatgattctctggttgggcagagtgggaacaagagtggggctctgttgaggatcgacgatgatgagcttttggtttttaatccaagggctgtgcttccttgttttgttattgtgtatactgtgtaaccggatttgtgatcctgtgtgtttttgtttatattttgttacaattgtgaagtgtgaaacgctttaggtttgtttggaaaatggaaaaatctttgtggtgagtaaa

SEQ ID NO: 4361 - DNA, 820 bp, Artificial Sequence
  P2373 (35S::G652)
tcgtcggagagattttgatcagaatgagcggaggaggagacgtgaacatgagtggtggagacagacgcaagggaacggtgaagtggtttgatacacagaaggggtttggtttcatcacacctagcgacggtggtgacgatctcttcgttcaccagtcttccatcagatctgaaggatttcgtagcctcgcagctgaggaatctgttgagttcgacgttgaggttgacaactccggccgtcccaaggctattgaagtgtctggacccgacggtgctcccgttcagggtaacagcggtggtggtggttcatctggtggacgcggtggttttggcggcggtggtggaagaggagggggacgtggtggaggaagctacggaggaggttatggtggaagaggaagcggtggccgtggaggaggtggtggtgataattcttgctttaagtgcggtgaaccaggtcacatggcgagagaatgctctcaaggtggtggaggatacagcggaggcgggggtggtggaaggtacgggtctggcggcggcggaggaggaggtggtggtggcttaagctgctacagctgtggagagtctgggcactttgcaagggattgcactagcggtggtgctcgttgaagcaaaccagactgtgaagaaggggtaaatcagtcatcgatccctcttctccgtgacttctatcaaattattatctatcttttgttattcgactctcttcaatgttgttttcggaatttattaattaggacttgtggttgttatggttatggttccttgtgatttgagaaagaaactggattggttttaaa

SEQ ID NO: 4362 - DNA, 1646 bp, Artificial Sequence; identical to SEQ ID NO: 985
  P2377 (35S::G1446)

SEQ ID NO: 4363 - DNA, 966 bp, Artificial Sequence; identical to SEQ ID NO: 297
  misc_feature (915)..(915): n is a, c, g, or t
  P2379 (35S::G359)

SEQ ID NO: 4364 - DNA, 1846 bp, Artificial Sequence
  P2381 (35S::G2633)
ctccgacaactttctctcttcccttctctcttcctctggttcacatggaacttcaataacattcactactttaaggtttctcatctccgaaaaagtcaggtcttaaatcatcctcttcttttgatcctgttggaaaattctttgatttggtggttatgttgcttagataacctaaaaagttattgtgcagatcattgaagtgactagaaatgtacaagcagcctagacaagagcttgaggcttattattttgagcctaactctgttgagaagcttaggtacttaccggttaacaactctcgtaaacggttttgtacgctcgagccatttcctgactctcctccttataatgctctatctactgctacatatgatgatacatgtggctcttgtgtaacggatgagttgaatgacttcaaacacaagattagggaaatcgaaacggtgatgatggggccggactcgttggacttacttgtcgattgcacggactcatttgattccacggcgagtcaagagattaatggttggagatcaactctagaggctatctcgaggcgggatttaagagctgatcttgtttcatgtgccaaagctatgtcggaaaatgatcttatgatggctcattcaatgatggagaagttgcggcagatggtttcggtttctggtgagcctattcaacggttgggagcttacttattggaaggtctagtggcgcagctagcttcgtcgggcagttctatatacaaagcacttaataggtgtcctgaaccggctagcacagagcttctctcttacatgcacattctctatgaggtttgtccttacttcaagtttggatacatgtcagcaaatggtgctattgctgaggcaatgaaggaagaaaacagagttcacattattgatttccaaatcggtcaagggagtcaatgggtcactcttatccaggcttttgcagctaggcctggtgggcctccgcggattcggataacgggtatcgatgatatgacttcagcgtatgctcgtggaggtggcctaagcattgttggaaatagactcgctaagcttgctaagcagttcaacgttccattcgagtttaactcggtatcggtgtcagtttccgaggttaaacctaaaaacctcggggttcgacctggggaagctctagccgtaaactttgcctttgtgcttcatcatatgccagacgaaagcgtgagcaccgagaatcaccgcgaccggttattgagaatggtgaagagcttatctcccaaggtggtgactcttgtggaacaagagtcaaacacaaacacagccgctttcttcccgaggttcatggagacaatgaactactatgccgcgatgtttgagtcaattgatgtgactctaccaagagatcacaaacagaggattaatgtggagcaacattgtctagcaagagatgtcgtgaacatcatcgcatgtgaaggagctgatcgggtggagcgacacgagctcctaggaaaatggaggtcacggtttgggatggcgggtttcactccttacccgttgagtcccttggtgaattcaaccattaaaagtctgcttaggaactactcagacaagtacaggctagaagaaagagatggagctttgtatcttggttggatgcatcgagatttggttgcctcgtgtgcttggaaatgagacagtgacatttctctagtgtgatggcaattaatgtgtttctacttgtatgcaatttagtcgctcatttgaatcttcaaaacatttgaagaatcttatgtttactactagagaccaagagtgtgcacaattgctcaaatgtcaaagtcaactctttcctcaaa

SEQ ID NO: 4365 - DNA, 1456 bp, Artificial Sequence; identical to SEQ ID NO: 1661
  P2384 (35S::G2741)

SEQ ID NO: 4366 - DNA, 958 bp, Artificial Sequence; identical to SEQ ID NO: 1413
  P2386 (35S::G2146)

SEQ ID NO: 4367 - DNA, 1025 bp, Artificial Sequence; identical to SEQ ID NO: 1671
  P2387 (35S::G2763)

SEQ ID NO: 4368 - DNA, 991 bp, Artificial Sequence
  P2388 (35S::G3054)
ttcttcatctactctttctctctctatctctttccacttcctcttgcttttactcctgggttagggtttagggtttcttggtcgacgtgatgagtcatcggcgagattacggcagtgatgcagttcacgtgagaatcacccacgaccctccgcctgagaattgttttccaaattccggcgacagttccgtctgggccactgaggatgattacagccgtgtctgggccataaactctgatggcgcagagtctccgagcaagaagacacgatcttcctcctcctccgagatcgggaaatcgttcttcaagacgaagctttgcttcaaattccgcgccggaacttgtccctactccgcgagctcttgccactttgctcacagcgcggaggagctccgtcttcctccgccgccgccgcccaattggcaggagacggtgacagaggcttcaagaaacagagaaagctttgcggttagtttaggccctcgtggcaatgttgctcagactctcaagtctccgaattggaagacaaggatttgcaataagtggcagactactggctattgtccttttggttctcactgccattttgctcatggaccttcagagttgcatacatttggcggaggactcgttgaaggagaatgtaagatcggaacatccgccactttggacacaaagcagagaggacaagtagacacagtgactagccttgtttctcctggagtctcatcccaacggacatctagtgctgttacgcagaaacccaacggagtcagaactcaacggaaatggaaaggaccagataaaatcagtcgtgtttatggtgattggatcgacgatattgagtaaagtcactgcattttcactgatttgttgatcaaggtatagcttcttttagacttgtaactgtgtggacatattagcttcctcccttctgtggttgtagattgtgactcactcaacaaagacaaaaactctcatctttttgtttt

SEQ ID NO: 4369 - DNA, 1249 bp, Artificial Sequence
  P2390 (35S::G2743)
ctaactttatagttaaagttatcaattattcgaaaacaaagctggttttttgttttgtcccttaaaccagcatgatcaagaacttaagtaatatgaagaatgacaatcagaaacgtgaaaaatgttgcgagtacatcgaagctctcgaagaagaacgtcgcaagatcaatgttttccaacgcgagcttcctctttgcgtagagctcgtgactcaagcgattgaggcgtataagagggagatatcagggacgtcgacggataacttatacggacagtcggagtgctcagagcagaccaccggagaatgtgggcgcatcttggatctgttcataccaatcaaacactcttcgacctccatagaagaagaggttgatgacaaagatgatgatgatgaagaacaccagtctcatgaaaccgacatagattttgatgacaagaacatgaaatctgaatggctcaagtctgttcagctctggaaccaatccgacgcagttgtttctaataatagacaggatcgctcacaagaaaagacagagacgctggtagagttgataaaaataaacgatgaagcagcgaagaaaaacaacaacataaaatcaccggtgactactagcgatggtggcagtggcggtggcggtggcagaagagggcagagaaagaataggcggtgttggtcgcaagagttacacagacgcttcttgaacgctcttaaacaacttggtggccctcatgtagctacgccgaaacagataagagatataatgaaggttgatgggttaacaaatgatgaagtcaaaagtcatttacagaaatataggctgcatgcaagacggccaagccaaacaacaccgaacaacagaaactctcaaacgcaacatttcgtggtggttggtggaatatgggtcccacagactaaccattcaacggccaacgcagtcaacgccgtcgcatcgggtgagaccaccgggatttatgggcctatggtcagttcgttgccgtccgagtggccgaggcattccaattttggtaggaagatttcggaagatagatcaagatgctctaacaacggattttttcggtgtagctcaccagctatgtcttgttctactcgtacaaagacgaaagatgcaaaaataatatcataaatttaatttttgattatttattaagagaaaaaagttatagacattaatattgtgaagagtgtatatatatagatgttggagcgtgcctctatgttatttttaaa

SEQ ID NO: 4370 - DNA, 961 bp, Artificial Sequence
  P2391 (35S::G3067)
gaaaagaaaaaaacacaaaacctggtgttttttctctcgtcgtcgtttggtcgtgtcctaagacaagaaccggcgaacgaagaacaaactttttgaatctaacatccgaaagaaagagagaaaatgtcgtttacaggaacattggataaatgcaaggcctgtgacaaaaccgtgtacgtgatggatttgttaacattagagggtaatacttatcacaaatcatgtttcagatgcacccattgcaaaggcactctcgtgataagcaattactcatcaatggatggagttctttactgtaagccacacttcgaacagcttttcaaagaatctggcaattacagcaagaattttcaggcaggaaagaccgagaagcccaatgatcatctgactcgaactccaagcaagttatcatcattcttcagtggaacacaagacaaatgtgcgacttgtaagaagacggtttacccacttgagaaagtaacaatggaaggagaaagttaccacaagacttgcttcaggtgcacacacagtggttgtcctttgactcactcttcttacgcttctcttaatggcgtcctctactgtaaagtccacttcaatcagctctttctcgagaaaggcagttacaatcacgtccatcaagccgctgctaaccaccgtcgatccgcctcttctggtggcgcttctcctccttctgatgatcacaaacctgacgacaccgcctcaattcccgaagcaaaagaagatgacgctgcccctgaagctgcaggagaagaggagcctgagccggtcgttgagtcttgaaaatgtcgtggaggaatgatcttatcagttctcaagtttgaagtttttatatgcgtttctgtttaatgaatatataaatacaaattgttgttgtttcttcttgtaaattcttgtaaagttttaaagctctttttggagagaatctgttgtaaacaaa

SEQ ID NO: 4371 - DNA, 900 bp, Artificial Sequence
  P2392 (35S::G2933)
aaaaaacagaatcaataaccttgtccttgattaagcaaaaaatgtgtgcattagtcccttcatttttcacaaacttcggttggccgtcaacgaatcaatacgaaagctattacggtgccggagataacctaaataacggcacatttcttgaattgacggtaccacagacttatgaagtgactcatcatcagaatagcttgggagtatctgtttcgtcagaaggaaatgagatagacaacaatccggttgtggtcaagaagcttaatcacaatgctagtgaacgtgaccgacgcaagaagatcaacactttgttctcatctctccgttcatgtcttccagcttctgatcaatcgaagaagctaagtattcctgaaacggtttcaaagagcttaaagtacataccagagctgcaacagcaagtgaagaggctaatacaaaagaaggaagaaattttggtacgagtatcgggtcaaagagactttgagctttacgataagcagcaaccaaaggcggtcgcgagttatctctcaacggtttctgccactaggcttggtgacaacgaagtgatggtccaagtctcatcgtccaagattcataacttttcgatatcaaatgtgttgggtgggatagaagaagatgggtttgttcttgtggatgtttcatcatcaagatctcaaggagagaggctcttctacactttgcatcttcaagtggagaatatggatgattacaagattaattgcgaagaattaagtgaaaggatgttgtacttgtacgagaaatgtgaaaactcgtttaactaggtgactaattcatataatggtgtgtttatccactagttctcatttctttttagctgtgtccttttctcatatgaatctaacactgatctggaccaaa

SEQ ID NO: 4372 - DNA, 1128 bp, Artificial Sequence; identical to SEQ ID NO: 1695
  P2395 (35S::G2790)

SEQ ID NO: 4373 - DNA, 1035 bp, Artificial Sequence
  P2396 (35S::G370)
caaactcactctccctgatctctctcttccatggacgaaaccaacggacgaagagaaactcacgatttcatgaacgtcaacgttgaatccttctctcagcttcctttcatccgccgtactcctcccaaagaaaaagccgccattattcgtctcttcggccaagagctcgtcggtgataactccgacaacttatccgcagaaccttctgatcatcaaaccactaccaagaacgatgagagctctgagaatatcaaggacaaagacaaagaaaaagataaggacaaagacaaagataacaacaacaacaggagattcgagtgtcactactgcttcagaaacttcccaacttctcaagccctaggtggacatcaaaacgctcacaaacgtgaacgtcaacacgccaaacgcggttccatgacatcataccttcatcatcatcagcctcatgaccctcaccacatctacggcttcctcaacaaccaccaccaccgtcactatccgtcttggacgacggaagctagatcatactacggcggagggggacatcaaacgccgtcgtactactcaaggaatactcttgctcctccttcttctaacccaccgacaatcaacggaagtcctttaggtttgtggcgtgtaccgccttccacgtcaacaaatactattcaaggcgtttactcatcttcaccagcttcagcgtttaggtcgcatgagcaagagactaataaggagcctaataactggccgtacagattgatgaaacccaatgtgcaagatcatgtgagtctcgatcttcatctctgacttcttttattttatttttttatcatccatcattgctgtgatatatgagactcgctgatcggtgaagccaattcttttgagagtgttggagactgaaaaaaagaaaaagaaaacgagaaccggtttggtgtgtagatcatcttgaacctttttgaggttttcacattctgagtttatattaataaagggaataatattttggttaattagtaaaattcgttcatccgttta

SEQ ID NO: 4374 - DNA, 1501 bp, Artificial Sequence
  P2401 (35S::G1983)
aaaaccaaaacacatcacaaacaaaaaaaacaagttagatattatatcatcatggatgtcgtttgtacggaacatcaaatgaggaagccaacggtggagattcctccgagaaagcttcttttatcttccaagagttttccttctgattcttcttcccctcgctcgccgcgtaaacataactggaacaaaagcaacaagattacatctgaacatgaagaagacaacgaagacaacaacagagagaataaagagtactgttatgattctgactctgatgatccttacgcaagtgatcatttccggatgttcgaattcaagatccgtcgttgcactcgtagccgaagccacgattggactgattgtccttttgctcatcccggtgagaaagctcgccgtcgtgaccctcgtcgctttcaatactccggtgaggtttgtcccgagtttcgtcgtggtggtgattgtagccgtggagatgattgtgagtttgctcatggagtcttcgagtgttggctccatcctattcgttaccgtactgaagcttgtaaagacggtaaacactgtaaaaggaaagtctgtttctttgctcattcgccacgtcagcttagggttcttcctccggagaacgtttccggtgtctcagcgtcgccttctcctgcggcgaagaatccatgttgcttgttttgtagcagctctcccacgagcactcttttgggtaatttgtctcatctttctcgatctccgtctctgtctccacctatgtctccggctaataaagccgctgctttttcacggttgaggaaccgcgccgcttctgccgtttccgccgctgcagccgctggttcaatgaactataaagacgttttgagcgagcttgtgaattctttggattccatgagcttagcggaagcgctgcaggcgagttcctcgtcgcccgttacaactccggtttccgctgcggctgccgcgtttgcgtcgtcctgcggtctgagcaatcagcgtctccatctccagcaacaacaaccaagtagccctttgcaatttgctctttcgccttccactccaagttacctaactaactcacctcaggcgaacttcttcagtgatgatttcactcctcgccggagacagatgaacgatttcacggcgatgacggccgttagggagaatactaacattgaggatggttcttgtggtgaccctgatctaggatgggtcaatgatctcttgacttgagggattgacggtggagattcgccgggaggagatctgacttgagaatgtaaatttcggtggaagaattttaatcacattcatgaatcatgggagaataatcggttcgtaacggtttggtcaatgcatggagagattgtttgttcaaatttattttgaagatttttttttttagctaattcagaagtgtcttgtgtattgtcgtttattttttagaattttctttttctgatgggatttttaccaaataatatgttgaacttgtaataaa

SEQ ID NO: 4375 - DNA, 1547 bp, Artificial Sequence
  P2402 (35S::G1276)
ttttgttgttgttgtgaaagctcagagttttgtttgcttttttgttgacttttttgagattgatgctggatctcaatctcgacgtcgactcgaccgagtctactcagaacgaacgagattcgattactgttaaaggggtttctttgaatcagatggatgaatcggtgacgtcgaactcttctgttgttaatgctgaagcttctagctgtatagatggtgaagatgagttgtgctctacacgaacggtcaagtttcaatttgagatactgaaaggaggaggagaagaagaagaagaagatgatgatgaaagaagtgctgtgatgatgactaaggagttttttcctgttgctaaaggcatgaactttatggattcgagcgctcaaagttcaaggagcaccgttgatatttccttccagagggggaaacaaggtggagactttataggtagcgggagcggtggtggcgatgcttcacgggtgatgcagccaccatcacagccggtgaagaaaagcaggagaggtcctaggtctaagagttctcagtatagaggcgtcactttctatcggaggacaggcagatgggaatcgcatatctgggattgcggtaaacaagtttatttaggtggatttgatactgcccatgctgcagctagggcgtatgatcgagctgctgtcaaattccggggtctggaagctgacatcaatttcgttattggcgattatgaagaggatctcaagcagatggcgaatctttccaaagaggaagttgtgcaagtacttcggcgacagagctctggtttctcaaggaataattctagatatcaaggagttgctttgcaaaagattggcgggtggggagctcaaatggagcagcttcatggaaacatgggttgtgacaaggcagccgtacaatggaagggaagggaagctgcttccttaattgagcctcatgcatcccgaatgattcccgaggcagctaatgttaagctcgacctcaacttgggaatctctctttcactaggagatggtccgaagcaaaaagatagggccctccggcttcaccatgtccctaacaattccgtatgtggaaggaacaccatgatggagaaccacatggctgcagcggcatgtgatacgcctttcaatttcttgaagaggggttcagaccatcttaataaccggcatgcccttccttctgcgttcttttcacccatggaaagaacaccagagaaagggcttatgttacgttctcatcaaagcttcccagccaggacatggcaagggcatgatcagtccagtggtgggaccgccgtagcagctacagcaccgccactgttttcaaatgcagcatcatcaggattctcactctcagctacacgccctccttcatccacagctattcatcatccttctcagcccttcgtcaatctgaatcagcccggtctctatgttatccacccatctgattacatatctcagcaccaacacaatctcatgaaccgcccacaaccaccaccatagcttcctccttcctccgcataactcaag

SEQ ID NO: 4376 - DNA, 1011 bp, Artificial Sequence
  P2408 (35S::G2691)
gttcgctgaaacagagaaatctttttcctgaaaaaaacctcatccgatttagcagtttttgatcagagatttttgagtggggtttttttggtgtgttcttggtgtgtttgagaagatatgaagtcctttgtgaaacctgagagagactctttgttgagaacagttcgtattgttttcactgatcctgatgctactgatgattcctcttcctctagcgatgaatggttacctaaacctcgaaaggtaaagcgttttgttcatgagattactttcctccctcaggtctccgagagttctcaggatcgtagcaatgctgtcaaaacccctagaaggaaatctactaggcagtttaagtatcctgtgggagttaggccgaggccatcaggcaaatttgctgctgagattttgaacccattcactaaaactaagaaatggttgggtacttatgaaactcctgcagaagctgagaaggcttatgttgacaagaaggttgagtatgatgcactggcttcttcaggttctgctgtttcctcatcggttgtaacagtgactagccagtgcttgcgttcccctacttctgcttctgtttcttgtgtaagtgctgatgatttgtctaaagaaaagacgtctctgaacaaagatgttgctgcgtctggtgattcaaccaccaaagaagtgttcactactttcgacttttcggatgtgaaaatacctgatctgagattcttagcagcagaagaggattctatggtttctaatgcaaatggtgcagagctagactttgattgtttccttactgactctaacattctgctggatgattactcattgctcgaaaatgatatcaacttcagcaggtttgaaaacagtcttccaagtgagctacctgactgtgatttcactgaaatggaattccagcttgatgatttcaaatttgcctatacagatcatctgacaacaccgcctctcggtttggtttaagagttgttagcttcggtttctgtttcacag

SEQ ID NO: 4377 - DNA, 988 bp, Artificial Sequence
  P2410 (35S::G172)
tttttctctgtgtctatttgtctctccgtaagaaacattatgccttcatctgattccacgatgatgaagaaaggaacaaagcgcaaaatcgaaataaagaaacgagaaaccaaagagcaacgagccgtgacttgctctaaacgccgtcaaactgttttttccaaagccgccgatctctgtcttatctccggtgctaacatcgccgtcttcgtaacctctccctccgatagttccgatgttgtctattccttctccggttactcctctgcctacgaaatcgctgattgttacctaaatcgcaagcctccacccaagattgttaacccggccggatccaaactaggattttggtgggaagaccctgatctctaccattcgtgtgatgatctctctgagttaagcattatcgaggatcgtttacagagaatgaagaagcatgtgatggcttgccttgagaaggaagaaaaatctcaacttgtttctagtttcgaccaaaaccctaatagtacttgttctctcgacgtcgaggattgtgatggatcttcttattcgcaaattgcttctacttttactccaaactctgtcaacgagtattgcagcgatcaaaccttttcttctttccatggcgatcaaaaccctaacctctcgtctccgtcttttgatcaggactgttactcctctctctatcagatctgtggagaatcatcttcacaagttgcttcttttgatcaaaaccctagctccgagatccaaggatttgaaacagaggaagagattaaccaaatcaatctactactacaagaaacacaaacagaggccaatgtcaatttggatgatgagatctgcttttggaatgatctatccaacgatgatgtgtttggtctaaacagctacttcggtctcgataacaccaatgcaatgatcaacttcggagattccgactttagacgtcatgtctgatatgatgtggttgtaatcttcagaactt

SEQ ID NO: 4378 - DNA, 874 bp, Artificial Sequence
  P2412 (35S::G2585)
taataaacccacagagcaataattataagtattactcaaaaaaacaaaaaaagatgaactcttgccaacaaaaggctatggagaagttgcttcacgggcatgggtgcgccaaccagctgctcatcatggaccagaccgagtcagactcgtccatggaaagggaggatttggccaagtccgtcctccattgtttctcagatgcgctctccatcttgatcgatactaatgaccaccaagacgatcaatccaataactcatctcctcaggactcttctcctgtgcttgagagctccaggaaaccacttcacaagaggggaagaaagacatctatggcagagagctcagactaccatagacacgaatcttcaaccccgatctaccacgacggcttcctctggaggaaatacggacaaaagcagatcaaagaatctgagtaccaaaggagttactacaagtgtgcctacaccaaggaccagaactgtgaagcaaagaagcaggttcaaaagatccaacacaatcctccattgtactcaaccacttacttcggccagcacatatgccagcttcatcaagcttatgcaactttccccattgacacatctgacttcgaagagcacgagggatcccacatgatccgattcggtcaccccaatatcagcttctcctcctccacctctaacctccgccaacatcagaatcatcaggatcgcatcaaagatgaatacatgaaaccggtgatagcagaagattggtctccatcccagtggatgtcgtccgaggttgccctcgccgtggaggctttcgagtttaatcctttctggacatctcacgacttatcatcatgacactatatccctcagctctatcatcatac

SEQ ID NO: 4379 - DNA, 2577 bp, Artificial Sequence
  P2414 (35S::G2574)
ggaaaaaaacagacaacaaaaagaaaagaaaatccaaacaagaagaagaagacgaaaatcttctgatatttctgacaatggaggttcttttgaaattaccctcttcagagtctcctcttaaggataaatttggatctgttcaaatccatgaagctaataaggtaaataccaactctatatgtgcatatacaaaattatacatgtatatggaaataatttagatcacaaaaccagaaaactgaccgttcttattctttatcggtgtgttttatgctttaacgtaattcttgtatcctgagatgtctcttccactctataatggcctctctcttttttcttattatcgtaattggtttaaaaagaaaaactcaaaactctaccatgttcattttttttatggaaacgggaagattatattagttatctatctagaaatattgaataattcgttagaattaagaatggaagtatgatgtgttagaaacttagaataaagaacatttttagatttagttgagaaattaatcaacttttttattcaatgatattaatcagggtgatggtgatcatcaagaacttgaatctgccaaggcagagatgagcgaggtgaaggaagagaacgagaagcttaaaggaatgctcgaacgaattgaaagtgattacaaatctctcaagctcagattcttcgacataattcaacaagaaccttcaaacaccgcaactaaaaatcaaaacatggttgatcatcccaagccaacgacgacggatttgagttcttttgaccaagaacgcgagcttgtatcgctttcactagggagaagaagttcttccccaagtgatagcgtccccaaaaaggaagagaaaacggacgcaatcagcgcagaagtcaacgctgacgaagagttgactaaggccggcttgaccttagggatcaataatggcaacggaggtgaaccgaaagagggtttatctatggagaatcgtgcaaattctggctcggaagaagcttgggcgccaggtaaagttacggggaagagaagctctccagcaccagcctccggtggcgatgctgacggtgaggccggtcaacaaaaccatgttaagagagctagagtttgtgttagagcaagatgtgacacaccaacggtacgtcctttaaattatacattaaataagttgatctataacgttaattaaaagatttgattatttatatgtgactaatgttgattcggacatgtttattaattatgttgtatagatgaatgatggttgtcaatggagaaaatatggacaaaagattgcgaaaggaaatccatgtccacgagcatattatcgctgcacggttgcacctggatgtcccgttagaaaacaggtatatttcgtattctatatagtctatttaagaatggaataaaaaatcggtttgaatttttcgtctggttttattttcatttccgtttgagttggatctgattttagttgttaaaatgtatcattcaatttaaactgaacaacataatttaagataaaaatgtatcattcagtttattttattttttgcgtttgcctttgcgtttccatggtattatagaaagtaagaaacatttgtgaccagtgtacaaataaaaagaaacgatctaactatttgtcctcgattatgtatgttttaggtccaaagatgtgcagatgacatgtctatactaatcacaacctatgaaggaacacacagccactctcttccactctcagccaccaccatggcttccaccacatcagccgctgcctccatgctcctctctggctcctcctcctcaccagccgctgaaatgatcggaaataacctctacgacaattcaagattcaacaacaacaacaaatccttctattcacccacccttcactccccattacatcccaccgtcactctagacctcactgctccacaacactcttcctcgtcttcttcttcattgctttctttaaatttcaacaaattctcgaactctttccaaagattcccatctacaagcctaaatttctcttctacttcatcaacatcatcaaacccgtctactctcaacctacccgcgatttggggtaatgggtattcttcttatactccatatccttacaacaacgtccaatttgggacgtccaacctaggaaaaacagtccaaaatagccagtccttaaccgaaaccctaacaaaagcgcttacttccgacccaagtttccactcggtgatcgctgctgccatctcaactatggtcggatcaaatggagaacaacagattgtcggtccacggcattcgattagcaataacattcaacaaaccaacacgacgaataataacaaaggatgtggaggctattttagcagcttattgatgtctaacattatggcgagtaatcaaacgggtgcttctttggatcaaccatcgtcgcaacttcctcccttctctatgttcaagaattcttcttcttcgtcttctacgactaatttcgtgaacaaggaagagaaaagctagtcattgttcttgttttttgttttttgggtgattttttattaggtgt

SEQ ID NO: 4380 - DNA, 1291 bp, Artificial Sequence
  P2416 (35S::G1013)
agtaaatagaaattcaacacacgttactcttaaaagttaaaagaataaagaatccctctctccctctccccctctccccctcaccaccagctcgcataagttttcttgtccccatactcatatggaagaagaaggttatcagtgggcaagaaggtgtggaaacaacgccgttgaagatccttttgtttatgagccacctcttttctttctgcctcaagaccaacatcatatgcatgggctcatgccaaatgaagatttcattgccaacaagttcgtcacatcaacactttactccggtccacgaatccaagatattgcaaacgctctggccttggtcgaacccctgacccacccagtccgagaaatctctaaatcaacgtaagtaattgatatttatttttttaattacaagaatacatctctttgccttatgtttagtatagccctttaataataagtactcatgagttcctttatatttatgtatagagttcctcttttggaaagaagtactttgagcaaggtggataggtacactttaaaggtgaagaacaatagtaatggaatgtgtgatgatggatacaaatggagaaaatatggccaaaaatcaatcaaaaatagccctaacccaaggtacatatatgcattctccgttttagaattgtatatgcatatcgaacttctttggttcggccaaaatgatacgtattaaaatcaacatatggaagttttatttagtatacttagttttcggtcacaagcctaatgttactatatttgtgatatatgtctaggagttattacaagtgcacaaacccaatatgcaatgcaaagaagcaagtggagagatcaattgatgagtctaacacatatatcattacctacgaaggtttccacttccactatacttaccctttcttcctacccgataagacacgtcaatggcccaataaaaaaacgaaaatacataaacataatgctcaagatatgaacaaaaaatctcaaacccaagaagagagcaaagaagcacaattaggtgagctcaccaaccaaaatcatccagtcaataaagcccaagaaaacacaccggcaaatctcgaagagggattgttttttccggttgatcagtgtcggccgcaacaagggcttctagaagatgtggtagctccggcaatgaaaaatattcctaccagggacagtgttttgacagcttcttgataaataaaaaattatttgaaaatattaaaaaaatataaaattaaacttctttatcataaccggagaaagtttt

SEQ ID NO: 4381 - DNA, 1414 bp, Artificial Sequence
  P2418 (35S::G2109)
gtattggttttgaacaggggatgggaagggttaagttgaagattaaaagacttgagagcacaagcaacaggcaagttacatacacgaagagaaaaaatgggattttgaagaaagccaaagagttatcgattttgtgtgatattgatattgtccttcttatgttttcccctaccggaagagctactgctttccatggagaacacagttgcattgaagaggttatttccaagtttgcgcaattaactccacaagaaaggacaaaaaggaaactggagagccttgaagcattgaagaaaacttttaagaaactggatcatgatgtaaatatacatgactttttaggagcaaggaatcaaactattgagggtctaagtaaccaagtagccatttaccaagctcagctaatggagtgtcataggaggttgagttgttggacgaacatcgatagaatagaaaacactgagcacctcgatttattggaagaatcattgaggaaatccattgaaagaatccagattcacaaggaacattacagaaagaaccaactcttgccaatagaatgtgcaacaacacagtttcacagcgggatacagttgcctatggcgatgggaggtaatagtagtatgcaagaagctcactccatgtcttggcttcctgataatgatcaccagcaaacaatcttacctggtgattccagttttcttccccatagagagatggatggttcgattcccgtttactcaagctgcttctttgagtctacgaaaccagaagatcagatatgcagcaacccgggacaacagtttgagcagttagaacaacaaggaaacggttgtttggggttacaacaacttggagaggaatattcatatcctacaccgtttggtactactttgggaatggaagaagatcaagagaaaaagataaaatctgaaatggaattgaacaacttgcaacaacagcaacagcaacaacaacaacaacaacaacaagatccttcaatgtatgatcccatggctaataataatggtggctgctttcagattcctcatgatcagtccatgtttgtcaatgatcatcatcatcatcatcaccaccatcatcaaaattgggttccagattcaatgtttggtcagacttcttacaaccagcaaccgaactaactcaagacatggctcatgtatgtatgatgactggacttatgtctgaccaaggactagtttgagccattgcctacaatgtctaagataaatatatatatgtagacagcgagagagtgtgtgtacatgtttttgtatgtgtgagcttgtgtcatatactcaggggagttttaggcatttgtgtataagagatgttgtctaggaaccgtatattacctttaacaagaatgataagtatatccaatatattaatg

SEQ ID NO: 4382 - DNA, 860 bp, Artificial Sequence
  P2419 (35S::G1932)
aaacgagccaacaaagcaaaacctctttcttctcttctccactttctctctagattctctcatatttcccctcttgagagtctaacaatggcgtcaacgacgtgtgcaagagaggtgcattacagaggagtcagaaagagaccttggggtcgctacgctgctgagatacgagatccttggaagaaaactagggtttggttaggcactttcgacactcccgaagaagctgctcttgcttacgacggcgctgctcgtttcctccgtggtatcaaagccaaaactaacttcccttctcctctctctctcgacctcaaccacctcccttccgctccctcagccgcaaccgccgccgcaaataaccaaccccaccaacaccaacagctctggttcgctgcgcctcctcctgttcctccaagctccgaccatcatcaccaacaccaccgcatttttctccgaaccggtgtgctaaacgacaaaacttcagattactcttctacagaagcgccgctttacttcacctcctcgcctaacacagccacgtcatcgcctggttatcaagtggttgggtttccgatgatgaattcttctccttcccctgttacggtgagacgtggcttagccattgacctcaacgagcctccgccgctttggctttgaaaacaaacgataaagatggatatagcggcgccgttttgcctacttttctatacggcgccgtttgagaccactttcggtggaactactttagtttctttttttagcaaatagtatctttttgttagagttagtagacttgtttttataatttaatccttcttttgttcgttatgtaagagtcggagatcgattgttgttgtgag

SEQ ID NO: 4383 - DNA, 1062 bp, Artificial Sequence
  P2422 (35S::G1423)
ctcaacaaaattgagaaaaatcaatcagaatggtgaaaaaaggtggcacgaagaggaagattgcgattgagacgatacagaagagagattcccttagggttacctgcaccaaacgccgtgaaggtctctatagcaaagcctctcagctttgtcttctctcagacgcacagatcgctatcttagcgactcctccttcttctgaatccaacgtatccttctactctttcggtcactcctctgttgatgccgttgtctctgcttttctctccggacaacgtcctgttccgaaggataacaaagagacgagggaggacgttggtatctgtttgactcgcaataatctagggttaggtttttggtggaacgacgagagccttgccagatcggagaatcctcaagagattagtgaagcgatcgactctatgcggacgctgttgaggaatctcaaggaattgcgtgcggatgaagctttagcctgtaatcaagctttcgttaatgatcgcgaggacctgaagaacaacgacaagtgcgattttgtttcagaccacgaaactcatgatcaaaccctaattcttcagtccgcttctccaatttgttgcatcccagaaaatctcaacgagattactcaagagccaaatcaaaccctaaatattcagtcgagtacttctgcaatttgttgcgtccctgataattcacctgaaaatttcaatgagatcactgaagaacaagatcagattcgctcgatttgtgaaactttttgtgttatggataacaacgctgctttacctgaaatgaacctggattacgatcaagacattggcttcgacacgccttttgagagcgcgctaaatgattggttttcggacaacactactcatcaggagattagtgcaagtattttgaacgctgttgttgatgatcaagtctcggtggatctaactccgttttcttattttcagagatgtttggatggagataatctacgattctctgattgtttcaaagactttgcaaacactatttcagcactttgaagataatttctctgcagttttcaaacta

SEQ ID NO: 4384 - DNA, 937 bp, Artificial Sequence
  Artificial sequence
  P2423 (35S::G2991)
caataaccaaaacccaagtttacaaaacatttcttcttcttgtttttcgaaaccctaaatgttttgagttgtcatggatgtaatagctactacaactactatagtatccgacttggattcacgacaacccgaaatcgaagctccgatccggatccagcccgcgaagcctatttctttctcaaacggcaaacgctgccaccaccatcatcttgcatctgaagcggttgcggttgcgacttataaagaatgtctaaagaatcacgcagcaggtatcggcggtcacgctttagacggatgcggcgagtttatgccgtcaccgtcgtttaactccaatgaccccgcttcactaacgtgcgctgcttgtggttgccaccgtaacttccaccgccgtgaggaggatccatcttctctctctgccatcgtccctgcgatcgaatttcgacctcacaaccgtcaccagcttcctccaccgcctcctcctcatctggcggggattcgtagtccagacgacgatgattcagcttctccaccgccgatctcgtcttcttacatgcttctcgcactctctggaggaagaggaggagctaacacggcggttccaatgtctaggaaacgttttaggacgaagtttagtcagtatcagaaggagaagatgttcgagttctcggagagagttgggtggaggatgccgaaagctgatgacgtggtggttaaggagttttgtcgggagattggagttgataaaagcgttttcaaagtgtggatgcataacaacaagatttcaggacgcagcggcgctagaagagctaacggcggagtagtagtaggaggagtaggagatagtcgtcagagtgttgttccgacaaatgggtcgttttcttcgacgtgaggaaaagaatggaaagcgttgaaaaagcgtcgtcgttttagaggctaa

SEQ ID NO: 4385 - DNA, 925 bp, Artificial Sequence
  P2424 (35S::G2996)
tgagaaacctcctctccccaaaaacgacgtagtttcacatttctcgacttcttgaatggagtttgaagacaacaacaacaacaacgacgaagagcaagaagaggatatgaatcttcatgaggaagaagaagacgacgacgccgtttacgactctcctcctctctctcgtgttctccccaaagcctcgacagaaagtcatgaaaccaccggaactacttccacaggcggtggcggaggattcatggttgttcacggcggtggagggagcaggtttaggttccgtgagtgtctcaagaaccaagcggtgaacataggaggacacgcggtcgatggttgtggtgagtttatgccagctggaatcgaaggtaccatcgacgctctaaaatgcgccgcttgtggctgtcaccgtaacttccaccgcaaggaattaccttacttccatcacgcgccgccacaacatcagcctcctcctcccccgccagggttttaccgtcttccagctccggttagctaccgaccaccaccgtcacaagctcctcctcttcagctcgctcttccccctccacaaagagagagatcagaagatccaatggagacgtcttcagctgaagcaggaggagggattaggaagaggcataggactaagtttacggctgagcaaaaggaaaggatgttagctttagctgagaggattggatggagaattcagagacaagacgatgaagtgattcagagattttgtcaggagactggtgttccgagacaagttcttaaggtttggttacataacaacaaacacactcttggtaagtcgccttcaccacttcatcatcatcaggctcctcctcctccaccaccacagtcttcgtttcatcatgaacaagaccaaccatgaatcttgaatttctttgatcactagggtttt

SEQ ID NO: 4386 - DNA, 1031 bp, Artificial Sequence
  P2425 (35S::G2989)
taagcttaacataaaccctaatattttcttgatttttttcaagaaaataaaaacataaagatgcttgaagttagatcaatggatatgactccaaaatcaccagaacccgaatccgaaactccgacccggatccaaccagctaaaccaatctctttcagtaacggaatcatcaaacgccaccaccaccaccaccacaacaacaacaaagtcacttacaaagaatgtctcaagaaccacgcggcggcgattggtggtcacgcgcttgacggttgcggcgaatttatgccgtctccttcgtcaacaccttccgatccaacttctctcaagtgtgcagcttgtggttgtcaccgtaacttccaccgccgtgaaactgacgattcctccgccgttccaccaccgtctcttcttccatcttcaacaacaaccgccgcaattgagtatcagcctcatcaccgtcatcatcctcctcctccgctagctcctccgttaccacgtagtcctaattcatcttctccgccgcctatctcttcctcctacatgcttttagctctctccggtaataataaaaccgcaccgttctcagatctaaacttcgccgccgcggctaaccatctctccgccacgcctggctcgaggaagcgattcaggacgaagtttagctcaaatcagaaagagaagatgcatgaattcgccgatcgaatcggttggaagattcagaaacgtgacgaagacgaagttcgtgatttttgccgtgagatcggagttgataaaggtgttctcaaagtttggatgcataataacaaaaactccttcaaattctccggcggaggagcaaccaccgtgcagagaaacgataacggtatcggcggcgagaacagtaacgatgatggagttcgcggtttagctaacgacggtgacggtggtggtgggagatttgagagtgatagtggaggagctgatggtggcggaaacgtaaacgcctcgtcgtcttcgtcgtgaagaagaaaacatcatgtcgttttgcagggaaa

SEQ ID NO: 4387 - DNA, 1132 bp, Artificial Sequence
  P2426 (35S::G2990)
aaagctcttaacccaaaaaccctaagtcttttttttcttcaaattattggttatattaatgttttaagctatgatggatatgactcctacaataacaacaacaacaacaccaactcctaaatcacccgaacccgaatccgaaactccgacccggatccaaccggcgaaacccatttcctttagcaacggcatcatcaaacgccaccaccaccaccaccatcctctcctctttacttacaaagaatgtctcaaaaaccacgcggcggctttaggtggtcacgctctcgacggttgcggcgaattcatgccgtctccgtcgtcaatctcctccgatccaacttctctcaaatgtgctgcttgtggctgccaccgtaatttccaccgccgtgatccagataacaacaacgactcttcccaaatccctcctcctccttccaccgccgtagagtatcaacctcaccaccgtcatcatccaccaccaccaccacctcctccaccaccacgtagtcctaactcagcttctcctccaccaatctcttcctcttacatgctcttatctctctccggtactaataacaacaacaacaacttagcttctttctccgatcttaacttctccgccggaaacaaccaccaccaccaccaccaacatactcttcacggatctcgtaaaagattccgaacaaaattcagccagtttcagaaagagaagatgcatgaattcgccgaacgtgttggttggaagatgcaaaaacgtgacgaagacgatgttcgtgatttttgccggcagatcggagttgataaaagtgttctcaaagtttggatgcataacaacaaaaacacctttaaccgccgtgatatcgccggaaacgagatccggcaaatcgataacggcggaggaaaccacactccgattctcgccggcgagattaataaccataacaatggacaccacggtgtcggaggaggaggagagcttcaccagagtgttagtagcggcggtggtggcggaggatttgatagtgatagcggcggagctaacggtggtaacgttaacggatcatcgtcgtcgtgaagttaaagatgagagtgtcaggttaataagaagcttagagtaagcttattcgtatta

SEQ ID NO: 4388 - DNA, 767 bp, Artificial Sequence
  P2427 (35S::G2992)
gctatggatttgtcttccaaaccacaacaacaacttctaaactctcttcccatcgccggagaactaactgtcaccggagaaatgggtgtttgttacaaagagtgtttgaaaaaccacgcggctaatctcggcggccatgctctcgacggttgcggcgagtttatgccgagtcccacggctacttccaccgatccttcttctctccgttgcgctgcttgtggctgccaccgtaacttccaccgccgtgacccttccgagaatctcaacttcctcaccgcgcctccgatttcttctccctccggcactgagtcgccgccgtctcgtcacgtgtcttctcctgttccttgctcttactacacctcagctcctccacatcacgtgattctctctctcagctccggtttccctggaccgtcagatcaagatccaacggtggttaggtcagagaacagttcaagaggagcaatgaggaaacgaacaagaaccaaattcacgccggagcagaagatcaagatgagagccttcgcagagaaagctggttggaaaatcaacggatgtgatgaaaagtcggtgagagagttttgtaacgaagttgggattgagagaggagttcttaaagtgtggatgcataacaacaagtactcacttctcaatggcaagatcagagagatcgaacatggcctgtgtctgaacactcacagcaatgatggtgatgggtcttacatctttcttgaagaaagattcaagattcgggttaaaccgaatta

SEQ ID NO: 4389 - DNA, 1160 bp, Artificial Sequence
  P2431 (35S::G2998)
cgtgtacttgttcatcttatctcctctgtaagtctctgattctcactgccatttagttttcttttttgccttattagtaatctcattatcatgttctttttcaggcataaacttcattgaagaaaaagtcttttttattttgttgatctcttttaattaagatccttttgggttttaatttattaatctccaagaaaaaaaatggatatgagaagccatgaaatgatagagagaagaagagaagacaatggcaacaacaatggtggtgttgttattagtaacatcattagtactaatattgatgataattgcaatggtaataacaacaacactcgtgtctcttgcaactctcaaaccctagatcaccaccaatccaagtctccctcttcgttttccatctccgccgcagctaaacccaccgtaagataccgtgagtgtctaaagaatcatgcggcgagcgtcggcggaagtgttcacgacggatgcggcgagtttatgccgagtggtgaagaaggaacaatcgaagctctcagatgcgctgcttgtgattgtcaccgtaatttccaccggaaagaaatggacggcgttggaagctcggatttgatctctcaccaccgtcatcaccactaccaccataaccaatacggtggaggaggagggagaagacctccgccgccgaatatgatgcttaacccactcatgcttcctccgccaccgaattatcagccgattcaccaccacaagtatggaatgagtcctcccggaggaggaggaatggtgacgccgatgagcgttgcttacggcggtggaggaggaggagctgagtcgtctagtgaagatctgaatctgtacggacaatcaagcggagaaggagctggtgcggcggcgggacaaatggcgttttcgatgtcgtcgtctaagaaaagattcaggacaaagttcacgacggatcagaaggagaggatgatggactttgcggagaagctagggtggaggatgaacaagcaagacgaagaagagcttaagagattctgcggcgagatcggagtgaagagacaagtcttcaaagtttggatgcataacaacaagaacaatgctaagaaaccaccaacaccaacaactactctctaatcagtgatcatatgattaattgagagatt

SEQ ID NO: 4390 - DNA, 1091 bp, Artificial Sequence
  P2434 (35S::G2994)
tccccaaaccaagaaacaatttgcaaagagaaagcaaaaggtttttgaagaagacccaattaaaaaagatggaaattgcaagtcaagaagatcatgatatgcccatcccattaaacactacatttggtggtggtggtagtcatggtcacatgatccatcatcatgatcatcatgctgctaattctgctcctccaactcacaacaacaacaatactactcaaccacctccaatgccgttacatggtaatggtcatggcaacaattatgatcatcatcatcatcaagatcctcatcatgttggttacaacgctatcatcaagaagcctatgataaagtacaaggagtgtctcaagaaccatgcagcagctatgggaggcaatgctactgatgggtgtggagagtttatgccaagtggtgaagatggctccattgaggctctcacttgctcagcttgcaattgccacaggaacttccatagaaaagaagtggaaggcgaactcgcagccaccgccatgtccccttaccaccaacaccctccacaccgaaaactcatgctcaaccaccaaaagatcagatcagctatgccacaccaaatgatcatgcccattggagtctctaactaccggtacatgcataacaactccgagtccgaggactttatggaggaagatggcgtaaccaccgcatctagatcgctaccaaacctgccatacaaccagaagaagaggttcaggacaaagttcacgccggaacagaaggagaagatgcttagttttgctgagaaagttgggtggaaaatacaaaggcaagaagattgtgttgttcaaaggttttgtgaagagattggagtgaagagaagagtgcttaaggtttggatgcacaacaacaagatccatttctccaagaagaacaacattaacctcgaagacaacgacaacgaaaagatcaacaatctcaacaatgttgatctgtccggtaataacgacatgactaagatcgtcccatgatataattaataacgttatttttatatgatctttgataattatttagttatctttatgttagctactagggttttaattttatct

SEQ ID NO: 4391 - DNA, 1236 bp, Artificial Sequence
  P2438 (35S::G2603)
aaagactcagcctttaagtatccccagaagtcgtatgaccttacgtagcttaatccttgagatgcgttcgagaccgcatcgtgtggtccacgaccttgccgccgccgcagctgccgattccacttctgtgtcatcgcaagattatcgctggtcagagattcctgaagagcttcttagggagattctgattcgtgttgaagcggcggacggtggcggatggccgtcacgacgcagcgtggtggcttgtgccggcgtttgtcgtggctggcggctacttatgaacgaaaccgtcgttatccctgagatctcttctaagttgactttccccatctctctcaagcagcctggtccaagggattcactggttcaatgctttatcaaacgtaatcgaattacgcaatcatatcatctctatctcggattaaccaactctttaacggatgatgggaagtttttgcttgctgcgtgtaagttgaagcacacaacttgtacggattacattatctctttacgttctgatgatatgtcgagaagaagccaagcttatgttggcaaagtgagatcgaacttcctaggaacgaaattcactgtctttgatggaaatctgctgccttcaacgggagccgcaaagttgagaaagagccgatcttataatcccgcaaaagtttcagcaaaagttcctcttggaagttatcctgtcgctcatatcacatatgagctgaatgtcttaggatcccggggaccaagaaagatgcaatgtcttatggacacaatacctacaagcacaatggagcctcaaggagtagcttcagaaccatcagagtttcccttactcggtactcggtcaaccttatccaggtctcagtcaaaaccattacgcagtagctcaagccacctgaaagaaacaccattagtgctgagcaacaagacaccacggtggcacgagcagctacgctgctggtgcttgaatttccatggccgtgtcacagtagcgtcagtgaagaactttcagctcgtggcagcaggagctagctgtggcagtggcacgggaatgtcaccggagaggcagagcgagcggattatattgcagtttgggaaagtcgggaaagatatgttcacgatggattatggatacccgatctcagctttccaggcttttgccatttgcttgagcagctttgagactagaatcgcttgtgaatgatttacaagactttgttaagatatcgctatatc

SEQ ID NO: 4392 - DNA, 1494 bp, Artificial Sequence
  P2443 (35S::G1660)
gcttccaagctctcttatcattcactgatttttggttctcgagaaaaaagtgaagatttttgagattctctttcgatggattacgaacgaatcggaaagacccaggttactagtagcggcggcggattttctccggggaagttaaggagtatgcttcttctaggtgttgatagaaagaagaatgaagaagaagaatcaactcctacaatgagatctgggtctaatcaaattgatgaccctagggtttatgggatagctagatcgattagtttgggtcttcaagagtattctgattatgataatgtgaatgagatcaagagtgtttctgcatcatctgtctttgagtttcaaaagactgagaaggaaaaagttaatcaaagaatgcctattagatcattctctaaaccagctccatctaaatgggatgatgctcagaaatggattgctagtcctacggctaaccgaccgaagactggacaggttcaggttccgggttcgaagaaagggcctagctttggtcgtcagtcttctatgaagattgttgaagttgctgaacatagagtggttgaagagcctgatacaaagagaatagatgtaagccaagtgaaaaaggatatgggaaacaagtttggtagctgggaagttgattcgtacactaccgtggattcatatgtcaaaccggttcttatggttgagaactctattgtagaatcagcaactgaagttaatctcagccgtcatgactcgtcagtcgcaactgcgtttgctcaaccgccttcaacggcaaggtctgtgtcaatgagagacatgggaactgaaatgactcctatagcgagccaagaaccttctagaaacgggacaccgattagggcaacaacgccaatacgaagtcctatatcttctgaaccttcaagtccaggcagacaagcatcagcttctcctatgagtaacaaggaactgtcagagaaagagcttcaaatgaaaactaggagagagataatggtgttgggtactcaacttggtaaatttaacattgctgcttgggctagcaaggaggatgaagataaagacgcatccacatcattaaagaccaaagcttctctacaaacttctaaaagtgtttctgaagctcgtgctacagcgtgggaggaagcggaaaaagctaagcacatggctaggttcagacgcgaagagatgaagattcaagcatgggagaatcatcagaaggcgaaatctgaagccgagatgaagaaaaccgaggttaaagttgagaggattaagggacgagcacaagaccggttgatgaagaaactcgctacaatcgagcgcaaagcagaggaaaagcgagcagcggctgaagcaaagaaggatcatcaggcagctaaaacagagaaacaagctgaacaaatccgaagaacaggcaaagtaccttcattgttgttctcttgctttagcttttgttcttaaatccaatcctattgtgaatgtgatgtt

SEQ ID NO: 4393 - DNA, 1049 bp, Artificial Sequence
  P2444 (35S::G2142)
aaacaataaacagtcgaaattctccggcgaagatgagaaccggaaaaggaaatcaagaggaagaagattacggagaagaagactttaactctaaacgtgaaggtccttcttccaacactactgttcatagcaacagagattcaaaggaaaatgataaagctagtgcgatacgttctaaacattcggtcactgagcaacgtagaagaagcaaaatcaatgaaagatttcagatattgagagaactaattcccaacagtgaacaaaaacgtgacactgcttcattccttttagaggtgatagattatgttcagtatttacaagagaaggtgcaaaagtatgaaggatcgtatccaggttggagtcaggaaccaacaaagttgacgccatggaggaataatcattggcgagttcaaagtttggggaaccacccagtagctataaataatggatctggtccagggataccttttcctggaaagtttgaagacaacactgtgacttcgacacctgcaattattgcagaaccgcaaatcccgattgaatctgacaaagcaagagctataaccggcatatcgattgaaagtcaacctgagttagacgacaaaggattaccaccactacaaccaattcttccaatggtacaaggcgaacaagctaatgaatgtcctgcaactagtgatgggctaggccaaagtaatgacctggttattgaaggtggaaccattagcatctctagtgcctactcgcatgagttattgagctcattaacacaagcactccagaatgcaggcattgatctgtcgcaagcaaagctttctgtgcagatcgatcttgggaagcgagccaatcaaggtctaactcatgaagagccatcaagtaagaatccattatcatatgatacgcaaggaagggattcaagcgttgaggaagaatctgaacattctcacaagcggatgaaaacactgtgacatttctctctcaggctccacggcgctggaatatataaatgtattgacagattccttgtatcgtgtacattgttcggcttc

SEQ ID NO: 4394 - DNA, 1176 bp, Artificial Sequence
  P2452 (35S::G2655)
aagtttaatttccctagagtgtctttaccttttgccttgtctccctctcgagacaaaaagagaaagagaaacactttctgtcctctttttttttcctctctttttctctctcgctggaaaccttttcatattcaagtgtaattttaatatttcaagcaattttctagctaattatggccttggaggctgtagtttacccgcaagatccgttctcctacatctcttgcaaagattttccgttttacgacttatactttcaagaagaagaagatcaagatccacaagatactaagaacaacattaagctagggcaaggacaaggacatggttttgcgagtaataattacaacggtagaaccggagattatagtgatgattataattacaacgaagaggatctccaatggccacgagaccttccttatggatctgccgtcgacaccgagagccagcctccaccgtcggatgtggcggcgggaggagggaggaggaaaaggaggaggacgaggagtagcaagaacaaagaagagatcgagaaccagaggatgactcacatcgccgttgaaagaaatcgccggaaacagatgaacgagtacctcgccgttctccggtctctcatgccaccttattatgctcaaaggggagatcaagcatcgatagtaggcggagccattaactacttaaaggagcttgagcatcatttacaatcaatggaacctccggttaagaccgccacagaagacaccggagccggccacgaccagaccaaaacaacctcggctagttcgtcgggaccattctcggatttctttgcatttcctcagtactcgaaccggcctacctctgcggcggcggctgaggggatggcggagatagaggtaacgatggtagagagccatgcgagtctgaaaatacttgcgaaaaagagaccgagacagcttcttaaactggtctcatcgatacagagcctaaggctcactcttctccatctaaacgtcacaactcgagacgactccgtcctctattccatcagcgtcaaggttgaagaagggagccaattgaatacagtagaagatattgcagcagctgtgaatcaaatcctaaggaggatcgaagaagagtcatcctttagctagtattgttgaattttagttatggcacatttagaggagctct

SEQ ID NO: 4395 - DNA, 772 bp, Artificial Sequence
  P2454 (35S::G2661)
catatcatgtaacagttataaaccacgacaatcacaatggatgatttcaatcttcgtagcgaaaaccctaattcatcatccaccacttcctcatcctcttcctctttccaccgtcacaagagcgaaaccggaaacacaaaacggtcaaggtcaacgtccacgttatcgacggaccctcagagcgtggcggctcgcgacagacggcaccgaattagcgaccgtttcaagattttacaaagcatggtccctggtggtgcgaagatggacactgtatctatgcttgacgaagccattagctacgtcaagttcttgaaggctcagatctggtatcaccaaaacatgcttctcttcataaacgaccacgaaactacatcatcttgtacttactctcccggcgctggagaatttggaccgaaactctttggttatgatgacgattatgcccctataatggacacatattcacaaggcgtgccacttacggttgcggactcgaagtatacgccgtggtttggttcggttgatgatgagcaagaacgtgactcgtcctagtcgttgccatatatgcaacattatgtgatttacatatccagaatctaccgtcttccttattctcgcaatacttagtaactatagtttaaggattatattatatgcgtctactatatatatctgagtgtatctaatttagagattgtaatatacatgagtatgagactaattaacctatagtatttgtattgacgtatggataatcacttggaaacacgaa

SEQ ID NO: 4396 - DNA, 1079 bp, Artificial Sequence
  P2456 (35S::G2776)
agaggcaacagcaatgagtatcttatccacaagatggttttctgagcaggaaatagaagaaaatagcataattcaacagtttcacatgaactcaatagtgggagaggtccaagaagctcaatacatttttccacactctttcacgaccaacaatgatccctcttatgatgatttgatcgaaatgaaaccaccaaagatccttgagacaacttacatatcaccttcttctcatcttcctccaaattcaaagccccatcatattcaccgtcattcttcctcaagaattctctctttcgaagattatggttcaaatgatatggaacacgagtactctcccacctacctaaactcaatctttagcccaaaattagaggctcaagtgcaaccacaccagaagagtgatgagtttaatcgaaaagggaccaagagggctcaaccgttttcaagaaaccaatccaatgctcaggatcacataatagccgaaagaaaacgtagagagaagcttactcaaagattcgtagctctttccgctctagttcctggccttaaaaagatggacaaggcttctgtgttgggagatgcattaaagcatataaagtatctccaagaaagagtgggagagttggaggaacagaagaaagaaagaagattggaatcaatggttcttgtgaagaagtctaagctgatcttggacgataataatcaatcattctcttcttcttgtgaagatggcttctcggacttggatcttcccgagatcgaggtaagattctcggatgaagatgttctaatcaagatcctttgcgagaagcaaaagggtcatcttgccaagattatggccgagattgagaaacttcatatcttgataactaattcaagtgtattgaattttggaccaactcttgatatcaccattatagctaagaaggagagtgatttcgacatgacactcatggatgttgtaaagagcttaaggtctgctttgtcgaatttcatatgattgtattaactttcatgcttctcgtcaatttctactgtgggagatcttgttgaacacatggacgaaacataagtggttt

SEQ ID NO: 4397 - DNA, 1352 bp, Artificial Sequence
  P2457 (35S::G2851)
aaaggtgatgaatagaggtgtgttggagagttcgccggttcagcagctgatggcagccggaaaccctaattggtggaacgtaagcggcggcatgaggccaccaccaccgttgatgggtcatcagcaggcgccgttgccaccacatatgactcctaataacaattatctccgaccacggatgatgcccactcccttcccgcacttcttgccatctccggcgacttcttcttcttcctcttcttcttcaccgtctttgcctaataaccctaatctctcttcttggcttgaaagcaatgatctccctcctgagtcttggagccttagccaacttcttttgggtggattgatgatgggagaggaagagagattggagatgatgaaccatcataatcatcatgatgaacaacaacaccatggttttcaagggaagataagattggagaattgggaagaacaagtgttaagccaccaacaagcttccatggtggctgttgacatcaaacaagagggtaacattaacaacaacaatggctatgtcatatcttccccgaactcacctcctaacaaatcttgtgttacaacaactaccacaacaagcctcaatagtaacgacgataacatcaacaacaataataatatgttggatttctctagcaatcacaatggtcttcacttgtcagaagggagacacactcctccggatcgatcctctgagtgtaacagcttagagattggtgggtctactaataagaagccaaggctccaaccttctccttcgtcacaatcaaccctcaaggtgagaaaggagaaactaggaggccgaatcgcagcgcttcatcagctagtatctccatttggaaagactgacacagcctctgtcctgtcggaagctattggatacattagattccttcagagtcaaattgaggctctgagtcatccatactttggtacgactgcctcggggaatatgaggcaccaacaacatttgcaaggagataggagttgcatatttcctgaggaccctggtcagctcgtgaacgatcagtgcatgaagagaagaggagcttcgtcgtcatctacggacaatcaaaatgcaagtgaagagcctaagaaagatctgagaagtcgaggtttatgtcttgtcccaatctcatgcacactccaagtaggcagcgacaacggcgcggactattgggctccagcacttggctccgccggtttccattgagccaatgaaattacgccacgtggaattccagcgttagagaaaaatgatataacatcacgagcagtcagtctactgagaaaacaacaaattgagtttccaaggctgattgctcatgatgcta

SEQ ID NO: 4398 - DNA, 2291 bp, Artificial Sequence
  P2461 (35S::G624)
cactatttctcctttctcagctgctttcaccattttctctttttctcctccatcaatctttctcacggttttctagggttttatatatgctttcctcttcatccatgtcatcgtcttcgttatctgctagattttgcttcaaccacgaatgttttgagttcaaactcgaccattgccgtcctggttggcgtctccgttctggcgatttcgtcgacctctgtgatcgttgcgcctctgcgtatgaacaaggaaagttttgtgacgtatttcaccaaagggcttctggatggaggtgttgtgagtcatgtggaaagcgaattcattgtggatgtattgcgtctgcttctgcttatacgttaatggatgctggaggaattgagtgtttggcttgcgcaagaaaaaagtttgctttgggacccaatttttcgccatcaccgtcctttcttttccagtctccaatttctgagaaattcaaggacttgtcgatcaactggagttcttcaactagatcaaatcagataagctaccagcctcctagttgtttagatccttcagttctgcagtttgattttcgtaatcgtggaggtaataatgaatttagtcaacctgcttctaaagaaagggtcactgcatgtaccatggagaaaaaaaggggaatgaatgacatgatagggaaattaatgagtgaaaactcgaaacattatagagtatctccttttccaaatgtcaatgtatatcacccactgatctcactaaaggagggtccatgtgggacacagcttgcgtttcctgtgccaattacaacaccaattgagaaaactggtcactctagactagatggaagtaatttatggcacacacgtaattcttctccgctaagtcgcttacacaatgacttgaatggtggagcagactcgccattcgaaagcaaaagtcgtaatgtgatggctcatcttgagacgccaggaaaatatcaggtggttccacgattttggcccaaggtttcatataaaaaccaagttctgcagaatcaatcaaaagaatctgaatccgttgtcactcctctctttgagaagatcctgagtgcaactgatactggaaagcggctggtcctgccaaagaaatatgcagaggctttcttgccccaactttcccacaccaaaggtgtgcctctcacagtacaggacccaatgggtaaagagtggagatttcagtttcgcttttggcccagcagcaaaggcagaatatatgttctagagggagtaactccattcatacagaccttgcagttgcaggctggtgatacagtcatattcagtcgattagatccagaaaggaagttaattttgggattcagaaaggcttcgattactcaatcgtctgatcagcaggctgatccggctgatatgcattcaccgtttgaagttaagaagtctgcttatataactaaagaaaccccaggagtagaatgttcctctggtaagaagaaaagcagcatgatgattacaagaagtaaacgtcaaaaagttgaaaagggagacgacaacttgctgaagctaacatgggaagaagctcaaggatttctcctgcctcctcccaacctcactccatctagagttgtgatagaggattacgagtttgaggagtatgaggaggctccaatcatcgggaagcctactgatgttgcaggtttcagatcaacgtgcactgaagttgaaggactgttgatatcaccaacaaccacaaagcacccacgacatagagatggctgtacttgcatcatttgcatacaatccccaagtgggataggtcctaaacacgaccgatgctgttcttgtgcagtctgcgacactaacaaacgccgtaggcgttccctgttgctacggagggaaaagaagcagatggagaaagaagacaatgcgcgcaagttgctcgagcaactgaattctgataatggacttcaccaatctgctaacaacagtgagaatcatgagcgtcatgcttcgcctttgaaagttcaattagatttgaacttcaaaccagaaaaggacgaagaatctctccctggttctaacaaaactaccaagagcgagactctgcctcatgatgacacagtaaagtctagcttcacgtcaccaagctcatcaagtgctcatagccaaaataacaaggaagatgaaggaaaactcaagacaaccacagaaattgcagacaccaccaccacaagctccatgtagattttgcagactcttatagctgcaaggtgaatagattatgatgggaaacaccag

SEQ ID NO: 4399 - DNA, 626 bp, Artificial Sequence
  P2466 (35S::G468)
agagctagagatatgggaagagggagaagttcatcgtcttcttcaatagagagtagcagcaagagcaacccattcggtgcttcgtcaagtactcgaaacctaagcacggacctgagactcggactcagcttcgggacatcctcagggactcaatatttcaacggtggctatgggtactccgttgcagctccggcggtagaggatgcggaatatgtggcggctgtggaggaggaagaagagaatgagtgtaacagtgtagggagcttttacgtgaaagtgaacatggaaggagttccaattggaagaaagatcgatctaatgtctcttaatggctaccgcgacttgatcagaacccttgatttcatgttcaacgcatccattctctgggctgaagaagaagacatgtgcaatgagaagagtcacgtgctaacgtacgcagataaggaaggtgactggatgatggttggagatgttccttgggagatgttcttgtctactgtgagaagactgaagatttcaagagctaattaccactactgatatataagtctacgtacttgttgtgtttaaatcgaagtaatgccaagaaaaaagtttttgcctgatgtaaatcaatggtcggatat

SEQ ID NO: 4400 - DNA, 979 bp, Artificial Sequence
  P2470 (35S::G2747)
ggtgaggaagtcaaaatcttgagagatctgagattgtaagaagatgaatcaagaagataaagagaagcctattgaagaagcttcttcatcaatggagagagaacacatgttcgacaaagtagtaacaccaagcgacgttggcaaactaaaccgactcgtgatccctaagcaacacgcagagagatacttcccattagataactccacaacaaacgacagcaacaaaggtttgcttctaaacttcgaagatcgaagtggaaactcatggaggttccgttactcttactggaacagtagtcaaagctatgtcatgactaaaggttggagccgttttgtcaaagacaagaagcttgatgctggagacatcgtttcttttcagagagattcttgtaataaagacaagctttacatcgattggaggagacgacctaagattcccgatcatcatcatcagcaattcgccggagctatgttccctaggttttacacttttcctcatcctcagatgccgacaaattacgaaactcacaacctttatcatcgatttcatcaacgagatctaggaattggatactatgtgaggtcaatggagaggagtcatccaacggctgtgattgaatctgtgccggtgatgatgcaaaggagagcacaagtggcttcaatggcttcgagaggagagaagcggttaaggctgtttggtgtagatatggagtgcggaggaggaggagggagtgtgaatagtacggaggaagagtcgtcgtcttccggtggtagtataccacgtggcagagtttctatggttggtgctggttctctcctccagttgaggttagtgagcagtgatgatgagtctttagtagcaatggaagctgcaagtcttgaggatcatcacttctttacaaagaaaggaaaaccttctttgtcttttgatttggataggtgatgattatgcatgagattaatcactatttaaaaatgc

SEQ ID NO: 4401 - DNA, 575 bp, Artificial Sequence
  Artificial sequence
  P2472 (35S::G2129)
tttgagatcattttaaattgtcctctcttttattttccggttaagcaccatgatgtctactatttccccggttttctcaaccgaaccgggtctattaacctctgtcctcccagcttttgaaaccagtttcactccatgggacatttcacacctcttctcggtcttcgattcattaatcgatccaaaaccggtttcgacccatgactatggttcagtaaaccagatcggttcagacatgtctccgaccgacaataccgacgagcggaaaaagaaacggaaattatcgaaccgggaatcggctaagcggtcaagagagaagaaacaaaagcacttggaggagatgagtatccagctaaaccaactcaaaattcagaaccaagaattgaagaaccagcttcggtacgttttataccattgtcaacgaacgaagatggaaaatgatcgtctacttatggagcaccgtatactgcatgataagttgttgaacatcagacaagttttgatgtttcgtcaaacctaacgaagctcatcaaactgtgccacttggccttgtaataacagtactgttgttacgg

SEQ ID NO: 4402 - DNA, 2214 bp, Artificial Sequence
  P2473 (35S::G1837)
ccgatttcgagagatcattcaagagggtttaatgggtatcgttgcttccaagggagatagtaatactccattgttgaatctatgtaaggagaggaaggaattgatcaaagcagctagagatgctcgttatcacttagcgagatctcatcttctttactttaaatctcttttagatttcagcaaagctcttaaacagtttcttcataaggatttggttgtgattccgtattccgatgatgattcgtctagtagtgatataatttgttctggatcagattcagactcggatacggattctgattcagattctgattctgattgtatagtctgtgatcaacctcaaacagctccgttgagcaataatgacgatcagagtcagcgaaaacccgtggttggtgatggaacttgcggtgcaagtaacaatggtcaagagggtatggagaagtcaagagaaggtttagggtttgaggggacacagttcgttagtgatccaagtgaagacgagatgaaaagttcgcaacacccttatgatatactcggtttctacaaatccgtgtataacatgcagcagtgcgaaattatcgaactggatcatagagatgatgaggttgagagtgatggatttagagaaattagggagagagaagggattcctgatttggaacctgaaagtgattataatagtctgataaggaagaataaaaagaagaataaaaagaagaagaagaagaagaatgttagagaaagctcttctgttgcaagtgaaattgataagcgagatgttgaagcgaatacttgtaatggtcaagttgcagatgagactgataattctaatgaagcttgtgcgcaagagacagaaaacactccagagattgttacggaagaagtgacgagatcagatgaggaagttgaagtagtggcaagatcagatgaggaagtttctgatgaagcgtatgagtcttcttcttcttgtttttcggaatcttctggttcgggtttgacggatctaaggaaggtagtggaaaggatcaatagtatatgcgggaaagctgcgggtaatagtgaagtctctgagttgcttgaagtaagcagagttgtttatcatcaacctttaggatctcaattcaagggatttgcttcaagagtaattggtagttccgggactacgactcgtgatttggttttaaagcgccgttttcgcttagatgatctcgctgtttcactctctatgacattagagaagctttatatgtgggaaaagaagcttcacgcagaagttacagctgaagaaaagcttagggttgcttatgaaaaagcgtacaagattctgaacaatcttgatcaaaacggagcagaatctagtgagctttacgaggcggaaactttggttaaactccatttatctaaggttaatgtttcggttcgagcggttgaatcgatttcgatgagaattcataagataagagacgaagagctttcgtttcaagtgattgagatcattaacggattcaaaacaatgtggagattcttggcgaaatgtcaccataagcagtttcgagtgattgcgagaagcaagtcttgtgttcacattgttgaaaacggatcgagctccaggaaagccacgcagcaagtcgaaaaacagattagaagatacagagaatctttgaaaggttacattgatgcacacagaggtttcgttaagcttttaaacgaatggcttaaccgaatcatcatggaggacgatgaaaccgagactgaagctcctgagatatttagggtttgcagcgagtggttaagagagattgagaatgtggatacgattaaagtgttgagtgttgttgaagaaatgagattaagatttcaagggttagggtttaagcaagtagaggaagagaaacagaggatgagaacagagagattgtctaaggagttagagaagaagacgaaggagttggaggagattcggggaacgagaggttctagtccgacgtcgaatatggttgaaccggagttgttgtttttgagagagagtgtgacgcaagaaacagaaaaacatgagagattgataagagagttaaacgacgccgtatcgatgagtttgcaagagtgtatggttcctgtctttgaggctttgggagatttttgttttgctaattttaaagcatatcagaacattgtaatcgttaccacataaactctatgattgcgtcaatc

SEQ ID NO: 4403 - DNA, 1145 bp, Artificial Sequence
  P2475 (35S::G2213)
gcaatccctatgaacattcatctttgtttttacagagactatatatgagttcgtcaaaacattcctctgtttttaactattctgctctgtttctatcactgtttcttcaacaaatggatcagaactctcttcatcatctcgattctccaaaaatcgaaaacgagtatgaaccagattcgttatacgacatgttagataagtaagttggaaaccctttgatactttttcttgctaaacaagttatctctcttttctttactgttttttctcattcgtttttggtctacaggttgcctccgcttgattctctcctagatatggaagatttgaaaccaaatgcagggttgcactttcagttccattacaatagctttgaagatttcttcgaaaacattgaagtggataacacaattccatctgatattcacttgttgacacaagagccctacttctcaagtgactcctcttcctcttcaccattggctatccaaaacgacggtctcatttccaacgtgaaagttgaaaaggtaacagttaagaagaagaggaaccttaagaaaaagaggcaagacaaattggagatgtctgagatcaaacaatttttcgataggccgatcatgaaagcggctaaagaactgaacgtgggactcactgtgttgaagaagcgatgcagggaattaggaatttaccggtggcctcaccggaagctcaagagtctaaactctcttataaagaatctcaaggtgcaacaacattaatttattaatagcatttgcttgtgattcacgagtagcgttttaggttttattatattacgttcttgatttcgaaaggttaatagtttgttcatgtttttggtgatagaatgttggaatggaagaggaagtgaagaacttggaggaacataggtttcttattgaacaagaacctgatgcagaactcagtgatggaaccaagaagctaaggcaagcttgtttcaaagccaattataagagaagaaaatcacttggtgatgattattattgatttcattttcttttagactgatgtttttttttaatcttgttgacccaattggtcaatctagattatctagggaatgtttctttaggttttcctcattgaacttgtttatcaattatttt

SEQ ID NO: 4404 - DNA, 1175 bp, Artificial Sequence
  P2480 (35S::G3083)
gggacggaggacccaaaatatgagccaagagacagcgatagcaagcttcaagaaattccaacagtcatggatcgagcagctacgaaaccacctgaaccacctccgctccgcccaaaaccatcaccggaactctgctaccggtgatgaggaacggttaagggaggctgtggacagagtgatggaacactttagagaatatcacagggccaagtgggctgcgacggataaagacgtcatcgaagttatggcttctccttgggcttcagctcttgaacggtcgcttcagtgggtcggtggttggcgaccaaccaccttgttccatctggtttacactgagtcgagtattttatttgagtctcgtatcgttgatatacttcgtggctttcgcaccggtgatctcagtgatctctccccttctcagttcaggttctacacgaacccctaattagctactttgtttactaatcacaactactagtaaagatttttttatctaatttaataaaatatccttaagttacgttgtaatttgattgaagtaatatcgtgatttgcgcgtgttattgtttaccaaaactaatacaggttcactcctacacctagagatatcaaatatgtagattagtttagaacatacgatgtttatttgtttacttttcttaccaaaaatgttttagaaagtgaaaaacacatttgagggataacaataaatttgagagattaaaacacttattttactttcttttttttcaatgtgtaaacaataacatatggactaactaaacatattttgattacttaatatttaatatttagggttccatttgtcaaaggcaggacggtaagtgagctacaatgtgagaccgtgaaggaagagaatgcgataacggaagagttgtcggagtggcaagacgatgcgagtgaccttgtcatggggacatcgtcagatcccgaccagaggatccgacggctagcagaaatcgtccaccgaactgatgatctgcgactgagaacgatcacacgtgtggtggaggtcttgagtccgctccaacaagcggagtttcttgtcgctgcggctgagcttcgtacaggcgttgctggttgggggactagccacgaccgtcgtcgaagttccgaagtttaaagctaactaaaaccggtctaaaggtaatgag

SEQ ID NO: 4405 - DNA, 524 bp, Artificial Sequence
  P2483 (35S::G2628)
ctcataatttcaatcttttagaagggactccatcgcgtaacaataatttcaactcaatgttccaacaaaacttacatgatgaagacgacgtccatgttcaagaccatgtctacaatcatgaccagtaccatcatcaacaaccgaatgttgtgacggatgaagagaagaggttaaggagaatggcgtctaatcgagaatcagcaagaagaacgcggatgcgtgagcggatgatgaaagaggggttgcaaatgcaagtaaaacaactcatggcgtacaatcaattcttgtataacaaatatattagcttgttggagtacaatcaccagatcttgcaagagaattcacagctcaaagagacagtttcatcctttcatgatcaatatactatatcttatggaaaccatgaaggtatacttggaaacaccaatgatttcgatttaaaccaactatcttcgtatcaaccatcttaactggtaagtcgaaaaatattatttttagtggaaaatggttctaatgtaattagc

SEQ ID NO: 4406 - DNA, 2837 bp, Artificial Sequence
  P2490 (35S::G2207)
ctctgacttatgttgcttcattgattttggagatatatccatggaagatagtttccttcaatctgagaacgtggttatggacgctgacttcatggatggattgttactagatggttgttggttagagactacagatggatctgagtttcttaacatagctccttcaacttcttctgttagcccttttgatccaacttccttcatgtggtctccaactcaagatacatcagctctttgcacatcaggagttgtatctcagatgtatggtcaggattgtgtagaaagatctagtcttgatgagtttcaatggaacaaacgatggtggattggaccaggaggtggtggttcttcggttactgagaggttggttcaagcagttgaacacattaaagattacacaacagcgagaggctcacttattcagttatgggttccggttaatagaggcggtaagcgagttttgaccacaaaggaacaaccttttagccatgatccgttgtgtcaaagacttgcaaactatagagagatctctgtgaattatcacttctctgctgagcaagatgattccaaggctttagctggtttgcctgggagggttttcttggggaagcttcctgaatggactcctgatgttaggtttttcaagagcgaggagtatccgagagtacaccatgctcaggactgcgatgtccgtggaacgctggcgattccggtgtttgaacaaggtagtaagatttgcttgggtgttattgaggttgtaatgaccactgagatggttaaactaagacctgagcttgaaagcatttgcagagcacttcaggtttgtgttcttctctaaagctttcagcttttgctatagaaatggttttctgagagtgatgaatgtgtttcctttttgcaggcagttgatcttaggagcaccgagcttccgattccaccttctctaaaggtaatcaaagaaactacatgagttccttatgttcagcttttgggtataaacaagattgtttcttctttattcagggatgtgacttatcctacaaagctgccttacctgaaatccgaaacctcttgagatgtgcttgtgagactcataaactacctttagctcagacatgggtttcttgtcaacagcaaaacaaaagcgggtgccgtcacaacgatgagaactacatccattgcgtatcaaccattgatgatgcttgctacgttggtgatccaacagttcgtgagttccatgaagcttgctctgagcatcacctcttgaaaggccaaggagttgcaggtcaagccttcttgaccaatggaccttgcttttcatctgatgtatctaactacaagaaatcagagtaccctctctctcaccatgctaatatgtacggtttacatggcgcggttgcaattcgcctgcggtgcatccacacgggctctgctgatttcgtcttagagttctttttgcctaaagactgcgatgatctggaggaacagaggaaaatgttgaatgctctttcaactattatggctcatgtgcctagaagcttaaggactgttacagacaaagaactagaagaagagagtgaagtgatagagagggaagagatagtaacgccaaagatagaaaacgcatctgaactccacggaaattccccatggaatgcctctcttgaagaaatccagcggagtaataatactagtaatcctcagaatcttggactggtatttgatggaggagacaaaccaaatgatggttttggcttaaaaagaggttttgactacaccatggattctaatgtcaatgagagcagcactttctctagtggtggtttcagtatgatggccgagaaaaagcgtacaaaagcagataaaaccatcactttggatgttcttcgacagtatttcgctgggagcttgaaagatgcagccaagaatatcggtggtaagcagcatttttttatcttctcgattcaatttatcggaaagtcctgagactgatctcttctttttgcccttttcttgtcttggaaattttcagtttgtccaacgaccttgaagagaatatgcagacagcatggtatacaaagatggccttcaagaaagataaaaaaagtgggacattctctgcagaagatccaacgagtgattgattcggttcaaggtgtttctggtcctcttcccataggctcattctatgcaaatttccccaatttagtctcacagtcacaagaaccatcacaacaagccaagaccacgcctcctcctccgccgccagtgcagcttgcaaagtcccctgtatcctcgtatagtcacagttcaaactctagccaatgttgctccagtgaaacccaactaaacagcggtgcaacaaccgatcctccttcaactgatgtaggaggtgcattgaagaagacgagcagcgaaatcgagcttcaaagctcgagtcttgacgagacaattttgactctctccagtttagaaaacatccctcaaggcaccaacttgttatcatctcaagatgatgactttctgaggattaaagttagctacggagaagagaagatcagattacggatgcggaattcgcgcaggttaagagatctattgtgggagattgggaagcggtttagcatagaggatatgagcaggtatgatctaaagtacttagacgaagacaatgaatgggttttgttgacttgcgacgaagatgtagaagagtgtgtagatgtctgcagaactacaccgagtcataccattaagcttttgcttcaggcttcttctcatcatttccctgaacgttcttcagctactgaatacagtttatggcactgaccttaaatcag

SEQ ID NO: 4407 - DNA, 780 bp, Artificial Sequence
  P2499 (35S::G1988)
caccatcatcattccaaaccaattctctctcacttctttctggtgatcagagagatcgactcaatggtgagcttttgcgagctttgtggtgccgaagctgatctccattgtgccgcggactctgccttcctctgccgttcttgtgacgctaagttccatgcctcaaattttctcttcgctcgtcatttccggcgtgtcatctgcccaaattgcaaatctcttactcaaaatttcgtttctggtcctcttcttccttggcctccacgaacaacatgttgttcagaatcgtcgtcttcttcttgctgctcgtctcttgactgtgtctcaagctccgagctatcgtcaacgacgcgtgacgtaaacagagcgcgagggagggaaaacagagtgaatgccaaggccgttgcggttacggtggcggatggcatttttgtaaattggtgtggtaagttaggactaaacagggatttaacaaacgctgtcgtttcatatgcgtctttggctttggctgtggagacgaggccaagagcgacgaagagagtgttcttagcggcggcgttttggttcggcgttaagaacacgacgacgtggcagaatttaaagaaagtagaagatgtgactggagtttcagctgggatgattcgagcggttgaaagcaaattggcgcgtgcaatgacgcagcagcttagacggtggcgcgtggattcggaggaaggatgggctgaaaacgacaacgtttgagaaatattattgacatgggtcccgcattatgcaaattag

SEQ ID NO: 4408 - DNA, 1033 bp, Artificial Sequence
  P2501 (35S::G1999)
ctccttttgtgccagtttcttcttctactttgatttcttctcatatctctgttttcatgttttgcgcagaaattatgatttcaaagtaccaagaagatgtcaagcagccacgagcttgcgaactttgtctgaacaaacacgcagtttggtactgtgcctccgatgatgctttcttgtgccatgtttgtgatgaatcagtgcattctgcaaaccatgtagcgacaaaacacgagagagtttgtcttagaacaaacgagatatcgaatgatgtgcgtgggggaacaacattaacctcggtttggcacagcgggtttcgaagaaaagcaagaactcctagatctcggtatgagaaaaagccacaacaaaagatagatgatgagagaagaagggaagatcctcgtgttcccgagattggaggcgaagtgatgtttttcataccagaagcaaatgatgatgatatgacttctcttgtgccagagtttgagggattcacagagatgggattcttcttgagcaaccacaatggtactgaagaaacaacgaaacaattcaactttgaagaagaagctgacacaatggaggatctatattacaatggagaagaagaagataaaactgatggagctgaagcatgtcctggacaatatttgatgagctgcaagaaagattacgacaatgtcataacggtttcagaaaagacagaagaaattgaagattgttatgagaataatgcaaggcatagactgaattacgaaaatgttatagcagcttgggataaacaagaatctcctagagatgtaaaaaacaacacaagtagcttccagctagttcctccagggatagaggagaagagagtaagaagtgagagagaagctagagtttggagatacagagataaaaggaagaatcgtttgttcgagaagaagataaggtacgaggttagaaaggttaacgccgacaaaaggccgagaatgaaaggtcgatttgtccgacgatctttagccatcgactcttagggaacagattctctcag

SEQ ID NO: 4409 - DNA, 726 bp, Artificial Sequence
  P2502 (35S::G2432)
cttaatcacaactctctctttaatctctttgtctctctctctctctctctatctctctctcattttaatggcgacccaagattctcaagggattaaactctttggcaaaaccataacattcaacgccaacatcacacagacgataaaaaaagaagagcagcaacaacaacaacagccagagctacaagcaacaacagccgttagatcaccctcatcggatctgacggctgagaagcgtccagacaagatcataccatgtccgagatgcaagagcatggagactaagttttgttacttcaacaactacaacgttaatcaaccaagacacttctgcaaaggttgtcaacgttactggaccgccggtggagctctccggaatgttcccgtcggtgccggtcgtcggaagtcaaaacctcccggacgtgtcggtgggttcgctgagttgcttggagctgcgactggagctgttgatcaggtcgagctagatgctttgctagtggaagagtggagagctgctacggcgtctcacggtggtttccggcatgattttccggtgaagaggctccgttgttacaccgatggtcaatcttgttaattatttttacatttttatttgtttgttttcgggtttgggtttgggtggtttgctataatttaacccgtagaaagaaagaacgtggttaaatttgctttgctttgattaactctggatacgtacaggctagc

SEQ ID NO: 4410 - DNA, 1267 bp, Artificial Sequence
  P2505 (35S::G1998)
gatcttacgtgtgttttactaatcgtgaaacaatatcaacgtcagattcttctctatacacttttctttaagtttacccaatcatcatgtctccaagtatggagccaaagtgtgaccattgtgcaacctcgcaagcattgatttactgcaaatccgatttggctaaactatgcctaaactgcgacgtccatgtacactctgcgaatcctctgtctcacaggcacatacgctctttgatctgcgagaaatgcttctcacagccagccgcaatccgctgtctcgacgagaaggtttcatactgccaaggatgtcattggcacgaaagcaactgttcggagttaggacacagagttcagagcttgaatcctttctctggttgtccttctcctacagattttaacagaatgtggtcttcaattcttgaacctcctgtctccggcttgcttagtccgttcgttggttcttttcccttgaatgatctcaacaataccatgttcgataccgcttattccatggtaccacacaacatcagttacactcagaatttcagtgataatttgtctttcttttccacggaatctaagggatatcctgatatggttcttaaacttgaagaaggagaagaagatctatgtgaagggcttaacttggatgatgcaccattaaactttgacgtaggagatgatattatcggatgttcatcagaagtacacatagaaccggaccatacggtaccaaattgcctattgattgacaagactaacacatccagctttaccggctccaactttactgtagacaaggctctagaggcatcgccaccaggtcagcaaatgaacatcaacactggacttcagcttcctctatcacctgtcttgttcggacaaatccatccatctcttaacatcactggtgaaaacaatgcagctgattaccaggattgtgggatgtctccagggtttataatgagtgaagcgccatgggaaacgaattttgaagttagttgtccacaagcaagaaacgaggctaagttgagatacaaggagaagaaattaaagcgctcttttgggaaacagattcgatatgcatctcgcaaagcaagagctgacacgaggaaaagagtgaaaggaagatttgtgaaagctggtgacagttatgattatgatccatcatcaccgacgacgaacaattgaaatttacaaaaataatgtacagtcttctttcccaaacagacttaaaccatgcttcatgatgatgataaaggttg

SEQ ID NO: 4411 - DNA, 1614 bp, Artificial Sequence
  P2508 (35S::G319)
caagcttgagatctcatatctacaatgcctttctttctttcaaatctatagatctcaaattttacactgttcgtatcttttttttttcttttttttttttgtttttaaattaagtgtaaaaaatgggatcaccattgtgcgagcatttggctaggctttgtcttcaatgtgatttgaagttacactctaagagtagtgtaaacaattacaactattcgcggattccgttgtgtaataattgcgtttcgcagaccgctcttgtagaatcccttgaacaagggttgtgcctatgccaatcatgcttttcaaatcccaatgtaatctcgcgttttcttcttcttcttagaaacgatgctagtgattattcggcatataattttccactggatcttgattcctcttcttcgtcttgttcatcttcttttatcgatcgcaattgggaattttcccttggttccttacctctcaataatgaggactcatcatcatcttttgaaatccttcaaatatttgaagatcatacaaagaattatagtgatcaacaagtgttgacgcttcagcccgattatttggacataattcctaaggtatatacttatttatttttattttgttaaagaggggttttgttcattgttatgagatatatatgtttgcttaactcgttccattgtttcctgtgtgtcacttttacgcaggatagttcatgctcaggcttcaaaagctacgaaactaaagaagatatagagaatgttttgatgaacacttttgatggcgccgaggcagcagtattagacctaaaacaatataaccccgaggaagatttgatcctcacggagctaatcgatgaattagcaagagacaattcagagaccacgccgaccaatgtaaacatcagctttaattctgtcgcatattaattatctttaattatggttgacttatttatatatttttgtttcattgtgtaatagactttaccaacttcagcatctggtatgtcatcggatatacataaagattacaacactgaagctttggctaatgcaagttctcaagattattttataaaccaaatgattggctcaaaagcaaaggaagagaccaatgatcttgcaatactccctaacgctcttgttcaacttgactgtggacaatcgcagttgatacttaccgatgagatgttaccatgggagaatcaaacatttgtacctgttaagggatttagtccgaaagatcgagaagaggccaagaaaagatatttcgaaaagaagaagaaacgcaagtaggtattacacctcattatacttataggtagataactccatgcaagtgtatacgtacttacaagttcaaatttataacaatgcaggtttgggaaacaaattagatatgaatctcgaaaatctacagcagatacgaagaaaagaatgaaaggaagatttacaaaagctggtgctgattatgactatgacccacgagctaatgatattaacaaagggaaaatacaaacatgagctaatgataaccaagctcaattgtgatatccaaataaggaaaataaaaagatggttgcaataatatatatgatgatcatcatcattatggttccat

SEQ ID NO: 4412 - DNA, 1096 bp, Artificial Sequence
  P2513 (35S::G646)
gtttcggctgatctgaggaagttcatctatggatacggctcagtggccacaggagattgtagtgaagcccttggaagaaatagtaacaaacacatgcccaaagccgcaaccgcaaccgcttcaaccgcagcagccaccgtcggtgggtggagagaggaaggcaaggccagaaaaggatcaagctgtaaactgtccgagatgtaactcaaccaacacaaagttttgttactacaacaattatagtttgacgcagccaagatacttctgcaaaggttgtagaaggtattggaccgaaggcggttcgcttaggaacattcctgttggcggtggctcaagaaagaacaagagatctcactcttcttcttctgatattagtaacaatcactcggattctacacaaccagctacaaagaagcatctctctgatcatcaccaccacctcatgagcatgtctcaacaaggtttgaccggtcaaaaccctaaattccttgagacgacccaacaagatctcaatttaggtttttcaccacatgggatgattaggaccaacttcactgacctcatccacaacattggcaacaacaccaacaagagcaacaacaataacaatccattgattgtttcttcatgttctgccatggctacttcttctctggatctcataagaaacaatagtaacaatgggaattcttcaaattcttccttcatgggatttccagttcataatcaagatccagcatcaggagggttttcaatgcaagatcattacaagccttgcaacacaaacaccacactgctagggttttcattagatcatcatcataataatggatttcatggagggtttcaaggaggagaagaaggtggagaaggtggtgatgatgtgaatggaaggcacttgtttccttttgaggatttgaaattgccagtttcttcttcatcagcaacaattaatgtcgacattaatgaacatcagaagcgaggaagcggtagtgatgcagctgctacgtctggtgggtattggactgggatgttgagtggaggatcatggtgctaattaatttctcggtttggttgatgaagatagtactattag

SEQ ID NO: 4413 - DNA, 807 bp, Artificial Sequence
  P2519 (35S::G2930)
ccatcggtggtaggaaagagcacaagcctcttttttgttcctcttgccgtcgtatatatatgtcttctcaaccgaatcatcagacttcaatatcaagtttactccatgatcgcttgcatatccctcctgcagaaacaatcgttgagaaagagtctgcagagaaggacacttgtcaatcacaaagaaaaaggaaagaaccagttttgcatgaggttgatggctcaagtagtggtgcagcaaagaaacaagaccataacgctaaggagcgtttaaggaggatgagacttcatgcctcttacctcactcttggcactcttcttcctgaccattcttcttcttcttcaaagaagaaatggtctgcaccatctataatcgataatgtaatcacttacattcccaagctacagaatgaagttggagagctaactctaagaaagcagaagcttgtggagttagagagacgaggtccttctattcgagcaatctcggttcttgaattgggggaatcaggttatgaggctgttgtacagatatgcttgaagaaagaaaacgaagatgagttctccaacttgcttcatgtaatggaggtgcaaggtttgagtgttttaagtgcttctacttctcaagtttgccgagagcaaagggtggtttgctacaacttccatgtcaagatggatgagaagccatgtgaaggtgatgactacatcacagtgttaaagaacaacatcatttcttcgcttcgtgacaacacaaagtgcaaatgatatatagtgaggtatagaatcaacagaatatctttgatgatgc

SEQ ID NO: 4414 - DNA, 557 bp, Artificial Sequence
  P2520 (35S::G3021)
ctcccttgtagactttcatttgcagcaaaaatagtttctcatatggagaggcaaatcataaacaggaagaaacgagtgttttctcttgaaccaaacaagaaccctagtgcagttttcacgagaaaatacacaagccacttggttcctgcactcaagaagctcaacatgaacaagaactcttcaaaacaaaccgtgaagcatgaagtagatatggctttggctttgtctgctcaagaatttgcatggagccgtttcttgctgcagaagctatcgtcctcatcgaatccaaccactaccactagttcttcttccgatggaattcggattcttgaaagacccgataaagaaggcggaaacgaagaaggagggatagaggagagactgagggaattgaagaagcttttgccaggtggggaagagatgaatgtggaagaaatgttgagtgagattggtaactacattaaatgtcttgagttgcagacgattgctctcaagtccattgttcaagatagtacttgacttttagtttaagtgtataatttatagtttgtttcatg

SEQ ID NO: 4415 - DNA, 1926 bp, Artificial Sequence
  P2528 (35S::G3044)
gtgtagaaagttgagtttcatgtgatcaaaattggggctttactacttttaagagaatgagtgacaaagacgagtttgccgcaaagaagaaggatttggtcaatacgccagtggatttgtatcctccggagaatccaatgttgggtccttctccgatgatggattcattcagagaaactctttggcatgatggtggtttcaatgtccacacagatgcagacacttcctttagaggtaataataatattgatatacctcttgaaatgggttggaatatggctcagttccctgcagattcaggattcattgagcgtgctgcaaagttttctttttttggatgtggtgaaatgatgatgaaccaacaacaatcatctcttggagttccagattcaactggcttgtttcttcaagatacacagattcctagtggatccaaactagataatggtcctcttactgatgcatctaagttagtgaaagagagatcgattaataatgtatcagaggattctcaatctagtggaggtaatggtcatgatgatgctaagtgtgggcaaacatcttccaaggggtttagtagtaagaagaggaaaagaattgggaaggtatagagatttgtagcactccttttgtattttgtgttttttggtctttcgttgataatatttctgttggtaggattgtgaagaagaagaagataaaaagcaaaaggatgagcaaagtccaacttcaaatgcgaacaagacaaacagtgagaagcaaccttctgattctttaaaggatgggtatattcacatgagggcacgaagaggccaggctactaatagtcacagtcttgctgaaagagtaggaacaatatttttttgaagttgaatagaaagcaaatttcttttgttgttgtatttgaatttggttaaacttgttatcgtaggtaagaagagaaaaaatcagtgaaaggatgaagttcttgcaagatcttgtgccaggttgcgacaaggtaagtccttttctttttagatgttgatgtctacatgtagaagaatggaagctgaagctgttttcttttcatataaatgggacattgcatttattgtgtaggtgactggtaaggcagttatgctcgatgaaatcattaactatgtgcaatcacttcaatgccaaatcgaggtttccctttgtttgctttgggaatttcctattttcttagtgtctgttcttgagacttcatttaattagcaacctcactttgtgttagttacttcttccatgcatttcagtttttatcgatgaaactttcggctgtgaatcctgtgctcgattttaacctcgaaagcctccttgcaaaagatgtaacatatgttgaaacccttctctttcttatcatttgacgagtaacttcattgatatgatgttgatgtcttctatatattcatgcaggctcttcaatcatctgcaccgacatttccccacaacatgtcgatgctttatcctcctgtatcgtatctctctcaaacaggattcatgcaaccgaacatttcctcaatgtcgctattgagtggaggattaaaacggcaggtacatatatttggttgcgcattgtactccaacaataaacatatctttgcagaatcatttctttctcttgcattcatctaatattgttagtgagttttgaacaggaaacacatggatatgaaagtgatcaccacaatcttgtccacatgaaccatgaaaccggcactgcacctgatcatgaagatacaacaggtgaaagtaaaagccctataagtttcatacttttgtaaccagatacttgaaactcgctaaagcttttcatgtttatctgatcttacagctgacatgaaggtggagccgtagatgtttcttcttcactttgtactcagctttagctgctgatatagtgcg

SEQ ID NO: 4416 - DNA, 1375 bp, Artificial Sequence
  P2531 (35S::G2791)
gaacaaatgaaacggccagtaaattaaaaaaatagaaatcaaatttttttgaaaagaataaaaacaggggagggaacagaggaagaaaccagaagaagagaagaagagatggaaaatggaaatggagaaggaaaaggagaattcataaaccaaaacaatgacttcttccttgattccatgtcaatgctctcctctctccctccttgttgggatccatctcttcctcctcctcctcctccgccacaatctcttttccacgctctagccgtcgacgcccccttccccgaccagttccatcatcctcaggtaccaaaactattatcttacatcataactcaccaaaactaagaatgtttctgatccttttctgtgttgttgttgttgtttgtcaatgcaggagtcaggaggtccaacaatgggtagccaagaagggttacagccacaaggtacagtgtcgaccacgagcgcacctgttgttcgtcaaaagccaagagttcgagccaggagaggccaagccaccgatcctcacagtatcgctgagagggtatctcattgttcacttcctccatatccttcttctcttatcttgtgtttctgattgtatggttttgtacagcttagaagggaacgcatcgcagagcgtatgaagtctctccaagaactggttcccaacaccaacaaggtattcactactttcctaatttatgaatcttgtttggatttgcataataaccgaattggttgatggtgagatgcagacggataaggcatcaatgttggacgagatcatcgagtatgttaggttccttcagcttcaagtcaaagtactaagcatgagcagattgggaggtgcaggatcagttggtccacgcctcaatggtctctccgcagaggtcagtttcttagtcccttatggctttcaacatatgtatagtggcatcaccaatcatcatcaatcgtcatggtttttggtaatgtaggcaggaggacggctcaatgccctcactgcaccgtgcaatggcttaaatgggaatggaaacgctacaggatcgtccaatgagagcctaaggtcaacagaacaaagagtggcgaaactgatggaggaagacatgggatcagcaatgcaataccttcaagggaaggggctttgcttaatgccaatatctctcgcaaccgcgatatcatcatcaactactcactctcgtggatccctctttaaccccatctccagtgctgtagcagcagaggattcaaatgtaacagcaactgcagttgctgcacctgaagcctcgtctactatggatgatgtatctgcttccaaggcctgaaccatagaatactcatgtgtttcgttttctcagtttaagtcaaacgc

SEQ ID NO: 4417 - DNA, 1050 bp, Artificial Sequence
  P2532 (35S::G2766)
cctaagcatcagattagcttttgtagggtttttcttttccggtttcatgtaccctcctaattcctctaagtccaccgctcatgacggcggcggcgatgccgacaccaatcaatatgactcagccgctggagctacccgtgatttctcctctcttggccctcaaacccaccatcatccgccaccgcagcggcagcagcagcatcagcagaatcccaacctcgtcggccattatttaccgggcgagccatcttccatcggattcgattccaacgcttcttcttcgtcttctttgttccgacacagaagctctccggctggattctacgaccaacatcttcccactgatcccaacggtttttctctaggacggccaaacggaggctacggcggaggaggagagcaagggccgtcgaggttgaagtcggagctgagattctctagtgggagtagtagccatcaagaacataattctctaccgcgaatctcggaggttgaagcggctgcagcggctagaaacggtgtcgcatcaagtagtatgagttttggaaataatcgtactaacaattgggacaactcgtcttctcatatcagtttcaccattgatcaacccggaaaacggtccaagaactccgactttttcaccttagaaactcagtatagcatgccgcaaacaactctggaaatggcgacaatggagaacttgatgaacatcccagaggactcggtgccttgtagggctagagccaagcgcggcttcgcgactcacccacgcagcattgctgaaagggagagaagaacgaggataagcgggaagctgaagaagctacaagaacttgtgcctaatatggacaagcaaacgagctacgcagatatgttggatttggctgttgagcatatcaaaggtcttcagcaccaagtagagtcactggaaaagggaatggagagatgtacttgtggggcatgcaagaagcgatgatgaatgatattgttccaagtatgatgcaataaagtatagaagaaaaggagatcacttacgaaccaaattctaag

SEQ ID NO: 4418 - DNA, 1115 bp, Artificial Sequence
  P2541 (35S::G2865)
cattacagcaaaccaaactatttgactaaagatgaaaacaacacctctcccgaggctgcattatttagtaagtcttctttgtttttttctttcttccaagattaaagaagacagacccaattatgtaagggcagtctctcctataaacctaactagttcattggaaaaaacaagagagaaaaaaaaacgattactgctgagatctaccatttctaaacctcaacccatgaatccttctaacaatcctaaaaagacaaggcaccagagtcatatgcctcaagaaagagatgaaacgaagaaggagaagaagcttctccaccgcaacatcgaacgacaaagaagacaagaaatggcgatccttttcgcctctcttcgtagtcagctacctctaaaatacatcaaggtacatatattttactccaatagtctcattgaagtcccaatcttcctatcaagttcattgatgggagatttttgttctctagggttttagttttctcaggctctttcttcgcagggaaagagagccatgtcagatcatgtaaacggagcagtaagtttcatcaaagacacgcaaacaaggataaaagatctctccgcaagaagagacgagctaaagcgagagattggtgaccctactagtctaactggatccggatccggatctggatcaagtagatcggaaccagctagtgtcatggtgcaaccgtgtgtgagcggcttcgaggtggttgtgagcagcttagcatcaggtctcgaggcttggccactctcaagagttcttgaagttcttcacgggcaaggacttgaagtcatcagctctttaacagcacgagtcaacgagaggctcatgtacactatacaagtcgaggtacggttacatatttggagttattgtagagttttttagtgtaagcttatctattgtgtaaatatgcttattcttatgtatccatatatatgatatatccacaggtaaatagctttgattgcttcgacttagcttggttgcagcagaagctaattgagcagttagtactttccacgactaggcactgaaaaaactaacatttgtcataagaatatgttcattgaatgatgcttttgtcccaatc

SEQ ID NO: 4419 - DNA, 1450 bp, Artificial Sequence
  P2546 (35S::G2859)
gaaactcagaaatggcgaatctctcttctgattttcagacatttacaatggatgatcccataagacaactagcagaactgagcaacacgcttcatcatttccaaacatttcctcctcctttctcttcttctctcgattctcttttctttcataatcaattccctgatcattttcccggaaaatctctcgagaataattttcatcaagggatattcttcccttctaatatccaaaacaacgaagagtcttcttcacaattcgataccaagaagagaaaatcattaatggaagctgtttctacgtcggagaacagtgtctctgatcaaactctctctacctcttctgctcaagtttccataaatggaaatatttcgacaaaaaatgtattttattaacctagaaaccctaatttcacacacatatattagagtactctcagtttctatgaattaatctaactttgtttttctcttttttcttattgatatcacagaattcttcaaggagagggaagaggtcgaagaatagagaagaagagaaagagagagaagttgttcatgttagagctagaagaggccaagccactgatagccacagcatagcagaacgggtaaaattgattttctctatacaaattatagtgtacataaataatataaatgaaaactatgagtaaaaaaattaaaattaactttcaggttcgacgagggaaaataaacgagagattgaaatgcttgcaagatatagtccccggatgttataaggtgattatattttgcttagactttaagaaaatatattattagttcttttattgaatatatatttggtgatgcagacaatgggaatggctactatgcttgatgagataattaattacgtccagtccttacaaaatcaagtcgaggtataacaataacaattaatttctcttaagttataggtcatctaaccaattccattcgtttcaataattatactaatttactttcttttttatgtgaactcagtttttatctatgaagcttacagcagcaagttcgtattatgactttaactcggagactgatgctgtggaatccatgcaggtacagaatctagaattataacttttaattaaaattttctcgtaagactggtgatgtttgctatgatttatttatttcttaatttaactatatggtttgatgtgattataattagatgatttaaatatcgatttttaattggaatattaaaatgcgcagaaggcaaaggcacgtgaggcagtggagatgggtcaagggagggatgggagttctgtcttccattcatcatcgtggaccctttgacttttgttttttgctctcctttttttgtctttctaattttcttcctttttttggatttaaaaagatacttttaaagattaatttcaagaaatctcgatgccatatgatatgtatacttg

SEQ ID NO: 4420 - DNA, 1276 bp, Artificial Sequence
  P2553 (35S::G2846)
ccttcgtatagcaacgatctagtagaaagcttatactaaaactttctgattctcttaatatggcggaggagtttaaagctacggcatcgatttgtggtggcggaggtggcgcgtggtggaactcgccaaggagcgttatgtctccttcggatcatttcttgtcaccatgcttcggagcggctatcacttccaatgattttagctcgcaagagaatcatctcaaatctaggatgacttgtacggacaacaacaacatcgttttcgggcagcgagaggcggattctgacagtggaggaagtaccgtgacgatggactcgacgttgcagatgatgggtctagggttttcctcaaattgttcttcagattggaaccaaaccattttacaagaagacttaaactcaagcttcataaggagctcacaagatcaagatcatggccaaggattcttatccacaactacttcaccttatatacttaatccagcttgttcttcatctccatcaacttcttcgtcctcaagcttgatacgaaccttttacgatcccgaaccaagtccatacaactttgtctccaccacaagtggttcaatcaacgatcctcaactttcttgggctaataagacaaatcctcatcatcaagtagcttatggactaattaacagcttctctaacaacgcaaactctcgacccttttggaattcttcatcaaccactaacttaaacaacacgacgccgagcaattttgtaaccactccgcagataatatctactcgtttggaggacaaaaccaagaatctgaagacaagagctcagagtgagtctttgaagagagcaaaggataatgaatctgcggcgaagaaaccgagagtcaccacgccttcaccgttgccaactttcaaggtgagaaaagagaatctaagggaccagataacttcattacaacaactagtttcacctttcggaaagacagatactgcatctgttctccaagaagctatagagtacatcaagttccttcacgaccaagtcactgttctaagcactccatacatgaaacaaggtgcctcgaaccaacaacaacagcagatatctggtaaatcgaagagtcaagatgaaaatgagaatcacgaactaagaggacatggtctatgtctcgtcccaatatcaagcacgtttccggtggctaacgaaacaacagccgatttttggacaccaacgtttgggggcaacaatttcaggtgattaaagagagagggttgtggttgtcaagacggatg

SEQ ID NO: 4421 - DNA, 1304 bp, Artificial Sequence
  P2554 (35S::G2783)
ctacggtcagagattcaaaagagttctttctctctatcttattctccgatcatcatgatgcagcagccaccacccggaggtatccttccacatcacgctcctcctccttctgcgcaacaacagtacggttaccaacaaccttacgggattgctggagctgctccaccaccaccacagatgtggaatcctcaagcggcggcgccgccatcagttcagcctacgaccgctgacgagatccggactctttggatcggggacttacagtattggatggatgagaatttcctctacggttgctttgctcataccggagagatggtttctgctaaagtgattcgtaacaagcaaaccggtcaagttgaaggatacggtttcattgaattcgcatctcatgctgctgctgaaagagttctacaaacattcaacaacgctcctatcccgagctttcctgatcagctctttagactgaactgggcatcattgagttcaggagataaacgagacgattcaccggactacacgatatttgtcggtgatctggctgctgatgttacggattatatcttacttgagacgttcagagcctcttatccgtcagtgaagggtgcaaaggttgttattgacagagtcactggacgtacaaaaggatatgggtttgttaggttttctgatgaaagtgaacagatccgtgctatgacggagatgaatggcgttccttgttctactagacctatgagaattggtcccgctgctagcaagaaaggtgtaactggtcaaagagattcataccagagctctgctgcaggggtaacaactgataatgatccaaataacacaactgtttttgttggtggattagatgcatctgtcacggatgatcatctgaagaatgtctttagccaatatggtgagattgtgcatgtgaaaatacccgctggaaagcgctgtggattcgttcagttttccgagaagagctgtgcagaggaagctcttagaatgctgaatggagtgcaattaggcggaacaaccgtcaggctctcatggggccgaagtccttcgaacaaacagtcgggggatccgagccagttttactacggtgggtatggacaaggacaggagcagtatgggtacacgatgcctcaagaccctaatgcatattacggaggctactctggtggaggatacagcggtggttaccagcagacaccacaggcaggacagcaaccaccacaacagccaccacagcagcaacaagtcgggtttagctactaaccccgagagtattgcttgagttaatgtcactc

SEQ ID NO: 4422 - DNA, 2796 bp, Artificial Sequence
  P2558 (35S::G2854)
gcatctacgacagtcgtaccttttgctaggttatcgtcgtcatgatgcagcagccacctccagcttccaacggtgctgcaacagggccagggcagattccttccgaccaacaagcttacctccagcagcagcagtcgtggatgatgcagcaccagcagcaacaacaaggtcagccgcctgcaggatggaatcagcagtctgcaccgtcttctggtcaaccacagcagcagcagtatggtggtggtggatctcagaatccaggatcagctggtgagatccggtccctgtggatcggtgacttgcagccatggatggatgagaactatctcatgaacgtctttggtcttactggcgaggtaattttgaaaatcctgttgatttctgtttttagtctctcgtttttcttctacaagtattgaaagtttcatcctttgtggttgcaggctacagcagctaaagttattcgcaataaacagaacggatattcagaaggttatggctttattgagtttgtgaaccatgctacagctgagaggaatttacagacttacaatggtgctccgatgccgagcagtgagcaggccttcaggttgaactgggctcagcttggagctggagagagacgccaggctgaagggcctgagcacacagtttttgttggagacttggcacctgatgttaccgaccacatgcttactgaaacgtttaaagctgtgtattcctctgtcaagggagctaaagttgtgaatgataggactactggacggtccaagggttatggatttgtcaggtttgcggatgaaagtgagcagattcgtgccatgactgaaatgaatggtcaatactgctcatcaaggcctatgcgtactggtcctgctgccaacaagaagcctcttacaatgcaaccaggtatgttttgatattaaggagcctgatatctgatcacttatgaataagttgagtgatgatatgactcactttgtcttacactgtctatgttagttgattgtcttttctttggggtactcctttactgctatctttctgattactggagaatctgtctacccttttctcccgcttcttgcctttcagctcttcaaagaatttaatatcgcaaaacatcctaaaacttataagaaaaaaactcatgttgtctttaagcaggagaacaagaggctctctttcgggggcctggaactgatttcagctgaaaatgattccaccttgcgtggcctcatttaggtcagttggttatgttttcagaagaagttaattacaaagcttttactccatttgcaaattattttccagtttcttacttatcaagcataagtctttccttttaatttttagccctatcttttatttcttttcatgttacatagttcattactcttcgctttattttgtccagtttgaatccttaaagagtgttttgatatctttttcatacctctcaattcatctttttccagtagttagtgctgcaatttttttccttctttcagttacgttgtgcctctaaatttatacttgcaaccttttttagtgttacatttcgtctttcggaaaagttgattacaatggtaagactgtcagaccttggaaggaatttaggttacttgtgataccctagagaatttaggtccgattctctaatttctcgaagttggatcttgcaggcacttcccctagtatatctttaatgtgcttttttgtattaattagcaactaacttcagaatcactttacctttatcttcgagctgtaacctatgtatggcatttgctttatatgttgataattttgggtcttgatttggataagttctgctactgctattgtcgtgtgtgtgcgtttgtgttagtgtctgtgtccttgcactgtcagcttaattaaataaatagatgtttgaggtttttttccttaccttctcttgactgttttattgcagcttcatatcagaacactcaaggaaattcaggagaaagtgatccaactaacacaacagtgcgtaacttgttttggtttccctaagccttttttttctttgacgttgcctaagcctttttctctgtgggatatattgttgaaattgaagcgttatgttctctattccagatttttgttggagctgtggatcaaagtgtaacagaagatgatttgaagtcagtttttggtcaatttggtgaactagttcatgtgaaaatacccgcaggaaaacgttgcggatttgttcaatacgccaataggtaaatgtgaacttggagacgaacttcatctttacttattttgagaatgttttttcacatatttaatctgtctgtatgcttcagggcatgtgctgagcaagcactttctgtgttgaacggaacacaacttgggggacaaagcattcgtctttcatggggtcgcagtccttccaacaaacaggtttgtatctgttagacaatgcaccaagcttactacgctttcatatacgttatgtgatctgatgacttgttgatccacgaatttcacagactcaacctgatcaagcccagtatggtggtggtggaggatactatgggtatcctcctcaaggatatgaagcatacggatatgcacctcctcctcaggaccctaacgcctactacggtggttatgctgggggcggctatggaaactaccagcagcctggtggataccagcagcaacagcaggtaacattctttggtttttatctgaatatcttcgaatgaaaagtatctatgttttctgtttttttgcgagataactgattcttcttcactc

SEQ ID NO: 4423 - DNA, 2347 bp, Artificial Sequence
  P2559 (35S::G2777)
aaaatgtgtattatctagggatttacttctctaacatatagtttatgtttttaattttgatggtacgtgaagcaggtagtcacttgaaaacccatgattttcttcaaccgttagaatgtgttggtgctaaagaagacgtaagtaggattaactctaccactacagcgtccgagaagccaccgccccctgctccacctccaccgttgcagcacgtgcttcccggtggtatagggacttatacgattagccccattccttacttccatcatcatcatcagagaattcctaagccggagttgtcaccaccaatgatgttcaatgctaatgagagaaacgttttggatgagaattctaactctaattgcagctcgtacgccgctgcatcaagcgggttcactctgtgggatgaatctgcttctgggaagaagggacagacaaggaaggagaatagtgttggggagagagtaaacatgagaggtaacaagaaaacttgaatcgtgatgtttatttagactagttttaaagtagtatttagaaatcaatggaatgatgaaatataagtttttttgaatgtgtagctgatgttgcagcaactgtgggacaatggccagtggcggagagacggtcccagtctttgacaaacaaccatatgagcggtttcagttctctctcttcctctcagttagtctcatatcttctcttttttatataactcggtctatggactttaaagagtgatcaactaaagttttactttggttgcagagggtctgtgcttaagagccagagcttcatggacatgataaggtcagcaaaaggaagttcacaggaagatgatttagatgatgaagaagattttatcatgaagaaagaaagctcctcgactagccagagccatagaggtttgtattgtccgagattccacctatatgatatctaaagtctaaacagtaacagcttaggatctgattgattgcttctttacagtggatttgagggtaaaagcagatgtgagaggctctcctaacgatcaaaagctgaacacacctaggtctaaacattctgctacagagcaacggagaaggagcaagatcaatgataggtaagtcctgaatatgtagcaaaagccaccagaattggttatatagcttagcagagtggagatactaatcaaacattgttaatggatccctctgcagatttcagatgttgagacaactaatacctaacagcgaccaaaagcgggataaggcctccttcttactagaggtataactatactcttttggccgaaaattttgtgacagtaagattcaatcacatctgctcctaatctccaatttttttttttgacaacttcatacaggttatcgagtatattcaattcttacaagagaaagcagacaagtatgtgacctcttaccaaggatggaatcacgaacctgcgaagctattgaattgggtaaatataatctcacattttccgaccatacttcatttttattccccgggttggaaactgaaaacaaacaaaccatgtaatgttaacccgtgtgatccatttacattatagcagagtaacaacaaccaacagctagtacctgaaggagttgcttttgctccaaaattggaagaagagaaaaacaacattccggtttcggtccttgcaactgcacaaggtgttgttattgatcatccaacaaccgcgacgacctctccatttccattgtcgattcaaagcaacagttttttctctcctgtgattgcgggtaatcccgtaccccagttccacgcaagagtcgcatcatcagaggctgtagagccaagtccgagttcccggagtcaaaaagaagaagaagatgaggaagttcttgagggtaacatcagaatttcaagtgtttactcacaagggtaaaactaaaaaactctcttttgaattttgatcttgcaacagttaagtaaaagtaaaaaattattaaccttttatacatttacttttgtgtgtggagcagattagtgaaaacactgagagaagcattggagaattcaggagtggacttaacgaaagcaagcatctccgttgaaatcgagctcgctaaacaatcctcgtcttcttccttcaaggtatctttttctttacttacgtttgattcaattcaaacacattttcatgagttggatcttgatagtttatagttttgttcacatctcgataggatcatgaagttcgtgaaccggtttctcgaaccagaaacgacaatgtcaagcaaactcggaaaccaaaacggctcaagacgggacagtagaagttataaaaacaaaacccaaacacacaatccggtaaaag

SEQ ID NO: 4424 - DNA, 2789 bp, Artificial Sequence
  P2581 (35S::G549)
gttgtatatatagaagttgctcgagtggtcatttttacaataaagcaatctgctcaaaagagtaaagaaagagagaaaaagagagtgatagagagagagagaaaaatagattatggatcctgaaggtttcacgagtggcttattccggtggaacccaacgagagcattggttcaagcaccacctccggttccacctccgctgcagcaacagccggtgacaccgcagacggctgcttttgggatgcgacttggtggtttagagggactattcggtccgtacggtatacgtttctacacggcggcgaagatagcggagttaggttttacggcgagcacgcttgtgggtatgaaggacgaggagcttgaagagatgatgaatagtctctctcatatctttcgttgggagcttcttgttggtgaacggtacggtatcaaagctgccgttagagctgaacggagacgattgcaagaagaggaggaagaggaatcttctagacgccgtcatttgctactctccgccgctggtgattccggtactcatcacgctcttgatgctctctcccaagaaggtacaataattatgaatacatatagaaatatcaaatatcgcacgttttataaatatgtgtatatattgttctcaacatttctatgcccgactttcaagaaaaagtatgtatatgttcacgtgactaatatagataactaatttatgaatcttaccatatgtatagtagttgctacataattttatgtttaagctttttttttggttaaatatattggttaagcttttgttacataatacaagataatatatgtcatatttaatttatatgttggatatatttacttgtatgatattgatttagagctactgtgtgtatagagtatgcagtcatagtctgatatttattaaatagacctagtgcaagaagtacgaggattaatgtcatgtacaggaattcaaagagtatatacgcctaaacttgaataattttttgtgattgtgacaatttatatgtagatgattggacagggttatctgaggaaccggtgcagcaacaagaccagactgatgcggcggggaataacggcggaggaggaagtggttactgggacgcaggtcaaggaaagatgaagaagcaacagcagcagagacggagaaagaaaccaatgctgacgtcagtggaaaccgacgaagacgtcaacgaaggtgaggatgacgacgggatggataacggcaacggaggtagtggtttggggacagagagacagagggagcatccgtttatcgtaacggagcctggggaagtggcacgtggcaaaaagaacggcttagattatctgttccacttgtacgaacaatgccgtgagttccttcttcaggtccagacaattgctaaagaccgtggcgaaaaatgccccaccaaggtatcttttgatttatcttctaagaactaatcctgaccgttcattatcttgaaatttatgtttcaaacaaaagtttaaaaaatggtgtcggaagttatggggtatggtaggggaactatagctataatcatggacagctgttctaaaagcaagtttgacaaatcacgatttctcagggttttcaattttttatttttttttgctatgtctcgcaacaaaatttaggttctaatttattaaatttttcattttgttttcatactgtcttcagcataaatatagttagatttcaatttcaattttgacagtaaacgtacgacaacgtgtcgagttagggaaaggacatagttgtttctttgtttttggctataacgacatgagatagttagatacgatatacaaatttttgcatgcattcacacatagtacacatagatattattagactttttgacaattaatagggatatttgttgtatgtatatattattatatctagttacagtctattgctcggcggataatagagggtcctctttcctctagtgatgatagtacagaatccatgagctctgtgccattgcttgtacagacgcacgttactaagaaaatctaatttatttgttttctttctaaatttgttattggttccaatattttgattattgtgttgtttttatcaaaaacctttttgttatctaattttttgggtttagttaagtgtcaagtctaacaagggttataaaaaatatctaacaactacggttataattttggtaggcatttttttttaatcattgtttaccgaattaaaaccaaacttattaggtttcatttttcctactatatatctcatgataaatgatttgtttgattatattgatgttggggaaaatgtgtaaataggtgacgaaccaagtattcaggtacgcgaagaaatcaggagcgagttacataaacaagcctaaaatgcgacactacgttcactgttacgctctccactgcctagacgaagaagcttcaaatgctctcagaagagcgtttaaagaacgcggtgagaacgttggctcatggcgtcaggcttgttacaagccacttgtgaacatcgcttgtcgtcatggctgggatatagacgccgtctttaacgctcatcctcgtctctctatttggtatgttccaacaaagctgcgtcagctttgccatttggagcggaacaatgcggttgctgcggctgcggctttagttggcggtattagctgtaccggatcgtcgacgtctggacgtggtggatgcggcggcgacgacttgcgtttctagtttggtttgggtagttgtggtttgtttagtcgttatcc

SEQ ID NO: 4425 - DNA, 3579 bp, Artificial Sequence
  P2584 (35S::G2455)
gttccttctttgatctcattgggataactaaaagtttcaagaagagaaacatatcattgaagagagaacccacacaaaaaaaaatgtctgtagatttctcatctgagcgtgtttgctatgtccactgcagcttctgcaccacgattttagcggtaatctccctctcctctttatattgtaaatctttctcaaaagaaagagtgttaatttggtacttactctgagctagatccccttttctctaacttaaatcaaactgttatataagatatatattatttacctatcaaagatggttggtgatatatctatatgtgtattgcatgatgaattttgcatctagttcatagatcaacatatatcttttctgtgattaattattgatgaagatatatataccggaaagtttcttaaatttcagaaaccctaaatcttattccttttttttcttctataacgcgtgatgagatacctaaaagaagcaaaagaagttcggtagttgaaacataaattttagtgctcaaacaaagtaaactcaaaggaaacagctcctgatcagatttagggctctatgagtaggttttaagtctacaaagataacttcttctttccctatttttactatttaaagaatttttatttttattttcgttttaaggacattttttcttcttctctttacaagtaaatccttcattttttactcttgtatattcatattttctttggtgttagttccctaagtttcaacagccattaatattttctgtaaaaggaatttggtagatagcatccatgtgatgcagtctcaaaattaaactttcactagggtcttccacctttatagtctgacttcatactatctaatcttttgatatgtataactgtagtatgtgacacatgtattatacttatatcatatcaatcatagatctttcatctacaagcgtggtccatgtaaaaatgtttacatcacatcaccagctgattattttaaaatcattttttgggttctccaaaattctctttttatgtttctcacagtgtgctgaagctattttattacatgtatatgattttaaaatttacttaaaacttcactaattatctccagctttatctaacggttttatgtgacatttaataatatccacagttcttccgtacatttttgatatgtgtgtatcagtgatatacgtctatctatatgtgtgtgtatataaattattgatctatgatccatataattaagtaatcatgagaaactaactagctaggttatgtagcttaatggtttagcgtttagacaaattaaaaaaaaaaaagtttatcatgagaaactcttgtacactgatattattcataaacgttatactacatatacataaataatggagatgtcgcacgagtctgattaggaacaaaaagggccatatttaataaaaatgttagaggtcttcttgcacaaaatagggtgtgtattgtagtggaaagtacaaaagatttgttctacccagttccagcaacaatttcttgatctatacaaaagctgcaaactgttaaatcatggccgatcttgaccacttaggattggatcctttctctctctctctctctctcgctcacacacaaaaatataagacgattataataaaaagatggtaccatcacatatgaaggactttatgggctgttgttaaggtcacgtcgttttctaacatgactgtcttctccttacaagcttcatcaaccattcttcatctctttactatcttttatcatgttgccttgaggtcttgtgtgtcagacatagaattcatcagaacccaccaaacagaaaaatacatattcttttatatatgttaaatttgatcatttgtttgttcgaatattagttgtggtaatacttctataaggttactattttctatttcatgtgataaaaatctataggactatctttacataggaaataggaaatctacaattaaccaaaaacaaggtgtgctatagcctataatggagtagtacttaacattctctctcaagagctctcgttacattagagaccagccactcgaattataaaatagtgataaaacaagacaattaacgtgtcccttataatgatcaagacatgtatgaatgattaggtaagtgtaccatacgcaagtttgttcacacttgtgacggtgagatgtggccattgtaccaatttgctatccctcaacattggagtttcacttcatcaaacctcagctcctcccattcaccaagatcttcaggtatcatattatattcattagtccttcaacatttttattattcccatttagaaatctggcttatatagtttttgaaatcatgaagcctcatagacagcacacaacctctctggtgacaaggaaagattgtgcatcgtcttctaggagcaccaacaattttatcggaaaacattgatcgtgaggctcctagaatgcctcctattcgccgtatgtctctctatttacctcttgcattccgtacatagtatttaaagtttgtgtaatatatgcaatcaccaagctaagtgagtccataattttcttttattttcatgtggcagcaccggagaaaagacaacgtgttccttcggccctacaacagatttcatcaagtaagtgttaatcctttgatgaaatatactaattaactctttcgctacaactttaataaactaaattgttaattagggaggaaatccaaaggattaagggcttgcaatccagagattagccaccgtgaggcattttagcactgctgctaaaaaatgtaagcttccttctttaccattctttttcacaaggtagattgttgctaagatagctcaaaaaaaaaaaaaatccttatcgtagcttcatcgacgatgtcagaattatatagaattaggaagaagatgcaaaaaaaaatgaaaaaaaaaaataactaaagttataaagtcttttaatactgtatttttagattcaataactctgtaaaatgtatttcttaactatttaaaaaataaaataaattattatctttttaaataacctaacaagtaaataaataaaaaatgatatacgaacacatgattggatagtagttttttttgtttgcaataattagtaccaactaattgaaataactgtggtgggagaattctagggcttggtcactctctttgaaaatataagtgtgtatgtataccaataagatagtggttctactatttataattggtggaatgtttatatatcacagtattagatgttttttaaaaataaatttgcctttcaatttttgggtgtagtgggcacattttcctcacattcactttggattaaagctggatggcaacaagaaaggcaagcaattagaccagtcagttgcaggccaaaagtctaatggctattactaaagcctttatatatatacacacatatatacacttatacgtatatatatgtgtatagatatatatgcgtgtgtatgatttatgtttatctttgtacgtacgcattaatgaatgtgtaagcagagagctgatgatggaaagag

SEQ ID NO: 4426 - DNA, 1614 bp, Artificial Sequence
  P2589 (35S::G2898)
gcgaacgaaagttcgattccgagaaagtgagagaaaatgacgaagagagctcccaagtcagggcctttgtctccgtcgtgcagcggaggctctagtcggtaagttttgtgtctggctttgataggttacagaacaagtttggctttttacacctggttttgctttgatttctctgtttagggtttaagggttctgcttagtctctctggttattactgattaagtggttagatagggaattggatatgaaagttgtgaactttatgctatccaatggcaaatgggtgagaagaagagcaaggaaagaggatgttagttagatttttgttaattgtgttgtaaaatcttggcaggaacttagagttggctgtgaagtcaagtgaaggtgcaaggaggtctacaagactgagacttcagcctttgagaaagccaaagacaagccccaagaagaaacccgttaaactccaaacgaagatgcccaagaaacctgccactgctttcttctttttcctgtaggtactctctctcatatgattccaaattgttatctaaatatttaagctcagctggacttccttaagtcttctcttaagtagaaatttgtgtgcattttgccattggtctttaggatgcgattatttatgttgttatgtgttctggttactttagaaaacatacgaagaaacacttgttgtattcattttcctcttgcctcatattgtcttatctttttggctccaaagggatgatttccggaagcaatatcaagaggagaatccagatgtcaagtccatgcgcgaggttgtagaatattactttgttggttttgtatgtcaaagtaaaacatggtggctattatgttcactttgattcttttgctaaagttgttttgttcttcattctgtacagattgggaagacatgtggagagaaatggaaaacaatgacttacgaggtaacatttgggtttcgcttttctgtcccagttagtctattgtctctatcttctaaaagtctcctctataatgttattcaaatcatagtcaaatgtatgatatctgacattgggatgactcacaaaagcaatgaaataggtttcatgttagcatatatagtggttggatagatatgttctaaaatgagtcaggtgttgccagtcttgttctttttggcgaacaatatctcattttattcttcttacctagatatctttggttgagaccttgacggaagtttcttactcctagattgtttgttcctcaactgttttgtaggaaaaggtaaagtattatgatatagctactgagaagagggaagaatttcaccgagcaatgacagaatataccaagagaatggtaccaccgttttcttcatttttccttgtttttgcttaatatttattcacatcagtgggttcttcatttttccttgtttttgcttaatatttattcacatcagtgtcccactgatgcggtgataaaacattagtctgagcttttcattttactattttgcaggaatcaggtgcccacgatgaatcagagaccgactcagactattctgaatagattactttttagtttctaccacattagaaacattgttctaagccttc

SEQ ID NO: 4427 - DNA, 2883 bp, Artificial Sequence
  P2596 (35S::G2372)
cttcattcgctgacttcgtttacactgaaaacaaatacctatgtcaccgccgtcggcaaccgccggtgacatcaaccaccgtgaagtagacccgacgatctggcgcgcttgtgctggagcctccgtccagatccctgtccttcactctagggtttactactttccacaaggtcacgttgagcactgttgccctctcctctctactcttccttcctccacctcgccggttccatgtatcatcacttcaattcagttgctcgccgatccggtcaccgacgaggtctttgctcaccttattcttcaaccgatgacgcagcagcagtttactccgactaattattcacgattcggcagattcgatggcgatgttgatgataacaacaaggtgactaccttcgccaaaattctcacgccttctgatgctaacaatggaggtggcttctccgttcctcgtttctgtgctgattccgtcttccctctgcttaattttcaaatcgatccaccggttcagaagctctacgtcactgatatccatggagctgtttgggatttcaggcatatctatcgcggtacaccgaggcgtcacttgctaacaacgggatggagtaagttcgtcaatagcaagaagctcatcgctggagattcggtggtgtttatgagaaaatctgcagatgagatgttcatcggcgttaggagaactccgatctcaagcagcgacggaggaagtagctattacggaggagatgagtataacggttactacagtcagagtagcgttgccaaggaagatgatgggagtccgaagaagacgtttaggagatctgggaatggtaagttgactgctgaggctgtgacggatgcgatcaatagagcgtctcagggattaccatttgaggtggtgttttatccggctgctggatggtctgagtttgttgtgagagctgaagatgttgagtcttcaatgtctatgtattggactcctgggactcgagtcaagatggctatggagactgaagattcttctcggatcacatggtttcaaggcatcgtttcctctacttatcaggagaccggtccatggcgtggatctccatggaagcagcttcaggtatatgatgtttttgaaatggtctttgctcttcttatctctataatgttgcgttaatggaacaattcagaatcgatcttgtatctgttgtgtgcaagcctttcatgagtagtttaagtctcatcctggttattcaaatgtcaattgggttttgaatgttgttttgattgctgtgttgttgttttgaaggtaaatattggaaacaggataagttaattcatacgaaaatgaatgttctctctcagattcatcttctataagatggaattgaaactggaagatttggcttagtattgtttgtgttgagcgtccgtgatgtagagttgcttttcattatccttctttggccacgcattgtacattgtgtttgttaaactagagttcctctgattagtcttatgagatactccttttttgccaatatattctacttcctctgattagttcctttgtttttaacttgcgtagatcacatgggatgaacctgagattctgcaaaacgtgaagagggtgaatccatggcaagtggaaattgctgcacatgcaactcaactgcatacccctttccctccagcaaagaggttgaagtatccacaacccggaggagggttcttgagtggagatgatggagaaatcctttatcctcaaagtggactgtctagtgcagcagcacctgatccaagtccttctatgttctcgtattctacatttcctgctggcatgcagggagccaggcaatatgattttgggtctttcaatccaaccggattcattggaggaaatcctccccagctattcaccaataacttcttaagtccgcttcctgatttgggaaaagtgtcgactgagatgatgaactttggcagtccgccatcagataacttatcgcctaatagcaacaccactaatctgtcctctggaaatgacctggttggaaaccgaggccccctttcaaagaaagttaactcgattcagttgtttggcaagatcattaccgtggaggagcattctgagagcggtcctgcagagtctggcttgtgtgaagaggatggcagcaaagagtccagcgacaatgagacacagttgtccttatcacatgctcctccaagcgtgcctaaacattccaacagcaacgcaggttctagctcccaaggtatattccgatctctctcaagtacaataatcaattgaatcagttgctataagcttttattactgttttgcacaaggcaatttctcttcctttcccatgaactatattatgtagagtaggaaacacaatcatgatttctgatatgacttgactgatgatgatacttgtgaaaactatctatatatctcttcagtaatcagtcgccttgaggtaattggaatttggaacttgaacattacttggattttaacttttcaatagcataagctttcctgtttcatcatatatgtttcactatacttggtatgcttttattactgctgatatttactattcctgctattttttttgggtctcgttaacggtaataaggacacagaattggctcttttatccatctgaactagacattactgtacaagtagatgaagaattatgtggttccattacaaatttgatttgcagaaagcttgaagctgctgcttatagacgattataatgttggaagatcctgaagcttggaatgatttgtacttttcttctggttgtgtgtgttttgacaggttaaaaagtgaaagaaagtggtggatctttgctggaatctccaagtcctaagtagtag

SEQ ID NO: 4428 - DNA, 2117 bp, Artificial Sequence
  P2597 (35S::G2567)
cgctattttgttcagatctgccactgtttcagcaaaaacggtcacaaaaaatatgataaatgtgatgaatccaatgaaaggtggaacagagaaaggtttagatcctcagctatggcatgcatgtgctggtggtatggttcgtatgcctcctatgaactctaaagtcttttactttcctcaaggtcacgccgaaaacgcttacgattgtgtcgatttcggtaatctccctattcctcccatggttttgtgtcgtgttttagccattaagtatatggctgatgctgaatctgacgaggttttcgctaaactgagattgattcctttgaaagatgatgagtatgttgatcacgagtatggtgatggtgaagatagtaacggtttcgagagtaatagtgagaaaacgccttcgtttgctaagactttgactcagtctgatgctaataacggtgggggtttctctgttcctcgttattgcgctgagacgattttcccgaggttggattataacgccgagccgccggttcagaccattcttgctaaggatgttcatggtgatgtttggaagttcagacatatttatagagggacgcctcggcgtcaccttcttacaaccggatggagtaattttgtaaaccagaagaagcttgtggcgggagattcgattgtcttcatgagagcggagaatggagatctttgtgtaggtattaggagggctaagagaggagggataggtaatggacccgaatattcagcgggttggaatccgatcggtggaagttgcggctactcttctctgttaagggaagatgaaagcaatagtttgaggagaagtaattgttcccttgcggataggaaggggaaagtgacggctgaatctgttatagaagcagccactcttgctattagcggaagaccgtttgaggttgtgtactatccgagagctagcacttcagagttttgtgtcaaggcattagatgctcgagctgccatgcggattccgtggtgctcaggtatgaggtttaagatggcttttgagacagaggattcgtctcggataagttggtttatggggactgtttcagctgttaatgtctctgatcctatccgttggcctaactctccttggcggcttctacaggtggcgtgggatgagccagatttactccaaaacgtgaagcgagttaacccgtggttggtggaattggtatcaaacgtacatccgatcccgcttacttcgttttcgccaccgaggaaaaagatgcggctacctcagcatccagattacaacaatctgatcaattcgattccagtaccttcattcccaagcaatccccttattagatcaagcccgttaagctctgttctggacaatgttcccgtgggtttacagggagccaggcataatgctcatcagtactacgggttatcatcttcggatcttcaccattactacttgaatagaccacctcctcctcctcctccatcctctctccaactttctccttctctcggtctccgaaacatcgataccaaaaacgaaaaaggattttgctttttgacaatgggaacaacaccatgcaatgataccaaatctaaaaagtcccatattgtattgttcggcaagcttatactacccgaggaacagctatcagaaaaaggctcaacggataccgcaaacatagagaaaacgcagatttcatcaggcgggtcgaaccaaaacggcgttgcgggaagggagttttcttcgtcagatgaaggatcaccttgctctaagaaagttcatgatgcatcaggtttggaaacagggcattgtaaagtgtttatggagtcagacgatgtaggtcgaaccttagacctatcggttcttggttcatacgaagaattgagtcggaaactctctgacatgtttggaatcaaaaagtctgagatgttaagctctgttctctatagggatgcatcaggagccatcaaatacgcaggaaacgaacctttcagtgagttcttgaagacagctcgaagattgacaattctgacggaacaaggaagtgagagcgttgtagtataacttggcagagtgttttgttggagcttggaagtcaaaactcaacgattgaatc

SEQ ID NO: 4429 - DNA, 2451 bp, Artificial Sequence
  P2599 (35S::G2885)
gaagagaggagacttgcaaacgtattgcatcaaatatggagtttggaagcactgaagatggaaggcatgacaagtttcctgtaggaatgagggttcttgctgtggatgacaatccaacctgccttcggaaactcgaagagttgctgcttcgttgcaagtatcatggtactacatattctttgcttttgtttttttttacctgtctgcttcggaattggggtgcatggtcaatgatgtttgattgattacgccagtgacaaagacaatggagtcgaggaaagctctggaaatgctgagagaaaacagcaacatgtttgatctggtgataagcgatgtagagatgccagacacggatggttttaagttgcttgaaattggtcttgaaatggaccttcctgtcatcagtacgtctcctaccattgtttttcatatcaactctagcccttattgtaacctgcttcattgtctcagtgttgtcagctcatagcgactatgacagcgttatgaaaggtattatacatggcgcttgcgattatctggtcaagcctgttggactcaaggagcttcagaatatatggcatcatgttgtgaagaagaacattaaatcttacgcaaaactgctcccaccttctgaatctgattccgtcccaagcgccagcaggaaacggaaagacaaagtcaatgacagtggtgatgaagatgacagtgacagagaagaggatgatggtgaggggagtgaacaggatggtgacgggtcaggtacgcggaagaagccacgtgttgtttggtctcaggagcttcaccagaagtttgtcagtgccgttcagcaattgggcctcgacagtgagtttccccatagacctctttaaacctttccttatgtgtgatgtccactcttgtttctcctatagagttattttgatgctttcatgtgtgggatcctcttttcatttctccttgtgttcatcacagaggctgttcccaaaaaaatacttgatctcatgagtatagaaggtctcactagggaaaacgtagccagtcatttgcaggtactaattccccattctctcttgcatttttccccttctttcgcaaatataatcttggatggttagacttgttttattctctggttttggttgcagaagtacagactgtacttgaaaaagatagacgaaggtcagcagcaaaatatgaccccagatgcatttggaacaagagattcatcttactttcagatggctcaacttgatggacttagagattttactgccgcaagacaaattccaagctcaggactcttatcgcgttcccatctcaccaaactccaaccccctatgtattcatcgataaatctccaaggaatgaactcctccagcttcatccaacaggggcatcaccagaactcaagcaattcagctaatccgtttggaacatatcacagtactctgtcaccaagaatccagaacgtgaatctgtttcagcgaacttcatctccactagaacccctccagtttcctagaagcaagtcatacattggagattttaaaggcttaggggacagagctattggcggtagcttcctagatacttgtatgccatttggtagctctagcacctctttaccaagtgcttccaccaatcctctaatgttgcaagcaaactatacacaacccctgcatatagcctcagatggaattcagccttgcatcgagggaactccgtccaactctgcctccccaaacatcagtttccaaggcttatctagatttcctggtcatagctggcaagggaatttgaacacaaccagattcccaccgagttccttaccactaaatcttgctttcttgccggatcaagtgacatgtgcagggaacaatctgggagattgtacttctttggtttctgcagagaatcctggtggagagatgcagtgtgatcctcaattacttggcggcttcatgcagaacgtgaatccgttaggcggacagaaatgggagcaacagaactgcaccatgctgaacaatccattcggtaacattgagtatcctctacccgcagataacatggttttcagagacaacaattcaaccagaagcaaaggcttggatgagtcactgatgaacccaatagacaacagtcaagagtatgttggaaaagctactacaatgctggatccagagatgaagtcgggaaagccagagaatgacaaccagcatgatgtattcgatgacataatgaatgagatgatgaaacaggtaacgcggttgttttcttgattggattaaaagcttttgtagtttgtagaaaatgaaagtgaatgtgtttgttgcaggaggagaataacggaatggtgccagtggctactagatttggctttgattcatttcctccaccttagctagtcatctctttctctaccagttgcattaagtttctccacttgagacc

SEQ ID NO: 4430 - DNA, 841 bp, Artificial Sequence
  P2603 (35S::G2650)
cccaacgacttcgtcaagcttaccagtttttctgtatcgacagaggacatgggaataaaaaaagaagatcagaaaagttccttgtccttgttgacgcaacgatggaataatccgaggatcgtgcgagtctcccgagcatttggaggcaaagatagacacagcaaagtgtgcacagttcgtggtctccgagacaggaggataaggttgtcggtgatgacagcgatccaagtctacgaccttcaagaacgattagggctgagtcagcctagcaaagtcattgattggctcttagaagttgccaaaaacgacgtcgatttgcttcctcctttgcaattcccacctggttttcaccaacttaaccctaatctcaccggccttggagaatcttttcccggggtcttcgatcttggaagaacacagagagaagctttggatcttgagaaaaggaaatgggttaatcttgatcatgtgtttgatcacatcgatcatcacaaccatttctcgaattcaatccagagcaacaagctttatttccctacaattacttcgtctagcagctcttatcactacaaccttggacatctccaacagtcactactagaccaatctggtaacgtcactgtcgcattttctaataactataataataataatctcaatcctccggcggcggaaactatgagttctctattcccaacaaggtacccttcgtttctcggtggtggtcaacttcaactctttagtagcacaagctcacaaccagaccatatcgagtagttccagctgcagattatttttagacgatctttaacaagttgaagaattcaagtcatgtgacatg

SEQ ID NO: 4431 - DNA, 1228 bp, Artificial Sequence
  P2616 (35S::G1823)
cagttctctagggttttcaatactcacaccaaagcttaatgccgatcaacgatcagtttcctagtgggttaagaatactcgttgtagacgatgatacttcatgcttgttcattctcgagaaaatgcttctccgtctcatgtaccaagttacaatttgctcacaagctgatgttgcgttaaccattctaagagaaagaaaagacagttttgatttggtgctaagtgatgttcatatgcctggtatgaatggttacaatcttcttcaacaagttggtcttcttgaaatggatcttcctgtcattatgatgtctgttgatggaagaacaactacagtcatgactggaatcaaccatggagcttgtgattatctaatcaaacctattcgtcctgaagagcttaagaacatttggcaacatgttgttagaaggaaatgtgtgatgaagaaagagcttcgaagttctcaagctttagaggataacaagaacagtggtagcctcgagactgttgttgtttcggttagtgaatgctcagaggaaagtttgatgaaatgtaggaataagaagaagaagaagaagagaagtgttgatagagatgataatgaagatgatcttcttcttgatcctggaaactcgaagaagtcacgcgttgtttggtctattgaattgcatcaacaattcgttaatgccgtaaacaaacttggaattgacaaagctgtaccaaagcggattctcgagttgatgaatgttcctggtttaagcagagaaaacgtggctagtcatttacagaagttccgattgtatttgaagagattaagcggtgaagcttcgcagagtaatgactctgagtctaccaaaagatatgaaaacattcaagctctggtttcctcaggacaattacatccacagacattagctgcattgtttggtcaaccaatagacaatcatcactctgctagttttggagtttggattcctaatgacaatcttggtagatctcaaaatgaacacttctcggttgatgtatcatccgcttctaaccgtcctgtttctgtggcggttcatggtctatcttcctcagcaaatttcagacagagaggtgacgttaacaacaacagaatcagacaagggtatggatcaaatgtcaatgaagaatcttggatcttggaaagatcttcaagacaaagatagtgaccaatatggatacgcttaagaagagaaggctctgcaac

SEQ ID NO: 4432 - DNA, 2501 bp, Artificial Sequence
  P2617 (35S::G1451)
gtttggtttcttgaagttgaattagacatgaagctgtcaacatctggattgggtcaacagggtcatgaaggagagaagtgtctgaattctgagctatggcatgcttgtgctggaccattagtctctcttccatcatctggtagtcgagttgtttactttccacagggtcacagtgaacaggtagctgctacaactaataaggaagttgatggtcacatacccaattacccaagcctaccaccacaattgatatgccagctccataatgttacaatgcatgcagatgttgagacggatgaagtctatgctcaaatgacacttcaaccattgacaccggaggagcagaaggaaacatttgtaccgattgagttggggataccgagtaagcaacctagtaattatttttgtaagactctcacagctagtgataccagtacacatggagggttttctgttcctagacgtgctgctgagaaagtgtttcctccattggattacacactgcagccaccagctcaagaactgattgcaagggatctccatgatgttgaatggaagtttaggcatatctttcggggacagcccaaacggcatctcctaactactggatggagtgtctttgtcagtgccaagcgactagtagctggagattctgtcattttcatcaggaatgaaaagaatcaactctttttgggaattcgtcatgccactcggccgcagactattgtaccatcatctgttttatctagtgatagcatgcatattggactccttgctgctgctgcacatgcttctgcaactaatagctgtttcactgttttctttcatccaagggctagccaatctgagtttgtgatacaactttccaagtacattaaagccgtttttcacacgcgtatttcagttgggatgcgctttcgcatgctcttcgagacagaagagtcgagtgtccgcaggtacatgggtactataactggtattagtgatctagattctgttcgttggccaaactctcattggcgatctgtgaaggttggttgggatgaatcgactgcaggggagagacagccaagggtttctttatgggagattgagcctctgactacctttcctatgtatccatctctttttcctctcagactaaaacgtccatggcatgctggcacatcatctttgcctgatggaaggggtgatttgggaagtggtctaacatggctaagagggggaggtggagagcagcaaggtttgcttcctctaaattatccatctgttggtttgtttccatggatgcaacaaaggctggatctcagtcaaatggggactgataataatcagcaataccaagcaatgttagctgctgggttgcagaacatcggcggtggagatcctttaagacagcagtttgtacagctgcaagagcctcaccaccaatatcttcaacaatcagcttcccataattctgatttgatgcttcagcagcaacagcagcaacaagcgtcacgccatctcatgcatgctcaaacacagattatgagtgagaatcttccgcagcagaatatgcgacaagaagttagtaaccaaccagctggacagcagcaacagctacagcaaccggaccaaaatgcatatcttaatgctttcaaaatgcaaaatggccatcttcaacagtggcagcagcaatcagagatgccatctccctcgttcatgaagtcagattttactgactcaagcaacaaatttgcaacaactgctagtccggcttctggagatggcaatcttttgaatttttctataaccggtcagtctgtactccctgagcagttaacaacagagggctggtctccaaaagcatccaacactttttctgaaccgttgtcacttccacaagcctatcctgggaagagtcttgctctagaacccggaaatccgcagaatccctctcttttcggtgttgatcccgactctggactcttcctccccagtacggttccccgctttgcttcttcatcaggagatgctgaagcttcccctatgtcactaacagattcaggatttcagaattccttatatagctgcatgcaagacacaactcatgagttattgcatggagctggacagattaactcgtccaaccaaaccaagaactttgtaaaggtttataaatctggttcggttgggcgttcattagacatctcccgattcagcagctaccacgagctgcgagaagagttagggaagatgtttgctatcgaagggttgttggaagacccccttagatcaggctggcagcttgtattcgttgacaaggaaaatgatattcttctccttggtgatgacccatgggagtcatttgtgaataacgtttggtacataaagatactatcaccagaagatgtgcatcaaatgggagatcatggagaaggcagtggtgggttattcccgcaaaacccgacccatctctagaagctgcttcggtgttagtctcatcatgctacaacgcg

SEQ ID NO: 4433 - DNA, 2090 bp, Artificial Sequence; identical to SEQ ID NO: 1025
  P2619 (35S::G1493)

SEQ ID NO: 4434 - DNA, 2790 bp, Artificial Sequence
  P2621 (35S::G446)
gcctagttagtgttgagtgtgggagagacaaaacagaacattgaaaaatctctctgtatgatggcttcattgtcttgtgttgaagacaagatgaaaacaagttgtttggttaatggtggaggaactataacaacaacaacatctcaatctaccttgcttgaagagatgaagctgttgaaagaccagtcaggtacaagaaagccggtaataaactcggagctatggcacgcttgtgcaggccctttggtgtgtctccctcaagttgggagcttagtgtattacttctcacaaggtcatagcgagcaggttgctgtttcaaccagaagatcagcaacaacacaagttcctaattatccgaaccttccatctcagttgatgtgtcaagtccataatgttactcttcatgctgacaaagacagtgacgaaatctatgctcagatgagtcttcaacctgttcactctgagagagatgtgttccctgtaccagactttggaatgctgagaggaagtaagcacccgactgagtttttctgcaaaacacttactgcaagtgacacaagcacacatggaggtttctcagtgccacgtagagctgcagagaagctatttccaccattggactactcagcacagccgccaacgcaagagcttgtagttcgagatcttcatgagaatacttggacatttcgccatatctaccgagggcaaccaaagagacatctcctaactacaggatggagtttgttcgttggatcgaagagattgagagctggggattctgttttgttcatcagggatgagaagtcacaacttatggtcggtgttaggcgtgccaatcgccaacaaacagcacttccttcatcagttctctcagcggatagtatgcacatcggtgttcttgctgctgctgctcacgcaaccgccaaccgtactccttttttgatattctataatccaagagcttgtccagcagagttcgtgatccctctagctaagtaccgtaaggcgatatgcgggtctcagctctcagttggtatgagatttggaatgatgtttgaaactgaagattccgggaaacgaaggtacatgggaactattgttggaatcagcgatttggatccgttgagatggcctggttctaagtggcgtaaccttcaggtagaatgggatgagcctggatgtaatgataaacctactcgggtcagtccatgggatatcgaaacacctgaaagtctcttcatttttccttctctgacctcaggactcaaacgtcagctccatccatcttactttgctggtgaaactgaatggggtagcttgataaaacggccacttatacgtgttcctgattccgcgaatgggattatgccatatgcatctttccctagtatggcttcggagcagcttatgaaaatgatgatgaggcctcacaacaaccaaaatgtaccatctttcatgtctgagatgcagcagaatattgtaatggggaatggaggtttgctaggagatatgaagatgcagcaacccctgatgatgaaccagaaatctgagatggtgcagccacaaaacaagctaacagtgaacccatctgcttctaatacgagtggccaagaacagaatctttcacagagtatgagtgctcctgctaaacctgagaactctacactctctggttgcagctctggtagagtccaacatggacttgagcagtcaatggaacaggcaagccaggttactacatccacagtgtgtaatgaggaaaaggttaatcagctacttcagaaaccgggtgcttcgtcgcctgtacaagctgatcaatgtcttgacattactcatcagatttaccaaccacagtctgatccaataaatggattctctttcctggaaactgatgagctgacatcacaagtctcttccttccagtctcttgccggatcatacaagcaaccattcattctatcctcccaggattcttcagctgttgtgttaccggattccacaaactcaccgctgtttcatgatgtgtgggacactcagttgaacggtctcaagtttgaccagttcagtcccttgatgcagcaggacctttatgctagtcagaatatctgtatgagtaatagcacaaccagtaacattctagatcctccactctcaaacacagtccttgatgacttctgtgccatcaaagacactgatttccagaaccacccttctggttgtttggttggaaacaacaacactagctttgctcaagatgtccagtcgcagatcacatcagctagctttgcagactcacaggccttctctcgccaagattttccagataattctggaggcactggtacatcttcaagcaatgttgattttgatgattgtagtctgcggcaaaatagtaaaggctcatcatggcagaaaattgcgacaccccgcgtccgaacctacactaaggttcaaaaaaccgggtcagtcgggagatcaattgatgtcacaagctttaaagactacgaggagctaaaatctgctatcgaatgcatgtttggattggaaggactactaactcacccacaaagctcgggttggaagcttgtatatgttgattatgagagtgatgttctgcttgtaggagatgatccatgggaagagtttgtgggatgcgtaaggtgcataaggatattgtcgccaactgaggtccagcagatgagtgaagaagggatgaagcttttgaacagcgcaggcattaacgatcttaagacttctgtttcataaatgtaacaatataaaaatgatctc

SEQ ID NO: 4435 - DNA, 1743 bp, Artificial Sequence
  P2623 (35S::G2184)
gagggatcggttttgatttgttacgtagatggcggattcttcacccgattcgtgtttcaaaggaggcaaatttagtgctccagggtttcgatttcatccaactgatgaagagcttgtgatgtattatttgaagaggaagatttgtaggaagaggcttagagttaatgttatcggtgttgttgatgtttacaaaatggatcctgaggaattgcctggtcaatcaatgttgaagacgggagatagacagtggttctatttcactccaaggagtaggaagtatccaaacgcagctaggtctaatagaggaactgaaaatgggtattggaaggctacagggaaggatcgagtcattgagtataattctagatcggtgggacttaaaaagactcttgttttctatagaggccgggctcctagtggtgagcggactgattgggtgatgcatgagtatacgatggatgaagatgaactagggagatgtaagaaccctcaggagtactatgctctttataagttgttcaagaaaagtggggctggtcctaagaatggtgaacagtatggtgctccgtttcaagaagaggaatgggttgatgatgataatgaagatgtgaatgctattgctgtagctgtgccagagcaacctgtggttcgttatgaggatgctcgtcgtgtggatgagaggagactttttaatcctgttattcttcagttagaggatatcgatgagcttctcaatggaatccctaatgcacctggtgttcctcaaagatgtattcctcaggtgaatagtgaagaagagctgcagagtacgttggtgaataattctgctagagagttcttgccaaacggtcagcaatacaacaggccctcaagttttgactcattagagaccgctgaggtcacctcagctcctctggtgtttgagaaggaagatttcattgaaatggatgatcttcttctgatccctgaattcggagcttcttcaactgagaaagccgcacagttctcgaaccatggtgaattcgacgattttaatgagtttgaccaattgttccatgacgtttccatgtctttggatatggaacctattgatcagggaacttctgcaaatctgtcttctctgagtgattctgctaactacacatcagaccaaaaacagcaactcctttatcaacagttccaggaccagactcccgagaaccagctgaacaacatcatggatcctagtacaactctcaatcaaatcactagcgatatttggttcgaggatgatcaggccattctatttgatcaacaacaatccttttctggagcatttgcttcaccctcatcaggtgtgatgcctgattccaccaatcctactatgagtgtgaatgcccaaggccatgaaatccaaaatggtggtggaacaacaagccagttctcatcggctttgtgggcattaatggactcaataccttcaacgccagcctctgcgtgtgagggtccccttaaccgaacctttgtacgtatgtctagcttcagccgtatgaggttcaatggaaaggctaatggaacgccagtgagtactaccatagcaaagaagggtattagaaacagaggttttcttctattatcaatcgtgggtgctttgtgtgccatcttctgggtgttggtagccacagttcgagtctcaggtagaagtcttctcttgaaagactagtggtggttctcttgaactcttaactactggtaagttagaag

SEQ ID NO: 4436 - DNA, 1264 bp, Artificial Sequence
  P2633 (35S::G2967)
caacaaaccccgtgtatttcgcgcctaaatggaagacgaacatcaagatctccataaacccattaatggagctttgcgagacctcaagattactcggtcacagaaagaaacagaaaagtctacgaaccaacagcaagatgttacttgttactatggtctaagggaaaactcgaagaagaaaacccaggaatctccggaaccaatgaagaagattttgtttcgatgcgaagaatgtggaaaagggtttcggtacgagaaatattttaagaatcatcgctcgatgatgcatttatcgccgaacgagaaggtttgtgaagaatccttgatgactctgtctcgtagccttgggtttgtgaagaagaagaaaagatcaagacttggtaggtctgggaagactttatttactacgtttcttgaaccgagttctatttttgatgcgactgatgaagaattagaagtggcggattgtttgattctattgtctaagagtgctcccaaggttgtagacgaattgaaaagtctttctgaggcagtacgtgttactcctgaaacacctgaaagtagctatgatttgggttgtttgctcaacaagaaaccgagaaaaggtggtgaattggaatctggggttttaagtaatgagcaaagacttatggaagaagggtttagtagttatggaacatcgaaagaaccagctagcttcttgagagacgaaaacagattggatcagcagaaacggagaaaagatggtgaatttgaatccggacttttgagtaatgagcaaagactgctagaagaagagattactactcctgtgacattcaaaggtccagcgagttccttgagacacaagtgtgctttggatcgaaatggaggtgaatttggtcctgagtttttgagtaatgagcaaacactgatggaagaaacatggaaagaaccagtgagtttcttagaagataagcatgaatttgatcagcggaaaatgcgagaagctggcgactttgaatctaggttttacagaattgagcttggagtaggagctatggagtgtacttcttcagatactgatatgctcacgcaatctgataagaagaacgttgagcatcgatgcaggttgtgcaacaagatattctcgtcttatcaagctctagggggtcatcagacgtttcatcggatgagcaaatgtaagaacaagaagaatggcatagaggaatcagttgaacccaggatgactctgtgagatgctcagtgagaagtgtagcatccg

SEQ ID NO: 4437 - DNA, 1068 bp, Artificial Sequence
  P2635 (35S::G2972)
ctatgagctttgtttcaattttcaggtttttgtcggcgaaatgtctcagagacttcatggttgcaaaacatgcgggagaaagtttggaactttaaaaggtgtgtatggtcaccagaggatgcattctggtaatcacaatagaatcgaagatgagaatggtttggaaaggatttggggtcttaagaagaagtctagggtttgctctgtttcagcttttgatcgattcaaaggatcttcttttatggctgagattgagaaacatgaggtgattgaagctgcattgaacttggttatgttgtgtcaaggagtttatgactttgcttctatcagtaatttgcctctaggtgatggtttcatggatttagagcttaaaccttgtcctttgagaaggaaactacagaaaaaatctcgctccagttataaatgcagtatatgtgagaagagttttgtgtgttctcaagctcttggtagtcaccagagacttcacagatggaaactagtgcctaaacctgagtacattgaagatgatagttcactgttagactcatcagaagctaagaagattgtttcaaaaccatcaagctttgaacatgctcaggaggagaagatcttacaatgtgttgagccgaaactagagttccacgaacagcttgctcactcgggtttcgacaagtttgatacttgcagtaaaatcaggttcagtgcattaccttctcctccagaagctaagaagattgtttcacaaccaccaagctttgaagtctctgtggatgaaaagatcttatatcgtgctgagccaaaactaaacttcagcgaaccgcttgctcactcgtgtttcgacaattctagtagctatagaagcataatatgtggcaagagttttgtgtgttcacaagcattaggtggtcaccaaacacttcacagatcgattaaaggccaattagcgggtactgaagatggtaattcactctctgtgactgactcagaagctagcaagattgttgcacaaccatcaagctacaagtctcaggggatataaaaatgtcagtgctttgatgtttccaagtc

SEQ ID NO: 4438 - DNA, 494 bp, Artificial Sequence
  P2641 (35S::G1993)
ctccctcgcgcgatatcatatacaaatgaatagaaaatacttggatcgtcgatcatattcatggtccggatcacaagcaagaccatacatatgcgaattttgcgagagaggtttttccaacgcacaagctttaggagggcacatgaacatccacagaaaagacagggcaaaacttcgacaagcgaacctaaaagaagaagacagtgaagatgccatttgcaccacttcgagaaatcggtttgggcaagagcttattgagttacctttcttcgttgatacggtcggtccaagaagaaaaggagaagatgataaaagcgaaaaaggtttaggagatgaagaaaagaaaaatatgaggatacttcaaaaggctttatctcaaagtgcagacgtgatagatcttgagctccgtctaggattagatccttataaaaaaacaacaagtacaagtacgtaactaataactatatatgtgaatactttaatccccaagtttg

SEQ ID NO: 4439 - DNA, 609 bp, Artificial Sequence; identical to SEQ ID NO: 1307
  P2643 (35S::G1985)

SEQ ID NO: 4440 - DNA, 549 bp, Artificial Sequence
  P2644 (35S::G2604)
gagattgagagaagagatttatccaaaaaaatattgcaattcttcttggagtgaataatgccagtccctcttgcaccatatccaacacctccggcaccggcactggctccgtcgtacaacactcctccggcaaatggaagtacaagtgggcagagccagttagtgtgttcaggttgcagaaaccttctgatgtatcccgtcggagcaacctccgtctgttgcgccgtctgtaacgccgtcacggccgttcctccgcccggaacggagatggcacagttggtatgtggaggatgtcatacactcttaatgtacattcgtggagctacaagtgttcaatgttcttgttgtcacactgttaatctcgccctcgaagcaaaccaagtagcgcatgtgaattgcggaaactgcatgatgctactaatgtatcaatatggagcaagatcagtgaaatgtgccgtttgtaactttgtcacatctgttgggggttcaacgagcacgactgattcgaagtttaacaattaaaacttggatctatctacctatcaatac

SEQ ID NO: 4441 - DNA, 1499 bp, Artificial Sequence
  P2647 (35S::G1968)
gcatctgtcaagctttctttgaagataaatttgaggtaaaaatcaaactaatggcttctctcactttttgtttctacttcttcttatgatcttttgtctttgttttgatcagatggagcagttcaaagagaggaagtttgtttgtaagttctgtagcaagaggtttccttgtgggaaatcacttggaggtcacatcagaactcacatgaatgagaattcagctgattcagatgaagatgaggctgataagctcaagatgattgatgaaaatggtggtcaatctagttatggtctgagagagaatcctaaaaagaacaagaggtttgtggatcacagacagattatggctctgaaacagcagcagcagcagcaacaacttcaagagctgcgtcgttgcagagaatgtggtaaaggttttgtttcttctaaagctctttgtggtcacatggcttgtcactctgagagagagaagattgttatggatagtcaatctgatactgaggcttcttcctctcctatcagaagaagatccaagagagttgttgtgaaacctcaccacaaagctgcttttgtagttggtggtaatggtattatgaatcaatctatttcagcttcttctgatgcttctgagattgagcctgaacaggaggaaatggcaaggtctttgatgatgctttcgagggattctagttttaagaaaggacataactctttggctgagtcatctgacaacaactctgtgattcttgagactaagtcatcttcaggtgagcaggttaagatgttcaatgtgaagaatgttgaagagttatgtaagaagaacaaacttgtagttgataaccagatgaggtctggtgaagaaaatggtgatgttcattatgattcagataattctgactctggctacttcaggaatggaccaaagaagttggactcagatgtttctgttgatgggttctttaggaacaaaacaataatgggatctggatccggattcaacagctccccaacaaaacaagatagggacatgaacagattcaggaaggaatggtataaggaaggagggtcagggtcaggatcaggatcaggtcgttcttctacaaagtatgatctgaggaaaagcaaaagaggttttccttctcatggtcgtaagaaaatcaagtatgagttcactgaatctgtctatgacagtggtgagcatagcttggaaactgactcttgtgcggacacaaacagaactatcaagattcatagtaagtctccaatggttaagaaagcaaacggtgcaaagaagaaaagcaaaggtcacgagtgtccgatttgcttcagggtgttcaaatcaggacaagctttaggaggtcacaagagatcacatttcattgggaatcaagaacacaggactttggtgattcaacatcaagtagctcatgagatgcatacactcatcgatctcaatcttcctgctcctattgatgaatgatcttactaaaaccgaaacc

SEQ ID NO: 4442 - DNA, 989 bp, Artificial Sequence
  P2649 (35S::G3059)
ccaattttctcgaattgtcaccgggaaaaatggaaaacaaaatcgcgccgtttagttacagcggaagctccgccggaaattcatccagtggcggcgtcgtttcgtcgtctctctactctgatcaactctacaagtcgactcgcaacataatgcaacagcgtcaagatatggtgaatcgcgaggcgttgtgttacacgcgtctccatgaggcttcgcttgaagcagaagcgcttcgtctagagaacactgaactccgatcgatgaatcttcgtctcaagaatgagctcaacagtctcatcagatcttcgatccagaaccgatttgatcatcgatctccgcttcggatgcttagcaatctttcgatcggaggtaatgacgccgacgaagtggagaatcagaaccgtacggttaatcgcgatgacgtcaatgataagagtccgacgagtgttatggagaatgaggatctgaatcgctcttcgcttccaaagagcatctctgtgagatctaatggctactctaaggcaagtcagggaggtggtggtgcggctgctcaaagtggaaaacctcgtggaaccgtcactaagcctgggacttgtggtcaagtcagtactacgcagaaggtgtatgtgcgaggaggagggaagaaagaagatcaggaggaagagatagaagtggaggtgtacaatcaagggatgacaaagacagagctgtgcaacaaatggcaagagacagggacatgcccatatggtgaccattgccagttcgctcacggcattaaggaactccgtccagtgatccgccatccccgttacaagactgaggtttgcagaatggttcttgctggtgataactgtccttatggtcaccgttgccacttccgccactcactatctgagcaggagaagctcgttgctgctggtttcaaacccaagtcatccctcaagctgatcacatgacctgaccctggtttcaagtcctccttcaagctg

SEQ ID NO: 4443 - DNA, 577 bp, Artificial Sequence; identical to SEQ ID NO: 305
  P2654 (35S::G366)

SEQ ID NO: 4444 - DNA, 2130 bp, Artificial Sequence
  Artificial sequence
  P2656 (35S::G2888)
cttcctccaataccaccatcgttaaacaaaaaaaaaaaaaaaagaaagatcatccaatgatacattacgaacaaaacaacaaccttcagaaccttccatcttcatcttccaacgatcttcttcttggcatcaatggagctgacgcaacccataagagaaaacggagacccgcagggacaccaggttcttaatatttcctcttttacgttttgaatttttcttattgtctactaggttttctataatctttttggattagttttctattaagttccaaaaagtgttgttgatattactctgtcaagatttctttttcatttctaatgttgggttgccaataatttagcacaagattttttatttttgagattgttttttaccatataatttagaaaatcattttttatcttctgtatcggagctaacagatccagatgcagaggtggtatctttgtcaccaagaacgttactagaatcagatcggtacgtgtgtgagatctgcaaccaagggtttcagagagatcagaatctacagatgcatagaagacgacataaagtgccatggaagcttctgaagagagacaagaaggatgaggaagtgaggaagagagtctacgtgtgtcctgagccaacatgtctccaccatgacccgtgccacgctcttggagatctggtcggaatcaaaaagcacttccgccgtaaacacagtgtccacaagcaatgggtttgcgagagatgctccaaaggctatgcagttcaatctgactacaaagcccatctcaagacctgcggttcacgcggtcactcctgcgactgtggccgcgttttctccaggttctttctcatatatcatcatctctaactgtgtgtatatctataaaaaaaagttttgttaacttagtcgatgttttgtggaaaaccctagctattctatcggctctatactgaggattagtttctcttgggttctccaaatcttttaattttctttgaaattttatttatacaatttaactttctaggtaagattataattggaaatatggaatccttaaactaaaccaaagaatgttttataggatggtgtgtaatgttgttacattacaggtatattttatctataaggcatatagatttgtttttttttaatgtgcatatatagattttgacacagcctaccaatagaagctcagcttgactgttgccagattattttaatttacatatgaagtcacgttgatacccattatggatttccattaccaacactttgttctattttgttaatacacaaactaaaaagtcttataatcacataatacctttccaaagatatctaagtccataactcaattttctattattgctttttcatttgattacgtacgtacaccatcaaacactattgtgttttgttttcaattcttttggttatccactactagctcattcttaattcttctcttgttcttttttcagggttgagagtttcatagagcatcaagatacttgcaccatccggcaacctcaacccaccaaccaccgtcatctacagcagcacacgatgggccttgacgctccatcaagaaccacttcgacagcaagcttcggccctttattgcatggacttcctttgttaagacctccacgaccgtccaatcaacattcaccagcttttgcttaccctttcaatgcttcatcagctcctttcgaaagcctcgaacttcaactatccataggaatggcaagaacatcagcacaagcgaggcacaacgaaaagagagagacgagtttaacaaaggagagagcgaacgaggaggcaaggaaggcagaggaaacgagacaagaagcgaaaaggcagatagagatggcagaaaaggattttgagaaagctaagagaataagggaagaagcaaaaaccgagttggagaaggctcacgttgttagagaagaagcaatcaagaggattaatgcaacaatgatggagatcacttgccactcttgcaagcaactatttcagctgcctgttacggctgatgagagtacgtcgtctcttgttatgagttacgtttcctcggcgacaactgaaggagaatgcgagtgatccaatgcatcttcatatatatatcc

SEQ ID NO: 4445 - DNA, 2255 bp, Artificial Sequence
  P2657 (35S::G3061)
tttttttttttttgtctcttcttacatatgaatcaagacatgatgattccacataatcatgaccgcctctcattctctagctttgtccatgaccaagagcacatcacccctaatccttaccctaactctcagcctgcagcctccactaaaacacccaagaaaaagagaaaccttccaggaaatccaggcatgtgtatatataattttatatgttctccatgggtctttaataaagctctagcttgatgtgttttcatcaaaatcaataatctttttccaagtatagatcctttgtgttttcttttttctttcttgatactgttttatttttattggttctaattttgtttctaacaacaacaacaaaaaacagatccaaatgcagaagtcatctctctatctccaaaatccctcatggcgacaaatcggttcttttgtgaaatttgtaacaaggggtttcagagagaacagaaccttcagctccacaaaagaggccacaacctgccatggaagctgaagcagaaaacgaacaagaatcaggtgaagaagaaagtttatatatgccctgagaagagttgcgtccatcatgatccagctcgagccctaggagaccttactggaataaagaagcactttagcaggaaacatggagagaagaagtggaaatgcgataagtgttccaagaagtatgctgtgatatccgattggaaagctcataacaagatttgtggtagcagagagtttagatgtgattgtggtactcttttctccaggtcattactactctttctacgtcttcgtctgcagcattatcgtttgccttaacatgttcatatatcaaacatttttaaaaattgtaacaacggaaaaaacgttttcaaatcttcaggtttgcatttatttgaagtgtttgataaaaatataaatataaacgtaaaacacaaaacatatttgaattatatttgaaacaaaccgggtcttataattggacatcgaaacagatgcatgcatacataaaagcatgatattgcctatgctagaaaaataaaaagttattgagtttactttatgtatagcgagtacgttggtctttggctcgtagcttgtcatttggataccactaccgttaattatttcttggcttctctgtgtcttggtccagtttgtagttttatagagacaccaatatcgaggagaaaaaaggctgcatgactaggacatgatgtggtcatgtctccatagccttgagtcttttttttttcaccttactacacatatcgattataagcttgcatcgaataaagagttgcatatataccatatacaagaagacctattttaatttaatttatatgttaccaattagcctatattaacatagttactttattgaatgatttggttgattgtaccaggaaggacagtttcatctcacatagatccttctgtgatgtcttagctgaagaaagttctaaattcttctcagttccttcaccattagccgccaattcgaccatcgccactgtcactgataccaacaatccaattctcattcaatcacaattggatcaatcttccacaggtacggccgatcttaacgtcaacaacaatcacaccaccctatttggacaaaagttcaccaactccaacccaacccaacaacaacccaatgctttggcgttgtcctcaccaccatcacctcgtagtacatctgattcggttcataatctatggaagttacaagaagaggaatgtgcacaccagtggttactcaatgaatatatgaacaataacaaaaacatattccataagggaatattcaagaatcaagaagatgagataaagaagggaaatatctacagcggctcaaacccaaccgatggaaacatagcatccttgttctcgtataatcaagaagcagtgaatatggcttcattttcggcaacaacattgcttcaaaaggtagctcaaacgggaacaccatcaagctccgaaactagcaccaccatgtttgggcaaatgacttcctccatcttcaacaatacgatgctaaactcctattgtttaacggcgaagaataatgaagaagagttgaccagagactttcttggtgtgggaagtagtgaggaccaacaacgtctacatcgtcatcgcttcccatcaagcgtgccattgacggcgaaccatgatattcccaagttggccgcaaccattgtaggcaggaagcaaccatagacatggcgtcatctgattct

SEQ ID NO: 4446 - DNA, 856 bp, Artificial Sequence
  P2663 (35S::G1832)
ctgtcttctctctagtaagagactcaataataatgtcgaacacttcaaactccgatcccaattccgatatcccatttgcttcctccaatgtaactcttcctagttacaatcaaaacccaagaagaaaacgtactaaactcaccaacaacgaagtcggttcttcttcgtcttctccaaggcctaaaccggtcacgcaaccggaccctgatgcttcacaaatcgcacgaccatgtactgaatgtggtaaacaattcgggtcactgaaggcactctttggacacatgagatgtcaccctgaacgtcagtggcgtggcatcaaccctccttctaacttcaaacgtaggatcaactcaaacgctgcgtcatcatcctcgagttgggatccatctgaggaagagcataacatagcctcctgtttactaatgatggctaatggtgatgtcccaacccgttcaagtgaagttgaggaacggtttgagtgtgatggttgtaagaaagtgtttgggtcacatcaagcgttaggcggacatagagcaacacataaagacgtcaaaggatgtttcgccaataaaaacataaccgaagatcctcctcctccacctcctcaagagatcgttgatcaagataagggcaagagtgtgaagttggtctcggggatgaatcatcgatgtaacatctgttctagagtgttctccagtggtcaagcgttaggaggtcacatgagatgtcattgggagaaagatcaggaagagaaccaagtcaggggcattgatcttaatgttcctgcggcgacatcttcagacacaacgttaggttgttccttggatcttaggttaggactttgatatatgataac

SEQ ID NO: 4447 - DNA, 1383 bp, Artificial Sequence
  P2668 (35S::G2832)
cttctctgtatcagttttgtcggtttatgcagcactcgtcttcattcatagattttgatttgaggtaaactaaactcatcagatattaaaaatgggttctttacttctttcgatttcgtgtgtaaaggagaaacctttattgattctttcttgcttgtttgctgtttgatcatttgtctaagagaagaaggtcaaattttcaaatggaggaagggaaagagaattcgtttttgtgcaagtactgttacaagacgtttccttctgggaaagcactcggtggtcacattagaattcatacgaacgagaattcagttggttacaatggcaataagaagaagaggttggtggatcagagaaagatgatggctcagaaacataagcaacaacaacaagttggttgcagagaatgtggtagagtgttcgtttctttgaaagctcttagaggtcacatggcttgtcacggtgaggtaaagaagatgttgatggatgataatagccaatctgatactgaaagtgagacttcctcagctcctatgaggaaaagatccaagagggtggtcatgaaacaatcaaattctgaatctttgagtaatgggagctcgtcttttggttctgagattgaccaagaacgtagggatggggcttataatttgatgatgttgtcgagtgattctagtagtttcaagaaaagacgtaacatggtgatgaattctcttggtgagtcatctgacaacaactctgcgattgttgagaataagtcatcttcaggggatgagtttaagatcatgaatgtgaagaatgcagtagatgaccaatggagatctgctgatgatgatggagttagtctctgtgattcagatggctctgattctgattacttcatgaatggtccaagtaagtcggagtcagacatttctgttgacaggaacactggatttggatctggattcaacaactcattgatcaggttcaggaatagtaatgagggaggaacaaagtatgagctgagcaaaagcaagagagccttgttttcttatgaaactgattcatgtgcagacacaaacagcaagattcatcataggttcaaagatagcaaatcctcaatggttaagaaagaaggtggtgagaaggtgaagagcaaaggtcatgagtgcccaatttgcttcaggatgttcaaatcaggccaagctttaggtggtcacaagagatcacattccattgcaaaccacgcagctgaaatgcgtaaccaaatcgatctctatcttcctgtttcggatactgatgaatgaatcagaacctgagaactatagttctctctgatagtatttcatccccactttttgtttgttttctttgctccacattttagaactagatcaaaag

SEQ ID NO: 4448 - DNA, 1209 bp, Artificial Sequence
  P2675 (35S::G2640)
gttatgggtggtggttgttgtcttggtgaatggcggggtttttctcgctagacggtggtggaggaggaggcggaggtggaggtaacaaccaagaagatcaccggagcaacacaaatcctcctccgcctgtatcagaagcttggctctggtatagaaaccctaacgttaacgcaaacgcaaacacaaacgttaacgcaaacgctccttcttcgtcaaacgctgctttaggaacacttgagttatggcaaaaccacaatcagcaagagatcatgtttcagcatcagcaacatcagcaaaggttggatctttactcttccgccgcaggtttaggtgttggaccaagtaatcataaccaattcgatatctccggcgaaacttcaaccgccggcgccggaagagctgcggcgatgatgatgattcgtagtggtggtagcggaggaggaagtggtggtgtgagctgtcaagactgtgggaatcaagcgaagaaagattgttctcacatgaggtgtagaacttgttgtaaaagccgtggcttcgagtgttctactcacgtgagaagcacgtgggtccctgctgctaaacgccgtgagagacaacagcaattagctacggtccagcctcaaactcagctgcctcgcggtgagagcgttcctaaacgccaccgtgaaaatttaccggcaacttcatcgtctcttgtctgcactcgcataccttctcattcagggctagaagttggcaatttcccggcggaggtgagttcatcggcggtgtttaggtgcgtgcgtgtgagctcagtagaagatggagaagaagagtttgcttaccaaacagctgtaagcattggtggtcacattttcaaaggcattttatacgacctcggtcctggaagtagtggtggcggaggctacaacgttgttgccgccggtgagagctcctctggtggtggtggagctcaacagctgaatctcataacagctggctctgtaaccgttgctaccgcttcttcctctactccaaacctcggtggtattggcagctcatcagccgcggcagccacgtacattgatccagccgctctttatccaactccgatcaatacattcatggccggtacacaattctttcccaacccaagatcatgaggaaaatctgacataaaagcaacataactcttttgaattcttagaatagaattagggtttataaacg

SEQ ID NO: 4449 - DNA, 2434 bp, Artificial Sequence
  P2702 (35S::G2981)
gaattctccagtagcgcggtagttagttttaggtggaagaagaatgacaactactgggtctaattctaatcacaaccaccatgaaagcaataataacaacaataaccctagtactaggtcttggggcacggcggtttcaggtcaatctgtgtctactagcggcagtatgggctctccgtcgagccggagtgagcaaaccatcaccgttgttacatctactagcgacactacttttcaacgcctgaataatttggacattcaaggtgatgatgctggttctcaaggagcttctgggtatgtaaaccacctcaattctgtgatttttatattaaaaggctttgatgtgtttattgtgatgtttggtttagcgatttttagggttttcattctattgcaatggctgcttttatgagcttaatgaatatatgaaactgaaccagtagatgtaagtatgatgtgtggatcatacttttacaagcttgaatttggctctcctgatatgtattagtctaaaatctactaataatctgcatatttgaatactcatctttcctatccttattgggacaaaagatactgtttaggccattgtctttgtgcgttaatttttgtgtggaagttgttacatgtgttctgtgtagtttagttgatcatataatctatttacagtgttaagaagaagaagaggggacagcgtgcggctggtccagataagactggaagaggactacgtcaatttagtatgaaaggtcttatctctttctctgcccctattatgctttcatctaaatgcctttcaagtttctagctatgaattgtgtggataatgcctcttaagattggttatacatttaactgatattatgttcgtctggccttcctttcagtttgtgaaaaggtggaaagcaaaggaaggacaacttacaatgaggtacggtagtttcctttttaaacaaaaagcttcacagtatttatgctttgcaagatccattcacttctgtttatgttatatgatgatactgatttattgtgcttaccagtgtgattaaacacttgtcaagatcacatatgggaatatcaatttgtctcatgattagtactgcaaacgtgtagctctgtaatacggtatctaacaggtgatagtactttcaggttgcagacgagcttgttgctgaatttgcacttccaaataacgatggaacatcccctgatcaggtatgcgtttcttcgatagtttctaccctggaacgtgtgcaatactcgttgtgaactctgatgaaattatatcatgtgaaaacgttttaccagcaacagtatgatgagaaaaacataagacgaagagtatatgatgctttaaacgtcctcatggctatggatataatatccaaggataaaaaagaaattcaatggagaggtcttcctcggacaagcttaagcgacattgaagaattaaaggtttcaaccacatattctatgtgcagatgttccatagcttgtttagagaattttcctgaatttgaattattttgttttgcagaacgaacgactctcacttaggaacagaattgagaagaaaactgcatattcccaagaactggaagaacaagtaatgaacatcatcgatactctcggcttatctgcttcctgttacttttatcatagattcttacatggtccttctatcatctctgtgtatgtctgaaagtatgtaggccttcagaatctgatacagagaaatgagcacttatatagctcaggaaatgctcccagtggcggtgttgctcttccttttatccttgtccaggtaaacttcaccaacagcttcgtatgatcttagattgatccacaaggaaacctcagaaaaatgaaaaaatcacctgattgttgttgtttctctgcaccagactcgtcctcacgcaacagtagaagtggagatatcagaagatatgcagctcgtgcattttgatttcaacaggtaaaatccaaacaccagatttgatctcttttcagctaatatatctatggaaccgattactgacactgtgacaactgttttcactatttgcagcactccatttgagctccacgacgacaattttgtcctcaagactatgaagttttgtgatcaaccgccgcaacaaccaaacggtcggaacaacagccagctggtttgtcacaatttcacgccagaaaaccctaacaaaggccccagcacaggtccaacaccgcagctggatatgtacgagactcatcttcaatcgcaacaacatcagcagcattctcagctacaaatcattcctatgcctgagactaacaacgttacttccagcgctgatactgctccagtgaaatccccgtctcttccagggataatgaactccagcatgaagccggagaattgaaacacgtatgaaggccccttgtacaatttctg

SEQ ID NO: 4450 - DNA, 1980 bp, Artificial Sequence
  P2703 (35S::G2982)
caactaattgatttgatttcgtgtagctaactttgttaattggtaaattgtgtagagaaggatgagtatggagatggagttgtttgtcactccagagaagcagaggcaacatccttcagtgagcgttgagaaaactccagtgagaaggaaattgattgttgatgatgattctgaaattgggtcagtgttaattattcttcttactcacaaagtctctggtttttttacttggagctaaaatgtctgtattgaatttgtgtttaaaagatcagagaagaaagggcaatcaagaacttctggaggcgggcttcgtcaattcagtgttatgggtcagtgatatatctctcttagctcaaacatgcctgaagtgaaagtattgttgttttgctgattttgatttaacttcacacagtttgtcagaagttggaagccaagaagataactacttacaaggaggtattactctctttgttccattaaggaattggtgatgtaatcaatgagttttcagtttaagacgcattagaattgatctttatatgaacaagtattcacttcaagaagcaatcctctaagttagttgttgagcattgtctcaaattcttcttctaatcaggagtcttgcccttatatagaggcattgtatcagaaaatgtgaaaatctacgtttgagactgtggctcttgtgattccaggttgcagacgaaattatttcagattttgccacaattaagcaaaacgcagagaagcctttgaatgaaaatgaggtatagcgagatggaaagctcatatcatctgtcttgagttatttggaaaaaaaaaaagctataacaacattctcttatgttcaatcagtacaatgagaagaacataaggcggagagtctacgatgcgctcaatgtgttcatggcgttggatattattgcaagggataaaaaggaaatccggtggaaaggacttcctattacctgcaaaaaggatgtggaagaagtcaaggtttagcttccaagcttttcctttcagttatctcatctatgtaattgctctctctcttcgtcttctctactaatctctctacctctatttgcagatggatcgtaataaagttatgagcagtgtgcaaaagaaggctgcttttcttaaagagttgagagaaaaggtgatcttctttctgtttgatggaaaatttaaatacaagactctcttagaatttgagatcttgttatgcatgtcaatagatgacaaaagttattgatattgcaggttttctagaatccatagatacgtcgtgtattgaatcattttatgttgtcttaatgaaatgttaaaccgtctttctacgttttgcttataatgttactcaaatgttgttatcatcaggtctcaagtcttgagagtcttatgtcgagaaatcaagagatggttgtgaagactcaaggcccagcagaaggatttaccttaccattcattctacttgaggtacttcaaaaatctctttctcgtccgtagtttctatttcatgtttttcgatatcctaatctatttccatctctatagacaaaccctcacgcagtagtcgaaatcgagatttctgaagatatgcaacttgtacacctcgacttcaataggtaaaaataaacaacatttcttctcaaaatcaaaatcagttctgctatctcttaaatcggaattgaaatcttcgtaaattttgttgtgagcagcacacctttctcggtccatgatgatgcttacattttgaaactgatgcaagaacagaagcaagaacagaacagagtatcttcttcttcatctacacatcaccaatctcaacatagctccgctcattcttcatccagttcttgcattgcttctggaacctcaggcccggtttgctggaactcgggatccattgatactcgctgaccgagcttctattcccaaattcttcaagaagaagaagtaatgatctaattggtatac

SEQ ID NO: 4451 - DNA, 927 bp, Artificial Sequence
  P2704 (35S::G1472)
gacatcactcacttctaactgtcagcaaagttttacaaaacaaattatgaacaaccaatctatgtcttcttcaagctcctcctccccacacaaacatgatcaaaaactcaaaagtgcccttgtggccgtggaggagaaggagacaataaacaatccgaaacaaaggtctcctcaagagattgtgtctgaaaggacaaaccttgagatgcctagtttcagattaagttttttccgaaagaaaagagataccgtgctaatacatcctcccaaggataacaagatcagccacacctgtcgtttctgcaagaggaatttcaaaagctgttttgccctaggcggtcacatgaagtgccacaaaaaggaacgagaattggagaagcagcgaaagataatcgaggatgcgatgctttgtgatagtactcctttcaccttgcaaaggcttcctgttggcccttgtaagtatggccaaggtggtagctcacatgctttatcaactgatggtattaatcttgatctaactcttggtccatccaagtccacaggaggcagcaacaatagcactaataacaacactaactcatcgttccatgggaatctaatgactcccgtgggtccttgtgtgcctagatacagtttggttgctggaaaccaggttgattcaagcaatatacatgttcctgcttatccaaccaccgatctttgttatgatttttttgctttacaagagcatggttcgggctctagtcactcaaaaagtctcatctcaaaggggaaaaacaaagtcatggtgcctgaagatgatgaggatatcgggatgataaggtggttgcccaagaaaaaaagatcaagaggagagtagtaatttatctatgtccctttgtgtttttcagttttctgttttctattgaggcctatgttcacctcttc

SEQ ID NO: 4452 - DNA, 964 bp, Artificial Sequence
  P2712 (35S::G3074)
gcgttttctcattcgacgatttctggatttggggatttcaaaaccatgaggaagaagctcgatactcggttcccagctgctcgtattaaaaagattatgcaagctgatgaggatgttggcaagatagctttggcagtgcctgtcttagtctcaaaatctttggagttgttcttgcaagacctttgtgatcgtacatatgaaattacccttgaaagaggtgccaagactgtgagctcattgcacctaaaacattgtgtggaaagatataacgtgtttgattttctgagggaagttgtgagtaaggtgcctgactatggccattcccaagggcaaggacatggtgatgttaccatggatgatcgcagcatctccaagagaaggaagcccatcagcgatgaagtgaatgacagtgacgaggaatataagaaaagcaaaacgcaagagatagggagtgctaagaccagtggcaggggtggtagaggaagagggcgaggaagaggtcgtggtggacgagctgcaaaagcagccgaaagagagggtctcaaccgcgagatggaagtagaagccgccaattctggacagccaccaccagaagacaatgtcaagatgcatgcgtcagagtcatcaccacaagaggatgagaagaaaggcatcgacggcacagcagcatcgaacgaagacaccaagcaacaccttcaaagtcccaaagaaggcattgactttgatctcaacgctgaatccctcgacctaaacgagaccaaactggcaccagccacaggcacaaccacaaccacaactgcagcaacagactctgaggagtattcgggctggcctatgatggacataagcaaaatggatccagcacagcttgctagtctgggtaagaggatagacgaggatgaggaagattatgacgaagaaggctaagtcataacagcactataggatatatagagtagcagcg

SEQ ID NO: 4453 - DNA, 1145 bp, Artificial Sequence
  P2714 (35S::G314)
cagaacggtgcgtttcatattgataaggtactatcaatatgtctcgtctctttctctttctttgtttcttttgctattattcacaaaaactctctttcgcattgattattattcccattgcttgtttgtcttcatcttcttcctcctctgttctttcaaggggatccaaatatgaacacaacccaaattctaaacccgacccgacccatttggcccagtttctcttcgtccaaatctcttagcggtgatgctaactgcatggagcagcttctcctccattgcgcaaacgccatcgaatcaaacgacgccacgttggctcaacagatcatttgggtgctcaacaacctcgcttcacccgacggcgactcaactcaactcaaagactcgctgcctctttcctccgcgcgttaatatcacgcaccgcctccaaaagccctgcgtttgcgtttctatcactggctgctacagcttccatatcccagaaaacgctacaccggttctccgtcatagagctcgctgagttcgtcgacttgacgccatggcaccgtttcggattcatagccgccaacgccgcaatcctcgacgccgtagaaggttactcatccgttcacatcgttgacttaagtttgactcactgcatgcaaatccctactcttatagactccatggcaaacaaactccacaaaaaaccgcctccgcttctcaaactcaccgtcattgcttccgacgctgaatttcatccgccgccgttgctcggaatctcctacgaagagctaggttcaaagctagtaaacttcgcaaccacacgtaacgttgcaatggagtttagaatcatatcttcttcttactccgacggcctctcctcccttatcgaacaactaagaatcgacccattcgtcttcaacgaagctctcgtcgttaactgccacatgatgcttcactatatccccgacgaaatattaacttcgaatctccgatcagttttcttgaaagaacttcgagatctaaacccaacgatcgtaacccttatcgacgaagactcggatttcacgtcgactaactttatctccaggtttatcttttttcggttctatttcaaaatttaaaccctaaacactaatgtttgacctgatgagtaaaatgtg

SEQ ID NO: 4454 - DNA, 1278 bp, Artificial Sequence
  P2716 (35S::G224)
ccctaatcccgatgatgatttacgtagttcccgatctacttgaagaaattttccttggattgcctttaaaatcaatcctcagattcaaaaccgtctcaaaacaatggagatcaatcctggaatcgaagagtttcgcggagaggcgtttgaacgttgagaagaaggagaaaattctggctgttggagaccggactgagttgggattcgaaggtgaggaagagatccagatggtctatttacactgcgatattgacgccacacgaccctctctgacatgtgagggtttggtgtgtatcccagcaccaggttggatcaacgttttgaacccatcgaccagacaactccggagatttccttgtagccctaatcatcacgtgccctctgatcgtattcgttttcagttcagagacgaactatacctcacttcctttccggggaattgggagatgggatttggtagagacaaatttaatggtagctataaagtggtgaggatgtgttttagtcctgtggaaaaatgcgaggttcttgatgttgaaactggggaatggagtgaactgaatccacctcctaacgatattgacgtgggaaggaagtcagtgtgtgtgaatgggtcaatctactggttaaaaaatgtttagcgtttcggaatcctagccttggatcttcacacactagagttccacaatgtttccgttccatctacgtgttgcaccatgagtgcccagatggtgaaccttgatgaccgtctagccataactaaaacaaacggtgcgccagaatgggagctagagatactgagcctgatggatgtagacaaagaaatatggagcaagacttactccataactttagccagtatcattattaaccacccatgggagtctagttggttcacggtgttgacggtttctaagctagggaatcttgtcttttgtgacaatcacaagcggttgtttaaatataataccgagacaaatgagatttgctgtctctcctcagatatttctgttatatctccttatctcgaggatttggtaccacttcgtttggactcaggacatgatcatcgggattacaaaatcaggacatctagttgcggattgttttcgaagcatccggaggcagggttattcaaggagatcatcacttttcggtttgtgtttgccactctagttctagttggttatcagtattatagatcattaaaattcaagtaggtggattcttctctatgtgttttaccctcttggcatgtaacttgcaaagcaagtacgg

SEQ ID NO: 4455 - DNA, 1836 bp, Artificial Sequence
  P2720 (35S::G852)
gacatttgggaacgttgtagttgcagctgaatggtggaacaaactgtggttagagaacatatcaaagcgagagtcatgtcattagtgaggtctgcagagccatcctcatataggaacccgaagctttacacgttgaatgagaatggtaataacaatggtgtcagttctgctcaaatctttgatccagataggtcaaagaatccttgtctgactgatgattcttacccaagccaaagttatgagaagtactttcttgattcgccaactgatgagtttgttcaacatcctattggctctggtgcctcggttagctcatttggctctttagactcatttccttatcagtcaagaccagttcttggatgttccatggaatttcagttaccgttggattcaacctctacttcatctacaaggcttttgggagattaccaagcggtttcttacagtccgagcatggatgtagtggaggagtttgatgatgagcaaatgagatcaaagattcaagagcttgaaagagcgcttctcggcgatgaagatgataaaatggttggaatagataacctcatggagattgacagcgaatggtcgtaccaaaacgaaagcgaacagcatcaagactcgcccaaagaatcatcgtctgcagattccaactctcatgtaagtagcaaagaagtggtgtctcaagccactccaaagcaaatcttgatatcttgtgctcgtgcgctatctgaaggaaaattagaagaagctttgtcaatggtaaatgagctgaggcagatagtttctatccaaggagacccttctcagagaatcgcagcttacatggtggaaggtctagctgcaagaatggccgcttcaggaaaattcatctacagagcattgaaatgcaaagagcctccttcggatgagaggcttgcagctatgcaagtcctgtttgaagtctgcccttgtttcaagttcgggtttttagcagctaatggtgcgatacttgaagcaatcaaaggtgaagaagaagttcacataatcgatttcgatataaaccaagggaaccaatacatgacactgatacgaagcattgctgagttgcctggtaaacgacctcgcctgaggttaacaggaattgatgaccctgaatcagtccaacgctccattggagggctaagaatcatcggtctaagactcgagcaactcgcagaggataatggagtatccttcaaattcaaagcaatgccttcaaagacttcgattgtctctccatcaacactcggttgcaaaccaggagaaaccttaatagtgaactttgcattccaacttcaccacatgcctgacgagagtgtcacaacagtaaaccagcgggacgagctacttcacatggtcaaaagcttaaacccaaagcttgtcacggtcgttgaacaagacgtgaacacaaacacttcaccgttctttcccagattcatagaggcttacgaatactactcagcagttttcgagtctctagacatgacacttccaagagaaagccaagagaggatgaatgtagaaagacagtgtctcgctagagacatagtcaacattgttgcttgcgaaggagaagaacggatagagagatacgaggctgcgggaaaatggagagcaaggatgatgatggctggattcaatccaaaaccaatgagtgctaaagtaaccaacaatatacaaaacctgataaagcaacaatattgcaataagtacaagcttaaagaagaaatgggtgagctccatttttgctgggaggagaaaagcttaatcgttgcttcagcttggaggtaagataagtgacaagagcatatagtc

SEQ ID NO: 4456 - DNA, 2703 bp, Artificial Sequence
  P2726 (35S::G1535)
cttccaagtgatgttgacaatgggagaaggtaatgtgatgacttcaaacaacagatttgcttcgccgccgcagcagccgtcttcttcttctccgggaacaatccaaaaccctaatttcaatttcatacctttcaactcatattcatccattatcccgaaggaagagcatgggatgatgagtatgatgatgatgatgggagatggaacagtagaggaaatgatggaaaacgggtcggcgggtgggtcattcgggtcaggtagtgaacaagcagaagatccaaagtttggaaacgaatctgatgtcaatgagcttcatgacgatgaacaacctcctccggctaagaagaaacgttatcacagacacactaatcgtcagatccaagaaatggaagcgttgtttaaagaaaaccctcatccagacgacaaacaaagaaagagattaagtgctgaacttggtcttaagcctcgacaagtcaagttttggttccaaaataggcgtacccaaatgaaggcacaacaagacagaaatgagaatgtgatgttaagggcagagaacgataatcttaagtcggagaattgtcatcttcaggcggagctacggtgcctctcttgtccttcttgcggcggccccaccgtccttggcgacattcctttcaacgagatccacattgagaactgtcgcctccgtgaagagcttgatcgtctgtgctgcattgcctcgagatacactggccgtccgatgcaatctatgccaccatctcagccattgatcaatccttctccgatgcttccacatcatcaaccttcattggagctagacatgagtgtatacgctgggaactttccagaacaatcttgtacagacatgatgatgcttcctccacaagatacagcttgtttcttcccagatcaaactgccaacaataacaacaacaacaacatgttacttgcggatgaagaaaaggttatcgctatggaattcgctgtctcttgtgttcaagaacttactaaaatgtgtgacacagaagagcctttgtggattaagaagaaatcagacaagattggcggcgaaattttgtgtcttaacgaggaagagtacatgaggttgttcccatggccgatggagaatcaaaacaacaaaggagattttcttagagaagcttcaaaggcgaatgcagtcgttatcatgaacagcataacactagttgacgcctttctaaacgctgataaatggtcagagatgttctgttcaatcgtggctagggcgaaaactgttcagataatttcatcaggagtttctggagctagtggttctctccttctgatgtttgcagagttacaggtactatctcctctggttccaactagagaagcttattttcttcggtatgtggaacaaaacgcagaaaccggaaattgggcaatcgtggatttcccgatcgatagcttccatgaccaaatgcagccaatgaatactattactcatgagtataagagaaaaccttcaggctgcatcattcaggacatgcctaatggatactcacaagtcaagtgggtggagcatgttgaagtagacgagaaacatgtgcacgagacttttgctgagtatgtgaaaagcggaatggcttttggagctaaccgttggctcgacgtgttgcagagacaatgcgagaggatcgctagtctaatggctagaaacataactgatcttggagtaatttcatctgcagaagcaaggaggaacataatgaggttatcacagagacttgtgaaaacattctgtgtgaatataagcactgcatatggacagtcttggaccgctttgtctgagacaactaaggacaccgtgaggatcacgacaaggaaaatgtgtgaacctggtcagccaacaggagttgttctttgtgctgtctcaaccacttggcttccattttctcaccatcaagtctttgatcttatccgtgatcaacatcaccaatctctggtaaacaaaaactagagtcttctctctgttcttgatgccaaaaccctaagatttttcgattttttccctgcagctagaggttttgttcaatggtaattcacctcatgaagttgctcatatcgcaaatggttcacatcctggaaattgcatctctcttcttcgaatcaatgtaagtttcaaaccttcattaaaaccctaattcaaagatttcaattttttccgaataaattagggtttttgcaggtcgcaagcaactcatggcataatgttgagctgatgcttcaagaaagctgcattgataactccggtagcttaatcgtctactccaccgtcgacgttgactcaattcagcaggcgatgaacggtgaagattcttccaatattccgattttacccctcggattctccattgtccccgtgaatcctcccgagggtatttccgtcaattcgcattctccgccgtcgtgtcttctcaccgtcgggattcaggtcttggcgagtaacgtcccaacagcgaaaccaaatctctccaccgtcaccaccatcaataaccatctctgcgccaccgttaatcagatcacttctgccctcagcaacaccattacgccggtgattgcatcttccgctgacgtgtccaatcaagaagtcagctagttgaccgaattacccctaaacctccttttgctttttctatctcagagtcagagcagtcccatgtc

SEQ ID NO: 4457 - DNA, 2110 bp, Artificial Sequence
  P2727 (35S::G1539)
cttgctatatcgctgtctctctcccttctcctctataaacatacatataaattaagtacacaccaaaatgtggacgatgggttacaacgaaggaggcgcagattccttcaacggaggaagaaagcttcgtcctctcatcccacgtctcacttcttgccccaccgccgccgtaaacaccaactccgaccaccgctttaatatgggtatctctttctctctctctcgtcaatttttggtgaaactttccagtctctctttcccttgtttctaatgctcattttcttgctttggttacgattttcacagcagtggtgacgatgacggcggagcagaacaagagggagctgatgatgctaaactcagaacctcaacatccaccggtaatggtgagctcacggtggaatccgacaccagatcagttaagggttcttgaagagctttaccgacaaggaactagaactccttctgccgaccacatccaacaaatcaccgcacagctacgacggtacgggaagatagaaggcaaaaacgttttctattggttccaaaaccacaaagcccgagaacgccagaaacgacggcgacaaatggaaactggccacgaagaaacggtcctttcaacagcaagtcttgtctcaaaccacggattcgacaagaaagatcctccaggtaagggaccataacagaacttggggattaacattcaaacaataaaagtctttttggattagaatgtctttttgggttgatttcatttcaaaattgacggtttgaaaattcatgtctggaattttgcaggttacaaggttgaacaggtcaagaactggatatgttcggtcggatgcgacacgcaaccagaggtatatatctctatttatacatatatttgtttctaaattgatattattttatgatatgtattatgtatatatgttgctcatattctgtgtttataatggtcttggggtttctattacatgaaagggagtgtaattaaggattgagggtttacatatataattagcatatgattacaaatagaatctgctagctaagaataagtgaattcctttttggaagtttgggtaagttattgaaagaaaaaaacaaaaggcagagagatgaggcggtggaaaagaccaagaagttaatttatggggaacttcaaaataagtatttttgtagcatatgcaaaaatacgtatattcttagcatataattatggttttattttgtttgaatattagtagtatctttttaaaaagattattgaattcatccaaaaagctgcagagactttcctttctgtcggcacagctgctacgtacgatcgatcctttagctctgtgtcttcttgtttttgctgaatttccataaattaatgtgctttttcactccaaacacatgcttgaaaagacccttttgaccctggtctttaacggtctcattcttcttcacccctgtccctatctggaattttgttttaagcataaagtttgtcgctttgccaaattttgacttatttgttaccaatttttacattttccgatgctaatttgactaatttcaacacatcttgaatgttctttcttttgcataattagaaaccttcccgtgattatcatctggaggagccagcgaatatacgggtggagcacaatgctcgttgtggaggagacgagagacgaagctttttagggataaacaccacgtggcagatgatgcagttgccacctagtttctactcttcttcacatcatcatcatcaacgtaacctcattctcaattcacctactgtttcctccaacatgtccaacagcaacaatgctgtctctgcttctaaagatacggtcacggtttcacctgtatttctacgtacgagagaagcaacgaacacagagacttgtcatcgaaatggtgatgataataaagatcaagaacaacatgaagattgctccaacggtgaattggatcatcaagaacagacacttgagctgtttccactgagaaaagaagggttttgtagcgatggtgagaaagacaagaacattagtggcattcactgtttctatgagtttctgccattgaagaactaaacctaattgaagtc

SEQ ID NO: 4458 - DNA, 869 bp, Artificial Sequence
  P2728 (35S::G1549)
cttgaaagtgattgttgtaagcagagatagacaaaagaggtaaaaaaaaagaagaagagaagatggaatattggagcagctccttcatcgatggcgcgtcttcttccagcttcatctctcctttctataactttgaccatttttcaggtaacatgcatccatagtactaggttttagtagagctagtttatatgcttaatgcttaatcattcactcaactgtatgtcgctttacaagtctctctctgtcttgtattgaatttgtaggaaaccaagacaacagatgtttaggtacaatgatgggtgcacaacaagatatacttcatgttcctctagcaatggtagagagtggctatggagaagaaagcaacagttttaatggacaggagaagaaaaaaaagaagatgacgagcgagcagctaaagttcctcgagagaagtttccaagaagagataaagctgaatccggacaggaagatgaagctgaatccggacaggaagatgaagctgtccaaagaactggggctgcagccgagacagattgcggtttggttccagaacaggaaagccaggtggaagaacaaacaacttgagcatctctatgaatcactaagacaagagtttgatattgtctctagagaaaaggaattgctacaagaagaggtaattactccagtgatcaatactaacttaataaataagctttcgagttacaatccattgagttactttcactttgtttcaacagctaatacaactgaaatcaatgataagagaggatagttcatgcaagaagaaacaaacctgggaaaaagcctgcagctgaggcaatagtatataagttccacttcagttatatctccaaaatggc

SEQ ID NO: 4459 - DNA, 2281 bp, Artificial Sequence
  P2732 (35S::G1593)
gaattgcaagttttgttgcttaattgtcagaataatggctgctttctttcttggagaatctgaaatgagagaacactcttctgatctttttatgatgactctgaatccgtttcgcgagcagacaacgaccactaatgctcatgacgatcacttctacaacttgtgctttggttcccaacaatatagacctcgagatgaagtaggtcatatagaacaaggaaattcttccatctccactttttcaaacggaggagtcttcagggctttggctccgatctacttgaaagcggctcaagaattactcaatgagattgtcaatgttggaaacggtagccacggcgcaaaacaagagcgaccggtgagtaaagagtccacgatttatggagttgaggacatcaatggtggctataagcctggcgtagctgctttgcaaatgaagaaagcaaaactcatctccatgggtgaaatggtaacttatttatacctacctatataatatgtgatacacaaataataataataagatctttgtatatacaaaccaaccatggtgatatatataatggcaataaactttctgttactttgagatcgggactcaagttcagtccatatatttggttattgcatgttaagtatttgatactttataaaggtttcaaagattggtaaattgatttgggaaatgaatttggtaaattatacacaggtggaacagagatacaagcaataccatgaccaaatgcagactataatctcatcgtttgagcaagctgcgggtttaggctcagcaaactcatacacacatatggcgttacaaacaatatcaaagcagtttcgtgctgtaaaagacatgataagtttgcaaatcaagcaaataaacaagctcttgggacaaaaggaatttgacgagcagcttaagaagttgggaaagatggcacatcaccattcaaatgcttggagaccgcagagaggtttgcccgaaaaagctgtttccgttctacgctcttggctctttgagcattttcttcatccgtaagtaacgttttcttctatctttaattcttgttacgattattgtcgatatatcagaatgatgggaccttgaagcaaagggaactaactaaggatatggaagctaggatcattacttagttttgtatagacatgcatgctaatgatttagttgtgtcttgttttggtttgtatagatatccgagggatttggataaggtaatgcttgccaaacagactggccttactaagagtcaggtaattgatttcgattatcagaagttggacatacttaagtttcttaatgttagatgtctcatacatagtacatatacaatttcatgacatcatctaacaccgactatcaagaataaataatctacaggtaaaaccgaatatatatatagattcaaacaaattttattccgatcaaaaaaatatttttagaaagatatctctttatttctatttttttttcttttcgagtctgaaaacaaaaacgtacccaagaattctaagaaaagcaggtaaaccaaatatattttggtaaatttatttagatagatgatgtatatttattttattataattattttaatgaaaatagcgatgatagcatacgagaaatatcatatatgtgatcctttgtaaagtaaatcaaatttattttggttaaattagtaattatatatattatggaatactttcttttagcacccatgattatatataatcaaaataagtattgttaatagtatcttgtgtaaaatggatgtaggtgtcaaattggttcattaatgctcgagttcgaatgtggaagccactggtggaggaactttattcggaagaaatggatattgaagaaagcagaaaaggaagtgaccggtatagtaccaaaggttcatcttcaaagcagccgtacaataatacaacttcaaatgaatcttcgaacacgatcctacccgcctttcgtcaaggattcactgaaactgaaacccctaggcaaaattcatcctcaagttgcagcgtagtcatgaggttcacgaagcaacacatgaatcaagcgaacttcatcaatttcaacggagggttcgaaaactatcacacaatggatggaaacagcgtctccctttccctcggcctgcctcattcttgtgaccaaacctttaataacattcattttgagtcaacaagtcatggaactgagaactcggccatatattcatcttcaacttatcaaatcatggattagaaataattagtgggg

SEQ ID NO: 4460 - DNA, 1440 bp, Artificial Sequence
  P2744 (35S::G2467)
gatcattagacttctagcattagcattgctaacaagatggacccgtcgtcaagctccagagcacggtcaatgccaccgccggtgcctatggagggattgcaggaagcagggccttctccttttctaacaaagacgttcgagatggttggtgatccaaacacaaaccacattgtgtcttggaacaggggaggcatcagttttgtcgtgtgggatccacattccttctcggccactattctgcctctatacttcaagcacaacaacttctccagctttgtcagacaacttaacacttatgtgagtatctctgtttctccactaaacgaccttactgtattttttgttttttttttcactatagtgttcccttaatcttatgtcttggaggaactcaacaatgccttcggcctttaattactgcaaaaggttaaacaatgtgtctatttgtgaattacttgttcactggatagtttagtactaagtaattatgctcaataataataatggctggtgaaacaagctagctagtagtgaaagagaagaagtttcttcgcaagttctggaaacctttatttataacaaaataaaaaagttctggaaacttttatccatatcaacctgcaataaaatattcaattattccatccaacaaaatataaaattgaagataatgttgctttccttttacagcgcagtagagtggcaggttcttcgtctgttatatataacatgtttacgtcgcaaaccaaaaaaaaacttatattatgatattcgattacttatttatctgcagggattcagaaagatcgaggcagagagatgggagtttatgaatgaaggtttcttgatgggtcagagggaccttctcaaaagcatcaagcgacgaacctcctcttcttcccctccttcgcttaactactctcagtctcagcccgaggctcatgacccaggcgtcgagcttccgcagctccgagaagagaggcatgtcctaatgatggagatctcgacgctcagacaggaggagcaaagagcgagaggctacgtccaagccatggagcagaggattaatggagcagagaagaaacagaggcatatgatgtccttcttgaggcgtgcggtggagaatccttcccttctgcagcagattttcgagcagaagagagaccgagaggaggccgcgatgattgatcaggctggcttgatcaaaatggaagaggtggagcacctgtcggagctggaggctctggcgcttgagatgcaaggatatggacggcaacggactgatggtgtggagagggagcttgacgacgggttttgggaagagttactcatgaacaatgaaaactccgacgaagaagaggcgaatgtgaagcaagattaggttttatgggttcatgtccgaaaaagaaaagtacaagtatcgatcaatcaaagctaatg

SEQ ID NO: 4461 - DNA, 1777 bp, Artificial Sequence
  P2750 (35S::G2453)
tcgaccctatcattcatcgtacacacacactctctatgacaaagctccccacaacactcaaccatctatttgatctgccggggcagatttgccatgtccagtgtggtttttgcaccactattttgctggtataccttaacttcttctcttattctctcccttcctttctcccttcctctctttatatatatgatcatgagtttaatgagtgtaaatgtgttgcaggtgagtgtaccgtttacaagcttgtcaatggtggtgactgtgagatgtgggcattgcacaagccttctctctgtcaatttgatgaaggcttccttcattcctctccatctccttgcttctctctcccatcttgatgaggtttccataacatctatacatagacaaacacacaccatctaaatatgaccaatatatatatatatatacttacttttgattatatgtaaatatatgtgcagaccgggaaagaggaggttgcagctacagatggtgtggaagaagaagcatggaaggtgaatcaggagaaggagaacagtccaacgactttggtttcatcttcagacaatgaagatgaagatgtgtctcgtgtttaccaagttgtcaataaacgtacgtttgagtataaattcaacttaaactttagttttgcgatttctcctttcatcagtcgtctaattatgttttgagtttgtatatatatagcacctgagaagcgacaaagagctccttcagcttacaattgcttcatcaagtaagaaataaattcaacacattacatgtgtatgtatattatatatattcttacaaatttaaccacttaaggttttgagtttgtaaaatggttcttctttgggggttgtattggagcagggaagagatcaggaggttaaaggctcagaatccaagcatggctcacaaggaagctttcagcttagctgccaaaaatgtacttaagcttaattagtcttaagatttaaaagaaaaccctaatatagttttcatctttttgttagcttaattgacagatcgagttagctaataacattttatgatttcaattttttgatttggggatggcgaagtgggcccattttcctccagctcacaacaagagagctgcttcagatcaatgtttttgtgaggaagataacaatgcgatactaccatgcaatgtttttgaggtaatcctcagcaaccatttatattttttaatcactttcgcttcaaaatcaattaccatattcttgacaagtaaactccacaacaagtgtcattttccaaagcaaaccaaataattaaagcattaactagatccaaatagcatcgctctcagtcaaaatttcagaaccctagctagactaattatataaagagaaatcatttactaattattagagtgaaagcaaggagaagggtaagtgagattgtgagaatatatcattgatcttcaactactacaatgtgtgaaatttatgacctaaacccttttatagtattgaagcttacactgcacacagtttacttttatagaaacccattcaactaatttaaaacattgaagctgaatatgtatagttttcaattaatataccaaataattgttgaaatgtttgtgatgcaggaccatgaagaaagcaataatgggttccgagagagaaaggctcagaggcattccatttggggaaaatctccatttgagtaataacaatttgggatatgaaaatttaacaaaaaaataaataatggcgtatgacatgtgatggtgactcgc

SEQ ID NO: 4462 - DNA, 881 bp, Artificial Sequence
  P2752 (35S::G2456)
ctatctgaacatcgatcagtcatatcttttcaatcaaatcaaagccctcctctctctcttactccttttttgttttaaatcaagaaaaagactccatgtcgagcatgtccatgtcgtcctcctcagctccagcttttccaccggaccacttctcatctacggaccagctctgttacgtccattgcagcttctgcgacactgtccttgctgtgagtgttcctccgagtagtttgttcaagacggtgacggtcagatgcggccactgttcgaaccttttgtcggtgaccgtgagcatgagagctcttcttcttccatccgtttccaaccttggccattcctttttacctccccctcctcctcctcctcctccaaatcttttggaggaaatgcgaagcggagggcagaatataaacatgaacatgatgatgagccatcacgcttcagctcaccacccgaacgagcatttggttatggcgactcgcaacggaagatcagtggatcatctacaagagatgcctcggccaccaccagccaatagacccccagagaagcgacaaagagtaccatctgcatacaaccgattcatcaaagaggagatccaacgtataaaggcaggcaaccctgatatcagccacagagaagccttcagtgctgctgccaaaaactgggctcatttccctcacatacactttggactcatggctgaccatcctcccacgaagaaggctaacgtgcgccaacaggaaggagaggatgggatgatgggaagagaagggttttacggttcagctgccaacgttggggtggcccataactagctacgaagactttcccaatcttttgtaatcttcaaaatgtggttactttcagctcaaacttaa

SEQ ID NO: 4463 - DNA, 789 bp, Artificial Sequence
  P2757 (35S::G2826)
ctaaagacatacatatttaatggaggagctggattttagttcaaaaacaacaacttctcgtctaaagctatttggatttagtgttgatggagaagaagatttctccgatcaatcagtcaaaactaacctatcttctgtatcaccggaacgtggcgagtttccggcaggatcttccggaagaagtggcggtggtgtacgaagccgaggcggaggaggaggaggaggagaacgtaagtatgagtgtcagtattgttgtagagagtttggtaactcacaagccttaggtggtcaccaaaacgctcacaagaaagagcgtcaacagcttaaacgtgctcagcttcaagctacacgaaacgcagccgcaaatttctcaaacgctggatcagcgtctcagtttttaaggaatcctatagtctctgcttttgctcctccgcctcatcttttatcatcatccgccgtgcctcagcctatgggaggtccttggatgtatcttccacgtgtttctccatctcaacttcacgtgtctcatggctgcgtcatccaagatggttcgggtggtgcgggtgctggtgggttctcgtacgagtatggggctcgtgattcagggtttggagtagttggggctcagatgagacatgttcaggcccatgggccgagaccatcggttaatgggttttcaagagaagtaggaactacttttgatgatggtttagggttggatttgcatctcagtcttgcacctgctggtcattgacgtgttttttaaagctcttgtatatttatcaacat

SEQ ID NO: 4464 - DNA, 900 bp, Artificial Sequence
  P2770 (35S::G2723)
gtttccctatatatatctcatatattcccaaaagaatttaaataaaatggcctctagttctatgagctcgagctcttcttggacgtctaagcaaaacaagatgttcgagagggctttagccgtttacgataaagacactcccgaccgttggcaaaacgtggctaaagcagttggaagtaaatctgcagaggaagttaaacgtcactacgacatcctcgttgaagatctcatgaacatcgaacaagacttagtacctttgcctaaatacaaaaccgtcgatgttggaagtaaatctagaggcatcgatgattttgatttgaggtgaaatctttttgtccttaccaaatcttttagagtttgtggtcgtttttgtgatttctatagtgatttagtagaaacatatgtttagttcaaataatttcaaaatctgattatataaatgagttcttttggtagtagtatattaaaactagtgatgaacgttggactatataataataataatataggtataataataagaaacatgcaaccacacgcaccatcccttctatttccggcattctcattaaaaggaaaggagtcacatgaaatctaatcctgtttgtgcaccatcacatgcacattgtcctcaacttttgaatcttatatgaatgatataatgttatatatgtatatatctagctaattctatattattcgaatacgattaaatataacggtatatattaatgcaaaagtgattctgatttttcactggtcggtgatcaacaaaagtggtatcttagtgtcaagttatattaattaatctattgttttttgacaggttaatgaagaatatgagaatccagtgaagttgttacatgatgtgaagattgctatatgtctaaggattcaaag

SEQ ID NO: 4465 - DNA, 1586 bp, Artificial Sequence
  P2771 (35S::G2802)
tcgacgagagagagttgatcaaagatattcgagattgagatgaacaagagtaatcctgctggttcggtgactggttcggatataatagacgccaagatcgaagaacatcaactttgtggatccaagaagtgtcctagctgcggccacaagctcgaaggcaaaccagtaacaggattgggttggtttaccagcaggagtgaaatttgacccaacggatcaagaattgatagaacatttagaagcgaaagtgttagctaaagacttcaaatctcaccctctcattgacgaattcatcccaaccattgaaggcgaagacggcatttgctacactcatcccgagaaacttcctggagtgactagagatggtttaagccgacacttctttcatagaccatcaaaggcgtacacgacgggaacaagaaagcgaagaaagattcaaacagaatgtgacaataatttgcaaggaagtagtagctccggtgagacgaggtggcataagaccggtaagacaagaccggttatggtaaacggtaagcaaaaaggttgtaagaagattttggttttgtataccaattttggtaagaatcgaaaaccggagaaaaccaattgggtaatgcatcaatatcatttggggacacatgaggaagagaaagaaggagaacttgttgtgtctaagatcttttatcaaactcagcctaggcaatgcaactggtcgtcttctacatcgagcttgaacgctataggtggtggcggcggtgaagcgagtagcggcggaggcggcggagagtatcatatgaggagagatagtgggactactagtggtgggagttgttcttcgtctagagaaattattaatgttaatcctccgaatcgatccgatgaaataggcggcgttggtggtggcgttatggccgtagcagctgcggctgcggcggttgcagctgggcttccgagttatgcaatggatcagctcagctttgttccgtttatgaaaagctttgatgaggtggcgaggagggaaactcctcagactgggcacgctacatgtgaggatgtaatggcagaacaacatcgtcatcgtcatcaaccatcatcatcaacatcacatcatatggctcatgatcatcaccatcatcatcatcaacaacaacaacaacggcatcatgcattcaacataagccagcctacacatccgatatcaaccattatttctccatctacttcgcttcaccatgcctccattaatattcttgacgataatccttatcatgttcatagaatcttgctccccaatgaaaattaccagacacaacagcaactacgtcaagaaggagaagaagaacataatgatgggaagatgggaggaaggtcagcttccggattggaagaactcataatgggctgcacttcttctaccactcatcatgatgtaaaagatgggtcatcatcaatggggaaccaacaagaagcagaatggttgaagtactcaacgttttggccagcccctgactcttctgacaaccaagatcatcatgggtaattgtgccattttccagtctgatgatcttgtcgacccacatcacggc

SEQ ID NO: 4466 - DNA, 654 bp, Artificial Sequence
  P2773 (35S::G2805)
gtttctctcccttcatcaatcatcatcagcattttccttaaatcttcttcttctaagagatcttagtttcactgaagaacgaagatgatgaagtcaagacgtgaacaatcaatcgaagaagcaatcgtcgcaaattatttgaagatgatgatcgataacgtaaacgtttggcctcgccacttcctccgaagcgaagacgtgtactgcaagaatccgtggacgcttttcgttactagagatcctataatcctacacttcggacgatacttcttcgttaatcggagtgtgaattcaggtttaaccgatggatgtgaatacggttgttggagaatcatcggtcgtgatagagtgatcaagtcggtgacgaccgggaagattctagggttaaagaaggtttataagttctgtgaaactgatcggaaaccgaaatcggtttttaagttcttggaaaaggagaagagaagagtaagagatagacgaatctgggcgatggaagagtataggtttgcaagtacgtggaaacaagattacgtgatctgcaagattcgacgtctgtatccacaaccatttgactacatgttggcccagcacattcgaggttactataaatgaatcactgatattctgatcctggatttgaacactcgattactg

SEQ ID NO: 4467 - DNA, 1081 bp, Artificial Sequence
  P2775 (35S::G1357)
gactctctttgcatcatctctacccttatggcagctgcaccaccgatcgagccggcggtgacgacgacgttccctggcttcaaattctccccgaccgacatcgaacttatatcttattacttgaagaggaagatggatggtttggagagatctgttgagattatacctgaggttgagatttacaacttcgagccttgggatttacctgataagtctatcgttaaatcggatagcgaatggttcttcttctgtgctcgcggtaagaagtatccccacggttcacagaacagaagagcaaccaagataggatattggaaagccacaggaaaagagcgtaatgtgaagtcaggttctgaggtcattggaacaaagagaacgcttgtattccacattggccgcgcgccaaaaggaggaagaacggaatggcttatgcatgagtactgcatgattggagtatcactggatgctctggttatttgccgacttaggaggaatactgaatttcaagggagtacaattcaaaagccaccacaaccaagtttaccactggataagcacgtaaacttgcggaatgaagctatttcagaaagtatttatggttgggaaactatggttgatttctacttatcaagtgagtcagggcaagaactacttagtgaaatagcagaatcttcacaatcttcacaaaatccacaggaatttttccatgtttaaaggttcctagtgaagaagatttctatgccgatatactgagggatgaaatagtaaagctagatgatccggcggtatccggtaatacactgatcaatgtaccaaggcttcaaacagagtccaataccacaagagtactacctttacctgacatggtagacaaacaaatgcaatcgttgctacagaaactaccattacaaaatgacactggagaagagaacaacatatccatgtcaaattgctttatcggtatctactcgattaagtctataaaccgagcgcgatgggacgttgttgtttggttactcgttatgatagccgtgttggtgttttatttagtgtgaggttaaagaagacatcttctaggcag

SEQ ID NO: 4468 - DNA, 934 bp, Artificial Sequence
  P2789 (35S::G2311)
gagagagcacgaggtaaatcacgcaagggttagatgggaaaccagaaactaaagtggacggcggaggaagaggaggcgttactcgccggaatcagaaagcacggtcctggaaagtggaagaatattctccgggatccagaattcgctgatcagctcatccatcgctccaacattgacctaaaggataagtggcgtaacttgagtgttccccctggtactcaaagtttaactaataaggcacggccagcaaaagtcaaagaggaaggcgacactccggctgcagatgcaaatgatgctgtcactattccacggcctattcctactattccacctcctcccggtcggcgtactttaccttctgagttgatccctgatgaaaatacaaagaatgctcctaggtatgacggggtgatatttgaagctctctctgctttagccgatggtaatggatctgatgtcagttccatttatcatttcattgagcccaggcatgaagtaccgccaaattttagaagaatccttagtacaagactgaggaggcttgcagctcagagcaaacttgaaaaggttagcaccttcaaatctatacagaacttctataagatacccgatccatcaggaacaaaaataggtgtcccaaaaccaaaggagacacatacgaagctgcgccaagcaaacaatcagacctctgctgattcacaacagatgatcgaggaagctgcaataaccgcagcctgtaaagtcgtagaggcggagaataaaatagacgttgccaaactagcagcagaagagtttgagaagatgacaaagattgcagaagaaaatagaaaactcctggtcatagctactgagatgcatgaactatgttcctgtggggagactatgctcttggcttgaattgaatctatgggacattccttgtagctctcttcag

SEQ ID NO: 4469 - DNA, 1141 bp, Artificial Sequence
  P2791 (35S::G515)
tcgacgcagaagaacatcaaccatggcgaaagctctccaatgcatatttttttgatcttttccttttcccttcttttttgatcgctgcagagaaatggaaactcctgtgggtttaagattctgtccgaccgacgaggagatcgtcgtcgattacctttggccgaaaaattccgatagagacacgagccatgtcgatcgattcattaacacagtccctgtctgtagactcgatccttgggagttaccttgccagtcaaggatcaaactgaaagatgtggcttggtgtttcttcagacctaaggagaacaaatatggcagaggtgatcagcagatgagaaaaacgaaatctgggttttggaagagtactggcagaccaaagcctatcatgcgtaatcgccaacagatcggtgagaaaaagattttgatgttttacacgagtaaggaatccaaatccgattgggttatacacgagtaccacggtttctctcataaccagatgatgatgacatacacactctgtaaagttatgtttaatggtggcatgagagagaagtcttcctcttctccttcttcttctggtgttagtggaattgagcagagtcgtcgtgactctttaatccctcagcttgtcaacaattctgagggatcctcacttcacagagaagatccaagtcagtttggtgatgtgctgcaagaagctccaatcgaggatgctaaactgaccgaggaattggtaaaatggctgatgaatgatgaggatgatgctcaaatcgaggatgctataccgattgaggaatgggaaacatggttgaatgatattgatgatgctaaggagaagagtatcatgtttatgcatgataatcgaagtgattacagacctccaaactcattaactggtgtcttcagtgatgatgttagcagtgatgataatgattctgatttgctaactccaaaaacaaactctattcaaacttcgagcacttgtgatagttttggtagctcaaatcatcgcatagaccagatcaaagacctgcaagaatctcctacctcaacaatcaacttagtgtcactaactcaagaggtgagccaagctctaataaccagtattgataccgccgagaagaagaagaatccttatggc

SEQ ID NO: 4470 - DNA, 1024 bp, Artificial Sequence
  P2793 (35S::G2636)
gttatctttccacatttggggaactctagggttttgttatttttagagctttcttcttgtgccgacaatggatgttgatgtgtttaacggttgggggaggccaagatttgaagatgaatcccttatgccacctgggtttaggtttcatccaactgatgaagagctgatcacttactatctcctcaagaaggttcttgactctaatttctcttgtgccgccatttctcaagttgatctcaacaagtctgagccttgggagcttcctgagaaagcgaaaatgggggagaaggagtggtacttcttcacactaagagaccgtaaatacccaacgggactgagaacgaacagagcaacagaagctggttactggaaagccactggtaaagacagagagatcaaaagctcaaagacaaaatcacttctcgggatgaagaaaactcttgtcttttacaaaggcagagctcctaaaggagagaagagttgttgggtcatgcatgagtatcgccttgacggcaaattctcttaccattacatttcctcctccgctaaggatgaatgggttctctgtaaagtttgtctgaaaagcggcgtagttagtagagagacgaacttgatctcttcttcttcttcttctgccgtcaccggagagttctcctctgccggttctgcaattgctccgatcatcaatacctttgcgacggagcacgtgtcctgtttctccaataactctgctgctcataccgatgcgagctttcatacattccttcccgctccaccgccgtcactgcccccacgtcagccacgtcacgtcggtgatggcgtggcgtttggtcagtttctggatttgggatcatcgggacagattgatttcgatgcagcagcagcagcgttctttccgaatctaccttctctgcctcccacggttcttcctcctcctccgtcatttgcaatgtacggtggaggctcccccgccgtgagtgtgtggccgtttactctctgatcgccatgcggtcattaaactatc

SEQ ID NO: 4471 - DNA, 1318 bp, Artificial Sequence
  P2795 (35S::G1247)
cttacatatgaagctcattcatgatgggtaaaattttccatgattcaggatcaagcgaatgatttattagcaatgaagaaaacttttactaagtctaaatggaaaccagaggaagatagaattttgaaagattatgttattcaatatggtgatagaacttggactcatgttccaaaacgcacgggccttcctcataatcctgcaagttgtcgttttcgttggatgaatcatcttaagccaagcttgaaaaaagggccctttaccgatgaggaagagaagcgtgttctccaacttcatgctgttttggggaacaaatggtcacaaatggctagagaagtatgtaactctctttcctttttttttcactctctacattttcatcttcttttactgtttgatttaaacttttgtttctttaagttccctggtcgaacagataacgagataaagaatttttggaacgcaagacgtatgcgattgaaaggaaagggtttaccagtttaccctgatgaagttcgagagcaggcgatacgtacagcagcacaatatggtgtaaaagttgaattattgaatgctcattatagtcaagactcattgatggcaggcaatgtcgagaaacctcaagaactcaataacttggcactcaatcaatgttctccgtattaccagtcaacgcttgccaatgttcagcctagccgcaatcgcgttatggaaccagaaacaacatttcctttcacgggtggatctgccatgaacgagcaaaaccctactctcttgtgtaatccttacgtggagagcactcaagaacagttacctgacagccatttgtttggaaatgttacatattcttctcctcctatgcctctcattcacgaggttgagaacttggagctcccttcattccaaggctttgattttcatgaagagcctagcagttttggagcagaacaatataacccaatgctgaatcttgagccacacaacactttggtccagtctcctctgataggccagacaccaacagatttcccatcatcattctatgatgaattgttggatgaattgttggaatcagttgttaacggttcattaggagaaataccgaaaaccgataccagttcggagtcccaactgtttcagtcctctctacgtagccataccgatgctacaccagacattgcaaacacaactggtaaaccttttttagtctctacgcattacattacaatcacttcattttttgtgtgttcaattcaagaggtttccactaatctttatgcatgacaaaacttcaattttgaaacagatttaggttatg

SEQ ID NO: 4472 - DNA, 970 bp, Artificial Sequence
  P2796 (35S::G2717)
gaacggacttgctttgacacagcagaccgtaaatcgggatgggtgctcctaagcagaaatggactcaagaagaagagtcagctttaaagtctggagttataaagcatggacctggtaaatggcgcacaattctcaaagatcctgaatttagcggagtcttgtacctgcgttccaatgttgatcttaaggacaaatggagaaacatgagtgtcatggcaaatggctggggatcgcgcgaaaagtctaggttagctgttaaaaggacgttctcccttcctaaacaggaagagaactcactagccctaaccaattctttgcaaagtgatgaagaaaatgtggatgcgacctctggactccaagtttcttctaatcctcctccaaggagacctaatgtaaggttggatagccttataatggaagcaatagctaccctgaaagaacctggtggctgtaacaaaacaacaattggtgcctacattgaggatcaatatcatgctccaccagacttcaaacgcttgttgtctaccaagctaaagtacttgacatcttgcgggaaacttgtgaaggttaaacgtaagtacagaattccaaactccactcccttgtcttcccacaggagaaaaggtctgggggtgtttggaggaaaacagaggacttcttctttgccttcacctaaaacagacatagatgaagtgaattttcagacaaggtcacagattgatacagagatagccagaatgaagagtatgaacgtacatgaggcggcagcagttgcagcacaggcagtagcagaggcagaagctgccatggcagaggctgaggaagctgcaaaggaagcggaggcagcagaagccgaagcagaagcagctcaagctttcgctgaggaagcttcaaagacattgaaaggaagaaacatctgcaaaatgatgatccgtgcctgaggtaatggaaagcgagagaagaaggagac

SEQ ID NO: 4473 - DNA, 1461 bp, Artificial Sequence
  P2797 (35S::G3075)
ggcgaaagggtgaaacatactgtagttctaaaaaattaatggtgtcgtcaaagaaacccaaggagaagaaggcgaggagcgatgtcgtcgtcaataaagcgagtggtcggagtaaacgcagctccggttccagaacgaagaagacgtcgaacaaggttaacattgtgaagaagaagccggagatttacgagatctcagaatcatcgagcagtgactctgtggaagaagcaataagaggcgatgaggcgaagaaaagtaacggcgtcgtgagcaagaggggtaacggaaagagtgtaggaattccgacgaagacgagtaaaaatcgagaagaggacgatggaggcgcggaagatgctaagatcaagtttccgatgaatcggattcggcggatcatgagaagcgataattctgctcctcagattatgcaggatgctgtatttcttgtcaacaaagccacggtatagtactaattagacatataaatttagcttgaggaacttaatttcacatggtttttgatgaatttgggagtatcaattgctagtcagtgttaattgggcgttataatctcgcaaattgctacagtaatgagattgtttctgttaattaagccgggaattaacgttattgcttcatctccatgtgtgtttgatgaaaccgtagttactgtgcttgattgtcataggtttagcttttacatccagaacttgtagacacctaacacatgagaaagtccttatatatgatttaggttcatattttcaaagcttaagtgatgagtgtttaattttcctgtattggaacttggcattgttttttctttcttttgatttcatcttgtgttcatcgaaattgatgttcattgcgtttacagtacattaactggtttttgtgattgaaggagatgttcattgagcggttttctgaagaagcttatgatagttccgtcaaggacaaaaagaaattcatccactacaaacacctctgtaagctctaatctcgtccctatttgccaatatctggttacctcaatactgaatcccatgtcgaaaatctcatgctgctgcaccaattgctgaacttaggatttctggcttctgcacaagggccagtagttagtcttaggaagagtttagataatgagttaatccgttcgtatcacttgcaagatttgttgcactcctaacataattgatgacactgtcatttctactcgttggcagcatccgtagtgagtaacgaccagagatacgagttccttgcaggtacttaataacctctgaagtattcgttttatgagttccatgtggtttacgaacagcattttaatacctgtaatatcttgaatgcagatagtgttcccgagaaacttaaagcagaggccgcgttggaggaatgggaaagaggcatgacagatgcaggctgaaataaatccggttggaatcgaactgaaccatttgg

SEQ ID NO: 4474 - DNA, 1920 bp, Artificial Sequence
  P2804 (35S::G1893)
ctcactatcttctctcctaaagttaatggctgatccagattgtatcttcagaaatggatatgtagactactataactatagcttcaactatgccacttccctctcacgcatctacaactctcatgacagcttttattatcctcaccagacgacaaacccaaacatcaacgaaaaccctaatttgacttcacctgactctcctccacttagagaagccctccctctccttagcttaagccccattcataagcatcaagaacctactgctaaccaccatgagtactatttcatggagacgacagaaacttcctctaattcaaactttcttgatcaatgccaagacagttatcgtcatgatgtaaccgtggatcttcatctagggttaccaaacctcggtgatggtggaagcagcagcagcgatgtggtccttgattccaccgaccaccaagagggtcaccatgatcatcatcaagatcaaggacttgaagttactatggcttctgaccatgatgatgaacatggtggcttacaaaggggtaatcatcttcatcacttttggatcccgactccttctcagattctgatgggtccaacacagttctcttgtcctctatgcttcaagactttcaacagatacaacaacatgcaagtaaggatatattcattcaataaacctaactctaattagttgctattttccataaaatgattttcaagttttgactttttgttcttgaaaatagattagttttcttatttgtatctacataataattcttgttatttatttatttttcaaatcttcatcatgataaaacccctagtacacactacgacttttcataataattattactattataactcgagaaataacttttaatttgatggtacaagtcatcagctgtacgatggattgatggctaggaaaagatcaactaaaatcaatcaataggtttaagatcaagaagatcttctttaaccaaaagtctttttttcatactgactgtttctaaccctaaaatgtgatcagtcgtccttttccatttttattgtctctcttgatttttgcgcagttccactacacaacactcactaccctaaaaagtaaaagaaaaagaggatgataaatgtctagcagattgtgttgtacctctttatatcttcacattataacatatatatattttatgattgtttatattaattaaccctaaacaatcattcagctctagatctttcttgtcgtaacgtctaaaacttttccattaactttatatcttcagaatatttccgaggatcaacaatatagaagaaaaaaacgaaatttacagtgtgaaatctgaaaactgaaatttccattaacatgtttcaagattagtttggaatttaatctgaaagttctttagatatggtctaatgtattgtgatgaaatgttattagatgcacatgtggggacatggttcacaatacagaaaaggaccggagtcgctgagagggacacaaccaacggcgatgctgaagctgccttgctactgctgtgcaccgggctgcaagaacaacatagaccacccaagggctaggccgctcaaggacttccgtacgcttcagacacattacaagcggaagcacggtgtgaggccctttgcttgtcgtaggtgtgggaaggcatttgcggtcaaaggagattggaggactcacgagaagaactgtgggaagctatggtattgctcatgtgggtcggattttaagcacaagaggtcacttaaagaccacgttaaggcctttgggaatggtcatgtcccttgttgtggaattgatcatgaggaagaggaggctgcttctgatgtcgagcagcaagaatgatcgtgtttagtgttgttgttgtttcgagcattaattaattgtatgctttatgc

SEQ ID NO: 4475 - DNA, 1985 bp, Artificial Sequence
  P2805 (35S::G2834)
cattggtgctctccaagttccatctcaagcttttcttcttgtgggtgattcaatctctctctttctattttttttttcatttctgttgatttagtgatctttgatttgtgaaactttgtttttatcgtgtttgtttttgatttagggttttattttgttgtcggcgagttttgatttgatgattttgatgatttttttttgtttgaccgtttggtttttggatcttaagagttatgtgtgaagatttttttttgtttgtttgggtgaagaatttgtgttgatttcgataattttgagtttgattttgaatcttagtaatgaaatttgattctgtgaagtgtgtatgatgaactttgagctggtcctaattctgattctgataaagatttgatttttatggtttcttttgtaggttttgttgttctcttaattgaaaaacaagatcttgaactaaaaaatggaaactgaagacgatttgtgcaacaccaattggggaagctcttcttcgaaatcgcgagagccgggttcatcagactgtgggaattcgacattcgcaggttttacgtcccagcagaagtgggaagatgcttcaatcttggattatgagatgggtgtggagcctggattgcaagagagcattcaagcaaatgttgatttcttacaaggtgttagggctcaagcgtgggatccaaggacgatgttgagtaacctttcttttatggagcagaagattcaccagctgcaggatcttgttcatcttcttgttggtcgtggtgggcagcttcaaggtcgtcaagacgagctcgcggctcagcagcagcagcttataacgacggatcttacttccattatcatacagcttatttcaactgcaggtagtcttcttccatctgttaagcataatatgtcaacagctccgggtccattcactgggcagcccggttcagccgtgttcccttatgtaagggaggctaataacgttgcttcacagagtcagaacaataacaactgtggtgctcgagagttcgatttgcctaagccggttcttgttgatgagagggaaggtcatgttgtggaggaacatgagatgaaagatgaagatgatgtggaagaaggagagaaccttcctcccggttcgtatgagatattgcagcttgagaaagaagagattctcgcaccgcatactcacttctgcacgatatgtggcaagggtttcaagagagacgcgaatttgaggatgcatatgagagggcatggagatgagtacaaaacagcagctgctctggcgaaaccgaacaaagaatccgtacccgggtctgagccgatgctgatcaagaggtactcgtgcccattccttggttgcaaacgtaacaaggagcacaaaaagttccagcctttgaaaacgattctatgcgtgaagaatcactataaacgcacccactgcgataaaagcttcacttgcagccggtgccataccaagaaattctctgtcattgcagatcttaaaacccacgagaagcactgcgggaaaaacaagtggctttgttcctgtggtacaacattttcaaggaaagacaagttgtttggtcacatagctctgttccagggacacacgcctgcaatccctcttgaagagacaaaaccatcagccagtacatctactcagagagggagctctgaaggcgggaacaacaaccaaggaatggttggcttcaatcttggttctgcatcaaatgctaaccaagaaaccacacagcctggaatgactgatgggaggatatgttttgaggagtcgttctcaccaatgaactttgatacatgtaattttggagggttccacgagtttccgcgactgatgtttgatgattcagagagttcttttcaaatgcttattgcgaatgcctgtggtttctcgcccaggaatgttggtgagtctgtttcagatactagtctctaaggcattgccatatatatgataagttatg

SEQ ID NO: 4476 - DNA, 775 bp, Artificial Sequence
  P2806 (35S::G2617)
ctcaccttaacttcttttctactgcatagaaaaatcttacatatgatggatagaggagaatgcttgatgtcgatgaagcttagaccgatggtgacgaggccatcttcggatgggactttattttggccgtttagggaagagagagcgtttgcgtcagctgaggagtatggcggcggaggtggttgcatgtggccaccgaggtcttactcatgcagcttttgcgggagagagttcaagtcggcgcaagcactaggcggtcatatgaacgttcatcgaagagaccgagctcgactcaaacaacaatcattatcaccttcatcaactgaccaagccacacctcctgaatgtgatcgtcaacaacaagttcttgatgtgggatcaaaggttcttgttcaagaagaaacaagaaagcctaacggaaccaagagggagataagtgatgtttgtaataacaacgttttagaaagttctatgaaaagatatgaacatgacaatggtgaagtcaagactgacttatcggtcggtctactgagtactgagtttgatcctcggaagaagcaactaatcaacggatcatcttcgtcatggaagagggcaaagacggatgtgtcaagatttccaatgatgttagggttggtcattggaatttccgagatcaacggccatcatgaggagttggatcttgagctaaggctaggagctgatccgcctaaggttaactagcttaagtaattaaaaagtaataatagttaatgtgattgccaaaaagaagaag

SEQ ID NO: 4477 - DNA, 729 bp, Artificial Sequence
  P2808 (35S::G2964)
ctactccgattcaatcgatcttatcgagacatggatgctcgtaagagaggacgccctgaagctgctgcctctcacaactccaatggcggattcaagaggtctaagcaagcacttctggatgtccatttggtgacaattgccacttcttgcactatgtgcccggtgggtacaatgctgcagcgcagatgacaaatctccgamcaccggtktstcaagtttccaraaatatgcaaggatckggtggtcccggcggcagattctcagggagaggagatccaggatcaggccctgtttcaatctttggtgcttctacttccaagatcagtgtagatgcttctttagccggtgccatcattggaaaaggtggaatccattccaaacagatatgccgtgaaacaggagcaaaattatcgattaaagatcatgaaagagacccaaacttgaagattatcgagctggaaggaacatttgaacagatcaatgtagcgagtgggatggtgagagagcttatagggaggcttggatcagtgaagaaacctcaagggattggtggtcctgaagggaaaccacatcctgggagcaactacaaaaccaagatctgtgataggtactctaaagggaactgtacatatggagatagatgccattttgctcatggtgaatctgagctgcgcaggtcaggaatcgcttagttatgtctttagactcttgagaacagattatgcattg

SEQ ID NO: 4478 - DNA, 892 bp, Artificial Sequence
  P2812 (35S::G651)
tcgacctgctctgttttggtaaattgaggaaatggaagagaggcataagtgcaagttatgttggaagagcttcgctaatggaagggctttgggaggtcacatgaggtctcacatgctcattcaccctctccccagtcagcccgagtcatattcgtcttccatggctgatccagggtttgttcttcaggacagagagagtgaaaccgagtcgtccaagaagccctcccgcaaacgatccagacttaaccggagatccatctcatcattacgtcatcaacaatccaacgaagaagggaaaagtgaaaccgcaagagcagcagatatcaagatcggggttcaagaactcagtgagtcgtgtacggagcaggaaccgatgagttcggtgtcggacgctgcaacaacggaagaagacgtggccttgagtctcatgttgctgtcgagagacaagtgggagaaggaggaagaggaaagtgatgaagagagatggaagaagaagaggaataagtggttcgagtgcgagacttgcgagaaagtgtttaagtcgtatcaggcgttagggggacacagagcaagccacaagaagaagatagcagaaacagatcaattaggctcagatgagttgaagaagaagaagaagagtactagtagtcaccatgaatgtccaatctgtgccaaagtcttcacatctggtcaagctctcggaggtcacaaaagatctcacgcttccgctaataatgaattcacgagaagatcaggaataataattagcttgatagatctaaatctcccagcgccatcggaggaggaagagatggcctcgtcggttttttaatgcttgatcagattggtcaaactatagtaattaccacctttgattccaagtaatgtaggc

SEQ ID NO: 4479 - DNA, 816 bp, Artificial Sequence
  P2819 (35S::G3060)
caatttgatttctactctcgtatcggatctatacttaatcatggatactcgtaagagaggacggcctgaagctggctcattcaactccaatggcggcggatacaagaagtctaagcaagagatggaatcatattcaactggtttaggaagcaaatcgaagccatgcacaaaatttttcagtacttctggctgtcctttcggagagaattgccatttcttgcattatgttcccggaggatacaatgctgtatcgcagatgacaaatatgggaccacccattcctcaagtttccagaaacatgcaaggttctggtaatggaggccgattctcagggaggggagagtctgggcctggccatgtctctaactttggtgactcagccactgccagattcagtgttgatgcctctttagccggtgcaatcattgggaaaggcggagtcagttcaaagcagatatgtcgtcagacgggagtaaaattatcaattcaagatcacgagagagacccaaacttgaagaacattgtgcttgaaggaacacttgagcagataagcgaagcgagtgcaatggtaaaagatttgattgggaggcttaattcagcagctaagaaaccacctggtggtggtcttggtggtggtggtggcatgggttctgaagggaaaccacatccagggagcaacttcaagactaagatatgtgagagattctcaaaaggaaactgtacatttggtgatagatgtcactttgctcatggggaagcagagctacgcaagtcaggaatcgtctagttgttgcttgcagatagagaatttgctgg

SEQ ID NO: 4480 - DNA, 1332 bp, Artificial Sequence
  P2820 (35S::G3055)
tctcgaattcacgaaatctctcagcttttccgtgattcttggtaaaaattcacaaaatcgaaattggagaaagaaagaaaaaattagggtttgaggaaaagcttcgatttttcacacgatgagtcatcaccggcgagattccggcggagatgtagttcacgtgattcccacaaacaatcctccgccggataattggtttccgaatctcggcgatagtgctgtttgggcgacggaagatgattacaatagagcttgggctatgaatcccgataacacctccggcgacaacaatggtccaccgaacaagaagactcgaggctctccgtcgtcttcatcagccacgactacttctgctgcgagcaatcgtactaaagcgattgggaaaatgttcttcaagacgaagctttgttgcaagtttcgtgctgggacttgtccgtatataacgaattgtaactttgctcatacggtggaggagcttcgtcgtccaccgccgaattggcaggagattgtggcggctcatgaggaggagagatctggtggtatgggaactcctacagtttctgtggttgagattccacgggaggagtttcagatcccgtctttggtgtcatcgacggctgagagtgggagatcttttaaaggaagacattgtaagaagttttatactgaagaaggatgtccttatggagaaagttgtacgtttctgcatgatgaggcttcgaggaatagagagagtgttgctattagcttaggacctggtggttatggaagtggtggtggtggtggaagtggcggtggttctgttggtggtggtggtagtagtagcaatgtagtagtgcttggtggtggtggtggaagtggaagtggaagtgggattcagattttgaagccttcaaattggaagacaaggatttgcaacaaatgggagattactgggtattgtccatttggtgctaagtgtcattttgctcatggagctgcagagttacatagatttggcggaggactcgtggaagaagaaggcaaagatggagtatcacccaatccggacacaaagcaaacagtacaaaaccccaaaggactatcagacacaacaacacttctatctccaggagtacctcataatgcagatgccagttaccacactggagttgcattgcaacgagcgtctagtgcggttacacaaaagcctggaattagaactcatcagaagtggaaaggaccggcgaaaatcagtcggatatacggtgattggatcgacgatattgaatgatgttacctctttcttttttctacacatttagataactgctaagaaaattacaatctccc

SEQ ID NO: 4481 - DNA, 2194 bp, Artificial Sequence
  P2826 (35S::G2887)
ctttactggtgaagagtttacagaagattgttcaaagttttcccctttggattcttcgccaatggggaaaactcaactcgctcctggatttcgtttccatccgactgatgttgaactcgtgaggtattacttgaagaggaaaatactggggaaaaagctccttgtcgatgctattgctgaagttgacatttacaagtttgaaccccctgatttacctggtatccatttctaaaacactcttgttctgttcatgtgtttgcatctaagttctctgactcggagacttgttctttacagatatgtcttttataagaagtggggatcttaagtggcacttcttctgccccagggaaaagaagtatgctagtggggtaagggcaaaccgtgcaactgagtgtggctactggaagaccacggggaaggagagaccagttctgtgcaattctgaggttgtgggaaagatcaaaactctggtttatcactttggcaagtcgcctcgtggggagcggactgattgggttatgcatgaatacaggcttgacgacaaagtactgacgcagatgaatgttcctcaggtaatatatactacttattataaatggcaaatatgatttcaacttgaacaggtgtttaggtttacgagtatttactgatgatagcttgccgttttaatttgttccttaattgctttgatagtgtgttactgtcctgcctgcaattttttccttcttccacttatatattgtttcctgcttgtttagttttatagatttatgtatcatccatgtaagcttatatcactctctctttacttacaattatgttttggactgcaggatacttatgtggtgtgtgttctgttcaagaaagatggtcctggacctagaaatggagctcaatatggagctccgtttaaggaagaggactggagtgatgaggaagtacgtactgatgttccttctactagtaatcccacaaaccttcttgagcctagcaaagaaaccactctggctttgactgccccagatgactccaataaggattgttttggtggcatgatatcagagtcatgtgtctcggatttcctaccagctacaactaataccaccagcgagcttccacatccaagtgatgcagctaccactcctatgtctactgcacctctggcagagaccgttcagacccccaacaatgatgacttatattcaatgttggatctatttgatgatgacgaagagttcttagggttcaacaataatgaggtagtttttttttgcattcttcttctttggcttagtatagtgataacaagccggtgtcactgcatgttcttaagctagcaaggctactttaaagctgttaagtgttttagtggcattggaacgtagtagttacccattagacaaagcttctttgctatatcttcgatcttagtatccaacatcaatatgtgctcttttgtatctgcttgttctccaacatcaatatgtgctcttttgtatctgcaaaatacattctcatatttaatcaatctacaggtaagatatgatcccggtgtctcagctccagtttgcttagaagaagaaggcattttcaacggactaccagagttgagcagcatgccaaggacggcctcttacgacctagttgaaaactcggagttatacctagagctacaagacctcactgctccattaaatccccaaactgggctacaagacctcactgctccatttaatcctcaaactgggctacaagacctcactgctccatttaatcatcaaactgggctacaagaccacactgctccatttaatcctcaaactgggctacaagaccacactgctccatttaatcatcaaactgggctacaagacctcactgctccatttaatcctcaaactgggctacaagacctcactgctccatttaatcctcaaactgggctacatgacctcacttctccatttaatcctcaaactgggctacaagacctcactgctccattaaatcctcaaactgggaatcgcaatgacccgagaagctcctcctttctgtataatcaaggccattttgacttctctggtggtaatgatgatgatccttatggcttttctgcttccatgagacatagaccaaaaatgtaaaaaaagaagaagagaagagaagcaggatttacaaatccaacagatgc

SEQ ID NO: 4482 - DNA, 1402 bp, Artificial Sequence; identical to SEQ ID NO: 1673
  P2829 (35S::G2765)

SEQ ID NO: 4483 - DNA, 746 bp, Artificial Sequence
  P2831 (35S::G2839)
cttgaagtcactaagttgattcaaaatggttgcgagaagtgaggaagttgagatagtggaagatacggcggcgaaatgtttgatgttgttatcaagagttggagaatgcggcggaggaggagagaaacgagttttccgatgcaagacttgtcttaaagagttttcgtcgtttcaagctttgggaggtcatcgtgcaagccacaagaaactcattaacagtagcgatccatcacttcttggatccttgtctaacaagaaaactaaaacggcgacgtctcatccttgtccgatatgtggcgtggagtttccgatggggcaagctcttggtggtcacatgaggagacataggagtgagaaagcctcaccaggcacgttggttacacgttcttttttaccggagacgacgacggtgacgactttgaaaaaatcgagtagtgggaagagagtggcttgtttggacttagattcgatggagagtttagtcaattggaagttggagttgggaagaacgatttcttgattcgttttatttcttcatattcgttatagggttttaacatattttcatacagtttcatattgtaatctttgtagatccatttatcttaccgatcgatgtgaatattattttgatatacactattggagtttacattcaatgtacaaaaaaaaaaaaaaagggcggccgctctagagtatccctcgaggggcccaagcttacgcgtacccagctttggtgtgttcaa

SEQ ID NO: 4484 - DNA, 1213 bp, Artificial Sequence
  P2833 (35S::G2375)
ctcttctttttttcaatgaaacctctcttcatttataagtaacccaacaaaaaaataaaattatctccctcttatttcttctcttcacgtcacaaagacaattcgattccaaataatggaccgacgtaaccctttccaacatcaccaccaccaccatcagcttcatcatcacttgatccaacagcaacagcttcctccgccgccgctgagcaccacggcgacgatggatcccggcggaggaggaggaggtggggagagaatcccacagtggagcatagaggagacaaaggagcttttggctataagagaagaacttgatcaaactttcatggagaccaaacgtaataagcttctttgggaagtcgtggctgctaagatggccgacaagggttttgtccgaagcgcagaacaatgtaagagcaagtggaagaacctcgtcactagatacaaggcgtgtgagaccactgagccagatgctattaggcagcagttcccattctacaatgagattcagtcgatttttgaagcaagaatgcaaagaatgctgtggtcagaagccacagaaccaagcacttcctcgaagagaaaacatcatcaattttcatctgatgatgaagaagaagaagttgacgaaccaaatcaagatatcaacgaggaattattgtctttagtagagacacagaaaagagagacagaagtgattactactagtacttcgaccaatccaagaaaacgtgcaaaaaaaggaaaaggcgttgcgagtggtacgaaagctgaaactgcgggtaatacactaaaagatatattggaggagtttatgaggcaaacggtgaagatggaaaaggaatggagagatgcatgggagatgaaggagatagagagggagaagagagagaaagagtggcggaggagaatggcggagctagaggaggaaagagccgccacagaaaggaggtggatggagagagaggaagagagacggttgagagaagaagctagggctcagaagagagattctctcatcgatgctttgcttaataggcttaatagagatcataatgatgatcatcataatcaaggtttctaagttctcattatttgtgttaagcataagttaattagctagttaatttgttaggcaaatcaatttagataatatatctaaattaatgtttgttttataatatttatatgaactattgaaatttccaaa

SEQ ID NO: 4485 - DNA, 1765 bp, Artificial Sequence
  P2910 (35S::G2592)
gaggactatatgttaagtttatactaagaaaatggttttggtatgtttttgcagcgtttctctaaagtagaatctttggtattcggaaaaatgtcgtttctgagtattgttcgtgatgttagagatactgtaggaagcttttcgagacgtagtttcgacgtgagagtatctaatgggacgactcatcagaggagtaaatctcacggtgttgaggcacatattgaagatcttattgtaatcaagaacactcgttgggctaatttaccggctgcgctattacgagatgtgatgaaaaagttggatgaaagcgagagtacttggcctgcacgtaaacaagtcgttgcttgtgctggtgtctgcaagacatggagactaatgtgcaaagatattgtgaaaagtcctgagttctcaggcaaactcacatttccagtttcgttgaaacaggttcgtggtttcgttattcgttacttccattcgacattatgtcggttattctgacaactcttttgatggtgaagcccgggcctagggatggaatcatacaatgttatatcaaaagagacaagtctaacatgacttaccacctttacctttctcttagtcctggtaagttattcgtctttgtcgatgttactacctctgcttcagtaaaatttggactcaaaatttagtagaacacacatgtcatacttttgtttaaattcaatacttatcaagatcttgaaaatatcaagaactcgaattttctctattatttagtttttgaatcttgtcaaatttgtacagccatacttgttgaaagtgggaagtttcttctctcggcaaagcgctcacggagagctacatacacagagtatgtaatatcaatggatgcagacaacatttcaagatcaagcagcacttacattggcaaactgaagtaagaagaagatttaaaaaaaacatcattcgtccacatgttttgagttcttgattaattcagacaaacgtttgtcttacttcattttcaggtctaactttctagggacaaaatttatagtatatgatacggctcctgcgtacaacagtagccagatattgtccccaccaaaccggagtcgtagtttcaactccaagaaagtgtctcccaaagtcccttctggaagttacaacattgctcaagttacatacgagctgaacttgcttggaacccgtggacctcgtagaatgaactgcattatgcactctatcccctccttagctctagaacccggaggtactgtccctagccaacctgagtttctacaacgttcccttgatgaatctttccgcagcatcggttcctcaaagatagtcaaccactcgggagatttcacccgaccgaaagaggaagaaggaaaggtgcgacctttggtactgaaaactaaaccgccaaggtggctccaaccgttgcgatgttggtgccttaacttcaaagggagagtgactgtagcttctgtcaagaacttccagttgatgtccgctgcaacggttcagcccggtagtggtagtgatggtggagcattggctacgaggccatcgttatcaccacagcagccagagcaatcaaaccatgataagataatactacactttgggaaagtgggtaaggatatgttcactatggactatcgttatcctctctctgcctttcaagcgtttgccatttccctgagcacctttgatactaaattggcatgtgaataaaagtagaaagatcataagagggacttaaaactaataggaa

SEQ ID NO: 4486 - DNA, 1411 bp, Artificial Sequence
  P3279 (35S::G2699)
catggacatgtcattgtctccaccctactatactctttttttgttctttttgtttcctcttgtgtcacaaaaataacaagattaaacgtacatttctctctaaaaccagactcaaatgaccaaaacccggattctcaacccgacccgattcccttctcccaaacccttacgtggctgcggcgacgctaacttcatggaacagctcctccttcactgcgccaccgccatagactccaacgacgctgcattaactcaccaaatcctctgggtcctcaacaacatcgctccaccagacggtgactccacccaacgtcttacatccgcattcctccgcgcgttgctctcacgcgccgtctccaaaacccctacactatcatccaccattagcttcctacctcaggccgatgaactccatcgtttctcagtcgtggagttagccgctttcgtagacctcactccgtggcaccggttcggattcattgcagccaacgccgcgatcttaaccgccgttgaaggttactcaacggttcacatcgttgacttaagtttgactcattgtatgcaaatccctactcttatagacgccatggcaagccgactcaacaaacctcctccgcttcttaaactcaccgtcgtctcttcctccgaccacttcccaccattcatcaacatctcctacgaagaactcggatctaaactagtcaacttcgccaccacacgaaacattacaatggagttcacaatcgtaccttctacttactccgatggcttctcctccctcttacaacagttacggatttatccttcttcattcaacgaagctctcgtcgttaactgtcacatgatgctccgttacatccctgaagaacccctaacttcatcatcatcatcgctccgaacagttttcttgaaacaactccgatctttgaatccaagaatcgtaaccctaatcgaagaagacgtagatctcacatcggagaacttggttaaccggttaaaatcggcgtttaactacttctggattccgttcgatacgacggacacgtttatgagtgagcagagacggtggtacgaggcggagataagttggaagatagaaaacgtggtggcgaaggaaggtgcggagagagtggagaggacggagacgaagagacggtggatagagagaatgagagaggctgagttcggtggagttagggttaaagaagatgcggtggcggatgtgaaggcgatgctggaggagcacgctgtcgggtggggaatgaagaaggaagacgacgacgagagtctcgtgctgacgtggaaaggtcatagtgttgtgtttgctaccgtttgggttcccatttaaatcaggttgatttaatttaattagcgttttaattggatacctaatatagtagaatagcattgc

SEQ ID NO: 4487 - DNA, 1073 bp, Artificial Sequence
  P3286 (35S::G2830)
gtaatcaataacgtgccagatttgaaattaactaaataacaaatatattgactttgaattcatgaatttcaatatattaccttttttgcacttcaaaaatatataaaaggatacatagggaaataatttagatacacttagagctacaaaatgtcttccatcccaaataggttcaatatttatggtggtgataccacaaaccatcgtgaatcgcttcccatcgaaatgaatcacaactctcgaatggttcgatccatgttcattacatctgatcgcatgaatcatagagatttgttttcttctcctccttctttctcttcttatcaaaattcacatatctcttcatcttctgttgggtttaataattcacatatgacttatcatatgctgaaaagaaattatgattctgtttcccgtgctgattatttctctactaaagatcattctcattttactcaagtatctttcactcaaaccatcacaaataagtatactactattgttccttccaatatatttgacactgttcactatgatattggtcgtgtcaaacgtgccatagattttagaaatatttggaatcctaaatctcatcttccaaaaaaatttaataggcaatgcgagattttgaatcctacccctcttaatatcgtctttccgcaccaggattcagctgatcgtcaacatttagacattattttctcgtcatcaaagcacaaccatgttttccaagatggtcgatccttgaagaaaatttccgaaccaaccaatctgtttgaaaaatctaattcttatgattctcaagaagatgagaaaatcgatgcttatcaatatgatggtcgtacacatagtctaccgtatacgaaatacggtccatatacatgtcccaggtgtaacggtgtgtttgatacttctcaaaaatttgctgcacatatgttatctcactacaataatgagacggacaaagaaagagaccaaagatttcgtgcaagaaataaaaaacgatatcgtaagtttatggacagtcttaaaatatcaaaacagaagatatgatccgtcgcgatgggacgatc

SEQ ID NO: 4488 - DNA, 1019 bp, Artificial Sequence
  P3288 (35S::G2837)
ctgtcataaccgccatggttcagagaaaactttatataagggctaattcaatgtcgttttgaaacatcaatccctagactaaagtgcgaaaatagtatgagtaatccgaacccagagaaaacgaaagtggatgttactgaggaagagaaagaggaatctgatgagcaatggagcgatgaagaaaccaatatgagagaaattgttctcggcctccctgctttgaatatcagcagtagaatatttggagagagtagtagtgtcgttgaggaagatgcagaaaaagcgcgtttgaatgagcaagcggttcttgcggcggggttgattttggctgcggcagaggaagcggttatgaaaggaatgaatgagggaagtgggagtggtgggaagaaaaagagtagaccaaggatatctacgcaaaccgatgacgaaggggatggtttgggtgaaggagaagcgaaaaagccgaagaagaaagcaaaggaattgactcatccaccgaaaggaccaccggtttgtcatatctgtggaagaggtttcggttcgtggaaggcagtgtttgggcatatgagggctcatagagatagaaactatcaagggtttcttcctcctcctacattctctgcgggggctgaaaggtttgtgattcccgggctaagatctgcttttactattgccactgtcggaggaggaagttctggtggtgtagcggtaggaggaagaagttccggtgatttttctggcagtggtggtggtgatgcgccaggatctgaaggtgggagaggttcaggtattgatttgaatgtggaacctgtggagcaagtagaggaagcgactgaatctggatgtattgccaagttcgatcttaataaatctccaccaaaagatgaagaggaagaggacaaacccaagtgaaagattttttcatactatttaataatttactataacacatagtatagttattattttcatatttcatatttgatatatttatctaacacattatgttgattctttga

SEQ ID NO: 4489 - DNA, 773 bp, Artificial Sequence
  P3291 (35S::G3003)
tcgaccgtgggatctacttacgtatctgcatgattattagttataaaagttattgcaaacattaaattactttcatagagagcaatcattatattaaggtaatttaattttattatatatagtcaagatttaaaggaataaagaaaagattctcaaaacatttcatctctctccaacaactattcaccacattcaatggagtcaccaccactatacgagatatcctcaagctcttcttctgaaaaacctagacaccatttccaatcccttgatctcttccctaacctcaaccaaaactcttgtatcaacaataccctaattgagcctttaccgcttattgatcgcataaacttgaactcaaacctagacctaaaccctaatcccttgtatgcggaagaaggagagcaagaggaggaagaagaagaagaccgtgaagtggacgtggacttacacatcggccttcctggttttggtaaaccaagcaatgatgctaaacagctgaagaagagaaatgggaaggagatcgccacatatgacgccggaaaaggcatcgagaatgaactttccggaaaggcatactggatcccggcgccggagcaaattctcatagggttcactcatttttcttgccatgtatgcttcaagacattcaatcgctacaacaatcttcaggtacgagtcaatatatctcatgcgcattgcttttccatgcacaaacatatataataaattcatcttatagagttatatctccggatctaatgttatgaggc

SEQ ID NO: 4490 - DNA, 1867 bp, Artificial Sequence
  P3298 (35S::G1136)
ctacacgtcacctctctcttcttctcaccggaaaaaagtcttcacctttcaccggaaaatatcaccttttcaaccggcgtatgttcacatgaacggcacaacatcatcaatcaacttcttgacctccgacgatgacgcgtcggcggcggctatggaagctttcattggaacaaaccaccactcatctctctttcctccaccaccacaacaaccacctcagcctcagttcaacgaagatactcttcaacaacgtctccaagctttaatagaatccgccggagaaaactggacttacgctatcttctggcagatctcacacgacttcgattcatccaccggagataacacagtgatcctcggctggggagatggttactacaaaggagaggaagataaagagaagaagaagaacaacaccaacacggcggagcaagagcatcggaaaagagtaatacgtgagcttaactcgttaatctccggcggaattggggtttccgatgaatcaaacgatgaagaagtaacagatactgaatggttcttcttagtttcgatgactcaaagcttcgttaacggtgttggtctccccggagaatctttcttaaactctcgtgtgatttggttatccgggtctggtgctttaaccgggtcgggttgtgaaagagcgggtcaaggtcagatttacgggttaaagacgatggtgtgtatcgcgactcaaaacggcgtcgttgagcttggttcgtcggaggttataagtcaaagctcagatctgatgcataaagttaacaacttgtttaatttcaacaacggtggtggaaacaatggtgttgaagcttcttcgtggggttttaatctgaatccagatcaaggagagaatgatccagctttgtggattagtgaaccgacgaacaccggaatcgaatctccggcgagggttaataatggtaataactcgaattctaattctaagtctgattctcatcaaatttctaagcttgagaagaatgatattagctctgtagagaatcagaatcgtcaaagttcgtgtcttgtcgagaaagatttgacctttcaaggtgggttgttgaaatctaatgagactttgagtttctgtggtaatgagagtagtaagaagagaacttcggtatctaaagggagtaataatgatgaagggatgctttcgtttagtactgtggttagatcagctgcgaatgattcggatcattctgatcttgaagcatctgttgttaaggaagcgattgttgttgagccaccggagaagaagccgaggaaacgggggaggaaaccggcgaatgggagagaagagccgttgaatcatgttgaagcagagaggcagagaagagagaagttaaaccagagattctactctttgagagctgttgttcctaacgtttcgaagatggataaagcttcgcttctcggagacgcgatttcgtatatcaatgagcttaagtcgaagctgcagcaagcggagtctgataaagaggagattcagaagaagctagatgggatgagtaaggaagggaataatgggaaaggttgcgggtcaagggcaaaagaacggaaaagttcgaatcaagattctacggcgagttctatagaaatggagattgatgttaagatcataggttgggatgtgatgatacgtgtacaatgcggcaagaaagatcatcccggtgctaggttcatggaagcacttaaggaattggatttggaagtgaatcatgcgagtttatccgttgtgaatgatttgatgattcaacaagctacggtgaagatggggagccaatttttcaatcatgaccagctcaaagttgctttgatgacgaaagtcggagaaaactattga

SEQ ID NO: 4491 - DNA, 2488 bp, Artificial Sequence
  P3299 (35S::G324)
tcgaccataagtgaacacagaagaagcggtggctctgagccggcgaaatctcctttctcatccctaaaattttcatgtccatcttgcctcctccgattatccaaggtcacaattcgtcttctccttcttcagattcctctctaaaccctagctctgagcatggcaacaactcttcttcttctctctctcctcttccctcctctcctccttcccggatctcttcttccaccggaactcgattctccggacattctgaatcctctcacaatttctccggtggctctagggaaccgagtgttgcagctgaggagggacatagccgtggatcttccaaagagatgacacaaaatggagcagggaaggagagtttttccccacctaatgcagataagcgtgaccattttcgatatgatggtcgaaggaataggtctagagggagaggtactggagctgctggttcttcttcttctcaattgcagcataattccggaccttttaattctcctagaggcggtgtttcgcatcataatccaactggtagaagagctaatatgataagtgggaatcatttactgaattttcagtatgatccgatttcgcaaccgcaatctaggggtcctcctccgcctcaaagaaggcaacaatataaggggaggccttttaacaaggatttgtttcttaaggccaattataagtttgttgtgttggacactggagatcattctcctgattcaatggatcctgataaaatgctgcagtgggatgatattatttgtgtaaggtattctactccgtctcctgtccagtgtccgatttgcttggagtatcctctatgtccgcagattacttcctgtgggcatattttctgtttcccgtgtattctacagtacctgttgactggtgttgataaccacaaggtggactgcttcaagaggtgtcctttgtgctttgtgatgatttctccaagagagttatacactgtttatattgagaacgtcaagcagtattctgttggagatcccatcgagtttgtacttttgactcgcaagaaagattcttttgctcctacccggaaaaatgagcatgacttggctgttcctaatggtgaaaatgagatatatgatccgttctcaaagttcactttcacccaagatgttgatctctctgtcagacaagcagtttcagagttagacagttggattgcaagagcagatcctcagctcgttgaagacttggagaagcatctttatgtaaatgccgctttagagcgtttggagcagagaaaattgtactggaatgagcataagctctctatttacagcaaagtgtgcacaacggctagaaatcagactcaatcattgtcacctcctgatgtttctcgagttggttatcaagcacccatggggggccatggagcgccagatagcggctccaatgatcaagataaatcaactgaagattcttcagcggataagtcagatggagaatctcaatcaagtttggaaaagggttgtgataatgatcttggtcatcctctagaagatcaagacgcaccgtcatcttcctcatgcaatggaagtaaaggtttcctgtctcaccaaattgacaccaaagacctgaaggacaacgacgcgtacaacttttatcagtctgttgatggtcagcacattatccttcacactttgaatgtgaagtgccttctgcatcactatggaagctatgactttcttccaccaagattgagtggaaagatactggaaatggaaaccattacccaatcagaagcgataaggagacgctaccgctttttaagtcatttttctttatcaactacacttcagatatgtgagattgatatgaaggaatccttgcctcctgatgcatttgctccatttatacatgaaattaagaagcgtgtgaagcagcggaaagaacgtgcttggaaggatcgaaaaaataaaatcaaagctgaagtagctgcagctgcagagcttgtaccattgatggccagttttgggcagtcgtcttctagtgatgactttcccccattttccttggatgactttgaagctctgggaaactctgccccaatatcatcaagccctccaaacattggagagagaagttccttctcacatgtgacaaggctcggtttcgcagctggtcacgactccccaaacctgaataacgagccaacaaacgttcaaagcagcagcagcagcagtgaagtctcaaacgcaaccacaggtgcaagaaacacaaacataacatcctttgcgagtgtagcttcaagaacaacaacaccaatggcaccaaccgtcaaagagcccggtaagagagggaagaaacagagccgagtacttctatcgacaactagtgtacgccgttactgaaaaggcctatggatttgtgtatgtataataatcttttcatctaagaaaaactgagtaaagaaagaaccagagattatggtgagtgagtaagtggc

SEQ ID NO: 4492 - DNA, 1621 bp, Artificial Sequence
  P3303 (35S::G1361)
ctccctcatacctttgtttattctgatgaagttgtgagcactgaaagaaaagaagagaggagaagagagatatgcacaagaagaattaaacttagggacacaaaacaacatgacttggtgcaatgaccgtagcgatgttcagaccgttgaaagaatcattccctccccgggggcggctgagtcccccgtagcctcacttccggtctcttgtcacaaaacttgcccttcttgtggccataacttcaagtttcacgaacaggttcttgtttctctttctacctatatcaagtttaaactttagatgatattggatatttgaatataatatattaatatgtaatgtaggctgggatccatgacttgccgggacttcctgctggagtaaaatttgatccgacggatcaagaggtcttggagcatcttgaaggcaaggtaagagatgacgcaaaaaagcttcatcctctcattgatgagtttatccgtaccatcgatggtgaaaacggcatttgttatacccatcctgaaaaattgccaggtgattctatgttgcatgttcaatcatcaattaatcggttacaaattgagactatagttacaaattttccgtcttcaaatgatcttctagttatgcttattgaaaactacataaatacgttgaaaaaacaatttaatcatattttaatacgatggaaattgtcatatagaaaaagaaaatgtagctaatccaatttcttaattaaattaagtttgatgaatgctaattagtcgttgaatacatatataggagtgaacaaggacgggacggtgcgtcatttcttccaccgaccgtcgaaggcatacacgacgggaacaagaaagcgacgtaaagtccacactgattctgacgtcggtggagagacacggtggcacaagacaggaaaaacacggccagttcttgctggaggaagagtgagaggctacaagaaaatcctagtgctctacacaaactacggcaaacaaaaaaaacccgagaagactaattgggtaatgcatcaatatcatcttggcactagcgaggaagagaaagaaggtgagctcgtcgtctccaaagtcttttaccagactcaaccacgtcaatgcggtggctccgttgctgctgcagccaccgctaaggaccgaccttacctccacggcctcggtggaggtggtggccgccaccttcattaccatcttcatcataacaacggtaacggtaagagcaacggcagtgggggaaccgccggagccggtgagtattatcacaatattccggctattatctcgttcaatcagaccgggatacagaaccacttggttcatgactctcaaccttttatcccttaaaaacaaaatgattttatatcaacgatcctaaaataaaacaaacggtatataatctaagcattatctttgatatacacatacatatatacgttgaaaataatttaaaatttacagtgcattcttgtattcgtaacttgttttttgtttctcttaattcttttttccttttgattttacggctttgtacaatttaaattccttggactgagactgaccatgaaaaatatgtacaaagatctccattggctattgttacatg

SEQ ID NO: 4493 - DNA, 3077 bp, Artificial Sequence
  P3308 (35S::G434)
gatcacactcactatatgtccagggagctaaacctctatatcgagtactaatagtatgcaatgtccaggttattgcattgagggaaaatgaatggacaaggtgatttggatgcggttggaaacattccaaaaccaggtgaagctgaaggcgatgagattgatatgattaatgatatgtctggtgttaatgatcaagatggtggaaggatgagaagaacccataggcgcactgcttatcaaactcaagaacttgaaaagtttgttcactttcttcttcatttcatcatcatgcaacatttcctattattttttttatttttttattttgagtttggaatgtttctctttactttgctctttactttaaaatgagtgtagtttctacatggaaaatcctcatcccactgaagaacagaggtacgagcttggacaaaggcttaatatgggtgtcaatcaagtcaagaattggttccagaataaaagaaatctcgagaaggtaccaaaaaatacagaagtgtatacatgcatgtggctgtgtcttttcttattctttgcacgtaccgtattatggaccatgtttctgccctatgttaaaaacaaatactgtatatagtttaccacctctctctctcatcctcaaaatctgccttgattatggtataattattgagtgtggttttttgggtaagcagatcaataatgaccaccttgagaatgtaactcttagagaagagcatgacagattgctagcaactcaggatcagcttagaagcgcaatgctacgtagtttatgcaacatttgtggtaaggcaactaattgtggagacactgaatatgaggtgcaaaaacttatggctgagaatgctaacttggagcgggagatagaccagttcaattccagatacctttctcatcccaaacaaaggatggtcagtacatccgaacaggcgccttcttcttcctctaatccaggaataaatgcaacaccagtacttgattttagtggtggaactaggacgtctgagaaggagacatcaatttttctgaatcttgccattacggctttgagagagttgattacattgggagaagtggactgtccattttggatgatagatccaatcgttagatccaaaggagtatcaaagatctatgagaagtatagaagttctttcaacaatgtcacaaaacctcccgggcaaattgtggaggcttcaagagctaaaggtttagttcccatgacttgcgtgactctggtcaagactcttatggacacagtaataacctttaaaccaccacccattttttagtgaaatgttgttacatgaaatgttaacaagttttttttttttttttaaacagggcaaatgggtcaacgtgtttgcacctatagtccctgtggcatcaacccataaagtgctatctaccggttctggtggaaccaaaagtggctcactccaacaggtataatatatatagttttctgagtcgtctatattggttgataatccaagagaagtagaaacatttcaaatttgtgatcatataattttggcagattcaagcagaatttcaagtaatttctccgctggtaccaaagagaaaagtaacgtttattagatactgcaaagagatcagacagggcttatgggtggtcgtcgacgttactcctactcaaaatccgactttgctgccctatggttgttctaagaggctaccctcaggccttatcatagacgacctgtccaatgggtactcccaggttacttctgaatcctgttctttgaacaatatatgttggttcacttgttattactcgcaatcataattaatgatctatcagagcatcttgtactgtggagacataaataaatggttaatggttattattatattcaccacatgtataacacatagagatttgatttcacaggttacatggattgaacaagcggaatataatgagagtcacatccaccaactctaccagcctttgattggctatgggatcgggctaggtgcaaagagatggctcgcgacgctgcagagacactgcgaaagcctctcgaccctttcatctaccaacttgactgaaattagtccaggtgaaagctatttaaattatagaataaatctcattacaactactttttaggtcattttcggttctccactaaatttggacaggccttgattgtgatatatgttttcgatataggattgtctgcaaaaggtgcaactgaaatagtgaagctagcacagcgaatgactctcaactactacagaggtattacgagtccttcggtggacaagtggcagaaaattcaggtggagaatgtggcacaaaacatgagtttcatgatccgaaagaacgtgaatgagcctggtgagctaactgggattgtgctgagtgcatccacttctgtttggctcccagtgaaccagcatacactctttgctttcattagccacctgagtttcagacacgagtgggatatcttgaccaatgatactaccatggaagaaacaatccggattcaaaaagcaaaacgccatggaaacatcatctctcttctgaaaatcgttgtgagtttcaaaacatttatttttggtttaatgagtgtcgttttgtctatgtttccattgattttcgtgagttttgcaatgcaaacagaataatggtatgctggttctgcaagagatttggaatgatgcatcaggtgcaatggtggtgtatgcaccagtggaaaccaattctattgagctggtcaagagaggtgaaaattcagattctgtgaagtttcttccttcgggattttcgatagtgccagatggagtaaatgggtcatatcatagaggcaatactggtggaggatgtctactgacatttggacttcagatcttggtgggcatcaatccaactgctgcactcattcaaggtactgtcaaaagtgtcgagacactcatggctcatactattgtcaagatcaaatccgcgttagatttacagacgtaaccatcagcagctccagtttccgttgttccgcaagaaattcgacattggcttgccctagttt

SEQ ID NO: 4494 - DNA, 859 bp, Artificial Sequence
  P3310 (35S::G140)
atggagggtggtgcgagtaatgaagtagcagagagcagcaagaagatagggagagggaagatagagataaagaggatagagaacactacgaatcgtcaagtcactttctgcaaacgacgcaatggtttactcaagaaagcttatgagctctctgtcttgtgtgacgctgaggttgctcttgtcatcttctccactcgaggccgtctctacgagtacgccaacaacagtgtgagaggaacaatagaaaggtacaagaaagcttgctccgacgccgttaaccctccgaccatcaccgaagctaatactcagtactatcagcaagaggcgtctaaactccggagacagattcgggacattcagaatttgaacagacacattcttggtgaatctcttggttccttgaactttaaggaactcaagaaccttgaaagtaggcttgagaaaggaatcagtcgtgtccgatccaagaagcacgagatgttagttgcagagattgaatacatgcaaaaaagggaaatcgagctgcaaaacgataacatgtatctccgctccaagattactgaaagaacaggtctacagcaacaagaatcgagtgtgatacatcaagggacagtttacgagtcgggtgttacttcttctcaccagtcggggcagtataaccggaattatattgcggttaaccttcttgaaccgaatcagaattcctccaaccaagaccaaccacctctgcaacttgtttgattcagtctaacataagcttctttcctcagcctgagatcgatcttatgcatatatatattcatgttacacttactgtcaaaaaacttaaaatgcagatggtaacgatttgagagggacc

SEQ ID NO: 4495 - DNA, 775 bp, Artificial Sequence; identical to SEQ ID NO: 289
  P3312 (35S::G351)

SEQ ID NO: 4496 - DNA, 1041 bp, Artificial Sequence
  P3315 (35S::G129)
cattttctgcaacttctccaaatctcatactttccagaaaatcattttcccaagaaaaataaaactttcccctttgttcttctccccccaacagcaatcacggcgtaccaatcggagctaggaggagattcctctcccttgaggaaatctgggagaggaaagatcgaaatcaaacggatcgagaacacaacgaatcgtcaagtcactttttgcaaacgtagaaatggtttgctcaagaaagcttacgagctctctgttctttgtgatgctgaagtcgcactcatcgtcttctctagccgtggtcgtctctatgagtactctaacaacagtgtaaaagggactattgagaggtacaagaaggcaatatcggacaattctaacaccggatcggtggcagaaattaatgcacagtattatcaacaagaatcagccaaattgcgtcaacaaataatcagcatacaaaactccaacaggcaattgatgggtgagacgatagggtcaatgtctcccaaagagctcaggaacttggaaggcagattagagagaagtattacccgaatccgatccaagaagaatgagctcttattttctgaaatcgactacatgcagaaaagagaagttgatttgcataacgataaccagattcttcgtgcaaagatagctgaaaatgagaggaacaatccgagtataagtctaatgccaggaggatctaactacgagcagcttatgccaccacctcaaacgcaatctcaaccgtttgattcacggaattatttccaagtcgcggcattgcaacctaacaatcaccattactcatccgcgggtcgccaagaccaaaccgctctccagttagtgtaatataggctgaaggaaatggccgggagtgaataaaaaccagaattgggttgagcaagcaatataaagctaatgcatgttatatatatatttatcccatgaatgttgtatcagtgaattttatgcttatgttgatgtgaaattaatatcttaaagacatgtcattaatgtgcttaatttgcttca

SEQ ID NO: 4497 - DNA, 1472 bp, Artificial Sequence
  P3320 (35S::G2443)
ttctttcagataccagctcccacaccatcaaacttactacatctgagttattatgttgaaacaagagagtaacgacataggtagtggagagaacaacagggcacgaccctgtgacacatgccggtcaaacgcctgcaccgtgtattgccatgcagattctgcctacttgtgcatgagctgtgatgctcaagttcactctgccaatcgcgttgcttcccgccataaacgtgtccgggtctgcgagtcatgtgagcgtgctccggctgcttttttgtgtgaggcagatgatgcctctctatgcacagcctgtgattcagaggttcattctgcaaacccacttgctagacgccatcagcgagttccaattctaccaatttctggaaactctttcagctccatgaccactactcaccaccaaagcgagaaaacaatgaccgatccagagaagagactggtggtggatcaagaggaaggtgaagaaggtgataaggatgccaaggaggttgcttcgtggctgttccctaattcagacaaaaataacaataaccaaaacaatgggttattgtttagtgatgagtatctaaaccttgtggattacaactcgagtatggactacaaattcacaggtgaatacagtcaacaccaacaaaactgcagcgtaccacagacgagctacgggggagatagagttgttccgcttaaacttgaagaatcaaggggccaccagtgccataaccaacagaattttcagttcaatatcaaatatggctcctcagggactcactacaacgacaatggttccattaaccataacgtaaggcttttgtatatttgttaccccttcaatttagcatcttcccataacgcagcagggtgaattctttcatcatacacacaaatccactgatccactgccaacagttgatctatagcacatagaaatttcaccagaagtctataataaaaacaatatatgcttccttttgcatcgactctctttagtcctcttaccagggggattgagaatgtctttgtttctgtcattaggcatacatttcatccatggaaactggtgttgtgccggagtcaacagcatgtgtcacaacagcttcacacccaagaacgcccaaagggacagtagagcaacaacctgaccctgcaagccagatgataacagtaacacaactcagtccaatggacagagaagccagggtcctgagatacagagagaagaggaagacaaggaaatttgagaagacaataaggtatgcttcgaggaaggcatatgcagagataagaccgcgggtcaatggccggttcgcaaagagagaaatcgaagccgaggagcaagggttcaacacgatgctaatgtacaacacaggatatgggattgttccttcattctgatactccctgtggcaaaaagaaaaactagattgcaagctgtaaattacttttagtttgacattatg

SEQ ID NO: 4498 - DNA, 1880 bp, Artificial Sequence
  P3322 (35S::G2453)
tcgaccctcattcatcgtacacacacactctctatgacaaagctccccaacatgacgacaacactcaaccatctatttgatctgccggggcagatttgccatgtccagtgtggtttttgcaccactattttgctggtataccttaacttcttctcttattctctcccttcctttctcccttcctctctttatatatatgatcatgagtttaatgagtgtaaatgtgttgcaggtgagtgtaccgtttacaagcttgtcaatggtggtgactgtgagatgtgggcattgcacaagccttctctctgtcaatttgatgaaggcttccttcattcctctccatctccttgcttctctctcccatcttgatgaggtttccataacatctatacatagacaaacacacaccatctaaatatgaccaatatatatatatatatacttacttttgattatatgtaaatatatgtgcagaccgggaaagaggaggttgcagctacagatggtgtggaagaagaagcatggaaggtgaatcaggagaaggagaacagtccaacgactttggtttcatcttcagacaatgaagatgaagatgtgtctcgtgtttaccaagttgtcaataaacgtacgtttgagtataaattcaacttaaactttagttttgcgatttctcctttcatcagtcgtctaattatgttttgagtttgtatatatatagcacctgagaagcgacaaagagctccttcagcttacaattgcttcatcaagtaagaaataaattcaacacattacatgtgtatgtatattatatatattcttacaaatttaaccacttaaggttttgagtttgtaaaatggttcttctttgggggttgtattggagcagggaagagatcaggaggttaaaggctcagaatccaagcatggctcacaaggaagctttcagcttagctgccaaaaatgtacttaagcttaattagtcttaagatttaaaagaaaaccctaatatagttttcatctttttgttagcttaattgacagatcgagttagctaataacattttatgatttcaattttttgatttggggatggcgaagtgggcccattttcctccagctcacaacaagagagctgcttcagatcaatgtttttgtgaggaagataacaatgcgatactaccatgcaatgtttttgaggtaatcctcagcaaccatttatattttttaatcactttcgcttcaaaatcaattaccatattcttgacaagtaaactccacaacaagtgtcattttccaaagcaaaccaaataattaaagcattaactagatccaaatagcatcgctctcagtcaaaatttcagaaccctagctagactaattatataaagagaaatcatttactaattattagagtgaaagcaaggagaagggtaagtgagattgtgagaatatatcattgatcttcaactactacaatgtgtgaaatttatgacctaaacccttttatagtattgaagcttacactgcacacagtttacttttatagaaacccattcaactaatttaaaacattgaagctgaatatgtatagttttcaattaatataccaaataattgttgaaatgtttgtgatgcaggaccatgaagaaagcaataatgggttccgagagagaaaggctcagaggcattccatttggggaaaatctccatttgagtaataacaatttgggatatgaaaatttaacaaaaaaataaataatggcgtatgacatgtgatggtgacctgaattggttcctttaaagcctgcttttttgtacaaagttggcattataaaaaagcattgcttatcaatttgttgcaacgaacaggtcactatcagtca

SEQ ID NO: 4499 - DNA, 870 bp, Artificial Sequence
  P3326 (35S::G1753)
aagctgtgatcaattcctcccaaaccattttctaactggtttgcactttcttcactctcttctcttcactcttcactacgtacttcactctccaactaacttaactgcaccataaaatggcttcgatctcttcctctccttcctcaaactcatcactcttctctactcaaaaccctaatactcattatcaatatgcaaggaacctccaaagacaatggcggccgccaccctttgtacaggggagtaaggcagcgaaagaactcaaacaaatgggtttctgagatccgtgagccgagaaaacctaaccgtatctggttaggaacattctctacccccgagatggcggcaatagcctatgacgtggcagctctagccctcaaaggcagtcaagctgagctcaacttcccaaactcagtttcctctttgcctgccccaacctccatgtctccagcagacatccaagcagcagccgcttcggccgctgctgcttttggtgctgctagggatgcgattgttatggcaaataataacagccaaacaagtggtgtggcttgcatgaatagtagttatgataatacaaatatgaatggattcatggacgaggatttggtattcgacatgcctaatgtgctcatgaatatggctgaaggaatgcttcttagcccccctcgtcctactgtctttgatgctgcttacgacgctgatggttttcctggaggagacgattacttgtggaattttccatgatagttaaacaaaccaaccatataaatatgtgattttgtgtgtttctatatatgtatgtatgaaataaataaatatggtgtctagtgatgcattgtatgcatggttaggcccgttaagaccgta

SEQ ID NO: 4500 - DNA, 896 bp, Artificial Sequence
  P3327 (35S::G2934)
ttggagatctgacactggtaaagctcaaagtgtcaaactatggatccttataagaatcttaatccaaaaggttaccagagacagagaccgtttagctcagccggcgagagtggcggcagcggcggctccggtacggcccatgaaacagatgacaataagaagaagaagaagcttctccaccgcgacatcgaacgccaaagaagacaagaaatggctacactctttgctactcttcgtactcacttacctcttaaatacatcaagggaaaaagagctgtgtcggatcatgtaaatggagcggtaaatttcattaaggacacggaagcacggattaaagaacttagtgcaagaagagacgagttaagtagagaaaccggccaaggatataaatcgaatccggatccaggaaaaactggatccgatgtaggcaaatcggagccggcgactgtgatggtgcaaccacacgtgagcggtttagaagtggtagtgagcagcaactcctcaggccccgaagctttgccactatcaaaagtgctcgagacaattcaggagaaagggcttgaagtcatgagctccttcactacaagagtcaatgataggctcatgcacactattcaagtagaggttaatagtttcggatgcatagacttattatggttgcagcagaagctagttgaggatttgatactttcgacggggtactaatcatgcagaaacataccattcgtagtcctaaagaacttcctcatcaaaaaatcaaagtcttcttgaaatttcgttatgagagcaaggtgcataggtgttaaagttcattcatggattgaggtgtagctttggtttaaacaagttcaagtgacttcatggggtagatcataacttcaccatgattcgccgcc

SEQ ID NO: 4501 - DNA, 780 bp, Artificial Sequence; identical to SEQ ID NO: 3858
  P3354 (OPLEXA::G156)

SEQ ID NO: 4502 - DNA, 1051 bp, Artificial Sequence
  P3359 (OPLEXA::G226)
tccagtagttatggataataccaaccgtcttcgtcttcgtcgcggtcccagtcttaggcaaactaagttcactcgatcccgatatgactctgaaggtctctcttcaattcattactctacactcatcctcctaactcgtcagcgttaaattatcttctcatttaatttttgtttggataaaacgaaacaaaaatgcagaagtgagtagcatcgaatgggagtttatcagtatgaccgaacaagaagaagatctcatctctcgaatgtacagacttgtcggtaataggtaacaaattctcttcttctgtcatgtccgattcaacatattttaaaaacaactagtattttataaaattaaaaaaaaaaaaaaaaaaactagtattttataatttaaaaaaaattcacatggcgagagtaacaaatcaaagctgataaagtgttatgttatggtaaacatgattctagagtagtttagactttcgaacgtgtttcgagaaaaatgacatgccaatatttaagcaatgacatgagtattttacttgtataatttcaaaaaaagttttatgttgttgataaactgataaaatgtataattaacagaaactaaaatttcttcttttcttaaagtgtgatgattttaaaaacagtgaaaggattgaataatatattggctcttgaatattattgtctttatatatatacattttaaatttcatttctgcattatatatgttgactcctgaattttgataaatgttttttcagaattttgtgctcgtctataattcaaaaacacattatatgcttgaatattgattgtcaggtgggatttaatagcaggaagagtcgtaggaagaaaggcaaatgagattgagagatactggattatgagaaactctgactatttttctcacaaacgacgacgtcttaataattctccctttttttctacttctcctcttaatctccaagaaaatctaaaattgtaaagaaatcaaaataaaagctttcaatcataaaagtagaacaaatcttgaatgtcttctcatca

SEQ ID NO: 4503 - DNA, 686 bp, Artificial Sequence; identical to SEQ ID NO: 3929
  P3367 (OPLEXA::G975)

SEQ ID NO: 4504 - DNA, 973 bp, Artificial Sequence
  P3369 (OPLEXA::G1073)
ggcaagaactgcatctacagagacctgaagattccagaaccccacctgatcaaaaataacatggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttagagttttagcgttttggtgacaccttttgttgcgtttgcgtgtttgacctcaaactactaggctactagctatagcggttgcgaaatgcgaatattaggtt

SEQ ID NO: 4505 - DNA, 1012 bp, Artificial Sequence; identical to SEQ ID NO: 4152
  P3371 (OPLEXA::G1760)

SEQ ID NO: 4506 - DNA, 734 bp, Artificial Sequence; identical to SEQ ID NO: 4097
  P3372 (OPLEXA::G1820)

SEQ ID NO: 4507 - DNA, 1160 bp, Artificial Sequence
  P3373 (OPLEXA::G1930)
attcacattactaatctctcaagatttcacaattttcttgtgattttctctcagtttcttatttcgtttcataacatggatgccatgagtagcgtagacgagagctctacaactacagattccattccggcgagaaagtcatcgtctccggcgagtttactatatagaatgggaagcggaacaagcgtggtacttgattcagagaacggtgtcgaagtcgaagtcgaagccgaatcaagaaagcttccttcttcaagattcaaaggtgttgttcctcaaccaaatggaagatggggagctcagatttacgagaaacatcaacgcgtgtggcttggtactttcaacgaggaagacgaagcagctcgtgcttacgacgtcgcggctcaccgtttccgtggccgcgatgccgttactaatttcaaagacacgacgttcgaagaagaggttgagttcttaaacgcgcattcgaaatcagagatcgtagatatgttgagaaaacacacttacaaagaagagttagaccaaaggaaacgtaaccgtgacggtaacggaaaagagacgacggcgtttgctttggcttcgatggtggttatgacggggtttaaaacggcggagttactgtttgagaaaacggtaacgccaagtgacgtcgggaaactaaaccgtttagttataccaaaacaccaagcggagaaacattttccgttaccgttaggtaataataacgtctccgttaaaggtatgctgttgaatttcgaagacgttaacgggaaagtgtggaggttccgttactcttattggaatagtagtcaaagttatgtgttgaccaaaggttggagtagattcgttaaagagaagagactttgtgctggtgatttgatcagttttaaaagatccaacgatcaagatcaaaaattctttatcgggtggaaatcgaaatccgggttggatctagagacgggtcgggttatgagattgtttggggttgatatttctttaaacgccgtcgttgtagtgaaggaaacaacggaggtgttaatgtcgtcgttaaggtgtaagaagcaacgagttttgtaataacaatttaacaacttgggaaagaaaaaaaagctttttgattttaatttctcttcaacgttaatcttgctgagattatttat

SEQ ID NO: 4508 - DNA, 505 bp, Artificial Sequence; identical to SEQ ID NO: 4055
  P3375 (OPLEXA::G3)

SEQ ID NO: 4509 - DNA, 904 bp, Artificial Sequence
  P3376 (OPLEXA::G22)
atacacaactacttatctcttcacttcattagtctccaagaagaaaacatctctcactctctaaaatacacactctcatcaaaaaccttctcttcggttcagaagcattcaagaatccattatgagctcatctgattccgttaataacggcgttaactcacggatgtacttccgtaacccgagtttcagcaacgttatcttaaacgataactggagcgacttgccgttaagtgtcgacgattctcaagacatggctatttacaacactctccgtgatgccgttagctccggctggacaccctccgttcctcccgttacctctccggcggaggaaaataagcctccggcgacgaaggcgagtggctcacacgcgccgaggcagaaggggatgcagtacagaggagtgaggaggaggccgtgggggaaattcgcggcggagattagggatccgaagaagaacggagctagggtttggctcgggacttacgagacgccggaggacgcggcggtggcgtacgaccgagcggcgtttcagctcagaggatcgaaagctaagctgaattttccgcatttgattggttcttgtaagtatgagccggttaggattaggcctcgccgtcgctcgccggaaccgtcagtctccgatcagttaacgtcggagcagaagagggaaagccacgtggatgacggcgagtctagtttggttgtaccggagttggatttcacggtggatcagttttacttcgatggtagtttattaatggaccaatcagaatgttcttattctgataatcggatataattagttttaagattaagcaaaatttgtccaacgagttttgctgtatgaaatatctatcgatgactcaacaggttttgatcatgatcatatgtaatgtgatgg

SEQ ID NO: 4510 - DNA, 732 bp, Artificial Sequence; identical to SEQ ID NO: 3816
  P3404 (OPLEXA::G489)

SEQ ID NO: 4511 - DNA, 748 bp, Artificial Sequence; identical to SEQ ID NO: 893
  P3412 (OPLEXA::G1275)

SEQ ID NO: 4512 - DNA, 1008 bp, Artificial Sequence; identical to SEQ ID NO: 4038
  P3424 (OPLEXA::G1543)

SEQ ID NO: 4513 - DNA, 1366 bp, Artificial Sequence
  P3573 (OPLEXA::G558)
cagcgcccagaatgctccgggtgaccaacatttgttcctgattcatttcctattggttcgtattgtctgtgcacacaagagaaatttcaagaagttgttactaaaagagaggccacaagtggatattgtctttgttatcaagtgttagtacagaaaagtggtgagaaagtaatatggctgataccagtccgagaactgatgtctcaacagatgacgacacagatcatcctgatcttgggtcggagggagcactagtgaatactgctgcttctgattcgagtgaccgatcgaagggaaagatggatcaaaagactcttcgtaggcttgctcaaaaccgtgaggcagcaaggaaaagcagattgaggaagaaggcttatgttcagcagctagagaacagccgcttgaaactaacccagcttgagcaggagctgcaaagagcaagacagcagggcgtcttcatttcaggcacaggagaccaggcccattctactggtggaaatggtgctttggcgtttgatgctgaacattcacggtggttggaagaaaagaacaagcaaatgaacgagctgaggtctgctctgaatgcgcatgcaggtgattctgagcttcgaataatagtcgatggtgtgatggctcactatgaggagcttttcaggataaagagcaatgcagctaagaatgatgtctttcacttgctatctggcatgtggaaaacaccagctgagagatgtttcttgtggctcggtggatttcgttcatccgaacttctaaagcttctggcgaatcagttggagccaatgacagagagacagttgatgggcataaataacctgcaacagacatcgcagcaggctgaagatgctttgtctcaagggatggagagcttacaacagtcactagctgatactttatcgagcgggactcttggttcaagttcatcagggaatgtcgcaagctacatgggtcagatggccatggcaatgggaaagttaggtacactcgaaggatttatccgccaggctgataatttgagactacaaacattgcaacagatgataagagtattaacaacgagacagtcagcacgtgctctacttgcaatacacgattacttctcacggctacgagctctaagctccttatggcttgctcgacccagagagtgaaactgtattttggtcacatgtcagctgtacaaaatccatatggacacaaaaccaggagagactattaatcaacacttgtcagattcttcttaccaaatccatcaacaaataagcaaatttctgggaaacaaaagactctttgtatgtaggtttcttctacatggttgtggtaattcatgttgttttagttgtagtcatca

SEQ ID NO: 4514 - DNA, 1564 bp, Artificial Sequence
  P3580 (OPLEXA::G1078)
cggttagtaattcgatgagacggcatcatcaacaaccttcaccaatgccgcaagtatacggcggcgctgaacaaagtaaatatgataaagcagatgatgctacgatatcttctggtagctatagaggcggaggagatatcgctgacatgaagatggtagttaggcatagggatttgaaagaaatcatcgatgccattaaggaaaatttcgataaggctgctgcctcaggggagcaagtctctcagatgctcgagcttggcagagctgagctcgatcgtagtttcagccaattgaagaaaacggtgattcattcgagtagtttattaagcaacttgagctcgacatggacctcgaagccgccattggcagtcaagtataggatagacacgactgcgctggatcaaccgaacagttcgaagagcctttgttccactcttgaccgtctcttggcatgggagaagaagctttatgaagaaattaaggctagagaaggtttcaagattgagcatgagaagaagttatcacagcttcaaagccaagaatataaaggggaggatgaagctaagttagacaagacaaaggcctctataacgaggttacagtcactgatcattgttacttctcaagctgttactaccacatctactgccatcatccgtcttcgtgatactgaccttgttccacaactcgttgagctctgtcatggctttatgtacatgtggaaatctatgcatcaataccatgagactcagaacagcatcgtggagcaagtccgggggctcattaacagatcgggcaaaggcgaatcaacatctgagctacaccgacaagctacacgtgacttggaatcagctgtctcttcttggcactccagtttcagtagtttgattaaattccaacgtgacttcatacactcagttcacgcctggttcaagctgacccttcttccggtttgccaagaagacgccgccaatcatcacaaagagccgctcgatgcttacgccttctgcgatgagtggaaactcgctctagatcgtattcccgatacagttgcatctgaggcaatcaagagcttcatcaacgttgtacacgtgatatccgcaaaacaagccgatgaacacaagataaagaaaagaacagaatcagcatcaaaagagcttgagaagaaggcttcgtcggttagaaacctagagagaaaatactaccagtcatactcaatggttggtgtcggtttaccagagtcaggacccgataaccgacacatgttagacgctcgagacccgttaagcgataaaaagtcagagcttgcggtttgccaaaggagagttgaggaagagatggtgaaatactcaaaggcaatagaagtgacaagagccatgactttgaataatctgcagacagggttgcctggtgtgttccaatctttaacaagtttctctgctttgttcatggagtctcttcaaacggtatgcactcgctcatactctatcaaataggacattatatattatatatatatatatattgatatgcttacagagtttacagtaacaattgtgagccg

SEQ ID NO: 4515 - DNA, 1055 bp, Artificial Sequence; identical to SEQ ID NO: 3952
  P3592 (OPLEXA::G1328)

SEQ ID NO: 4516 - DNA, 768 bp, Artificial Sequence; identical to SEQ ID NO: 4001
  P3598 (OPLEXA::G913)

SEQ ID NO: 4517 - DNA, 533 bp, Artificial Sequence
  P3599 (OPLEXA::G1053)
cctcatataaaccaaactaaaaccatgattccggcagaaatcaacggatatttccaatatctatcaccggaatacaacgtaataaacatgccttcatctccaacctcttccttaaactacctaaacgatttgatcatcaacaacaacaactattcctcatcatccaacagtcaagatctcatgataagcaacaactcaacttccgacgaagatcatcatcaaagcatcatggtactcgacgagaggaaacagagaaggatgctttcgaacagagaatctgcaaggaggtcaaggatgaggaaacagagacatcttgatgaactctggtctcaggtaataaggcttcgcaacgagaacaactgtcttatcgataagctgaaccgcgtatcggagactcaaaattgtgtattgaaggagaactctaaactcaaagaagaagcttctgatctccgacagcttgtttgtgaactgaaatctaacaagaacaacaacaatagttttccaagagagtttgaagataattagtattactc

SEQ ID NO: 4518 - DNA, 668 bp, Artificial Sequence; identical to SEQ ID NO: 1211
  P3603 (OPLEXA::G1836)

SEQ ID NO: 4519 - DNA, 1127 bp, Artificial Sequence; identical to SEQ ID NO: 1093
  P3604 (OPLEXA::G1640)

SEQ ID NO: 4520 - DNA, 1300 bp, Artificial Sequence; identical to SEQ ID NO: 4021
  P3606 (OPLEXA::G1635)

SEQ ID NO: 4521 - DNA, 1243 bp, Artificial Sequence; identical to SEQ ID NO: 4042
  P3617 (OPLEXA::G1903)

SEQ ID NO: 4522 - DNA, 1065 bp, Artificial Sequence; identical to SEQ ID NO: 4047
  P3619 (OPLEXA::G635)

SEQ ID NO: 4523 - DNA, 956 bp, Artificial Sequence
  P3645 (OPLEXA::G1865)
caagaagaggacatgaagcacagagattctgcagactgcaggtgaccaatggacactttatcaataaaaacatacctactactctcttacactttcaattttccaatacaaatcccaatctttaatctctctttcttcttcatctctctttctctttctctcttcatggctacaaggattccattcacagaatcacaatgggaagaacttgaaaaccaagctcttgtgttcaagtacttagctgcaaatatgcctgttccacctcatcttctcttcctcatcaaaagaccctttctcttctcttcttcttcttcttcatcttcttcttcaagcttcttctctcccactctttctccacactttgggtggaatgtgtatgagatgggaatgggaagaaagatagatgcagagccaggaagatgtagaagaactgatggcaagaaatggagatgctctaaagaagcttaccctgactctaagtactgtgagagacatatgcatagaggcaagaaccgttcttcctcaagaaagcctcctcctactcaattcactccaaatctctttctcgactcttcttccagaagaagaagaagtggatacatggatgatttcttctccatagaaccttccgggtcaatcaaaagctgctctggctcagcaatggaagataatgatgatggctcatgtagaggcatcaacaacgaggagaagcagccggatcgacattgcttcatccttggtactgacttgaggacacgtgagaggccattgatgttagaggagaagctgaaacaaagagatcatgataatgaagaagagcaaggaagcaagaggttttataggtttcttgatgaatggccttcttctaaatcttctgtttctacttcactcttcatttgatcatcttttgttcttataaccttgtatttcttgttaagatggtaatgcaaattctc

SEQ ID NO: 4524 - DNA, 1055 bp, Artificial Sequence; identical to SEQ ID NO: 4133
  P3647 (OPLEXA::G1226)

SEQ ID NO: 4525 - DNA, 953 bp, Artificial Sequence
  P3650 (OPLEXA::G812)
atcgaaatcatcaagaatcttgtctttaatttccaattgggtttttcaaaacccgttacctcaggatgatgaacccgtttctcccggaaggctgcgatccaccaccaccaccacaaccaatggagggtttacacgaaaatgctccacctccatttctgaccaagacatttgagatggtggatgatccaaacactgaccacatcgtatcttggaacagaggaggaacaagttttgtcgtctgggatttgcattctttctccacgattctccttcctcgtcatttcaaacacagcaatttctcaagtttcatcagacaactcaatacttatggtttcagaaagatagaagcagagagatgggaatttgcaaacgaagagtttttgttaggacaaagacagttgttgaagaacatcaagaggagaaacccttttactccatcatcttcaccaagccatgacgcttgcaacgagcttcgcagagagaagcaagtgctaatgatggagatagtgagtctaagacagcagcaacaaacaacgaaaagctacatcaaagctatggaacagaggatagaaggaacagagaggaaacagagacaaatgatgtcgtttctggctagagcaatgcagagtccttcgtttttgcatcagttgttgaaacaaagagataaaaaaattaaggagcttgaggataatgagtcagcaaagaggaaaagaggttcttcttcgatgtcggaattggaagttttggctttggagatgcaagggcatggaaaacagaggaatatgttggaagaagaggatcatcaactggtggtagagagagagttggatgatggtttctgggaagagttgcttagtgatgagagtttggcttccacctcctaactagatggatttctttttggttttgtttttagtttcttctactttcaagctcattttcttctgtcacaa

SEQ ID NO: 4526 - DNA, 892 bp, Artificial Sequence
  P3651 (OPLEXA::G1950)
ttctgaattcgaattcgaactttggaagaagaagaagctttgatcaatcatggaaattgcaaccgatacagcaaagcagatgagagacgaagagttgttcaaagcagcggaatggggagattcatcgttgttcatgtcattatctgaagaacagctctctaaatctctcaatttcagaaacgaagatggtcgctctctcctccatgtcgctgcttccttcggccattctcaaatagtgaagttgttatcaagttcagatgaagcaaagactgtaatcaatagcaaggatgatgaaggatgggctcctttgcattccgctgctagcatcggtaatgctgagctcgttgaggtgcttttgaccagaggtgctgatgtcaatgccaaaaataacggtggtcgcactgctcttcactatgctgctagcaaaggccggttggagattgctcagcttttattaacacacggtgcaaagattaacatcacagacaaggttggttgcactccgcttcacagggcagcaagcgtgggaaagttagaagtttgtgaatttcttattgaagaaggagcagagatcgatgctacggataaaatgggtcaaactgcactcatgcattcagttatctgcgatgacaaacaggttgcgttcctgcttataagacatggtgcagatgtggatgtagaagacaaggaaggctacactgttctaggccgagctaccaatgaattccgacctgcacttatcgatgctgctaaggccatgcttgaaggataaaatgactctggattactttaaaacttactaactctgagagttgtttagttacttaaaaggatttttctttactgtatcatgtttgcaaaatgtttctgccttatcaattcatgttctgtc

SEQ ID NO: 4527 - DNA, 918 bp, Artificial Sequence
  P3657 (OPLEXA::G580)
ctattctgttctgttctccaatgttgtcatcagcaaagcataataagatcaacaaccatagtgccttttcaatttcctcttcatcatcatcattatcaacatcatcctccctaggccataacaaatctcaagtcaccatggaagaagtatggaaagaaatcaaccttggttcacttcactaccatcggcaactaaacattggtcatgaaccaatgttaaagaaccaaaaccctaataactccatctttcaagatttcctcaacatgcctctgaatcaaccaccaccaccaccaccaccaccttcctcttccaccattgtcactgctctctatggctctctgcctcttccgcctcctgccactgtcctcagcttaaactccggtgttggattcgagtttcttgataccacagaaaatcttcttgcttctaaccctcgctcctttgaggaatctgcaaagtttggttgtcttggtaagaaaagaggccaagattctgatgatactagaggagacagaaggtataagcgtatgatcaagaacagagaatctgctgctcgttcaagggctaggaagcaggcatatacaaacgaacttgagcttgaaattgctcacttgcagacagagaatgcaagactcaagatacaacaagagcagctgaaaatagccgaagcaactcaaaaccaagtaaagaaaacactacaacggtcttccacagctccattttgagaaaaatctactatttctttttgggggagtttcaagtgtttcttatgaagatgagaaaaacagaaaaagtttgtacattttagctaagttaaatttgtggtggtaagtaatgtaaaagaaaagtgtgtgtagaagaaaagtgtctagaaaaagaaagcaactaactttcttcttcttctctggtttcctatcg

SEQ ID NO: 4528 - DNA, 1420 bp, Artificial Sequence
  P3663 (OPLEXA::G1958)
cgattatccccaagaggagaatcctcataatcattttctccgattcgattcgtcttccttggtcctggattgcttcatgaatttctaggacaacaatggaggctcgtccagttcatagatcaggttcgagagacctcacacgcacttcttcaatcccatctacacaaaaaccttcaccagtagaagatagtttcatgagatcagataacaacagtcagttaatgtctagaccattaggacaaacctaccatttactttcatctagtaacggtggagctgttggacatatatgttcttcttcatcatctggttttgcaaccaatctccattactcaactatggtatctcatgagaaacaacaacactacacaggaagcagcagtaataatgctgtgcagacaccaagcaacaacgatagtgcttggtgtcatgattcattgccaggagggtttcttgacttccatgaaaccaacccggcgattcaaaacaactgtcagattgaggatggtggcattgcggctgcttttgatgacattcaaaaacgaagtgattggcatgaatgggctgaccatttgatcactgatgatgatcctttgatgtctactaactggaatgatctcttgcttgaaacaaattccaattcagattcaaaggaccagaagacactgcaaattccgcaacctcagattgttcagcagcaaccttctccgtctgtggaattgcgacctgttagcacaacatcttcaaacagcaataacggaacgggcaaggcacgaatgcgttggacgccagagcttcacgaggcttttgttgaggctgtcaacagtcttggcggtagtgaaagagctactcctaaaggggtactgaagattatgaaagttgaaggcttgactatatatcatgttaaaagccatttacagaaatataggacagctagatatcggccagaaccatcagaaactggttcgccagaaaggaagttgacaccgcttgaacatataacatctcttgatttgaaaggtgggataggtattacagaggctctacgacttcagatggaagtacagaagcaactccatgagcagctcgagattcaaagaaacctgcaactccgaatagaagaacaaggcaagtacctgcaaatgatgttcgagaagcaaaactctggtcttaccaaagggacagcctcaacatcagattccgcagccaaatctgaacaagaagacaagaagactgctgattcgaaggaggttccagaagaagaaaccaggaaatgtgaggaactagaatctccacagccaaagcgtcccaaaatcgataattgaaagtattggtcttttgctggataatctcggagtttcagagttaacagtgatagagagaacgagctcttatcttgaggttcttcaggacttctctc

SEQ ID NO: 4529 - DNA, 716 bp, Artificial Sequence; identical to SEQ ID NO: 3805
  P3771 (OPLEXA::G435)

SEQ ID NO: 4530 - DNA, 946 bp, Artificial Sequence
  P3843 (OPLEXA::G1638)
gattcgatcaacaatcgttgaaaacatgaacagaggaatcgaagttatgtcaccagcaacatatctagagacatcaaactggttgtttcaagaaaacagaggaaccaaatggacagctgaagaaaacaagaaattcgaaaacgctttagccttttacgacaaagatactcccgacagatggtccagagtcgctgccatgcttcccggtaaaacagtcggagatgtgatcaaacaatacagagagcttgaggaagacgttagcgacatcgaagctggtcttataccaatccctggttacgcctctgattcattcacacttgattggggtggctacgacggagcaagcggtaacaatgggtttaacatgaacggttactacttttccgccgccggaggaaagagaggatccgccgcacgaacggcggagcatgagaggaagaaaggtgttccatggacagaagaagaacacagacaatttctgatgggtttgaagaaatatggaaaaggagattggagaaacatagctcgtaactttgtgaccacaagaacgccaacgcaagtcgcaagtcacgctcaaaagtatttcatacggcaagtcaatggtggcaaagacaaacgccgttcaagcatccatgatatcacaaccgtcaacatccccgactctcctgacgctgcagccgcggataacgcaaccgcaaacgcaccttgctcgccaccttccgtaggaggaaaccagcgggagacatcggagtgggaaggtcaaacactatacgatgaaacggcagctgcgttttataatcaaaacgcgttttcagaaacgctacttggaatgtcttcgacgccctacatggcaaaacttcaggagcagagttttctgaacgcatcgcaattcgaatcgtacaatgcgtatctccaaatgtagctcacaaggtgaagatctcggaga

SEQ ID NO: 4531 - DNA, 535 bp, Artificial Sequence; identical to SEQ ID NO: 3993
  P3852 (OPLEXA::G30)

SEQ ID NO: 4532 - DNA, 505 bp, Artificial Sequence; identical to SEQ ID NO: 3994
  P3853 (OPLEXA::G47)

SEQ ID NO: 4533 - DNA, 1231 bp, Artificial Sequence
  P3955 (OPLEXA::G328)
gcgtccgctcaccatcaaacaactacaacatctgcggttagtatgttgaaagtagagagtaactgggcacaagcctgtgatacatgccgatcagccgcctgcaccgtgtactgccgggctgattctgcctacttgtgctccagttgtgatgctcaagttcatgctgccaatcgtcttgcttcccgccatgaacgtgttcgagtctgtcaatcatgtgagcgagccccggctgcctttttctgcaaggcagatgctgcatctctatgcacaacctgtgattcagagattcattccgcaaacccacttgctagacgccatcaacgagttccaattctgcccatttctgagtactcttacagttccacggccactaaccattcatgtgagacaacagtgacagatccagagaacagacttgtgcttggtcaagaagaagaggatgaagatgaagcagaggcggcttcatggttgttgcctaattcagggaaaaacagtggtaacaacaatggcttctcgattggggatgagtttctgaaccttgttgattatagttcgagtgataagcaattcacagatcaatccaatcagtatcaactagactgcaacgtacctcagaggagctatggggaagatggagttgttccacttcaaattgaagtatcaaagggcatgtaccaagagcaacagaactttcagctgagtatcaactgtggctcctggggagctcttcgaagctccaatggttccctcagtcatatggtaagctttcatatatttaattcagatccgttactatgaccagcatgctgcttctttcacacaaatccatgaagtaaatttctaagaatgtctttgttactgtcattaggtgaatgtttcatctatggacctgggagttgtgccggagtcaacaacgagtgacgcaacagtatcaaacccaagatcgcccaaagcggtaacagaccaaccaccttaccctccagctcagatgctcagtccaagggacagagaagctagagtcctgagatacagagagaagaagaagatgaggaaatttgagaagacgataagatatgcttcaaggaaagcgtatgcagagaaaagaccacggatcaagggccggtttgcaaagaagaaagatgtcgatgaagaggcaaaccaagctttctccacaatgataacatttgacaccggatatggaattgttccatcattctgatgctgctatggc

SEQ ID NO: 4534 - DNA, 1416 bp, Artificial Sequence
  P3979 (OPLEXA::G1650)
agtcacaaatgtccatatgagtttctgggcgacttctatcagaatttttgttcataattttttttattgtatcaagggatgacttggaaaccgaagatgcttatattatcccatgatctaatctcaccagaaaaatacatcatgggtgaagatgatatcgtggagctcttagggaagagcagccaagtagttacaagtagccagacacaaacaccctcttgcgatcctcctctcattctccggggcagcggaagcggggacggagaaggaaatggtcctctaccgcagcctccgcctcccctgtaccatcagcagagtctctttatccaagaagacgaaatggcttcttggcttcaccagcctaatcgccaagattatctctactcccaacttctttactccggagtagcctcgactcacccgcaaagtttggcctccctagaaccaccaccaccacctagggctcagtacattctggcggcggatagaccgaccggtcatattttggccgagagaagggcggagaattttatgaatatctcgaggcaaagagggaacatatttcttggcggtgttgaagctgtaccgtcgaactcgaccctgttgtcttcagccactgaatcaataccagcgactcacggcaccgagagtcgagcaacagtcactggcggagtatctcgtacttttgcagttcctggtcttggtccgaggggaaaggcggtggcgattgagacggcgggaacacaatcttgggggttgtgcaaggccgaaacagagccggttcagagacaaccagcgacggagacggatatcaccgatgaacggaagagaaaaacgagagaggaaacaaatgtcgaaaaccagggaactgaagaagctcgtgattcgacgtctagtaagaggtcacgagctgcaataatgcataaactctccgaaaggagacggagacaaaagattaacgagatgatgaaggctttgcaagaactccttcctcgctgcacaaagactgatagatcttccatgctggatgatgttatagagtacgtgaaatctctacagagccaaatacaggatgttctcaatgggacatgttatgattccaccgatgatgtatgcggggaatatacaacaacagtacatgccccacatggccatgggtatgaatcggcctcctgcattcatacctttccctaggcaggctcatatggcggaaggtgtaggtcctgttgatttatttagagagaatgaagaaacagagcaagagacaatgtctcttctccttagagaagacaaaagaacaaaacagaaaatgttttcttgaactgaaacttgttagttcttttattaagacaagacacactcttatatacatgttcacataactactctacgttggtaacagttgtaacttctcca

SEQ ID NO: 4535 - DNA, 542 bp, Artificial Sequence
  P3982 (OPLEXA::G1809)
cctattctcgtctttagcaaaatctcaaaagacaaaaagatattgatgtctctccaacgacccaatgggaactcgagttcgtcttcttcccacaagaagcacaaaactgaggaaagtgatgaggagttgttgatggttcctgacatggaagcagctggatcaacatgtgttctaagcagcagcgccgacgatggagtcaacaatccggagcttgaccagactcaaaatggagtctctacagctaaacgccgccgtggaagaaaccctgttgataaagaatatagaagcctcaagagattattgaggaacagagtatcagcgcaacaagcaagagagaggaagaaagtgtatgtgagtgatttggaatcaagagctaatgagttacagaacaacaatgaccagctcgaagagaagatttctactttgacgaacgagaacacaatgcttcgtaaaatgcttattaacacaaggcctaaaactgatgacaatcactaaatatttaccctttaatccattgttcagtgttgtatgattatctttcg

SEQ ID NO: 4536 - DNA, 1421 bp, Artificial Sequence
  P3994 (OPLEXA::G1273)
tcagattttcttcgttccctaactcctaaaaaggagagattcttcaaatccttatcacaacttcagtttttgcattcaccgtcgtgagtgttctacttttggtcaagtaatggaggtgaatgatggtgaaagagtggtaatagcaaaaccagttgcctcaagaccttcttcaagttctggcttcaggacattcactgagcttcttactgattcagttaccgtatctccgcaaacgacttgccacgagattgtagacgctgctataagaccaaagactttgagattcaatcagccagtagcagcttcggtctcatgtccacgggctgaagtaaaaggtattggaaatggaatgtcttgtgatgatgattcagatagcagaaactacgtcgtttataaaccgaaagcaaagcttgtctccaaagcaaccgtctctgcattggctaatatggggaatcgtcaacaaacttggagacaaagcgaagcagtatcctatgggaagagtgtgagccaaggtacacatcgagcaggtcctaatctagtccagaaagttccatcttttacggaatcagagacatctactggggatagatcttctgtggatggatacaactggaggaaatacggacagaagcaagttaaaggaagtgagtgtccaaggagttattacaaatgcacacacccgaaatgtccggtgaagaagaaagtagagagatcagtggaaggtcaagtttcagagattgtgtatcaaggtgaacataatcactcaaagccatcttgtcctcttccacggcgtgcttcatcatcaatctcttcagggtttcaaaaaccaccaaaatcgattgcttctgaaggatcaatgggacaagaccctaacaataatctctattctcctctatggaacaatcaaagcaatgactctactcaaaacagaacagagaagatgagtgaaggttgtgttattacaccatttgagtttgctgttccaagatcgacaaattcaaatcccggaacttcagattccggttgcaagagtagccaatgtgatgaaggagagcttgatgatccaagcagaagcaaaagaaggaagaacgagaagcaatctagtgaagcaggagtatcgcaaggctcagtggaatcagacagtcttgaagatggattcaggtggagaaagtatggacaaaaagtggtaggaggcaatgcgtatccaagaagttattacagatgcacaagtgctaattgcagagcaaggaaacatgttgaacgagcgagtgatgatccaagagctttcattacaacctacgagggtaaacataatcatcatttgctcttgagccctccatcttcctctactcttccctttaactccccacaactttctaagcaaacaatttgatttgatgatccattcatgctttttcttt

SEQ ID NO: 4537 - DNA, 898 bp, Artificial Sequence
  P4002 (OPLEXA::G1007)
attccttcttgcctaggaactaattgttgcacacttcggtacacaattttttgagcacttcgacatcaaaacgagagagaaaagaatggtggattctcatggctccgacacggaatgttcctccaagaagaaaaaggagaaaacgaaagaaaagggggtatatcgtggggctcgcatgaggagctgggggaaatgggtctcggagattcgggagccccgtaagaaatcaagaatctggctcgggactttccccacggcggagatggcagcgcgtgcccatgatgttgcggcattgagtatcaaaggaagttccgcaatccttaacttccctgagctcgcggattttctgccaagaccagtctcgctcagccaacaggatatccaggccgcagccgccgaagccgctcttatggatttcaaaactgtaccattccatcttcaggatgactcaacgccgttgcaaactaggtgtgatactgagaagatcgaaaagtggtcatcctcatcgtcctcagcctcatcctcatcctcatcttcgtcctcgtcctcatcatctatgctttcgggggagctaggagatattgtggagttgccgagtcttgaaaacaatgtaaaatacgattgtgcgctgtatgactcgttggaggggctggtgtcgatgcccccatggttagatgctaccgaaaatgattttaggtatggagatgattcggtactgttggacccatgtctcaaagaaagctttttgtggaattatgagtaaggtttttttttggaaagaaatgtggttttttgtttcctcctctcttttatactttcgatctttttttctaagcatatatatcttctacatatgtaatacttttccattagtaaacaatgattcggtttcgggtac

SEQ ID NO: 4538 - DNA, 780 bp, Artificial Sequence; identical to SEQ ID NO: 4074
  P4012 (OPLEXA::G450)

SEQ ID NO: 4539 - DNA, 1258 bp, Artificial Sequence
  P4019 (OPLEXA::G675)
tcagagagagatggggaggtcgccttgttgcgacgagaatggtctaaagaaagggccatggactcctgaagaagatcaaaagcttattgattacattcataaacatggtcatggaagctggagagctctccccaagctcgcagatttgaataggtgtggaaagagttgtagactgaggtggacaaattatttgagaccagacatcaaaagaggaaagttttcagccgaagaagagcaaacaatcctccatctccactccattctcgggaataaatggtcagctattgcgacgcatttgcaaggtcgtacagataatgagataaaaaacttttggaacacacatctaaagaagaaattgatccagatggggatcgatcctgtgactcatcagccaagaaccgacctcttcgcaagtttacctcagctcatagccttggcaaatctaaaagacctaatcgaacaaacatcacaattctcatccatgcaaggcgaagcagcccaactagccaatctacaatatctccaacgtatgtttaattcttcggcttcattaaccaacaacaacggcaacaattttagcccgagtagtattctcgatatcgatcagcaccatgccatgaacctcttaaactccatggtctcttggaacaaagatcaaaaccccgcttttgatccggttcttgaactcgaggctaacgatcaaaatcaagatttatttccactagggtttatcattgatcaacccacccaaccactccaacaacaaaaataccatttaaacaatagtcctagtgagctaccatcgcaaggtgacccacttcttgatcatgtccctttcagtctccaaacacctttgaatagtgaggatcactttatagataatttggtcaaacatccaactgatcatgagcatgaacatgatgacaatccatcttcatgggttctcccttctcttatagacaataaccctaaaactgtcacgtcttctcttccacacaacaatccggcggatgcaagtagcagctcaagctatggaggttgtgaagctgcgtcgttttattggcctgacatttgcttcgacgaaagcctcatgaacgttatatcttagttactcttggtttagtgttttttttttagatctctgttattttatacaagttttttatttggtgttggtgttttgtaagtagaaaaggtgcgaatgtgtgatccgtttatccctttatgtaattaaacaggagatctctgtgatccgtta

SEQ ID NO: 4540 - DNA, 860 bp, Artificial Sequence
  P4035 (OPLEXA::G1784)
cactggagaactctgatcacgtcgaagtatttcggaaaaagacacatggctcttgagaaaagcaaaggatgcaaactcctttttgtttgtgatgattttgtagatcgtgcagaggacactctgtttttaaaaacagttgccttggagaagacgtcagtttctgagggagatgaacaagctttcgaattcgaaggatataaggggtttctcgatatttccgagagctgtgatggccttgtctgcttctacgacactacaagagcagtggaagtaatgaatccggccacaacaatgttcatagaactccctctatcgagaatccaacagctttgtatatacaagccaaacccggaggtggagctggagccagttcaagatccaaatcctgttctagacccagtcatgacatgttctcagattggagttgggaaagacagcgttagtggaagttataaactagtatggatgtataatacttctcctgctactcctcctacgtgcgaggttttggatttagatggaaaaaaatggaggttcgtgaatactacttctcttgatcatcatcagatcttgtgcgatcagaggccggtgtttgcaaacggatcactctactggctcacgggagatgaggaaggatatgcaacaacacaaaccaaactcatagttttagatttacacacagagatgtttcaagtcatccaaacaccgccttttattacccgtgatgcctctggtgacaagattggtttatgcaatcttgatggtcgtctctgtatttcagagttgaagaaagattgcaagcaagagttttgatggagagttgaagataacaacacatgggagaggatcttctcggttga

SEQ ID NO: 4541 - DNA, 685 bp, Artificial Sequence
  P4190 (OPLEXA::G485)
tcctctctgatccaacggacccaaaacatctatctctctttctcgaccttttgtctcctcgatctaaagatggcggattcggacaacgattcaggaggacacaaagacggtggaaatgcttcgacacgtgagcaagataggtttctaccgatcgctaacgttagcaggatcatgaagaaagcacttcctgcgaacgcaaaaatctctaaggatgctaaagaaacggttcaagagtgtgtatcggaattcataagtttcatcaccggtgaggcttctgacaagtgtcagagagagaagaggaagacaatcaacggtgacgatcttctttgggcgatgactacgctagggtttgaggactacgtggagcctctcaaggtttatctgcaaaagtatagggaggtggaaggagagaagactactacggcagggagacaaggcgataaggaaggtggaggaggaggcggtggagctggaagtggaagtggaggagctccgatgtacggtggtggcatggtgactacgatgggacatcaattttcccatcatttttcttaattgtaaaatgataaaagcaaattttcatttttattaattaatgatatatatatatatatgtttaacttttagtataatgtttacagaattttttttttaaaactaggttcaacccactaacgtaacagcg

SEQ ID NO: 4542 - DNA, 1289 bp, Artificial Sequence
  P4195 (OPLEXA::G1785)
agattcataccgagatttcatccgttttccattttagaatcttcatttcaattcaagttcgtgtttaaatggaattctcattgatctccgatgaaaatttcatctttaacaacgcttatctatgttctgttaatgatgatacatctcatataccaaaaaataatcttacctttttcaatgacaatctaggtcaatcttcttgtactagatggtccttttcaccagatctgactgatatctctaatcagcactaccaccaaaatcttatacctttgatcccaaattacgattctcaaaatcagaatttggatactaatcaaaaccatttggtttacaactcttcctcatataaaattccatcaaactacccattaatgagtatcaaatcctactcaaatgttgatatctctgagcaatctatgaatagcatagccaacaacggaaaaatccatatgattgataaccccccaacttttgcataccctaaaggtaatgggtgaacctcaatcatttaatgtgccagtgccagaatatatcaaaaacacaaccaacgaaatcatgaatcaaagtgaagatgataagatgaaaaaaaattatcaaaagaagaatataaaggtggtgagcacaagcaaatatttgaagaaaagtgacatcgacaaagtaaactggacagaatctgaggacataaaattgaaagagataatggcgcttggacccaaaaacaaatggacaaaggtcgcaaaaaaattcgaaggaagaacaggaaaacaatgcagagagaggtggtataaccatgctcgtcctaacattaagaaaactgcttggagtgaagaagaagatcaaattttgattgaagcacacaaagtacttggtaccaaatgggtcgagatcgcacagcaacttccggggaggagcgataacaatattaagaaccattggaacaccacaaagcgtcgggtgcaaaataaaagaggtggaactgtcaaccctgtcggcaataacatccttgaaaactacataaggtgtatcacaatcaacaacgaagattttcttaagaccgatggatcttatggtgaaccgacaaacattgagagtgatgatgactctaaagatatgttatacggggagatgaatttgagtctagagactataacgacgcagaccaccaaaccattgaccaatgcttctacaacatcaccttatgttcagatgccagaagataattatactatggaggattgtgaatcactggaggacattctagagctgctgcgttggtgggaataatt

SEQ ID NO: 4543 - DNA, 722 bp, Artificial Sequence; identical to SEQ ID NO: 1365
  P4196 (OPLEXA::G2108)

SEQ ID NO: 4544 - DNA, 1064 bp, Artificial Sequence; identical to SEQ ID NO: 1393
  P4229 (OPLEXA::G2132)

SEQ ID NO: 4545 - DNA, 1092 bp, Artificial Sequence; identical to SEQ ID NO: 995
  P4336 (OPLEXA::G1462)

SEQ ID NO: 4546 - DNA, 1142 bp, Artificial Sequence; identical to SEQ ID NO: 997
  P4337 (OPLEXA::G1463)

SEQ ID NO: 4547 - DNA, 1633 bp, Artificial Sequence; identical to SEQ ID NO: 4178
  P4342 (OPLEXA::G2505)

SEQ ID NO: 4548 - DNA, 999 bp, Artificial Sequence
  P4350 (OPLEXA::G1504)
gggaatgtgttctgtgtagtcagctgcgttctcggaagtgggtgacaaatgaataacgatttgtggttacctgaagaggacttcaagggtctaccggataatttccttgataatctcgttgatcctaccaatgatgtttctgtagaagatatagagaccggcgatgatgagggagattgggatgccaaatttcaaaagctcgtacctccaccattggatgagctaatgagtttgtcctatgagttcacttgcaatggacagcgtgtgcaagttcagaagcatgtgccaattttgaagcagtcgagttcttcagaagtcttctctactgttgataactcccctcctaatgtcaaagtctcaaagttgttgcaatctttaagcccagtctcagtcctcaagaacaccaacggttctggctcaccccaaaacccaaacggagatcagaaactggcctttctcgtgaaaggcatcagaagcaagcgcaaacgccccacactactgagagttacattcctcaaatcatttctattagagatgtcacagcagtttgctccggatgaatctgaatcttctgagatttccgccttgaagaaacgcaagaagaacaagagtcgtcgcttgaaatgcactcattgcgagacaaccactaccccgcagtggagggaaggacctaatgggcgtaaaaccctttgcaatgcttgtggaatccgctttagatcgggccgtcttgttttagaataccgtccagcagcaagcccgaccttcatcccaaccgtgcattcaaatttgcacaagaagatcatatatatgagaatgaaagataacgaccagtttgataccagaaagatccgtgctgagacatccggaccagagactagatcaaggcttcgtaacttcggcagaccaatgagttatggtcaatgaaaaacaagattgtcaggatccgtagaattggttaattttctctcaaagactgatgttctaaatactagggtctag

SEQ ID NO: 4549 - DNA, 966 bp, Artificial Sequence
  P4352 (OPLEXA::G383)
cgtggactctttctttgttttggctgactcttctttcaccgtttccttagagaacttattcatctcataaacaccacacacaacacacacttctctttctccttctctctatatattttaatatcaactttctagggtttccaagttcatatatagtgatgggtttctcaatgttcttctcccccgaaaacgacgtcagccatcattcctctccatatgcttctgttgactgcactctctcacttggaactccctccactcgcctctgcaacgaggatgatgaacgtagattctcgtctcatacctccgacaccataggctgggacttcttgaacggttccaagaaaggcggtggaggcggcggacataacctcctcgctcgccgttgcgccaactgcgacaccacttctactcctctttggagaaacggtccaagaggtcccaaggtatttaatatgtaacctttacatcaaatattttatcatttcttgatgtgggactaatatttctctctgtacaacaaaacaaatattgataataactttatatgatttttaatttggtcagtcgttgtgtaatgcgtgtggaatccgattcaagaaagaagagagacgtgcatcgaccgccagaaactcgacctccggcggaggatcaactgcagctggagttccaactttggatcatcaagcaagtgcaaattattattataacaataataaccaatatgcttcatcgtcgccttggcaccatcagcataatacgcagagagttccatattactcgccggccaataacgaatactcatacgttgatgatgtcagagttgttgatcatgacgtcacaaccgacccgttcttgtcttggaggcttaacgtcgccgaccggaccggccttgtccacgattttacgatgtgatgagtgatcatttcatagatattccccttataagtcttagccttggatacc

SEQ ID NO: 4550 - DNA, 1331 bp, Artificial Sequence
  P4357 (OPLEXA::G1364)
ttgtgttaattgttgtaaagttagggtttttttttctttctgagatggcggagtcgcaggccaagagtcccggaggctgtggaagccatgagagtggtggagatcaaagtcccaggtcgttacatgttcgtgagcaagataggtttcttccgattgctaacataagccgtatcatgaaaagaggtcttcctgctaatgggaaaatcgctaaagatgctaaggagattgtgcaggaatgtgtctctgaattcatcagtttcgtcaccagcgagtatgtcttttttaaccttttaacaatgctatgttgtgtttgctcttgctgaatgtttagaggcttgataggaactttgagttttagtttcaagtcttaaactttatagtgatttttgggtttttcttaactagtgaaagttgaggcctttttagtccttacattggttactctttcttgttgttcatctttgtttggctttgatgttgcatatttgatgatgcaatggtttttctatgacgttgatgagcagagcgagtgataaatgtcaaagagagaaaaggaagactattaatggagatgatttgctttgggcaatggctactttaggatttgaagactacatggaacctctcaaggtttacctgatgagatatagagaggtatgttctgagtacgatgtttattagttatgctgttgtgtgaagagagtttttgaatttcactaacttactctgtttctccttttccttttcttgctctactacgtgaactggaatatcacagatggaggtcagtggttcttcttattctatttcttgttcattcctaaaacttgcaacgatctatgatctttatggcttccgtgaatcatctctttttgtcaacttatgtatcaaactatttatgctttccttatccttttcaatgatcaatagggtgacacaaagggatcagcaaaaggtggggatccaaatgcaaagaaagatgggcaatcaagccaaaatggccaggtatatgtctcaaatctcatgcctttgaccattttttcgtcttcgcattcatctgcacgtattctctcttccgctttagctaagttagtctgacattcatggggtttgtttaccatttggcagttctcgcagcttgctcaccaaggtccttatgggaactctcaagtaacttttcctctcttctcttcacactcaagcaatacgcatcattctcttctaatttgttaagaattgaaaacttgtaaagcatcacttatgttataatctatgaatacctcaaaatctgtgaactaatttgacattggactcggtataattgtaggctc

SEQ ID NO: 4551 - DNA, 892 bp, Artificial Sequence; identical to SEQ ID NO: 4190
  P4359 (OPLEXA::G211)

SEQ ID NO: 4552 - DNA, 485 bp, Artificial Sequence; identical to SEQ ID NO: 7
  P4361 (OPLEXA::G2133)

SEQ ID NO: 4553 - DNA, 746 bp, Artificial Sequence
  P4382 (OPLEXA::G2313)
acaatcgctcttccgtaacatattccacaaaacgatcttcttgtttcttgaatttttagccatctcttttttttttttctcattttctcggatactatggcttcgagtccacgctggacggaggacgacaacaggcgttttaagtcagctctgtcgcaattccctccggataacaagcgtttggtgaatgtcgcccagcatctgccgaaacctttggaggaggtgaagtactactacgaaaagttggtcaacgatgtttatctgccgaaacctttagagaatgtcacccagcatctgcagaaacctatggaaatggaggagatgaagtacatgtacgaaaagatggccaacgatgttaatcagatgcccgagtacgtaccactggcggaatcgagtcagtccaaacgcaggaagaaggatacgccaaatccttggacagaagaggaacacagattgtttctgcaaggattgaaaaagtatggggaaggagcttcgacgttgacatcaacgaattttgtgaagacaaagactccacggcaagtgtcaagccatgcacagtattacaaaaggcaaaaatcggacaataagaaggagaaacgccggagtatttttgacataactttggagtctaccgagggcaatccagattctggaaatcagaaccctccggatgatgatgatccgtcccaaggtcaaggcacttgtcttggagtttagatgttggaagatagaagaatggtgtgaaa

SEQ ID NO: 4554 - DNA, 1135 bp, Artificial Sequence
  P4387 (OPLEXA::G1645)
ctcccaacactaactccatgtttataacggaaaaacaagtgtggatggatgagatcgtcgcaagaagagcttcttcttcttgggacttccctttcaacgacattaatattcatcagcatcatcatcgtcactgcaacacaagtcatgagtttgaaatcttgaagagtcctcttggagatgtagcggttcacgaagaagagagtaataataataaccctaatttcagtaacagcgagagtggtaagaaggagacaacagatagtggtcagtcttggtcctcgtcgtcttcaaaaccatcggtcttggggagaggacattggagaccagctgaagatgttaaactcaaagagcttgtctccatttacggcccacaaaactggaacctcatagctgaaaagcttcaaggaagatctgggaagagctgtagactacgatggtttaaccaattggacccgaggataaaccgaagagctttcacagaagaagaagaggagaggctgatgcaagcacataggctttatggtaacaaatgggcaatgattgcgaggcttttccctggtagaactgataattcagtgaagaaccattggcatgttgtcatggctcgtaagtatagagaacactcttctgcttaccgtaggagaaagcttatgagtaataatccacttaaacctcacctcaccaataatcatcatcctaaccctaaccctaattaccactcttttatctccactaatcattacttcgctcagcctttccccgagtttaatttgactcatcacctggttaataatgcccctatcacgagtgaccataaccagcttgtgttgcctttccattgctttcaaggttatgagaacaatgaacctccgatggttgtgagtatgtttggcaaccaaatgatggtcggcgataacgttggtgccacgtcagacgcgttatgcaatattccgcacattgaccctagtaaccaagagaaaccggagccaaatgatgcaatgcattggatcggaatggacgcggtagatgaggaggtgttcgaaaaggctaagcagcaaccacattttttcgattttcttggcttggggacggcgtgaatgttgaacaaattggtgttaatcagataacgacagtg

SEQ ID NO: 4555 - DNA, 794 bp, Artificial Sequence; identical to SEQ ID NO: 4213
  P4390 (OPLEXA::G1752)

SEQ ID NO: 4556 - DNA, 819 bp, Artificial Sequence
  P4393 (OPLEXA::G1935)
tttgattattttgcagtgaccatcggatatgggtcgggttaaattggagttaaagcgtatagagaagagcacgaaccgacaaattacgttctcaaaacgtaaaaaaggtttaataaaaaaggcttatgaattgtcaacactttgtgacatcgatcttgccctcctcatgttctctccctctgatcgactatgtctcttttccggtcaaacaaggatcgaggacgttttggcgaggtacatcaatcttcctgatcaagaaagagaaaacgccatagttttccctgatcagagcaagcgccaaggtatccaaaacaaagagtatttgttaaggactttggaaaaactcaaaattgaggatgacatggctctccaaatcaacgaacctcgtccagaagccaccaactccaatgtcgaggaacttgagcaagaagtttgtagattacaacaacagcttcagatatcagaggaagaactcaggaaattcgaaccagatccaatgaggctaacatcaatggaggagattgaagcatgtgaagctaacctcatcaatacgttgacacgtgtcgtccagagaagggaacatttgttgagaaagtcctgcgaagcacaaagtaaccaacaaagcatggacgggatccttctaaatgacatcgtcgaggattggggacctgagcccgagcccaaacaagcccatatgatagctaattcggcccatcattcaaatcagccaagctatgatttactcttacgcaggagtaattcgagttcgaaccaaaatccaaaatgatattaggtgaatcgcaaggcgtcgtcgagccc

SEQ ID NO: 4557 - DNA, 1406 bp, Artificial Sequence
  P4394 (OPLEXA::G2417)
ataccggtggaagattctgctttactacgctctccgcttcttcttctcctcgattcgattctcctcatgggtttatcatgaatttttaggttttgagtaattcagaaactcgagtgatgatcccgaatgatgatgatgatgcaaattctatgaagaattatccgttaaatgatgatgatgcaaattctatgaagaattatccgttaaatgatgatgatgcaaattctatggagaattatccgttaaggtcaattccgacggagctttcacacacttgttcattgataccaccttctttaccaaacccttcagaagcagcagcagacatgtccttcaattcagaactcaatcaaatcatggcaaggccttgtgatatgctccctgccaatggtggagctgttggtcataacccttttttggaaccaggattcaactgccccgagacaacagattggattccctctccactcccccatatttattttccttcgggttctcccaatctaataatggaggatggtgtcattgatgagattcacaaacaaagtgacttgccactttggtatgacgacttgattaccactgatgaagatccactcatgtctagtatcttgggcgatcttctccttgacactaatttcaactcagcttcaaaggtccagcaaccaagtatgcaatcgcagattcaacaaccccaagctgttctgcagcagccttcttcttgtgtggaattgcgcccacttgataggacagtatcctcaaacagcaacaacaatagcaacagtaataatgcagcagcagcagctaagggacgtatgcgttggacgcctgaacttcatgaggtttttgttgacgctgttaaccagctcggtggcagtaatgaagcaactcctaaaggtgtcctgaagcatatgaaagtcgaaggtttgactatttttcatgtcaaaagtcatttgcagaaatatagaacagctaaatatataccagtaccatcagaaggttcgccggaggcaaggttgacaccgcttgagcaaattacatctgatgatacgaaacgtgggatagatatcactgagactctgcgaattcagatggaacatcagaagaaactgcatgagcagcttgagagtctaagaacaatgcaacttcggatagaagagcaaggaaaggcgctgttgatgatgattgagaagcaaaatatgggtttcggcggaccagaacaaggagagaaaacaagtgcgaaaacgcctgaaaatggttcagaggagtcggaatccccgcggccaaagcgtccgagaaatgaagaatgaaggaaacctttcttcggatggtagatcataaaactgtggttttggtggagttgtagagtatgacttattaggagtagagctttcagtcttcttcag

SEQ ID NO: 4558 - DNA, 980 bp, Artificial Sequence
  P4396 (OPLEXA::G2425)
gagatctgattgctcaccggagagaacaaaacaagaaatggggaggacgacgtggttcgacgttgacgggttgaggaaaggagagtggacggcggaggaagaccggaagctcgtggtttacatcaacgaacacggtctaggcgagtggggttcactgcctaagagagccggtctacaaagatgtggaaagagttgtagattaagatggctgaattatttgaggcctgggattaaaagaggcaagttcactcctcaggaagaagaagaaatcatcaaataccatgctcttcttggaaacaggtgggcagcaatagctaagcaaatgccaaacagaacagataatgacataaagaaccattggaactcatgccttaagaaaagacttgctaaaaaaggaatcgatccaatgacccatgagccaacaacaacaacaagcctcaccgtcgatgtcacctcctcatcaactacgtcgtctcctacaccgagccctacttcttcttctttttcctcctgttcctctactggctctgcacgtttccttaacaagctcgctgctggaatctcgtcaagaaaacacggactagagagtatcaagacagtgatattggcagaacaaccaagagaagccgttgatgaagagaagatgatgacaattaacatgaaagagaaggaattgattagttgttacatggagattgatgagacgatgagtattgatgaactaccttgtgatgactcgacgtctggcttcgtggcttttgacgactactcattaatcgacccatacagagacggtgtgtacgtatctgatttctacgatgagactgaacaccttgacctgttccttctttgaatcacatttcctttgtctaaataaatccgtttctttagtgtgacgagagagagacagtggagagagagacagtggagagagatgtctgaaaaaaacaagtgcggattagtactttgaatgacatgcg

SEQ ID NO: 4559 - DNA, 968 bp, Artificial Sequence; identical to SEQ ID NO: 983
  P4397 (OPLEXA::G1444)

SEQ ID NO: 4560 - DNA, 1985 bp, Artificial Sequence
  P4398 (OPLEXA::G270)
caaaggacgaacgggaagtcaggcccatatgtttaagtaaggcccattagaaagtgaggcccattgaaattgtcggatactacatcagaggccggcgaggaggagaggagaaagctccgttattcaagattattccgataatgcagtcactctccaccccacacaccatctctcttcttctccccagaacctctccgtctcgtctttctccctctcttcactcccttgctttccccactcgattacggtctctttcctattcttctcaaacgtcgatcctccccgatgccggcgatgatttcattgtcggtgactgtctcgtctacgaggacggcgtcttcgaagacccttaccttgataaggaggtcactcaggttgcgaagcaggagcgcaagaagaatcggcgtggcggggctaagagattagatgaatccgagattgagcccgagaacctcgtgccagaggaatggagggatattcaggcggaggtgaatctgacgaagaaggacaagcgcaaaatagcgcaggagatggagttcggggttcgggtggagaagaagaggcaagggctaattccgctgaggaaagttgacttgaatgactttctcacgtacaaggaagccaagttggctcaattgaggcctgtcattctcgataaaccgggaaatttctccgacgacagtggagcgtcaagcgatggagagaccgctgtatcatctcccagcgagcgagtggctcctaagaaccctagatgggcagtttacggaaagggattcgaccacgttgccaagttcttcaatagcgacaagtacgatcccagcgacaagaaatccgacggtatacgtttaccactcttgtttccttctcttgcttgaattgcaaaaagagcttatatttggctgatccctcgttaggccctcgaaagctgctttcaaaagaagagaagtttatgctcaatagccggaatcctgacctagccgttgccacatcagtaagtccccttacgatgctcttcgtcaaagtgaatgttttcagtctctgatgaaaatgtatttatgtgtgtgtacctctggtgaatcagaaaaaatggcttcctcttcacacactggcagcatgtggagagttttatctggttgattccttgctaaagcacaatcttgatatcaatgcaaccgatgtggtatgtctgacttttttgaagctgttgcttttgtgcacagtgtttatgtttgttggcgtctctttctagtgttgtttccattcttgtcgtttctagggcggcttgacagtacttcaccgagcaatcattggtaagaagcaggctattactaactacctgctgagggaatcggcaaatccatttgttcttgatgacgtaagtggtcaactaatgatatttatatcttgttatgatctcccttgcgcttcagatactggatctgatccgtttggtttatgataggaaggtgcgaccttgatgcactatgctgtgcaaacagcatcagctcccacaataaaacttctcctactgtataacgctgatataaacgctcaggacagggtaggatgatgtcaagcattcattgtaagacaacatcattgttgatcaggtggttgacaatttggcactgggttttcaggacgggtggactccactgcacgttgcagtacaggccagaagaagcgacattgtaaagcttcttttgataaaaggggcggacatagaagtgaagaacaaggcaagttcccgcgtatattcccatatctggttttgaaagcattaactgatgataccatatttgactataccaggatgggttaactccgcttgggctttgcctctaccttggaagagagataaggacgtatgaggtgatgaagctgttgaaagagtttccacttagcagacacaagaagagattggtaacaacagatgaagatattgaatagtcctttcaatttcagcttgaagtacattcccttac

SEQ ID NO: 4561 - DNA, 688 bp, Artificial Sequence
  P4405 (OPLEXA::G2294)
tcctcccttaattagtatcaaaaatggtgaaaacacttcaaaagacaccaaagagaatgtcatctccatcatcatcatcttcatcatcctcatcaacatcatcatcatccataaggatgaagaagtacaagggagtgagaatgagaagttggggttcatgggtttcagagatcagagctcctaatcaaaagacaaggatctggcttggttcttactcaactgctgaagccgcggctagagcctacgacgcagcactcctatgtcttaaaggatcctcagctaataatctcaacttcccagagatctcaacttctctctaccatattatcaacaatggtgataacaacaatgacatgtcccctaagtctatacaaagagtagcagctgcagctgctgctgccaacacagatccttcctcatcatcagtctctacttcatctccattgctttcctctccatctgaagatctctatgatgttgtctccatgtcacagtatgaccaacaagtctccttgtctgaatcatcatcatggtacaactgctttgatggtgatgatcagttcatgttcattaatggagtctccgcgccgtatttgacaacatcactttctgatgatttctttgaggaaggagatatcagattatggaacttctgctgattctactttcattataccttattctttgt

SEQ ID NO: 4562 - DNA, 522 bp, Artificial Sequence
  P4406 (OPLEXA::G1791)
tgcaaaaacaaaaaccttaaaagctttcatggaacgtatagagtcttataacacgaatgagatgaaatacagaggcgtacgaaagcgtccatggggaaaatatgcggcggagattcgcgactcagctagacacggtgctcgtgtttggcttgggacgtttaacacagcggaagacgcggctcgggcttatgatagagcagctttcggcatgagaggccaaagggccattctcaattttcctcacgagtatcaaatgatgaaggacggtccaaatggcagccacgagaatgcagtggcttcctcgtcgtcgggatatagaggaggaggtggtggtgatgatgggagggaagttattgagttcgagtatttggatgatagtttattggaggagcttttagattatggtgagagatctaaccaagacaattgtaacgacgcaaaccgctagatcatcactacttacttacagtgtaatgtttttggagtaaagagtaataatcaatataatatactttagtttag

SEQ ID NO: 4563 - DNA, 722 bp, Artificial Sequence
  P4407 (OPLEXA::G1755)
gccatcttctttgctactactaatctactattacactgaatcgtttgggttcttcttcttcttcagctgctactttgttcgagtgattgctgacatgccgtcagcgtcggagattgttgacaggaaacggaagtctcgtggaacacgagatgtagctgagattctaaggaaatggagagagtacaatgagcagaccgaggcagattcttgcatcgatggtggtggttcaaaaccaatccgaaaggctcctccaaaacgttcgaggaagggttgtatgaaaggtaaaggtggacctgaaaatgggatttgtgactatacaggagttagacagaggacatggggtaaatgggttgctgagatccgtgagccaggccgaggtgctaagttatggctcggtactttctctagttcatatgaagctgcattggcttatgatgaggcttccaaagctatttacggtcagtctgcccgactcaatcttccactgctgccactgtgtcaggctcggttactgcattttctgatgaatctgaagtttgtgcacgtgaggatacaaatgcaagatctggttttggtcaggtcagactagaggattgtattgatgaatatgttctcctagatagttctagtgtattgttaatcgtagttgactattgtgaggtcttaagttgtagattgaaaatgagatagctcatatggagctttattgaaatgcaagaaag

SEQ ID NO: 4564 - DNA, 1590 bp, Artificial Sequence
  P4417 (OPLEXA::G1954)
tcttctactatcttgcatgtcttgcgtcttttatatacatctctcgtaaaccctagcaaatcatacaaggtcaagaagcttgaccttcattagacttaagcagtttataatcaactaccacgaatagcaatggataaagattactcggcaccaaacttcttaggtgaatcctcaggcggtaacgatgataacagctctggtatgatagactatatgttcaatagaaaccttcaacaacaacaaaagcaatcgatgccacaacagcagcaacatcaactctctccttccggatttggagcaacaccctttgataaaatgaacttctctgatgtgatgcagtttgcggacttcggttcgaaacttgcgttgaaccagaccagaaaccaagacgatcaagaaaccgggattgaccccgtttatttcttgaagttccctgtcttgaacgacaaaatagaggaccataaccaaacccaacatctcatgccttctcatcagacgtctcaagaaggaggtgagtgtggaggaaacataggcaatgtgtttcttgaagaaaaagaagatcaagacgatgacaacgacaacaactccgtgcaactacgttttattggaggagaagaagaagatagggagaacaagaatgttacgaaaaaggaggtgaagagcaagaggaagagagctagaacgagcaagaccagcgaagaagtggaaagccaacggatgactcatatcgcggtcgaaagaaaccgtaggaagcaaatgaatgagcatcttcgtgtccttagatctctcatgcctggctcctacgttcaaaggggagaccaagcgtcaatcataggaggagcaatagagtttgtgagagagctcgagcaactcctacaatgtcttgaatcacagaagcgtcgaagaatcttaggagaaaccggtagggacatgacaacgacaacgacttcttcttcttctcccataactacggtagcgaaccaagcacaaccgctcattattacgggaaatgtaaccgagctagagggcggaggagggcttcgggaggagactgcggagaacaagtcgtgcttggctgacgtggaggtgaagctgctagggtttgacgccatgatcaagatactttcaagaagaaggccgggacagctgattaagactatagctgctttggaggatcttcatctctctattcttcacactaacatcactaccatggaacaaaccgtcctctactcctttaatgtcaagataacaagtgaaacgaggtttacggcagaagacatagcaagttccatccaacagatatttagtttcattcatgcaaataccaacatatctggaagctctaacctgggaaatattgtgtttacttgaaaatcatcacacggcgacaactttgtacactggtgaagattacagtacgtaataatctctacatattgggttttattctccaagcatttggaagagtgtttaagttaaagggagtgcttactttatttttttggggcttttttcatgcaatttaaattttagtgatgattgtgtcgcttgtaatgttagaactcgttgttgtgatttctgctgctt

SEQ ID NO: 4565 - DNA, 1237 bp, Artificial Sequence; identical to SEQ ID NO: 4238
  P4418 (OPLEXA::G2156)

SEQ ID NO: 4566 - DNA, 1347 bp, Artificial Sequence
  P4419 (OPLEXA::G2157)
ccatgtcttgtgtgtctgcttcatgcaacatgttggtttggatttggttaatctaaaagtttaagataaggttttcggattctcttcctgtcttgtaatagtttcttgtcggagagccatcaacaccaacttcaacaaaaaaaacaagaaaaagaaaaagattctctttctcgttttatttccattagagaagaaaaaaagaatggcgaatccttggtgggtagggaatgttgcgatcggtggagttgagagtccagtgacgtcatcagctccttctttgcaccacagaaacagtaacaacaacaacccaccgactatgactcgttcggatccaagattggaccatgacttcaccaccaacaacagtggaagccctaatacccagactcagagccaagaagaacagaacagcagagacgagcaaccagctgttgaacccggatccggatccgggtctacgggtcgtcgtcctagaggtagacctcctggttccaagaacaaaccaaagagtccagttgttgttaccaaagaaagccctaactctctccagagccatgttcttgagattgctacgggagctgacgtggcggaaagcttaaacgcctttgctcgtagacgcggccggggcgtttcggtgctgagcggtagtggtttggttactaatgttactctgcgtcagcctgctgcatccggtggagttgttagtttacgtggtcagtttgagatcttgtctatgtgtggggcttttcttcctacgtctggctctcctgctgcagccgctggtttaaccatttacttagctggagctcaaggtcaagttgtgggaggtggagttgctggcccgcttattgcctctggacccgttattgtgatagctgctacgttttgcaatgccacttatgagaggttaccgattgaggaagaacaacagcaagagcagccgcttcaactagaagatgggaagaagcagaaagaagagaatgatgataacgagagtgggaataacggaaacgaaggatcgatgcagccgccgatgtataatatgcctcctaattttatcccaaatggtcatcaaatggctcaacacgacgtgtattggggtggtcctccgcctcgtgctcctccttcgtattgattagttagataggcggtggttggtgcgttctttttactggaatgattatattttccattaggatggttaggcttttgtttattaaagctatcaagtttcttttttttttacggataattcggatgacaattagctagtgtttgtttgtttgttttgtggcggcttttctgacttgactattttgatcgcggatagctttgtatgaaagtgaa

SEQ ID NO: 4567 - DNA, 918 bp, Artificial Sequence
  P4423 (OPLEXA::G2052)
acgtctagcaagtcatcgtattctactttgttgttgcaaatgggaagttcatgtttacctccagggttccggtttcatcctacggatgaagaactcatcgaatattacttgaaaagaaaagtcgaaggtctcgagattgagcttgaagtcattcccgtcatcgatctttatagtttcgatccttgggagttaccagacaagtcgtttctcccaaaccgggacatggaatggtacttcttctgctcaagggacaaaaaatatcctaatggttttcgtacaaatcgaggaacaaaggctggttattggaaagcaaccggaaaagatcgaaaaattacttctcgttcatcttctataattggttatagaaaaactctagttttctacaaaggccgtgccccgttaggcgatagaagcaattggatcatgcatgaatatcgactatgcgatgatgatacatcacaaggatcacaaaatttaaagggagcttttgtgttatgtcgtgttgctatgaagaatgagatcaaaactaatacgaaaatccgaaaaattccaagcgagcaaacaatcggatcaggagaaagctcgggtttatcaagccgagtaacgtctcctagtcgcgatgaaacaatgccgtttcactcatttgccaatcctgtatctactgaaactgattcttccaacatttggatttcacctgaattcatcctcgattcttcaaaggactatcctcaaatccaagatgtcgcatctcagtgcttccaacaagactttgattttccgatcatcggtaaccaaaacatggagtttccagcgagtacaagcttagatcagaacatggatgagtttatgcaaaacggttattggacaaattatggatacgatcaaaccggtttattcggttactcagatttctcctag

SEQ ID NO: 4568 - DNA, 1548 bp, Artificial Sequence; identical to SEQ ID NO: 4245
  P4524 (OPLEXA::G2153)

SEQ ID NO: 4569 - DNA, 1199 bp, Artificial Sequence; identical to SEQ ID NO: 703
  P4527 (OPLEXA::G937)

SEQ ID NO: 4570 - DNA, 1348 bp, Artificial Sequence
  P4528 (OPLEXA::G729)
aacaacttcagtggcagcaatagcaagagaaaggtttctttaattatgtctatggaaggtgtttttctagagaaaaccaaaacaaacacaacaactactctccctgatctatctctccacatcagtctcccagatattcatcaataccatcacaatgaatcttctaaagaatcttcaagaagatcctcccaactcgaaaacaacaaccgatcgtccaactttgaactctctttatctcatcataaccatccaacagcaagaatcttccattgtcctgatcgaagaacccttaatcttcctcatcagcagcattacaacaaccctatcatcaatggtgttcatcaaagggtcgatgaatccgagattagtaatctccaccgtccaattagaggcatcccggtctatcacaaccgttcattccctttccaccaacaaaactcttcattaccttctcttggaggaggagacatggatcaaatctcaatcttaaactcatcttccggctacaacaacgcttaccgatcattacaatcttccccgaggcttaaaggtgttcctttgcatcatcatcatcatcataatcagtatggagtcgttggatcttcagattcgtcttctcctcatcaccataaccatcatcatcatgggatgatcagatcaagattcttgcctaagatgccgacaaagcgaagcatgagagctccaaggatgcgttggactagtagcctccacgcgcggtttgttcacgctgttgagcttctaggcggccatgaaagagcaactccaaagtcggttcttgagctcatggatgtaaaagacttaactttagcacatgtgaagagccatttgcagatgtatcgaactgttaagaccactaacaagcctgctgcttcatcagatgggtcaggagaagaagaaatgggcataaatggaaacgaagttcatcatcaatcatcgacggatcaaagggcacaatctgatgatacttctcttcatcaagaaactgacatttcttccacacaacctcgttggagtaactcttcacgagagacatggccattaagtaataactgctcaagcgacatagatacaatgatcagaacttcatcaacatcaatgatctctcattatcaaagatccagcattcaaaatcaggagcaaaggtcgaatgatcaagcaaagaggtgtggaaatcttagttgtgaaaatccaagtttggagtttacattaggcagaccagattggcacgagaaatgactttcttgatcaatttggatttttatatatattggattttttatttttttgtttcatctttctctctctatatatactcagaaacatgtat

SEQ ID NO: 4571 - DNA, 986 bp, Artificial Sequence
  P4529 (OPLEXA::G1909)
atggaagtataataagtggccacggactagtactctctcaccaacttccacctctccaagcaaaccctaaccctaaccaccaccatgtcgctacctctgctggtcttccgtcaaggatgggtggatcgatggcggagagagcaaggcaggccaacattcctccactagcgggacccctaaagtgtcctcgatgcgactccagcaacactaagttctgttactacaacaactataacctcactcagcctcgtcacttctgcaaaggttgccgtcgctactggacacaagggggcgccctgagaaacgtccctgtaggtggaggctgccggaggaataacaagaagggcaaaaatggaaatttaaaatcttcttcttcttcgtccaaacagtcttcctcggtcaacgctcaaagtcctagctcaggacagctaaggacaaatcatcagttccctttttcaccaactctttacaatctcactcaactcggaggtattggtttgaacttagccgctactaatggcaacaaccaagctcaccagatcggttccagtttgatgatgagcgatctagggtttctccatggacgaaatacttcaactccgatgacgggaaacattcatgaaaacaacaacaataataacaatgaaaacaacctaatggcatccgttggatctttgagcccctttgctctcttcgatccaacgacggggctatacgctttccagaacgacggtaatatcgggaacaacgttgggatatctggttcttctacttccatggttgattctagggtttatcagacgcctccggtgaagatggaagaacaacctaatttggctaacttgtctagaccggtctccggtttgacgtctcctgggaatcaaacaaatcagtacttttggcctggttcggatttctcgggtccttctaatgatctcttgtgagatttttgtgtgttttgtcggatcattaacgtatgctacgac

SEQ ID NO: 4572 - DNA, 1411 bp, Artificial Sequence; identical to SEQ ID NO: 4254
  P4539 (OPLEXA::G989)

SEQ ID NO: 4573 - DNA, 759 bp, Artificial Sequence
  P4547 (OPLEXA::G1897)
aactctcaactctcgactttcagataacctctcttctcaacaacatgccttctgaattcagtgaatctcgtcgggttcctaagattccccacggccaaggaggatctgttgcgattccgacggatcaacaagagcagctttcttgtcctcgctgtgaatcaaccaacaccaagttctgttactacaacaactacaacttctcacaacctcgtcatttctgcaagtcttgtcgccgttactggactcatggaggtactctccgtgacattcccgtcggtggtgtttcccgtaaaagctcaaaacgttcccggacttattcctctgccgctaccacctccgttgtcggaagccggaactttcccttacaagctacgcctgttcttttccctcagtcgtcttccaacggcggtatcacgacggcgaagggaagtgcttcgtcgttctatggcggtttcagctctttgatcaactacaacgccgccgtgagcagaaatgggcctggtggcgggtttaatgggccagatgcttttggtcttgggcttggtcacgggtcgtattatgaggacgtcagatatgggcaaggaataacggtctggccgttttcaagtggcgctactgatgctgcaactactacaagccacattgctcaaatacccgccacgtggcagtttgaaggtcaagagagcaaagtcgggttcgtgtctggagactacgtagcgtgatagagactatcggttcagcttctacttcatcggaggg

SEQ ID NO: 4574 - DNA, 1763 bp, Artificial Sequence
  P4559 (OPLEXA::G843)
gccgggaagaagtgcgagcttggtgccgatgggtcgttcgaaactagcttctcgtcctgctgaggaagacctgaatccaggaaaatcaaaaaggaaaaagatatcattgggtcctgagaatgctgcggcatcaatttccaccggaattgaagctgggaatgagaggaaacctggcctttactgttgtaactattgcgataaagatctgtctggtttggttcgtttcaaatgtgctgtttgtatggactttgatctttgtgtggaatgcttttctgtcggcgttgaacttaatcgtcacaagaacagtcacccatatcgtgttatggacaatttgtctttttcgcttgttacttctgattggaatgccgatgaagagatactccttcttgaggccattgcgacatacgggtttggcaattggaaagaagttgcagaccatgttggtagtaagacaacgacagaatgtattaaacacttcaattctgcttacatgcagtcaccatgctttccacttccggacttgtcccatactattggaaagagcaaagatgagctgcttgctatgagtaaagatagtgcagtcaaaacagaaatacctgcatttgtgaggctatctccaaaagaagagttacctgtgtcagctgaaatcaaacacgaagcttcagggaaggtcaatgaaatagatccacctttgtctgccttagctggagtcaagaagaaaggcaatgtaccgcaggctaaggacatcatcaagttggaagctgcaaaacaacaatctgacaggagtgtcggggagaagaaactcagacttcctggagagaaagttccattagtaacagagttatatggttacaatctaaagagggaagaatttgagatcgaacatgacaacgatgctgagcaactgcttgctgacatggaatttaaggattctgacacagatgctgagcgtgagcagaaactgcaggttcttcgtatttactcgaaaaggcttgatgagaggaagcggaggaaggaatttgttctggaaagaaacttgttgtaccctgatcaatatgagatgagcctttcagcagaggagagaaaaatatataaaagctgtaaagtgtttgcgcggttccaatccaaagaagagcacaaggaactgattaagaaagtcattgaagagcaccaaattctcagaagaatcgaggatcttcaggaagctagaactgctggttgcaggacaacttcagacgcaaatagatttatagaagagaagagaaagaaggaagctgaagaaagtatgctgctgcggcttaaccacggtgcaccaggcagtatagccggtaaaacactaaaaagtccaagagggttacccagaaatttgcatccctttggttctgactcactgccaaaggtcacacctccaagaatatacagcggtttggacacttgggatgttgatggtctccttggagctgacttactctcagagaccgaaaagaagatgtgcaatgagaccagaatactgcctgtacactatttgaagatgttggatatcttaacaagagaaataaagaaggggcagataaagaaaaagtctgatgcttatagcttcttcaaagtagagccgagtaaagtagacagagtatatgatatgctggttcataagggaataggtgactcaacatgactcatagcttcatggtcctaacatgtacttctcgaacatatattagccatgtaaatataaaggaaggtgatgctgattttggttacac

SEQ ID NO: 4575 - DNA, 500 bp, Artificial Sequence
  P4562 (OPLEXA::G1481)
gacacaaaacgaacaaccacagaaacttgaaagagagaaagagtttgattttgattaaaatggggaagaagtgtgatttatgtaacggtgttgcaagaatgtattgcgagtcagatcaagctagtttatgttgggattgcgacggtaaagttcacggcgctaatttcttggtagctaaacacacgcgttgtcttctctgtagcgcttgtcagtctcttacgccgtggaaagctactgggcttcgtcttggcccaactttctccgtctgcgagtcatgcgtcgctcttaaaaacgccggcggtggccgtggaaacagagttttatcggagaatcgtggtcaggaggaggttaatagtctctgctccgatgatgagatcggaagctcttcagctcaagggtcaaactattctcggccgttgaagcgatcggcgtttaaatcaacggttgttgtttaactcacactctaccgtatcgtcagaatgaacggcgccggtacatcg

SEQ ID NO: 4576 - DNA, 863 bp, Artificial Sequence
  P4563 (OPLEXA::G1884)
ctcttgtcccatattgcaccatctccttcagaaaaaaataaaaagagtttataactcatgatgacgtcatcccatcagagcaacaccaccggctttaaaccgcggcggatcaagacgacggcgaagccaccacgtcagatcaataacaaagaaccatctccggcgacgcagccggtgctcaagtgtccgagatgtgattcagtcaacaccaaattctgctactacaacaactacagcttgtctcagccacgtcactactgcaagaactgtcgtcgttactggacacgtggcggcgccctccgtaacgttcccatcggtggctccactcgaaacaagaacaagccttgcagcctccaagtcatctcttctcctcctttgttctcgaacgggacgtcatcggcgtctcgtgagcttgtaagaaaccatccatcgacggcaatgatgatgatgagttctggtggattctccggctatatgtttccgttggatcctaacttcaaccttgcctcgtcttctatcgagtctttgagttcttttaaccaagatttgcaccagaagcttcagcaacaaagactcgtcacttccatgtttctccaagattctcttccggttaacgagaaaacggttatgtttcagaacgtagagttgattcctccttcgacggtgacgacggattgggttttcgataggttcgccactggaggaggtgcaacaagtggcaatcatgaagataatgatgatggggagggtaatttgggaaattggttccataatgctaataataatgctctgctctaattatcaattatcatttactctctatttctctaaatattgtagctagcatgcagaagctatggctg

SEQ ID NO: 4577 - DNA, 828 bp, Artificial Sequence; identical to SEQ ID NO: 4266
  P4566 (OPLEXA::G2513)

SEQ ID NO: 4578 - DNA, 1668 bp, Artificial Sequence; identical to SEQ ID NO: 4278
  P4593 (OPLEXA::G922)

SEQ ID NO: 4579 - DNA, 1325 bp, Artificial Sequence
  P4598 (OPLEXA::G2150)
tcttcagaattcccagagaagttgttggaattgaatttttcacttttttgttcataaaagttctagtctttttagatgaacatggacaaggaaacagagcaaaccctaaattacttacctttgggtcagagcgatccctttggcaatggcaatgaaggaacaattggagatttccttggaagatactgcaacaaccctcaggagatttcaccgttaactctacaatccttctctctgaattctcagatctccgagaatttcccaatctctggtggaatcagattccctccatatccaggtcaatttggatccgatcgtgaatttgggtcacaaccaacaacgcaggagagtaacaagagctctttgttggatccagattcagtttcggatcgagttcacaccacgaaatctaactctagaaagaggaagtcgattcctagtggtaatggcaaggagtctccagcttcatcgtctcttacagcttccaattcaaaggtttcaggagagaatggtggatctaaaggtgggaagagaagcaagcaagatgtagctgggagtagtaaaaacggagtagagaagtgcgatagtaaaggcgacaataaggacgatgctaagcctcctgaggcgcctaaagattatattcatgtcagagctagaaggggtcaagcaactgatagccatagtcttgctgaaagagcaagaagagaaaagattagtgagagaatgacgttgcttcaggatctggttcctggttgcaaccggattacagggaaagcagtcatgcttgatgaaattataaattatgtgcagtccttgcagagacaagttgagttcttgtccatgaagctggctaccgtaaatccaaggatggagtttaatgctaatgcttctttatccacagagatgattcaaccgggggagtcgttaacgcagtctctttacgcaatggcttgctcagagcaaagacttccatcagcatactattcacttggcaagaacatgccaagattctcagacacacaattcccctcaaacgatggatttgttcacactgagacaccaggattctgggaaaataatgacctgcaaagcattgttcagatgggttttggagatatcctccagcaacagagcaacaacaacaacaacaactgttctgagccaacgcttcagatgaagcttgaaccatagtccatagctatgattattatctctgttgtacatacagaaaaccaagtagtgatgagtaacggagtgaatcatattggaattttaatgtttacaatcgttgcttctttgcttgtgtctctgttgatttcttctca

SEQ ID NO: 4580 - DNA, 817 bp, Artificial Sequence
  P4601 (OPLEXA::G1808)
ccccttctaatttctctcatctctctattagaaaaattattagcaattatgttgtccactgcaccggccttttcattctccgaaccgggtttggttaatcaattctcgggtttccaaaccgggttcactccttgggaatgggattgctctgatctctttttcgtggaccaaatgtctcttgaaccggccatccctagtccttgttatggtgaatccgacactggttccgtcaaaattaattccggttctcatgacatgaaaaccggttctgacgaatcttgtgccggtttcgtcaaaattaatcctcgttgtgacgacgccgacatatcaaacgatctaccgtgctctcaagcagatgaaccggactcggacgacacaaaacaattgacagccatcacaaatttcggttcgggagagaataaccataaccggaaaaaaatgatccaaccggagatgaccgacgagcggaagaggaagaggatggagtcaaaccgggaatcagcgaaacggtcaagaatgcgtaaacaaagtcacattgataacttacgagagcaagtaaaccggttggatttagaaaaccgtgagctcgggaaccgactccggttagttttacaccagcttcaacgagtgaattccgacaataaccggctcgtgacagaacaagagatactccggctaagattgtcggagatgcgtcggattctgatcattagacaacttcaacaacagcaacaatgggaactacataaccggagaatgatcatgactgaacaaaaccaccctcatcttcaatgatagatcaaaatatttaagaagg

SEQ ID NO: 4581 - DNA, 1590 bp, Artificial Sequence
  P4603 (OPLEXA::G2072)
tatgccattttcctccccgtggaaggtctaacaatcacacgtctcctaatctcgtacgtcttcttaggtatgttctttgcatgttaaagaaactgtatcttcaattcttgtcattacatgataatggttttcttatacatgttttgctcataccttataggttttgaagaatggaaaatttaaggaggttgtcaaacccgggaaatttcggattcattggaagatcacaatcacgagttccccaaaaaaacatggaaaataacatttctcctcctaataatatgcaccaccatagtgcttctttagatgatcttttcacagaagaccaaccagcttggctcgatgagctcctaagtgagccagcatcacctaagattaacaaaggtcatagacgttcagctagtgacacagctgcttacttgaactcagctttaatgccttcgaaggaaaatcatgttgctggttcgtcttggcagttccagaactatgatttgtggcagtccaactcttatgaacaacacaataaattaggatgggatttctctacagcaaatggaactaatatccaaagaaatatgtcatgcggagctttaaatatgtcgtcgaaacccattgagaaacatgtaagcaaaatgaaagaaggaacttctacaaaaccagatggtcctagatcaaagactgactcaaaacgtatcaaacagtaagtagtcttatctttgtcatgtgtacttataataggttattaaaatgtcccacatcgattgagattaagatctttaggcattatctggcaatccttaactcttgagctaactgttgggataagttagaccacattcctaatataggttgataaacatatttctgatgcggtttaataatatacaattttatcgaaaattattaaaatgcagtcaaaatgctcatcgagcgcgtttgagaaggcttgagtacatatcagaccttgaaaggaccatccaagtgctacaagtaagattctaaaggctcgtgtatttctcgaagttctttaatttcattaataatatgaaaagattcctaatgttatattatacatgttggattttcttcaataggttgaaggatgtgaaatgtcatctgccattcactacttggatcagcagttactcatgcttagcatggaaaatagagctttaaaacaacgtatggatagtttagcagaaatccaaaagcttaaacatggtatttaacctttcatatcactactaaaatggatcaaaatgcatttattttgttctcttgtaaaattttgattttggttggttaatacagtggagcagcaattgcttgagagagagataggaaacctacagtttcgacgacaccaacaacaaccacagcaaaaccaaaaacaagtccaagcaatacaaaatcgatacaacaaatatcaaccacctgttacacaagaacccgatgcccaatttgcagccttggcaatatgatttaggaaatatggatacattgttcagattaagctgagctcctcttgctctaccttaatgtccatacaacataggtgaacttgatgtttgtagccttgaatgaaaaccg

SEQ ID NO: 4582 - DNA, 1149 bp, Artificial Sequence
  P4605 (OPLEXA::G2116)
ttcatctccatcattatctccattgacattgttctcaattgcgaataataatcataattattcacacaaccaaagcattcatctctcagattctcttaaaaaaatggagaaatcagatcctccaccagtcccaaagcccggcgccactattatcccctcctccgatccaattcctaatgccgatccgattccatcttcttccttccaccgccgatctcgctccgacgatatgtccatgttcatgttcatggatcccctctcctccgccgcaccaccttcctccgacgaccttccctccgacgacgatctcttctcttctttcatcgatgtcgatagcctcacctctaatcccaatccctttcaaaatccttccctctcctccaactccgtttccggcgctgctaatcctcctcctcctccttcctctcgtcctcgccaccgtcacagcaattccgttgacgctggatgcgccatgtatgccggtgatatcatggacgctaagaaagctatgcctcctgaaaaactctctgagctttggaacatcgatcccaaacgcgccaaaaggattctagcgaatcgacaatctgcagctcgatccaaagagagaaaagctcgatacattcaagaacttgagcgcaaagttcaatctcttcaaaccgaagctaccactctctctgctcagcttactctctaccagagagacacaaatggactagcaaacgaaaacacagagctgaaacttaggttgcaagcaatggaacaacaagctcagcttcgtaatgctttaaacgaagcgttgaggaaagaagttgaaaggatgaagatggagacaggagaaatctctggtaattcagattcgtttgatatgggaatgcagcagattcagtattcttcctcaactttcatggctattccaccatatcatggctcaatgaacctccatgatatgcagatgcattctagtttcaatcctatggagatgtccaattctcaaagcgtgtcggactttctacagaacggccgaatgcaagggctggagattagtagcaatagctcaagcttagtcaaatctgaaggaccttctctctctgctagtgagagtagctctgcctattgacgacaagattatgatgaggctcatttttctgg

SEQ ID NO: 4583 - DNA, 866 bp, Artificial Sequence
  P4728 (OPLEXA::G1815)
tatgagacattagttatagaagagagactaacatgaagatggatttttcatgtttccaagaatacccttttgagtttcattgcagaggaacaacatttaatgggtttagagaaaacaatgcagtgtctgaaacagtagaagagttctgtaataaaagaaggatgcagaagaagagtgatgatttgaagactaagaagaagaagaaacagagtgtttctagggtttgtagtagaggacattggaggatctctgaagatactcagcttatggagcttgtttcggtttacggtcctcaaaactggaaccacattgcagagagtatgcaaggaagaacaggtaacgacaaaaattgaaatctttaatcttcccttagctaattccggaacatgaaacttacaatgttttttcttgcttctttgtgttttgtcttaaaggaaagagctgcagattgaggtggtttaaccagttagatccgaggattaacaagagagctttcagtgatgaagaagaagagagactacttgctgctcatagagcttttggtaacaaatgggctatgattgctaagcttttcaatggaagaacagataatgccttgaagaatcattggcatgttctcatggcaaggaagatgagacagcaatcaagttcttacgtccaaagattcaatggttctgctcatgaatctaacacagatcacaaaatcttcaatctttctcctggtttgtctcttcttaccttacacatatgcattgagtttaactctgttattgtaatgagatactttcgatatttatcactcaggaacaatgaacttatggtttggtctcaaaagtagtcagattgcaagtttggtgagtctttaa

SEQ ID NO: 4584 - DNA, 1235 bp, Artificial Sequence; identical to SEQ ID NO: 4312
  P4729 (OPLEXA::G2893)

SEQ ID NO: 4585 - DNA, 1099 bp, Artificial Sequence
  P4741 (OPLEXA::G2296)
atcctaaacagaaaatatgtctcttgagattgatgcgaaggctgtctcagcactcctccttggccaaggatgcgctaacaatctcaagacgctcctcaaaaaccatgaaacaggctcagtttcaacagagccactcatcaactccattcttgattctttctcgtttgctctgtcttctcagaacataccacgtcatgtgtctcaaagatcatcaaagaagtaaattattaaaaactctaaatcaagtagaaaacacacacctgttttggtctatgttactctatttcttctaccactttcgatgcaagtatcctagtgaacattgctctgatacaacattgcagaaagatgtgtggaatacaaggtatggaagattctccgacaccggcccacattgatggcttcatctggaggaaatatggacaaaagaccatcaaaacctctccgcaccaaaggttagttaattaagtagattagaaagacatagctactgctctcttttcacaaatacagagctattttctagagtgtgtattgagcgatgactaattgtagagtaaaatttacaggtggtactaccgatgtgcctatgcgaaagaccaaaactgcgacgctaccaagcgggtacagaagatccaagacaatcctccagtgtacagaaacacctatgtcggacaacatgcatgtgaagctccagcttatgcagttaataatggtggtacatacggttcaaaaatgatcaaattcgactatgttattcctgaatcggttatgcctcaacctttatcaattgattcccaagaaattaccatggaggataaagacacagacgaccatattttgaactatattaacgagcatttgatggaagatgaggcgtatgatgttttccctgatgtacttggagaacgttgctgctttggattagaaccctttccaggattgaacattaataaatcttaaaagcttttcatgttcttcgatcttatggtggagaatgaatgattcattcttcatttcttttcatgttcatgttttgtaattttgatttacgtgttgtttttttgtaaaaggaagttttatcagtgatgtatttctt

SEQ ID NO: 4586 - DNA, 1225 bp, Artificial Sequence; identical to SEQ ID NO: 1397
  P4743 (OPLEXA::G2137)

SEQ ID NO: 4587 - DNA, 1520 bp, Artificial Sequence
  P4753 (OPLEXA::G2141)
ttctgattagtgagtggtgttcatcaagtattagaagaagatggatttaagtgcgaaagatgagttttcagcagagaagaggaatcctgataactatgattctgttaataatccgtctggagattggcgagttgattcatatccttcagagaatctgatttcagctggtcctgcgtcttgttctccttctcagatgatggattcatttgggcaaactctttggtatgatcccacgagtgttcaggctgttggttatgccggttttaatggtggtaatgcttcgtcttcttcgtttaggggtagtattgatagatctcttgaaatgggttggaatctgcctaatttgttgcctcctaaaggcaatggtcttttcttaccgaatgcgagtagtttccttcctccgagtatggctcagttcccggctgattcaggttttatagagcgtgcagcgaggttttcgctctttagcggtgggaattttagtgatatggtgaatcaaccacttgggaattctgaggctattggtttgtttcttcaaggtggtggaacaatgcaagggcagtgtcaaagtaatgaacttaatgttggtgaacctcacaatgatgtatctgtagcagtgaaagaatcaactgttagatctagtgaacaagctaaaccgaatgttcctggatcgggcaatgtatccgaggatactcagtctagtggtggtaatggtcagaaaggcagagaaacctcttccaacacaaagaagaggaaaagaaatgggcagaagaactctgaagcagctcaatcacacagatcccagcagtctgaggaagaaccagacaacaatggtgatgaaaagcgcaatgatgagcaaagtccaaattcacctggaaagaagtcaaacagtgggaaacaacagggcaaacaaagttctgatcctccaaaagatggatatattcatgtacgggcacgaagaggccaggccacaaatagccatagtcttgcagaaagagttaggagagaaaaaattagtgaaaggatgaagtttcttcaagatctagtaccgggttgcaacaaggtgactgggaaggcagttatgcttgacgaaatcataaactacgtacaatcactacaacgccaagttgagtttttatcgatgaaacttgcaactgtgaacccacaaatggactttaaccttgaaggtcttcttgcaaaagatgcacttcaactacgagctggttcttcatctacaacaccattcccaccaaatatgtcaatggcttatcctcctctacctcatggattcatgcaacaaactctttccagcattggaaggaccattacctctccattgtctcctatgaatggtggattcaagcgacaggaaacaaatggatgggagggtgatttgcaaaatgtgatccacattaactatggagctggtgatgtcacacctgaccctcaagcagcagctacagcatctcttccagctgcaaatatgaaggttgagccatgatatttcgtcctgttagata

SEQ ID NO: 4588 - DNA, 1176 bp, Artificial Sequence; identical to SEQ ID NO: 4336
  P4754 (OPLEXA::G2145)

SEQ ID NO: 4589 - DNA, 597 bp, Artificial Sequence; identical to SEQ ID NO: 4012
  P4776 (OPLEXA::G24)

SEQ ID NO: 4590 - DNA, 1125 bp, Artificial Sequence; identical to SEQ ID NO: 3799
  P4877 (OPLEXA::G237)

SEQ ID NO: 4591 - DNA, 1002 bp, Artificial Sequence; identical to SEQ ID NO: 3950
  P4914 (OPLEXA::G1324)

SEQ ID NO: 4592 - DNA, 1241 bp, Artificial Sequence
  P4942 (OPLEXA::G522)
gtgtcctatacacatatctataattccacaggttgaagaaaagaaataatggaatcggtggatcaatcatgtagtgttcctccgggattcagattccatccaacagatgaagagctcgttggttactatttaaggaaaaaagttgcatcgcaaaagatcgatcttgatgtcataagagatattgatctctacagaatcgaaccatgggatttacaagagagctgccgaatcggatatgaggaaagaaatgaatggtatttcttcagccacaaagataagaaatatccaacaggaacaagaacaaacagagcgaccatggctgggttttggaaagccacgggccgagacaaggctgtttacgacaagtcaaaactgattggtatgagaaaaacacttgtgttctacaaaggaagagcccctaatggccaaaaaaccgattggatcatgcatgaataccggctagagtcagatgagaatgcacctcctcaggaagaagggtgggtggtttgtagagcgttcaagaaaaagccaatgaccgggcaagccaagaacacagaaacttggagctcaagttacttttacgacgaattaccgagtggagtacgctcagttacggagcctcttaactacgtatctaagcagaaacaaaacgtttttgcacaagatttaatgttcaagcaagaactagaaggatcagatatcggtttaaacttcatccactgcgatcaattcattcaacttccgcagcttgaaagcccttcactccctcttaccaaaagaccagtgagcttgacgtcaattacatcattggagaagaataaaaatatctacaaaagacatttaatagaagaggatgtgagcttcaatgcgctaataagtagtggaaataaagataagaagaagaagaaaacatcagtgatgacgacggattggagagcactcgataaatttgttgcttctcaacttatgagccaagaagatggagtttcgggttttggaggtcatcatgaagaagataacaataaaatcggtcattacaataacgaagagagcaataacaagggatcagtagagactgcttcttccacgttattgagtgatagagaagaagagaacagattcatcagtggattattgtgttccaacttggactatgacttatatagggatttacatgtttgataaaagataacactataatatggtgcgtaacgtttgctatataggtaccgtagaattta

SEQ ID NO: 4593 - DNA, 982 bp, Artificial Sequence
  P4955 (OPLEXA::G159)
cgcttttctttttctgttcaaaacatctcgaaaatggcgagaaagaatcttggtcgtagaaaaatagagttggtaaaaatgaccaacgaatcaaaccttcaagttacgttttcaaaaagaagatctggtcttttcaaaaaaggcagtgaactttgcaccttatgtgacgcggaaattgcgataatcgtgttttcaccctcgggaaaagcatactcttttggtcatccaaatgttaacaagttacttgaccactctttagggcgtgttataagacacaacaacacaaactttgctgaaagccgcacaaagctccgtattcaaatgctcaatgagtctttaactgaggtgatggctgaaaaagaaaaagaacaagagaccaagcagtcaatagtccaaaatgaaagagagaacaaggacgctgagaagtggtggaggaactctccaacagaactcaacttagctcaatcaacttccatgaaatgtgatcttgaagctttgaagaaggaagttgatgaaaaagtcgctcaacttcatcatagaaacctaaacttctatgttggaagttctagcaatgttgctgctccagcagctgttagtggtggtaatatctccacaaaccatggtttctttgatcaaaacggaaactctacttctgctccaacactgccgtttggatttaatgttatgaatcgcacaccagctgggtacaacagttaccaactccaaaaccaggaggttaaacaagtccatcctcagtattgggctcgttactattagtctatctctctcgttgtgtgactttttaagtctccaatagtttgttctgctttttgttttgtttttgtttgttgttgttgttgttgtcgggcttttaattaagtctcgagtcaactagtttcttgtttcttttcgttatactttgtcttgtagctttatatcattttcttgtggaatatgagtaagctatatgaagtttcatatt

SEQ ID NO: 4594 - DNA, 1034 bp, Artificial Sequence; identical to SEQ ID NO: 3812
  P5072 (OPLEXA::G482)

SEQ ID NO: 4595 - DNA, 649 bp, Artificial Sequence; identical to SEQ ID NO: 3832
  P5099 (OPLEXA::G682)

SEQ ID NO: 4596 - DNA, 1034 bp, Artificial Sequence; identical to SEQ ID NO: 157
  P5142 (OPLEXA::G190)

SEQ ID NO: 4597 - DNA, 1136 bp, Artificial Sequence
  P5557 (OPLEXA::G881)
gtgaccgaagaaagcaaattgagactacgcaccaactagtcctttggtttgtatcttaagataaaggtttcttttatggacggttcttcgtttctcgacatctctctcgatctcaacaccaatcctttctccgcaaaacttccgaagaaggaggtctcagttttggcttctactcacttaaagaggaaatggttggagcaagacgagagcgcaagtgagttacgagaggagctaaacagagttaattcagagaacaagaagctaacagagatgttagctagagtctgtgagagctacaacgaactacataatcatttggagaagcttcagagtcgccagagccctgaaatcgagcagaccgatataccgataaagaaaagaaaacaagacccggatgagttcttaggctttcctattggactcagtagtggaaaaactgagaacagctccagcaacgaagatcatcatcatcatcatcagcaacatgagcagaaaaatcagcttctttcatgtaaaagaccagtcactgatagcttcaacaaagcaaaagtttcgactgtctacgtgcctactgaaacatcggacacaagcttgacagttaaagatggatttcaatggaggaaatacggacaaaaggttacaagagacaacccgtcacctagagcttactttagatgctcgtttgcaccgtcttgtccagtaaaaaagaaggtacaacgcagcgcagaggatccatctttacttgtagcgacatacgaagggacgcataaccacttgggtccaaatgcttctgaaggggatgctacaagccagggtgggtcaagcacagtgactttggatctggttaatggctgtcatagactagcgttggagaaaaacgaaagggataatacgatgcaagaggttctgattcaacaaatggcgtcatcgttaacaaaagattcgaaatttacagctgctcttgctgctgctatatctgggaggttaatggagcaatctagaacatgaacgtttttagtgaatgtattgtttttgtttgtttagaatgattcttcgttttcgaattgtgtctttcgattaggagataaaagatgtatataaatattataagtagatgaagaaatcgtataagtaaa

SEQ ID NO: 4598 - DNA, 673 bp, Artificial Sequence; identical to SEQ ID NO: 4227
  P6071 (OPLEXA::G1792)

SEQ ID NO: 4599 - DNA, 1079 bp, Artificial Sequence
  P6407 (OPLEXA::G187)
ggcttatctcatctcttcttctttgtcttctttactctttttttacctctctcttcattgttcttcaccatgtctaatgaaaccagagatctctacaactaccaatacccttcatcgttttcgttgcacgaaatgatgaatctgcctacttcaaatccatcttcttatggaaacctcccatcacaaaacggttttaatccatctacttattccttcaccgattgtctccaaagttctccagcagcgtatgaatctctacttcagaaaacttttggtctttctccctcttcctcagaggttttcaattcttcgatcgatcaagaaccgaaccgtgatgttactaatgacgtaatcaatggtggtgcatgcaacgagactgaaactagggtttctccttctaattcttcctctagtgaggctgatcaccccggtgaagattccggtaagagccggaggaaacgagagttagtcggtgaagaagatcaaatttccaaaaaagttgggaaaacgaaaaagactgaggtgaagaaacaaagagagccacgagtctcgtttatgactaaaagtgaagttgatcatcttgaagatggttatagatggagaaaatacggccaaaaggctgtaaaaaatagcccttatccaaggagttactatagatgtacaacacaaaagtgcaacgtgaagaaacgagtggagagatcgttccaagatccaacggttgtgattacaacttacgagggtcaacacaaccacccgattccgactaatcttcgaggaagttctgccgcggctgctatgttctccgcagacctcatgactccaagaagctttgcacatgatatgtttaggacggcagcttatactaacggcggttctgtggcggcggctttggattatggatatggacaaagtggttatggtagtgtgaattcaaaccctagttctcaccaagtgtatcatcaagggggtgagtatgagctcttgagggagatttttccttcaattttctttaagcaagagccttgatcgatcattgttataactacatatattatatatattgagagagagaggtagag

SEQ ID NO: 4600 - DNA, 451 bp, Artificial Sequence
  P6424 (OPLEXA::G1795)
acaaacacgcaaaaagtcattaatatatggatcaaggaggtcgaggtgtcggtgccgagcatggaaagtaccggggagttcggagacgaccttggggaaaatatgcagcagagatacgagattcgaggaagcacggtgaacgtgtgtggcttggaacgttcgatacggcagaggaagcggctagagcctatgaccaagctgcttactccatgagaggccaagcagcaatccttaacttccctcatgagtataacatggggagtggtgtctcttcttccaccgccatggctggatcttcctccgcctccgcctccgcttcttcttcttctaggcaagtttttgaatttgagtacttggatgatagtgttttggaggagctccttgaggaaggagagaaacctaacaagggcaagaagaaatgagcgagatataattcatgattatttctaac

SEQ ID NO: 4601 - DNA, 831 bp, Artificial Sequence; identical to SEQ ID NO: 3811
  P6812 (OPLEXA::G481)

SEQ ID NO: 4602 - DNA, 1281 bp, Artificial Sequence; identical to SEQ ID NO: 15
  P7140 (OPLEXA::G867)

SEQ ID NO: 4603 - DNA, 820 bp, Artificial Sequence; identical to SEQ ID NO: 4267
  P7170 (OPLEXA::G2107)

SEQ ID NO: 4604 - DNA, 1246 bp, Artificial Sequence; identical to SEQ ID NO: 3851
  P7824 (OPLEXA::G9)

SEQ ID NO: 4605 - DNA, 949 bp, Artificial Sequence
  P7826 (OPLEXA::G28)
gaaatctcaacaagaaccaaaccaaacaacaaaaaaacattcttaataattatctttctgttatgtcgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagatccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataattttgatttttctttgttggatgattatatgattcttcaaaaaagaagaacgttaataaaaaaattcgtttattattaaa

SEQ ID NO: 4606 - DNA, 1473 bp, Artificial Sequence; identical to SEQ ID NO: 797
  P7832 (OPLEXA::G1067)

SEQ ID NO: 4607 - DNA, 1820 bp, Artificial Sequence
  P8079 (OPLEXA::G2345)
ccgatttcccaatctctacctgattatctagggtttctgagatggccgaatcgcaaaccggtggtggtggtggtggaagccatgagagtggcggtgatcagagcccgaggtctttgaatgttcgtgagcaggacaggtttcttccgattgctaacataagccgtatcatgaagagaggtttacctctaaatggcaaaatcgctaaagatgctaaagagactatgcaggaatgtgtctctgaattcatcagcttcgtcaccagcgagtaatttctttctctactttctcaaaaatgttacctttttgttgctttggtggttatagcgtgtaaagccctcttctttgttaagttagattgatgttatattcattgggttgttaagcaaagtcactatgtcgattttggaatattgttttgccttttagggctagtgataagtgccaaagagagaaaaggaagaccatcaatggagatgatttgctttgggctatggccactttaggattcgaagattacatcgatcccctcaaggtttacctgatgcgatatagagaggtatgttccacttcagattagtcagtttacattctgctatacattcactgactctctgtttttccttctcatttccttgtctatgctatttggattggaattttgcagatggaggttcgtggttctcctctttcatttatctttctgatagtcgaattttgtacgtggatccttttatggggtatatggtgtatgattgtatctaattaggattgtctgctaccctttgctattgttatctgtctgatagggtgacactaaaggatcaggaaaaggcggggaatcgagtgcaaagagagatggtcaaccaagccaagtgtctcaggtaatgactcggtcttctccagttgatatggtcgtttacctaagcattagcttctccagctaatttattgtttccctgtctttactttctgaacagttctcgcaggttcctcaacaaggctcattctcacagggtccttatggaaactctcaagtaagtgttttccgacaaaagaaatgttgatacttataaatgaattcattctctacatagagcagagccggggtataaagagagaatattattaacaattaaaggatttaaggactttaatagactcgataaaaccgtcatatatgcattatccactttttgaaatctagacataggttctcatatgttccagtctctgaggttcggcaatagcatcgagcatcttgaagtgttaatggtatttgtaatctatcaatatgcagataattgattaaactcgtttgtgaatgtagggttcgaatatgatggttcaaatgccgggcacagagtagtactaggacactattcatcacaatcttccgagactcgactatgcctgttgtgtctgagaatctgagtgatccactttccatagatatggattgtggtatctcagtttttgggagagagaagatttgtatatgattgtgttgtagggagaagagtttggtttgcttatgataagaattgaaaagcaccttttttttcttttgactgttatgtttcttaggttttggtcttaagcagaagctatttatcaccacttcattggcctgttgattctttcatgcaagtgagcccgtaacttttataaaacaacatcatgatttataattatctctttgattttttggtcctaaattcgagtttcatttgacatcatccattgataaaaagaaacgaaacttgatattgaatcgttgtggtgtggtaaaattcacgatctaagtttgtgataacactccg

SEQ ID NO: 4608 - DNA, 1187 bp, Artificial Sequence
  P8223 (OPLEXA::G1816)
atttcatcacattaatttctctctatttttcttttcttacttcaatagtaatggataacactgaccgtcgtcgccgtcgtaagcaacacaaaatcgccctccatgactctgaaggtacctctctattctctatatattttctatttcctaaatccaattttattaaacatcttgaaaataaatttagttcctagctaggatcatattctctttgtatatattcgttaaaacgagggatacgtttaattacttctaaattagttacacctcgtgctgactaaaagacttatcaagattagtttctagttttaacaaaaattaatatctttttaaaaagtttatatttgtctttttttgttagtttaatattgttttgagtttaattggtttaatattgttatttgcagaagtgagcagtatcgaatgggagtttatcaacatgactgaacaagaagaagatctcatctttcgaatgtacagacttgtcggtgataggtaacaatttcttcttcttctactttttctaagattatcccagcataaaataaattttatattttagacatgtctagctaaaacaatttaatatgcaggtatatacaattttacatacgttaatttaagcatatgtactttataacatatgtacagtgtaccatgttgtaggggaagcacatggtgtccactaattttctaaaaaaagacatttaattaaagctatcacgttcattaaattatatatgtacacacatatatatagagataaaaataagaacctaatttactattcttatcagtacgtactcatgtatataaatgcttggctggctcaaaaatggaaatttttgaactgacaaattatattttattatgaaaatataaatgctaatgcttgggataaaaatgtttttttttttcttttgaattaggtgggatttgatagcaggaagagttcctggaagacaaccagaggagatagagagatattggataatgagaaacagtgaaggctttgctgataaacgacgccagcttcactcatcttcccacaaacataccaagcctcaccgtcctcgcttttctatctatccttcctagtgtttttgtttttaagccaacgaaaaaagaaaataaaaaaattataatagatgtatagtagtggttcttgttagtttgaagaattcatc

SEQ ID NO: 4609 - DNA, 713 bp, Artificial Sequence
  P8239 (OPLEXA::G1274)
tcttcacttctctagttcttggatgctttaaacctctctctctctctctctcaattatttttttttctatttcaaaaacaaaaaaaaatgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggcaagaaatctgtcaaaaacaacattaacaagaggaattactacaaatgctcaagtgaaggttgctcggtgaagaagagggtagagagagatggtgacgatgcagcttatgtaattacaacatatgaaggagtccataaccatgagagtctctctaatgtctattacaatgaaatggttttatcttatgatcatgataactggaaccaacactctcttcttcgatcttaatccaaatctctcatcctcgttgagattgtaagataccaaca

SEQ ID NO: 4610 - DNA, 1436 bp, Artificial Sequence
  P8242 (OPLEXA::G3086)
acgaaacttccggtgtggtactgcaaacggagaaaaaaataaccaaagaagagagaaactcaaaagctactaagatggaatcagaattccagcaacatcacttccttctccacgatcatcaacaccagagaccaagaaactcaggattgattcgttaccaatcagcaccaagttcgtacttttcgagtttcggtgaatcaatcgaagagtttttagatcgacccacaagtcctgaaactgagcgaatcttatctggctttttacaaaccaccgacacaagcgacaacgttgatagtttccttcaccatacttttaacagtgatggaactgagaagaaacctccggaagttaaaacagaggacgaagatgctgaaattccggtgactgcgacggcgacggcgatggaggttgttgtttccggtgatggtgaaatctcagtgaatcctgaagtatcgattgggtatgtggcttcggtttcgaggaataagagaccaagagagaaagatgatcggactccggtgaataatctagctcgtcataatagttcaccggccggattattttcatccattgatgttgaaacagcttatgcagctgtaatgaaaagtatgggaggttttggaggaagtaatgtgatgagtacaagcaatactgaagcttcgtctcttactcctagaagcaagttacttcctcctacttctagagcgatgagtccgatctctgaggttgatgttaaacccggtttctcgtctagattgcctcctcggacgctttccggtgggtttaatcgttcttttgggaatgaagggtctgcttcttccaagcttacagctcttgctaggacccaatctggaggtctagatcaatacaaaaccaaggatgaggattcagcaagtagacgtcctcctttggcacatcacatgagtttgcccaagtctttatcagatattgaacagttactgtcagattctatcccatgtaagatcagagccaagcggggttgtgcaactcatcctcgaagcatagccgagagggtgagaagaaccaagatcagtgaaagaatgaggaagctgcaagaccttgttccaaacatggacacgcaaacaaacacagcagacatgttggatcttgcggttcaatacatcaaggacctgcaagaacaagtgaaggcgctcgaagagagtcgggcaagatgtagatgctctagtgcgtgaaactagaagtgggagtatgcgcgagtgctagccagggagggagttgtgcatagaagtatcggttcggcctttggagaaaagtcgaagatagcaaagtagagaagagatcatgaacaaagctaaatttggtggtggtggtgaaaagggtttttgtaaagttggaacctttttttggtagggaagaaagtagcaaggttgtgtaatggtccgaactccaatgct

SEQ ID NO: 4611 - DNA, 1092 bp, Artificial Sequence
  P8576 (OPLEXA::G2423)
tgctgaacaatcttgttgtggtctcttctgtgtatatcaatggatgaaaaaggaagaagcttgaagaacaacaacatggaagacgagatggacctaaagagaggtccgtggactgctgaagaagattttaagctcatgaattacattgctactaatggagaaggtcgctggaactctctttctcgttgcgccggcctccaacgcaccggtaaaagctgtagactaaggtggttaaactatctccgccctgacgtccgccgtggaaacattacacttgaagaacaactcttgatcctcgaacttcattcccgttggggaaatagatggtcaaaaatcgcacaatatttaccgggaagaacggacaacgagatcaagaactactggaggacgcgggtgcaaaagcatgcgaaacagttgaaatgtgatgtgaatagccaacaattcaaagacacaatgaagtacttgtggatgcctcgactagtcgagaggattcagtcagcctcggcctcatccgcagcagcagccaccaccacaaccaccaccaccacaggatcagccggcacgtcatcttgcatcacaacctctaacaatcaattcatgaattacgactacaacaacaacaacatgggacaacagtttggtgtaatgagcaacaatgattatatcacgcctgaaaattccagcgtggcagtgtctccggcgtcagacttaacggagtactacagcgctccaaaccctaacccggaatactattcgggtcaaatggggaatagttattatccagatcagaatttagtgagttcacaattattaccggataattatttcgactatagtggattattagacgaagatctaacggctatgcaagagcagagtaacctcagctggtttgaaaacattaatggtgctgcttcttcttcagacagtttatggaacattggagaaactgatgaagaattctggttcttacagcagcaacaacagttcaacaataatggtagcttctgaagttagaaaaaaaaaatagaaatcgttttaagttaaattatacactatagtatacgtgtgaaaggaatttgttgtaaggga

SEQ ID NO: 4612 - DNA, 954 bp, Artificial Sequence
  P8587 (OPLEXA::G2999)
gcttagggttttggagagagattactaagaaagttttaatgtttgtttaagagaaaagttatatattagggttttctttattcagaagcttcaagatcagaaaagatggaagttagagagaagaaagatgagaaaatggagatgacaagaagaaaatcatcagctctagatcatcatcgtcttcctccgtacacttactcccaaaccgccaacaaagagaaacccaccaccaaaagaaacgggtcggacccggatccggatccggatcttgatactaacccaatttctatatctcatgctccaagatcatacgctaggcctcaaactacttctccggggaaggcaaggtatagagaatgccaaaagaatcacgcggcgagctccggtggacacgttgtcgacggttgcggcgagtttatgtcttccggggaagaaggcacggtggagtctcttctttgtgcagcttgtgattgccaccggagcttccatagaaaagagatcgatggtttgtttgttgtcaatttcaatagctttggccattcacagagaccactcggaagccgccacgtgtctccgataatgatgagttttggtggtggtggtggttgtgcggcggagtcatcgacggaggatctaaacaagtttcatcaatcttttagtggttatggagtggatcagtttcatcattatcaacccaagaaacggtttaggacaaagtttaatgaagaacagaaggagaagatgatggagtttgctgagaagattggttggagaatgacaaaactagaagatgatgaagtgaatcggttttgtcgtgagattaaagttaaaagacaagtgtttaaagtttggatgcacaacaataaacaagcagcaaagaagaaggatttgtaagagatttctatatatatatatatactatttttacttctctttgttcaacattgctttaac

SEQ ID NO: 4613 - DNA, 304 bp, Artificial Sequence
  P8664 (OPLEXA::G2718)
acggtgcgtcgtaaatctttgtgtactaaggtgtcttttgagatgaatacgcagcgtaagtcgaagcatcttaagaccaatccaaccattgttgcctcttcttctgaagaagtgagcagtcttgagtgggaagaaatagcaatggctcaggaagaagaggatttgatttgcaggatgtataagcttgtcggtgaaaggtgggatttaatagctgggaggattccaggaagaacagcagaagagattgagaggttttgggtgatgaagaatcatcgaagatctcaattacgttgatggccaactc

SEQ ID NO: 4614 - DNA, 4725 bp, Artificial Sequence
  P13371 (35S::G287)
tcgacctctcaagcggctgtgtttgtcgtgggtcggtttataatcattatctcccccggaaaacttctcggagaaggagaagaatggttattccggcgacttctaggtctttttttcttctcatttgcataaatatcaagcaagctgtctctatcatttgactattgattttcttacttagtttttaagtaatatcaaattaattgtttaatacagttatagtttctatataaaaatgggttcaactaaacattcttcttctaattacgtctgctaggtttgggtttcgtgctgaattcaacaccaaggagtttcaagcttcctgcatctctctcgctaagtaaaaaatctctcttttaagtttccgttgaattcatctttgttttaacctaaaaaaattctttatttctgggtttcttcgagcttcactgaaaactttactcctggatttggtgaatgcagtgaaatcgatgcggctattgggagaaatgaagttccagggaatattcaagagctcgctttaatcctcaataatgtttgtttatatttttttgtcttgtaaaagtttcgatttttcaaggtgcttttagtttaatcttagtgctcttgtttatgtgtgttacttggtgtaggtgtgccgacgtaaatgtgatgattatcaaaccagggcggtggtaatggcgctgatgatctcagtcaaggtaaaagagttagaattagcaactccagctcaagtcaatttcggcagaaatttgctgatttggatatgtaacactgaatttgtgtttctctcatagagtgcttgtcagcttggatggttcccggagagagagactcaagaattgttggctatcatagacttggtatgttttgttccagccgaatgtggtgattagagagtaatctgatttctgtgaataatgatgtttttattcttgttcagatgtggaatggtttcagctgtcctgaaaatgtcacctcttgtgtaaatagtcccgtcactctaatatcgcaggtcattgagaggtaggcttttcatgtgttttcattcatttatttcaaactagcaaggttaccagtctgctactctaaataatactagttaactaaaaatcaaaaccttggtttgtttcaatctcctacttttctatctgtaggttctatccatgtgtgaagctggggcatattcttgtttcttttgaagctaaggtgactttatatattattcagttcttagcacctttctttttaatgtgtgttttagtcagctttgtttccttctcgcagccagaatcaaagatgatgatgaaggacttccatatttcaaagaagatgccacattctcccaaacagaaagttgtatgtattggaatttaagttatgaatgtgtcttgataccagattttgcgttgtcaatttgaatttttttggtcgcttatatagtattgtgcatatgtggtttctcctgcatatatgttttaaatgcaattagattagaagatgcatgaatatactttcaaagctatacctttcagctttgctcgtcgtgtcacttcagcattttttcgtttcgaatctttgtttatgtacctgcttcttatgctcaatatagttacggaattttgtgctcttcagggattatttgttgttcggacagaggacataagcagatctaattgtattgtacatccacaaggagtcaggtgtggttggattgctttattttttccgccggatgtttgtgaagcagtttttgtatttagccatattgatttacatatgaaaattacagctttttgttgaatggaaagggcattgacaagagagttaacatctcaatggtttgtggatttcattgtttcttggatatgttttggaagtacttactacgtactctgatgcaagtaattgtttattgtaatttcttttcaggagtctgggccgcagcttccaactaatgttactgccctgctaaaccttggggcaaatcttctacaagcaataggctgttttggaggtttctgttcaatgaagatatctttagttcctctcctcatattcagtaataatggacagatacccatttgctataggtagttacttgattgctattgctttcatggatgtcataccactgcccaacaaaccgttactgaaagattatgttcatcctgaagtcgttggatcaaactcaggtatatccaagagtgtttagtgactaagagaagaaactatgacttagaagtttattgcatttccacatatgaagtcattagatcatttagtcgtatgtattcatataatcgtattccgagaactccagatcaaacattatttgtcttttccaatttgtctgtagattgtgacataattgaggggccatcgaggatatctctcagttgtcctatcaggtatctaaggatgtttttcctatgttgctttatatctcaagaaattgctttcacagttacctcaaccttttaagatttaatcatcacaattataacagccgaacgcgtatcaaacttcctgtgaagggtcatgtctgtaaacatcttcaggtgatgcattttctgttaagcataagtaaggataggatgtttcttgttttcattacttaaatcattatgaaaagaactattccattaatacatgaatttctaggctctggttttcttcgctgttgccataatatgtcttctcaaagtatgatttttgtaagttaatacgatataaatgtgtgacatgcttgattatgaagattgctagtaaaagagataagttttggcaaatttagaatctattgaaatatttccctcatctctgttttatatgtttctttctgctgtagtgttttgatttctggaattatgtcaacatgaacacaagacgaccatcatggcgctgcccgcattgtaatcagtctgtttgctatactgatatccgtgtagatcaaaaactgagaaaggcaagtagcttatttttgttgcttagtgaatacatctttttaagtcttagattgaataaacaatcttggctaatatccacagattctagaagaagtgggacgtaatgctgcagatgtggttatctctgctgatggaacctggatggttgagacggaaaatgatgaggacgtggaacttgtgccagaaaccactcatgaccatggagacccaaatagtttcatcaacttggggcctactgttaagaatcctgccagagatgagaatgaaatggaaacatccacccaagtcgaagaacataatccttgtttatctgagattcagggtccgtcaaatgacacacataggcctgcttcagattatactatgcttaaccagtctcatacttcaaccaacacactaccacagctgccacgaactttgaatgcctttgatggtcaacaattcgtgaacttaccacaagtaataaacacccgagattcaccagcaagccaagccttacctatgacattctcaccaaccccatctccacaagatatattagctactaatgcggcaaactttggcacatcaatgccggctgctcagtcttctcagtttcaaggctcacatgttacgtcccttggaaattgtgaaggaagaacttctgatttgatggcgagatggaaccacatctatggacgtgttcaaactcaatttccacctgcacctctttcgcatcatcattattcaatgcaggtttgtcaaccattaccatagagttgttttttgttcgtatgcgtaaatatctggtgaagctacattaccattaccaactctgaagttttttcttatatgtttgcagaatcagagcccgtcccctgcacagcaaagaccagtgccatcttacattgcacatcctcaaacttttcatgtcaactacggagagaacgctgaccaaagatggatgccgtcttccattgcacatcctcaaactttacctgttaactacggaggaaatactaaccaaagaccgataccatcttccattgcacatcctcaaactttacctgtcaactacagggggaatactgaccatagatcgacgccatattccattacacatctccaaacattacttaactacggagggaacgccgatcaaagaccaatgccatcttccattacaaatctccaaactttacctgccacgtacggagggtacgcccaccaaagaccaatgtcatcttccattacacatccccgaacttcacctgtcaactacggagggacccctgaccaaagaccaatgccatcttccattacacatccccaaactttacctgtcagctacggagggaccacagaccaaatactgaatcctggtggtgcaatgggacagttctcatcacgagagttcatgaatttgactcctgctaacactgagaattggcgcccacaaagccggatgcgaggcagcgtagcacctggtacgggatatgaccatatgatcattcatcctacccgtccagttcatccacaagctcaaacacctcctgcgcctctttcaacatcttatgatggagcagatgaaattcaagcatttatagggcacccaagctatcccgttagtaataacgaaacacaagcgggtaccagttcgttgccagtggcagagggtcttgggtattcagggtcgttttggtcaatgcctcctgagacatggtgatatctgatggcttagagattgtagcacacggtcactaacacaatcagtcgc

SEQ ID NO: 4615 - DNA, 3941 bp, Artificial Sequence
  P13372 (35S::G2515)
cttcgcgtaatttctcatcaaactccacttttcttctttttaagagaatctagggtttcttctactacttcttctttcttctttaggtggtcaaatttccaagttcttcttttagctctctcttttgtttccaagaaacctgagaagaatttttgtagatatgggaagaggaagggttcagctacggcggatcgagaataagataaggagacaagtgacattttcaaagcgaaggaccggtttggtaaagaaagctcaagagatctcagtgttatgtgatgctgaagttgctttgattgttttctcccccaaaggcaaactctttgagtactctgctggttccaggtttgaatctttcctaagctaattaatttaccaacttattttaagatcgcatatttatctacataaatattagcctatatttcatgtttgacatattgggaaaagtggtatatataggtttcacatagaggagattgatttgaaattggctgagattgtttaattaattaaatcagtttatagccaattttgtttagttcttccatctctaacttagagaagatcataaaaaatgaatgattgtacaatactatatattaaatcaaaagaagtgattaatagagatgatcgcatcaaaaaataattgtgagacataacagttccacagattatatattatccaaaaaatatgatggaagaatgtgctaattgggcaaacatgattacgaaataatatacgtattaatataatttgattcttgaggacatatgtatatatgttgaacatatcatgaataaagagagatctttcatttcattgttgtgtaagtttgttcttcaacgttctggagataattaaaacatgatctacataagtttaaagagatatttaatacaaagtgtacaaaaaaactttagaattaacacctgcaggcttaggatcaaacaagtagatctaatgctcaaagttagcttactttggcactcataggagacttcattttatttatttcaaggaaaaatataataaattcaaggaaaacgaattttaaaaagggttcttgaatcaaaataattttaatgttcttcttttggaataaatctgctatttacattttacttaaaaataaaattgaatgttgactaaaataaaaataaaatgttgactataatacaaaataattttggtggttttaactaactgaacatattctggtaataacaaaacattatttatcagagaatttaatataaaagaaatgaactgtaaataatagcaatttaatttttgaaaaataaatccaattttaagatgacgatttttttttttttagtaattgtcaaaacagaacagtaaaatactaggagacataatttgtgatgacaccgtctaaattatctccaaggttcatgtaatatctaatgcggtatcattggatcaaaatgaacgacacaccaaaagaaaaacaattatctcaatatacacaaacatactaaagagggacaagaaatctactataaatagaagagtcagctttcgatcatgattgtagtaactaataatagtaaacatgaaactttgatttgattatgttaaaataaaaatttaagatatacagctaaaatcttgttggaaattggaagcatgacaagcctttgtatagagctttgtgcattgctttgtcttttggttggcggaacctaggactaacctcgatcgtcacatgaaaatatacaaacccatgaagctacttttctagcttgtaggcttaactagaatgttcaaaaatgaatttgcttgcaaacatattttaacaaaatttgagtagacttggtgtatcgattgctatagtctaatcaatacattcaattaatgtatcaaattgtttgcaaatgtagattaaagttctcgatatagagcttaaattaatttagaaatgtttcaactaaagtacaaaaatgattattcaatatcttcaatgtatttgttgagtgatgatagtatatacatcgagtgttgattgttgtttgatatactatttttttagcatggagagaattcttgatcgatatgagaggtctgcctacgccggtcaagatattcctacaccaaatttggattcacaggttcttaagcacatttaagacatatgagtatatatatatgaatcattgtttatggtatgtttatggtaaacttaactatcgtgtatcgatctttttatcatttgtagggagagtgctcaacagaatgttcaaagctcttgaggatgattgatgtcctgcaaagaagcctgaggtaaggacttattacttacgtatcatccaaacataaaatacatacctaagatatctaaatatgtacaagataagaaattgcatctttatcaaattataaggcacttaagaggagaagaggtggatggtctaagtatcagagaccttcaaggtgtggagatgcaacttgatactgccctcaagaaaactcgctctagaaaggttatttatatgtatacaaaaacattgtagtatattttctatacatgcatggatcatttgtatatacaaatgtgtatatctaataatgtgcagtttgtgtatgcataaatatacacagatatatagataaactacacctaatcatgtagtaattattgttttggtttgggagcacagaaccagctcatggtagagtccatagcacagcttcagaaaaaggtaatacactaattaagagactatcgttgttatggttgtgcctaggcctggacgtttgagtttacgggtccggttttagtttggttctattttttggtttttgagtttaggatccattcaagtaattgttttggatattgtttccacctaacttttggtatttcgagtatttttggttattcggtctaaaaataactaattattttaggtgtataaaatgtatttcgattcgctgaatatttcagtctggttcccgttctttcagttatgaagttataatccattcggatatttacgaattttggttcgtttttctattaagttcctctcggtttggttagagtttggttattttgcctaggactacttttgccatgcaaactcatgtatctgcctgtcttttttttcttttcgggtttgtacaaaacattatacttatagtagatcttcacaattagtagtctttgattttgagaaataaacacaaatacatatactagatcttgaatacttgactcgatatgagttaaactaataaatatgtgtcttttcttttgatggcataggagaaggaactaaaagaactgaagaaacagctaacaaagaaggtgaaagtgatgttagaatctttgactatatatataaccagtttcttataaaatgtagaattcacttaacttttaagagagattagtctaggcgctagtttgaactctctcaatcaagtgtcgattttaaatttatatttgaatgttaagcaatcggtgactggtaaatagtaactataacaagtattgaatttggcaggctggtgaaagggaagactttcaaacgcaaaacctcagccatgacttagcctccttggcaacaccgccatttgaatcaccccatgagcttcgccggacaatatctcctcctcctcctcctttatcttcggggtactttaaagtttgatttcacatagctacaaagatagtaaaaatataaatgataatttgttagtgttgatcaatgatagtaaggtaacatattatagtttgtatcaatatttatttatcgtgtatatgagatgaattaataaactgcttatagggatacatcacaaagggatggagttggagaagtagctgccggaaccctaattcgaaggacgaatgcaacgttgcctcattggatgccccagctcaccggagaatagaggtccgaaacaatcttgg

SEQ ID NO: 4616 - DNA, 1482 bp, Artificial Sequence
  P13386 (35S::G1554)
ggcaccacaaattcttcttgattccttgatcatctatattatatttatataatcaataaatattcttcctatacagcgagagagagagagtatataagctataaatatggcgtcctcatcagaactaagcttggattgcaagccacaaagctactctatgcttttgaaatcctttggagataactttcagagcgatccaaccacacataagcttgaagatcttctctctcgcctagaacaagaacgtctcaagatcgatgccttcaaacgcgagcttcccctttgcatgcaactccttaacaatgctgtggaagtttacaaacaacaactagaagcatatagagcaaatagtaataacaataaccaaagtgttggtacaagaccagttctcgaagagttcatacccttaaggaaccaacccgaaaagacaaacaacaaaggaagtaattggatgacgactgctcagctatggagccaatccgaaaccaaaccaaaaaacattgattcaactactgatcaatctcttcccaaagacgagattaatagtagtccgaaactcggacattttgatgcaaaacaaagaaatggcagcggtgcttttcttcccttctctaaggaacaatctttgcctgaattagctctatccacggaggtcaagagggtctctccgaccaacgaacatactaatggccaagacggtaatgatgagagcatgatcaacaatgataataactataataataataataataacaattcgaacagcaatggagtttcttctacaacgagtcaaagtaatagaaaggcacgacgttgctggtcgccggacttgcaccggagatttgtccaagctcttcaaatgcttggtggctcgcaagtggctacacctaaacaaataagggaactcatgaaagttgatggtttgaccaatgatgaagtcaaaagccatctccagaagtatcggcttcacactagaagaccaagcccaagcccacaaacgtcaggtgggccaggtccacatttggtggtcctaggtggcatatgggttccaccggagtacacctccgcacatggtggcactccgactctctaccaccaccaagtccaccaccaccataccaacacggcagggccgcctccaccacacttttgctcctctcaagaattctacacaactccaccgcctcctcagccgctccaccaccaccactttcaaacgtttaacggttcatccggtggcaccgcctctaccgattctactcatcatcaggtgacggacagtcccacagttgaagggaagtcaccggagagtggtggtggagagagaaaagggttggctgctcttagggaagaatgtgaagatcacagcaatattaatggaagtgaaataactctcaaattctaaaaaaaataaagattcttgattaattaattagagtaatgagattttagggttagggtttgtgggtgcctacgtaactt

SEQ ID NO: 4617 - DNA, 2859 bp, Artificial Sequence
  P13387 (35S::G611)
tcgaccttctctcctccaacatttcagatttcgcgacccggatcttaacccggacccgcatttgtttcggttccgatctggtttcttgacaatggcgtcagaagcttcgccttcttcttcggccaccagatcggagccacccaaagactctccggcggaggagagaggtccagcttctaaggaagtatcagaagtaatagaatcgctaaagaagaagcttgcagctgataggtgtatatcaataaagaaaaggattgatgaaaacaagaagaatttgtttgctattactcaaagttttatgaggtcttctatggaacgaggaggtagctgtaaagatggcagtgatcttttagttaagaggcaaagagattcgccaggtatgaaaagcggaatcgatgaaagtaataacaacagatatgtagaagatggacctgccagttcaggaatggttcaaggatctagtgtccctgtcaaaatttccttacgtcctatcaaaatgcctgatatcaaacgtttgtcaccttataccacatgggtttttctggacagaaatcaaagaatgactgaagaccagtctgtagtgggtcgaaggagaatttattatgatcaaactggcggggaagcgcttatctgcagtgatagtgaagaggaggccattgacgacgaagaagaaaaaagagattttttggagcctgaagattatattattcgcatgacccttgagcaactaggtctttcagactcagtcctggcggaactagcaagtttcttgtctagaagtactagtgaaatcaaggcaagacatggagtgcttatgaaggaaaaagaagtatccgagagtggcgataatcaagcagagagctcccttctcaacaaagatatggaaggagcattagattctttcgataacctgttctgccgtagatgccttgtatttgattgccggcttcatgggtgttcacaggatctcatttttccggctgagaaaccagctccatggtgtcctcctgtagatgaaaatttaacctgtggtgcaaactgctataaaacgcttctcaagtctggaagatttccgggatatggcaccattgaaggtaaaactggcacttcatcagatggtgcaggtactaaaaccacacccacgaagttctccagcaaacttaatgtgagaaaaccaaagaccttcccaagtgaaagtgcatcgtctaatgaaaagtgcgcactagaaacaagtgactcagagaatggactacagcaggataccaattccgataaagtttcatcatcgccaaaggtgaaaggtagtgggagacgagtaggtcgtaagaggaacaaaaaccgagttgctgagcgagttcctcgtaagactcagaagaggcagaagaagacagaagcctcggatagtgattccatcgccagtggaagttgttcacccagcgatgcaaaacataaagataatgaagatgctacttcctcttctcagaagcatgtaaaatctgggaactccgggaagtcaaggaagaatggcactcctgccgaagtctccaataattctgtaaaggatgacgttcctgtttgccagtcaaatgaggttgcgtcagagcttgatgcgccgggtagtgatgaaagtctaaggaaagaagagtttatgggtgaaactgtatctcgaggaagattggctacaaataagttgtggagaccacttgagaaaagcctttttgataaaggtgttgagatttttggaatgaatagctgcttgattgctagaaatcttttgagtggtttcaaatcatgttgggaggtcttccaatacatgacgtgctcggaaaataaagcttccttctttggaggtgatggattgaatcctgatggctcttccaagttcgatatcaatggaaatatggttaataaccaagtgaggagaaggtcaagatttctacgtaggagaggcaaagtgcggcgcttgaagtatacctggaagtctgctgcatatcattcaattaggaaaagaattactgagaagaaagaccagccctgccgtcagtttaatccatgtaactgcaaaattgcttgtgggaaggaatgtccttgtttgctaaacgggacttgctgcgagaagtactgcggttgcccaaagagctgcaagaataggtttagaggttgtcattgtgccaaaagtcagtgtcgaagccgccagtgtccatgctttgctgcagatcgggaatgtgacccagatgtttgtagaaactgctgggtcattggtggggatggttcgcttggggtcccaagccaaagaggcgataattatgagtgcaggaatatgaaattgctcctgaaacaacaacaaagggttttacttggaatatctgatgtttctggttggggagctttcttaaagaacagtgtaagtaagcatgaataccttggggaatacacaggagagctgatctcacataaagaggcagataaacgcgggaagatatacgatcgcgagaactgctcttttctcttcaatctaaacgatcagtttgtgctagatgcttacaggaaaggagataaactgaaattcgccaaccattctcctgaacctaactgttacgcaaaggtcatcatggttgctggagatcacagggtggggatcttcgcaaaagagaggatactggctggagaagaactattttacgattaccggtatgagccagatcgagctccagcttgggccaaaaaacctgaagctcctggttctaagaaagacgaaaatgttacaccttctgttggtagacccaagaagcttgcttagcaacaaaagaaacaaccatttttttgtcaattctttggttacaggtggaagaacgctgc

SEQ ID NO: 4618 - DNA, 771 bp, Artificial Sequence
  P13388 (35S::G2319)
tcgactctctctctgcattctctcttacacctgtctttatctgaaaaataaccgatgagctcgtcgccgtcaagaaatccaacgaacgccgaagcacctccgccaccaccaacatcgacggatgctgtggcagagggttcgtctaagaaagtgaggaaaccatataccatcaccaagtcaagagagagctggacagaggaagagcacgataagtttcttgaagcacttcaactgtaataatttatctctgtttctctgtttttagagacttcaaatttcttagtttgctgctgatttctgagtttagttagttatagactgaacaaacagaggaaagtttatgttacttagcttaggtctagtagtaacttagctataaaaaatctgcttagctaaaaagatctgcttcttggagcacttcaactgtaataaatttatagttgtgttgactttttgaaagtgttattgatgtaactaggacctgattctgctgatactactactcctctatgttccttaggtttgatcgtgactggaagaagattgaagattttgttggttcaaagactgtgattcagataaggagtcatgctcaaaaatactttctcaaggttcagaaaaacgggacattagctcatgtgccacctcctcgacctaagcgcaaagcagctcatccgtatcctcaaaaggcatcaaagaacgctcaaatgccacttcaagtttccacgtcttttactactacgcgaaatggcgacatgccgggatatgcgc

SEQ ID NO: 4619 - DNA, 1066 bp, Artificial Sequence
  P13392 (35S::G2913)
ctctactaaaagtctctctatagcgatgtcatcggacaacgaatcgacaccgtctcaagcgacggtagaaatgatggcgacttcgccggcgaagattaaagagtatccagaaccattggctttacatgaagttgtcgtcaaggattcttctgtcttctgggatactctcaggcggtttcactcaattatgtccactaagttcatgattcctgtgattggaggaaaagaactagatttgcatgttttgtatgtggaagtcacgaggaggggaggttacgaaaaggtagtcgtagagaaaaaatggagggaagttggaggagtgtttagattctctgcgacaacaacaagtgcttcgtttgtcttaaggaaacattatctcaatcttctcttccattacgaacaagttcatctcttcactgctcgtggtcctcttcttcatcccatagctacatttcatgcaaatccctcaacgagcaaagaaatggcgctcgtcgaatatactcctccgagtataagatatcataatactcatcctccttctcaaggttcgtcgagtttcacagccataggtacaatagaaggcaaattcgattgtggttatctggtaaaagttaagttgggctcagagattcttaacggcgttctttatcattcggcccagcccggcccatcatcatctccaaccgctgttctaaacaatgccgttgtaccttatgttgaaactgggaggagacggcgtcgtttaggtaaaagacgaagaagcagacgcagagaagatccgaattacccgaaaccgaaccggagcggttacaatttcttctttgctgagaaacattgcaagctcaaatcactttatcccaacaaggagagagagtttacgaaacttatcggagaatcgtggagcaatctctctaccgaagaacgaatggtttatcaagacattggattgaaggataaggaaaggtatcagagggagttgaatgagtacagagaaacgttgagacttagggatggtgacatgacaaacggcaaggctttttaggtgatttagttaaaacggcaagtc

SEQ ID NO: 4620 - DNA, 1861 bp, Artificial Sequence
  P13394 (35S::G1585)
ctatcaaccctaagtaatctctttagctctcgattatcatcattacaccatcatcatgtcctcctcaaacaaaaattggccaagcatgttcaaatccaaaccttgcaacaataatcatcatcatcaacatgaaatcgatactccatcttacatgcactactctaattgcaacctatcatcttccttttcctcaggtactcacaaaatttacattttcttctgttaaatttataaaaagtatattgttaattttacttgattatagaaacaagctatatgaacgatgttatgtatatatgttaagacatgcatgcatgatgatataaaccgctctatgaaacagatcggataccagatcctaaaccgagatggaatcctaaaccggagcagattaggatactcgaatcaatcttcaattccggtactattaacccacctagagaggagattcaaagaatccggatccggcttcaagaatatggtcaaatcggtgacgcaaacgtgttttactggtttcaaaaccggaaatctcgagcaaaacacaagcttcgtgttcatcacaaaagccctaaaatgtcaaagaaggacaagacggttattcctagtactgacgctgatcattgttttggttttgttaaccaagaaaccggattatatccggttcaaaacaatgagttggtggtaaccgaaccggccggttttctatttccggttcataatgatccgagcgctgctcaatcagcgtttggttttggcgattttgttgtaccggtggtaacggaagaagggatggcattctctaccgttaataacggcgttaatttggagactaacgaaaattttgataaaattccggcgatcaatttatacggcggagatggaaatggcggtggaaattgttttcctcctttgactgttccattaaccatcaatcaatctcaaggtaaattaatcatttcgaaatagtaatactgttcatatttttttcttttcgaaatagttttattacctcatttgctcaacatacatgaaaataaatattataattaatgcttaatttggtatatttcgtagatgtataattagtatactaaatttagtatatagcatatatatatcgaatctaatatcatatagttcttaccatatgcatgctggtgttatccaatgtcacatatacatagatatgtacgtacactcatttctcatatttcatatattagtgtgtatatatatatatatatatatgtatatgtatcttggtcataaaaaaaaaaaaggaatcttggtcatatatatatgaattataatacttagataggtcatagattatggtaaataaattattaaattattccatattttggaatgagtaacgcatgcatacgatattttgggaaaaagacgttttggtctttagatttgaccatttactgtgtatttttttgggtaaattagtattatttaattactttgactaacattaattaccaaaatgtgctctattgatcacaagaaaaacgagatgtaggattatccggtggtgaagacgtcggagataatgtttatccggtgagaatgacggtgtttattaacgagatgcctatcgaagtagtgtctggattattcaacgttaaggcagctttcggaaacgatgccgttttgatcaactcgtttggccagcctattcttacagatgaatttggtgttacttatcaacctctccaaaatggcgcaatctattatcttgtgagttttgtgtaatggtcttaaggtttttgtttttcttgtatgaattgctgaaagcttttgtgtttggttttgcagatttagaagatattgaaaagcaaatgttatggtg

SEQ ID NO: 4621 - DNA, 995 bp, Artificial Sequence
  P13422 (35S::G730)
attcaccaattctctcttcttatggagcttttcccttcacaacctgacttgtacttgaagatcagccgaagaagagaagaagaacaagaaaaagaaagtcaagaactacaagaacaagaagtcgaaaggagattagggtttcagagtaaagcctcagatttagacaacaagtcttcaaataatctcatccacactctccagttcacttcaaacaatgaagccaccaagattaatagtaatcaagaacacaaggaatctctcgatcaagacttgagatctatttttatgatgagaccaataagaggaatccctctttaccagaatcaagtccttgaccactactactactcatctacctctcccaatcctttcttcttcagtgaagtcaacggtcaacatgctagtcgtcgcttaatcacaaaccctaattgtagttttaatctccacaaccgtcatcggcgtcaagctcaaccgcagccgccaagattcaccgccaaaagaggagtaagggctccaaggatgcggtggacgacgaccctccacgcccattttgtacacgctgttcaattattgggtggtcatgaaagagcaaccccaaaatcagtacttgagctgatggatgtgcaagatctcacattggctcatgttaaatcccatctacagatgtatcgaaccatcaagtctactgaaaaacctacaacgtcatcagggcagtcagattgtgagaatggatcacaagtaaacagtgagagagaagcaagaaatctcacgggtctatggaataactcctcaagtgaagctcggttccagttgaaggcaaaggcatcatcaggtgtagacatttcatccaatgagaatgaatggaagaatcgaagatgtccaagcaacgaacggttgtcgtcagattcgtcaagccttacagggacaagaccagagactgaaactcccaatcttgatttcactttagctacaccaaacctctctccctaattttc

SEQ ID NO: 4622 - DNA, 1472 bp, Artificial Sequence
  P13423 (35S::G3076)
gcattgtgtatatatcgatagacgtaggtataaatattgttccaaaatgctaattttctttatagaatataaccactaatgagcaaaatgagaaacctagtagaagaaaagttcctagagttctatgagagttgggttattcaacttgagctatatcttcatcaacttttaattgctcataacaataacactatgagtgagaccgagcttcgacatttgatctcgaagctaactacacatcacaaagcttattatacagccaaatgggcagccataagagaagatgtcttagcttttttcggatcagtttggttaaacccgttagagaatgcttgctcttggttaaccggatggaaaccgtcgatggtgtttcggatggttgataggctgaggaagtcgagagtggtgcttgtggaggctcaggtgaagaaattggaggagctgagagttaagaccaagttcgatgagcaaaaaattgagagagagatggagcggtatcaggtgggtccaacatttagattcattagaattttaaaactatttttcaaacattgatttatttataaacggaatttttttaactgaataatggattgctattttcagtgattgctctattttctttgaaaattatgtttttttaaaaaaatctttaaagttatagcaattttgatgaattttctattgaatccttaacatttaaaccgaaaagcaaattatattgaaaatagtgtcaaatcaaaaatattctatatatttttttttgtttattcaaacaagggataccgaattttaatatatatatatatatacacaaaatatttttttgttagacctaattattactcatctgtgtggtgctagttggatacaattttaaattttatttgatataaaagacaacatatatgatcttgatattttacggaatggtggaatgattcaatatgtttttgtctattacattttcttcgaatcacgtttttattcatctatttttagttttttactgtttgcataatttgtgaaagaaaaaaaagtcgccatttccgtaaattttggacttaaatcaaatattttccgtttacctttatcagtaattactatacctatactgaaatgtaggaatacaaattttgtaaatcattttattttagttatttaacttgaaactgtctttaggtggctatggctgatcggaaaatggtagagctggcgaggcttggatgtcacgtcggaggagaatcggtgatggtggtggaggcagcggtgagaggattatcgatgggtcttgagaaaatggtgaaggctgcggattgtgtgcggctgaaaacgcttaaaggtatattagacattttaactccaccgcaatgcgttgagtttttggcagcggcggctacgtttcaggttcagttacgtcggtggggaaaccgaagacattatgtcactcactcctgacacaaacttaagag

SEQ ID NO: 4623 - DNA, 1459 bp, Artificial Sequence
  P13429 (35S::G2694)
ccctgttcctcttataacccctctcgtctcatgtctacctcctcctcttcttccgacaacggagccggtggaagcggcggcgttttcgaggccccatctccatcccgccctcgccgcggagccaacgatgtttggccggagccttttcttgaatctctcgccgttcaagttgccgttaacgcttccacatccgccggcctcctcgccgcagctccggctcttgccaacgtttttcgggtttgcaccacgtggcacgctgtctctcgctccgaccatctatggcaactactatctcgccaagtttgggcaagaacacatttgatgcacgacacgtggcgggacgagttcatctaccgtcatcggacggctagaaacttccggacgcgtactcacacctacttcactctccaatttgacccgtctgatgtggacgagcctgatagtctctcttgccgttgtctcaccctctcagacctctacttagccgcagggttcgccgacggaaccgtccggctttttcttttaaacaaccgactccacgtcaggaccttacggccacctctacgtgaccgctttggtagattctcacgagccgtctcaggcattgttatctccgactcaaggctcacgttcgctacgatggacggagacatccacgtggcggaaatagacggtgttggtcacacacgcacggcttacgcaggagatatagttaacgacggtgcgttggtagatttcactggctgtggacgttggtgggtcggtcttttcgcgggtgtgccaggtcgtgcctttcacatatgggactgtaacagcgaagagacaacattcgtcggtggtacactcaccgaccctgaagctgtcatgggatggcacacgttaacagagctaacaacgtcccttggccgtctcagaatctccggtaacgagacggcggtagcatgcacgagatggagaatcatggtgatcgatctaagaaaccaaggagtgatcatcggagaagacgaagagcaacgtagaggactaatagtgacaggcttcgatgccaacgacgaagcgtacgttagattggacagtagaggaaacgctagcgtgcgaagggtgaacacgcaacaaacggtgtgtgagttccgtgttagtggagcggcgcagagaagagtaatgggttgtgttaatagactgcacgcgctaatgtgcgcaggtggtataatgcgcgtgtgggaggtagagagaggagagtatctgtacagtattagggagagagtaggagaagttgacgccattgttgccgatgatagacatgtggcggttgcgtcagcttcatcaacggctcagagtattatacatctatgggatttcggtgcactgtagcgtaccagattaataatttttttttttttaacttgaagaaaaagaaactatttttctctgaaaaagcgaaaccctaaacctaggtgta

SEQ ID NO: 4624 - DNA, 1440 bp, Artificial Sequence
  P13433 (35S::G2850)
gcatcatcaactctcatacatatatggactctgctaatctccatcagcttcaagatcaattacagcttgtggggtcttcttcatcttcttcttccttagacaataactctgacccttcttgctatggagcttcatctgcccatcaatggagcccaggaggtatttctttgaatagtgtgagcttgagtcataattataacaatgagatgttaaacacaagagctcacaacaacaacaacaacaacaacacaagtgaatgtatgagtctctccagcatccacaatcactccttgatccaacaacaagactttcctttacaatggcctcatgaccaatcttcatatcaacatcatgaaggacttctcaagatcaaagaagagctttcctcatcaactatctcagaccatcaagaaggcatatccaagttcacagacatgttaaatagtccagtgataacaaactatttgaagatcaatgaacataaggactacactgagaagcttcttctcaagagtatgtcttctggattcccgatcaatggagactatggtagcagccttccctcttcttcttcttcctcttcaccttcgtctcagtcgcatagaggcaacttcagtcagatttacccaagcgtaaacatatcgagtttgagcgaatctcggaagatgagcatggacgacatgagtaacatctcaagaccatttgatataaacatgcaggtttttgatggaagattgtttgaaggaaatgtattagttcctccttttaacgctcaagagattagtagtcttgggatgagcagaggaagccttccttcttttggcctcccttttcatcatcatctgcagcaaacacttccccacctttcttcttcccctactcatcaaatggaaatgttcagcaatgaacctcaaacaagtgaagggaagaggcataacttcttgatggcaacaaaagcaggagaaaatgcttccaagaaaccgcgcgtggaatcacgctcctcttgcccacccttcaaggtgaggaaagaaaagttaggagacagaatagcagctctgcagcagttggtttcaccctttgggaagacagatacagcatctgtgttaatggaagcaattggatacatcaaattcctacagagccagatcgagactttaagcgtcccctacatgagagcatctaggaaccgacccggaaaagcctcccagctggtctcacaatcacaagaaggggatgaggaagagacgagagatcttagaagccgtgggctatgtctagtgccgttatcatgcatgacttatgttaccggagatggtggggatggaggaggcggtgttggtactggtttttggccaacgccacctggttttggtggcggaacttagccgtggacttaacaaaccgtaggactatgatgagtacatttatcggacttggagg

SEQ ID NO: 4625 - DNA, 1679 bp, Artificial Sequence
  P13435 (35S::G2)
tctctctctctctttagctctttttttttttttgttttcattaaagtttttattttattttctaccaaccaaaagcttttctctttggtttctcttatttagcttctaaccttgaggagaatataccagaggattgaagtttgaaccttcaaagatcaaaatcaagaaaccaaaaaaaaacaaaaaaaatgtgggatctaaacgacgcaccacaccaaacacaaagagaagaagaatctgaagagttttgttattcttcaccaagtaaacgggttggatctttctctaattcaagctcttcagctgttgttatcgaagatggatccgatgacgatgaacttaaccgggtcagacccaataacccacttgtcacccatcagttcttccctgagatggattctaacggcggtggtgttgcttctggctttcctcgggctcactggtttggtgttaagttttgtcagtcggatctagccaccggatcgtccgcgggtaaagctaccaacgttgccgctgccgtagtggagccggcacagccgttgaaaaagagtcggcgtggaccaagatcaagaagttctcagtatagaggtgttacgttttaccggcgtaccggaagatgggaatctcatatttgggactgtgggaaacaagtttacttaggtggatttgacactgctcatgcagcagctcgagcatatgatagagctgctattaaattccgtggagtagaagcggatatcaatttcaacatcgacgattatgatgatgacttgaaacagatgactaatttaaccaaggaagagttcgtacacgtacttcgccgacaaagcacaggcttccctcgaggaagttcgaagtatagaggtgtcactttgcataagtgtggtcgttgggaagctcgtatgggtcaattcttaggcaaaaagtatgtttatttgggtttgttcgacaccgaggtcgaagctgctagagcttacgataaagctgcaatcaaatgtaacggcaaagacgccgtgaccaactttgatccgagtatttacgatgaggaactcaatgccgagtcatcagggaatcctactactccacaagatcacaacctcgatctgagcttgggaaattcggctaattcgaagcataaaagtcaagatatgcggctcaggatgaaccaacaacaacaagattctctccactctaatgaagttcttggattaggtcaaaccggaatgcttaaccatactcccaattcaaaccaccaatttccgggcagcagcaacattggtagcggaggcggattctcactgtttccggcggctgagaaccaccggtttgatggtcgggcctcgacgaaccaagtgttgacaaatgctgcagcatcatcaggattctctcctcatcatcacaatcagatttttaattctacttctactcctcatcaaaattggctgcagacaaatggcttccaacctcctctcatgagaccttcttgaatcttttatatttttaaggtttattattatataagaaaaacaaaaatgaacctttgaaatccccacatgttcttggtcatttcattaatcatcggcttatattttgcttattttcccctaaatcctcttgttaacttaggcgaacaaaaaaaattaatggaaatctttttccctccatcggttacaaaaata

SEQ ID NO: 4626 - DNA, 1058 bp, Artificial Sequence; identical to SEQ ID NO: 115
  P13436 (35S::G155)

SEQ ID NO: 4627 - DNA, 1659 bp, Artificial Sequence
  P13437 (35S::G309)
accggtccggtaattcccgggatatcgtcgacccacgcgtccgccacgcgtccgtgcaaatcaattttaatgaagagagagcacaaccaccgtgaatcatccgccggagaaggtgggagttcatcaatgacgacggtgattaaagaagaagctgccggagttgacgagcttttggttgttttaggttacaaagttcgatcatccgacatggctgacgtggcacacaagcttgaacagttagagatggttcttggtgatggaatctcgaatctttctgatgaaactgttcattacaatccttctgatctctctggttgggtcgaaagcatgctctcggatcttgacccgacccggattcaagaaaagcctgactcagagtacgatcttagagctattcctggctctgcagtgtatccacgtgacgagcacgtgactcgtcggagcaagaggacgagaattgaatcggagttatcctctacgcgctctgtggtggttttggattctcaagaaactggagtgcgtttagtccacgcgctattagcttgtgctgaagctgttcaacagaacaatttgaagttagccgacgcgctcgtgaagcacgtggggttactcgcgtcctctcaagctggtgctatgaggaaagtcgcgacttacttcgctgaagggcttgcgagaaggatttaccgtatttaccctcgagacgatgtcgcgttgtcttcgttttcggacactcttcagattcatttctatgagtcttgtccgtatctcaagtttgcgcattttacggcgaatcaagcgatacttgaggtttttgctacggcggagaaggttcatgttattgatttaggacttaaccatggtttacaatggccggctttgattcaagctcttgctttacgtcctaatggtccaccggattttcggttaaccgggatcggttattcgttaaccgatattcaagaagttggttggaaacttggtcagcttgcgagtactattggtgtcaatttcgaattcaagagcattgctttaaacaatttgtctgatcttaaaccggaaatgctagacattagacccggtttagaatcagtggcggttaactcggtcttcgagcttcatcgcctcttagctcatcccggttccatcgataagtttttatcgacaatcaaatcaatccgaccggatataatgactgtggtcgagcaagaagcaaaccataacggtaccgtatttctcgatcggttcacggaatcgctacattactattcgagcttattcgactcgctcgagggcccgccaagccaagaccgagtgatgtcggagttattcctaggacggcagatactaaaccttgtggcatgcgaaggagaagaccgggtagagaggcatgagactttaaatcagtggagaaaccggttcggtttaggaggatttaaaccggttagtatcggttcgaacgcgtataagcaagcaagcatgttgttggcactttatgccggggctgatgggtataatgtggaagagaatgaaggttgtttgttgcttggatggcaaacgcgaccgcttattgcaacatctgcgtggcgaatcaatcgtgtggaataaaaataaataatgggaaaagtgaaaatgtgctatatactttattgcattgctgat

SEQ ID NO: 4628 - DNA, 1531 bp, Artificial Sequence
  P13443 (35S::G2071)
ttctctctctcgcagctcttctctattttcagcaatcgcctataatattaggtaaagctaaaagggtctgattcgtttgttttttcactgaagaatttggaaggaagtgattccgttgtgaaacagaaaagaagtatgggtactcacattgatatcaacaacttaggcggcgatacttctagagggaatgagtcaaagccattggcgaggcagtcttcgttatattccttaacgtttgatgagcttcagagcacattaggtgagccggggaaagattttgggtctatgaatatggatgagttactcaagaacatatggactgctgaggatactcaagcctttatgactactacatcttcggttgcagccccgggacctagtggttttgttccgggaggaaatggtttacagaggcaaggctccttgaccttgcctagaacgcttagtcagaagactgtcgatgaagtctggaaatacctgaattcgaaagaaggtagtaatgggaatactggaacggatgcgcttgagaggcaacagactttaggggaaatgactctggaagatttcttactccgtgctggcgttgttaaagaagataatactcagcagaacgaaaacagtagtagcgggttttatgctaacaacggtgctgctggtttggagtttggatttggtcagccgaatcaaaacagcatatcgttcaacgggaacaatagttctatgatcatgaatcaagcacctggtttaggcctcaaagttggtggaaccatgcagcagcagcagcagccacatcagcagcagttgcagcagccacatcagagactgcctccaactatctttccaaaacaagcgaatgtaacatttgcggcgcctgtaaatatggtcaacaggggtttatttgagactagcgcagatggtccagccaacagtaatatgggaggagcagggggtactgttacagctacttctcctgggacgagcagtgcagaaaacaatacttggtcatcaccagttccttacgtgtttggtcggggaagaagaagcaatacgggcctggagaaggttgttgagagaaggcaaaagagaatgatcaagaatcgggaatccgctgctagatcaagggctcgaaaacaggcttataccttggaattggaagctgagattgaaagtctcaagctagtgaatcaagatttgcagaagaaacaggctgaaataatgaaaacccataatagtgagctaaaggaattttcgaagcagcctccattgctggccaaaagacaatgcttgagaagaacccttaccggtccgtggtaagaaggtgaagtcaaagcaagaagaacctgctaatgtaatacaggaccactcaaaaggaagacactgggagagtaatatgtaatagaagatagtgctactgtacaggagaaattacagagacgcttacaatgtagaaatcttttgagctgaatttaactaagagtgcagtctgtgtagagtatgagagctttcaatatgaattcataattttcataaa

SEQ ID NO: 4629 - DNA, 1104 bp, Artificial Sequence
  misc_feature (1052)..(1052): n is a, c, g, or t
  P13446 (35S::G2319)
aaaaataaccgatgagctcgtcgccgtcaagaaatccaacgaacgccgaagcacctccgccaccaccaacatcgacggatgctgtggcagagggttcgtctaagaaagtgaggaaaccatataccatcaccaagtcaagagagagctggacagaggaagagcacgataagtttcttgaagcacttcaactgtttgatcgtgactggaagaagattgaagattttgttggttcaaagactgtgattcagataaggagtcatgctcaaaaatactttctcaaggttcagaaaaacgggacattagctcatgtgccacctcctcgacctaagcgcaaagcagctcatccgtatcctcaaaaggcatcaaagaacgctcaaatgccacttcaagtttccacgtcttttactactacgcgaaatggcgacatgccgggatatgcttcatgggatgatgcctcaatgctgctaaacagagttatttcaccacaacatgaacttgctactcttcgtggagcagaagctgatattggatcaaagggcttattaaatgttagtagcccttctacatctggcatgggaagctcaagccgaacagtatcaggttctgagattgtaagaaaggctaaacagcctccagtgcttcacggtgttcctgattttgctgaagtttataatttcattgggagtgtctttgatcctgaaacgagaggccatgtggaaaagctcaaggaaatggatcctataaatttcgaaactgttctgttattgatgagaaacctcacatttaacttatcaaaccctgatttagaatccacttcggattgtaatgatgctgcagaggaaagtcctcttatcatatgacaacgtgacgaccgagctcccaagcgttgtttcccttgtcaagaactcaacaagcgacaaatcagcataacaaaaatatgagccatcagctagcaagtttactcattgggttcccatggttaataaactttgggggtatacgtcactggaatcacaatcgtgtcactgcatcatcatgtggggaattgtgtnaaaagtctttgttggtttgaggagaaacattagccaagtttgaaactttagg

SEQ ID NO: 4630 - DNA, 2343 bp, Artificial Sequence
  P13690 (35S::G1798)
atatcgcaggaacaatggtgagagggaagatcgagatcaagaagattgagaacgtgacgagcagacaagtcacgttctcgaagcgaagaagcggtctatttaagaaggctcatgagctttcggttctatgcgatgctcaagtagccgccattgtcttttctcagagcggaagattacacgaatactctagctcccagtaagatattctttcatcaaattatttcaaaatatttacacatgtctatttccaaaatctttctctagctacacatagatttgttgagtatctagaacttctgtagtgaatagtataatatatctctggttaaatcgtactagagattttgcaataatataggcgctaaagatttggccccctttcttttggtgctagctagttcctgactttgcccaacaatgccttgtcacattctaattttagaatttaagttttgtaagtacttagcttctggattttatttaagcaaacttaagaatttttactacttaagagagtttcttcaagcacgagcaagtggattgtattagggttttcagaaaaaaagtttcttgaacagtgaacctcgtattccttggaacttaaactgttacccacacacccacttggcatctggttttattagaatatccagcataaatgaatatccgaaaatgtagttacattaagtacagaaattgtaaatataatgcatgatgagaagatttaaaaaatatctcgggcatccaaactttttcactagatttacaatcatgaggtcggtacattgttcattttataaatcccttttgttttgtggttaatagaattggtttaaagattagtactatacaatctttacagagtataatttattttgtataacttccctttgtttcatttttcatttcatgtttaacaatctttgtgcagcaaaaaccttccttcactaggtttggtgattgcaaaaattaaaagtattcgattgtatgagtgttatctaaattatagacatctacattaatcaaaatattggtggacaaatctatcatagaagctaagtcggtataaaagataacatgtagatatatatatattaagaatattcgtccataatatttcaatcttatgatccgtcatcatcattcatcactgacaaatatcttcttgtgaattaacttttcaggatggagaagattatagatagatatggcaagtttagtaatgccttctatgtggcagagaggcctcaagtagaacgatacttgcaggttcattctctatattcatatatattctttatgttagtttcttcatttatttaaaaaaaaaatgtacagtatgtattaattcagatggtaatcgactatttttggggttgtattattgtgtaggagctgaagatggaaattgatagaatggtgaaaaagattgatctccttgaagttcatcaccggttcgcatcttactattcttacggttaattactctgtgcattgtatatttgtatataactaaactttgtttcagtcctaaaatatactgaaatttattatctcttgattcttgaatgccactatatatgaagtaagctgttggggcaaggtttggattcgtgttcagtgacagaacttcaagagattgacactcaaattgagaaaagccttcgtattgtcaggtcaagaaaggtacaaacactcggacacaaatatatatataacatatacacacatgttaatgatgtaattatgtcttcgttggttgatcttggtgcgtaggctgagttatatgcagatcaactgaaaaagctaaaagaaaaggtaaatttttttaaatgagtaacttatatacaagttttaatttgtgggatcggttgtattttctccatgtgattttatttttaatcgatctttcttgctcggattctaggagagggagctcttgaacgagagaaaaaggctgcttgaagaggtaaatatgcaccactcatcaaaggttacatataaaaatacacatgaaatttagttatgtctcttcgtttaggtagaggcttagattcatcgcacttaaaacttctttcttataagaataatcatagttcatagaggccttgattgtttgtttgtgtttgcatttacgttttacatgacattttcagcaaaatagagaaaggttgatgcgaccggtggtgccagcaactttacaaatatgtgataagggtaatactgaaggtggtcacagaaccaaacattcatcagaggttgaaaccgacctatttatcggattgcccgtgactcggctataacatattactttggttccatgtttgtacactataatgcttc

SEQ ID NO: 4631 - DNA, 1722 bp, Artificial Sequence
  P13693 (35S::G2035)
gatagagctagagagtactgggtctgtgtaaagttgataactttttttggtttagagagagaaaggacagagctttacagagatggagatgaagcagatgaagtttcttactcaccaagctttcttttcctctgttcgatcaggagatcttagtcaacttcaacagttagttgacaatttaaccggagatgagctaatcgatgagtcatcgccgtgttctgctgtggctgagcttatgtctgtgcaaaacgacgccggagagaccgccgtctatatctccgccgcagagaatcttgaagacatttttcgttacttgattaggttttctagtttggaaacagttaagatcagatccaaatccgacatgaacgcttttcatgtcgctgccaagcgaggtcacttgggaattgtgaaggagttactgagactatggccagagctttgcagaatctgcgacgcttccaacacgagtccgctttacgcagctgcggttcaagatcacttagaaatagtaaatgcaatgcttgatgttgatcctagctgtgcaatgattgtgagaaagaacgggaaaacatctttgcacactgcgggaaggtacgggcttcttcggatagtgaaagctctcatagagaaagacgcagcgattgttggtgttaaagataagaaaggtcagactgctcttcacatggctgttaaaggacgaagtttggaagtagtcgaagagattttgcaggctgattacacaatattgaatgagagagatcgaaaagggaacactgctttgcatattgctactcgaaaggcgcggccacagataacgagcttattgctgacctttacggcgattgaagtgaatgcgattaacaaccagaaagaaactgctatggatttggcggataagctgcaatatagcgaatctgctttggagatcaatgaggctttggtagaagctggggctaagcatgggaggttcattggtcgagaagatgaggcgagagcattgaagcgagcagtgagtgatatcaaacacgaggtgcaatcgcagcttttgcagaatgagaaaaccaaccgtcgtgtctctgggatcgcgaaagagctgaggaaactccacagagaagcggttcagaacacgactaactccataacggtagtggcggttctgtttgcttccatagcgttcttggccatattcaacttgccgggtcagtatttcacggaggggtcgcatgtgggacaagccaatattgcagggagaaccggattccgcgtgttctgtcttttaaacgcgacatctctgtttatatcgttagcggttgtggtagttcaaataactttggtggcgtgggacacacgggcgcagaagaaagttgtgtctgtagtgaataagctaatgtgggcagcttgtgcttgcacattcggagcatttttggcgattgcatttgcggttgttggaaaggggaactcgtggatggcgattaccataacgttgcttggagcaccgatcttggtagggacattggcaagtatgtgttatttcgtgtttcggcagcggtttaggagcggcaacgattcacagagaaggattaggagagggagtagtaagtcgttttcatggtcttactctcatcatgtatccgattttgaagatgaatcagatttcgagaagattattgctctttgaattaagtttcttaagcgtctttgtatagatcgtctcttctc

SEQ ID NO: 4632 - DNA, 3238 bp, Artificial Sequence
  P13700 (35S::G2492)
gctgcaagagtttcgccgaggacgattgagaattttgattttcgaaaaatggattctgtggaggaagaaggtgttgttagggttgaagaagagaacggacgcggtggtctccgtaggcatcggagggtttctacgaagctggcgaattacgtagatcctccgactgacgacgaagaagatggaggacccaagcgaaagggcaaaaggggtggaaatagggctccgaaaaagacaccgaagaaagacgaggagatgcaaaagaacgaaattgatgaagcaaaccgagtcactggtctggtgaaggaaaaaagagccgcgactaagattctgaatcgcaaagactccattattgaagtaggagaagcttctggaagcatgcccaaggaagtaaagggaattaggattgggaaaaggaagggagaaatcgatggtgagattccaactaagccgggcaagaagccaaagactacagtagacccgagaatcattggttacagaccggacaatatgtgccatcaatgtcaaaagagcgataggattgttgaacggtgtcagacctgcaatagtaagcgttattgtcatccatgcttggacacttggtacccccttatagcaaaagaagatgttgccaagaaatgcatgttctgctctagtacttgcaattgcagagcatgcttgcgtctagatactaaattgaaagggataaattcgaacctcatagtcagcgaggaagaaaaggtccaagcctctaagtttattctgcagagccttctcccacatctgaaaggaataaatgatgaacaagttgctgagaaggaagttgaggccaaaatatacggactgaagtttgaagaggtgaggccccaagacgctaaagctttccctgatgaaagactatactgtgatatctgcaagacttctatctatgatctccataggaattgcaagtcctgtagttttgatatctgccttagctgttgccttgagatccgcaatggaaaggctctggcatgtaaggaggatgtgtcttggaattatattaaccgaggtttagagtatgaacatggacaagaaggaaaagtgattgaaaagccggcgaataagctagatgataagttgaaagataagctggatggtaagccggatgataagccgaagggtaagccaaagggtaggccaaagggtaagccggatgataagccgaagggtaaactgaagggtaagcaggatgataaaccggatgataagccagatgagaagccggttaatacagaccatatgaagtacccttctctgtggaaagcaaatgaagctgggatcattacttgttgttgtggtgctggggagttagtgctgaaacgactacttccggatggttggatatctgagttggtcaacagagttgaaaaaactgctgaagctggcgagcttttgaatttacctgaaacggttttggagcgatgcccttgttctaactctgacagacatattgacatagacagctgtaatttgttaaaagctgcttgtcgagaaggttcagaagacaattatctttactctccaagtgtatgggatgttcaacaagatgatttgaagcattttcagcaccattgggtaaaaggcgagcctgtgattgtgagaaatgtgcttgaagctacatctggtttaagctgggaaccaatggtaatgcatcgtgcctgccgccagataagccatgtccagcatggatcacttaaggatgttgttgctgttgattgtttggacttctgtgaggtaaaagttaatcttcatgaattttttactggatacacggatggccgatatgatcgaatgggttggccactagttctgaaactgaaagattggcctccagctaaagtcttcaaagataacttgccacgtcatgctgaggagttcttatgtagtttgcctttgaagcattacactcatccggttaatggacctttgaatctcgctgtcaagcttccccaaaattgcttgaagccagacatgggaccaaagacgtacgttgcttctggatttgctcaagaattaggccgtggagattctgttactaagctccactgcgacatgtctgatgcggtgaatattttgacgcacatatctgaagtgcccaatatgcaacctggaattggaaatctgaaaaagaagcatgccgaacaagatctcaaggagctgtatagctcagtagctaacaaggaggaaatgatggagattcttgaaaattccagacaacaagtccaaaatgttgaaactgatgatggagctctttgggacattttccgtagagaagatattcctaaattagaaagttacattgagaaacatcacaaggagttcagacatctctactgctgtcctgtgtctcaggttgttcatcctatacatgaccagaacttctatctgacgcggtatcatataatgaagctgaaagaagaatatggcattgaaccttggaccttcaatcggaagcttggtgatgctgttttgatacctgtaggttgccctcatcaagttagaaatttgaagtcctgcaataaggtagcgcttgacttcgtctcacctgaaaatgtcagcgagtgtttacgcttgacaaaacagtatcgtctacttccaccaaatcattttgcaaaagaagacaagttaggggttaagaagatgatagtccatgcagttgataaagctctcagagacttaagtggagagaagtctccagaacctgaagagaagaaacaaaatatgagagggccgaagaagggggcagccaaggcagttgccaaggctctcaaagacttatctccaagtgaaaagaagtcttcggaagcagctgaagaggagatatcaaatgggatagtcaatgcaatcgataagggtctcaaagacttacctccaagtgaagagaagtcttccgaagccaaagtggagatatcaaatgggatagtcagtgcaatggataaggatctcgaacacatatcttcaagcgaaaagaagtctacggaagaggaaggggtgaaaagaccaaatattgtgaggacatatgagcggagaaaaaagctgggaagtgaagtaaccaacgcatacattgacagattagaaatggagaagatgtagtagtagtagtagttttcaattaacatcatcttttgttatagctttagcaaactcttttgctactttcatatctctaagttaaacagagtagtactaagggatagac

SEQ ID NO: 4633 - DNA, 1206 bp, Artificial Sequence
  P13710 (35S::G2539)
cagccatcgactaagatttgaaatctttaacgtgaaccagctccgatggcgattccacaaagaaacaagcgcaaagcaagatcctcgccggaacggctaacacaaccgccggaactaccacacaactccgacgttccttcttcttcgtcttcttctgccgctgataatttcttttcttggtcgacgaaacagtttgctttcccgccaggttatagatttgtaccaaaggaccaagaactcatctttcattacttgaaacccttttcgcaaggcaataaatgctcattgctcaatgttcctatccatcgtgtgaacatctacgagtcaaatccacaacatctttcaggtttgtctccgtcaatggctctgttctttattctctaatcgtggtttatgtatataaatggctctgttcttttgaattcaatacagagaaatatgagaagggtaatgataaagattggttctatatatcggagaggaccaagaccggtaaggctggaagaagtaataaacgtgtcgacaatggaggatattggagcgcaactgtagctgcccaaaagatcaacgctggaaatggcatagtcggctacaagacttcactagagtactatgttgggaaacaatcaaatagtgtcaaaggggattggttaatgcaagagtactggtttgagtcttctgatgataacaacaacgagaaggtgagggtaagtgtctttacttggattccaagttattaggattcgtgacttttggatttattgtgttttgttttggttggtgtgtataggtggatcatgctttgtgcaagatttatctgactccagcggcagcaaagaagaagaaagctgaggaagcagagaatgagaagctgaagaaagaagaagacgttgagcagctggatttgaatcaaccagaccaattgcagctgcaacagcctcatgatattgtgtatcaaccgcagtattgtttacttccagaacatcatcagccgcagccttttcctgataacttttctgagttgatcagctttcaacagcaaccagtgatgatcccagacgattttgaagatttcttggctgaattcactaaaccacattcactggatggagatgaagaattcaacaattatggtttgtttgaaggcttctttgacacagaaggaatgataaaacattaaactaactgatctcaatctgctcatac

SEQ ID NO: 4634 - DNA, 1447 bp, Artificial Sequence
  P13712 (35S::G2757)
cccttacccaccgctctttctactttcactaatttattcttcgccgccgcaatgacaatacccgatgatggatctcccgtcgccatggccatcgattcttccaccgccgtaaccgtcgccaccaccaccactcgaagagttcctcctccgtgctggaccgacgaggaaaccgctgcgcttgtcaatgcctacaaggataaatggttcgccctccgccgcgggaacctccgtgcggctgattgggatgacgtcgccgcggctgtttcgtcctcgtccaccgttggaggtccgccgaaatcagcaatccaatgtcgacacaagatcgagaagcttcggaaacgttatcgcggcgaaaaacaacgagctcttaatcgaccaggcaagttctcttcctcttgggatttgttccctatcttggatgctatgggattcgctccggtgactccggcagccgtagaaacttacgatcccgatgtggatcatgatgatgagagtaacggtttggatggatttagggttagatcgaagaggtctgggaagtttagcggtggttactctgattcacctcgagaagtaggagatggatatggggttagatctagggcaaggagtaacatgaaaatgtatggtggtttcaagtctgagtttgattcagatcacgattcaggaagtggatttggattgaaaaggaaatacaatgggaatccaaaggttagtgctgatttcgatgctgattctgatgatgagattgtgttagtccccaaggcaactaggcttaggactcatggcaagccttcctctggtgattttagccatggcagtggtggtgggtttccgttgaagtcgtttggtgatcggaattttgcttctcatgggtttaaacctaagaatttcagtaagcctgaacccaatttctctcaggatctggattatgatgatgagtttgatgatgatagagcagagagggaaggattcaacccgaggattcaaagttctaggagctcttcgcgggtgaatggctacagcaggaaggatgggagctatcctcgaaacactggtgcttccaatggctatggatcgtcttctaggttcaagcatgagcaaatgaatgcagcagcagaagttgagtctgacccgatcgatgaagttgtttcttctgttaagatgttgacagaaatgtttgtgagggtggagaattcgaagatggagatgatgagagagatggagaagtcgagaatggagatggagctgaagcattgccagatgatgcttgagtcacagcagcagatcataggcgcgtttgctgaagcgttgagcgagaaaaagagcacaaatgcaaggaggccggtttcgtagtagcaaagtcgcttattaaagaggaatgaaacggttcataatatggattttcatatggtataatgatcaaatagctttcgagtgtagtacg

SEQ ID NO: 4635 - DNA, 1130 bp, Artificial Sequence
  P13733 (35S::G2106)
cctcttcttttatgttcatcgccgtcgaagtttctccggtaatggaagacatcacacggcagagcaaaaaaacttcggttgagaatgaaaccggcgatgatcagtcagcaacatcagtagtccttaaagctaaacgcaaacgccgatcgcaaccacgagacgctccaccccaacgtagctccgtccatagaggcgtcacaaggcatcgatggactggaaggtacgaagcacatttgtgggataagaatagttggaacgaaactcagaccaagaaaggaagacaagtatatttaggggcatatgacgaggaagatgcagcagcacgtgcctacgacttagcagcattgaaatattggggacgagacaccatcttgaacttccctgtaaattttctcggaatcctattgtgtaattatgaagaagacatcaaagaaatggaaagccagtcaaaggaagagtatattggatctttgagaagaaaaagtagtgggttttcacgaggtgtatcaaaatacagaggcgttgcaaagcatcaccacaatgggagatgggaagctcgaatcggaagagtgtttggcaataaatatttataccttggaacttacgcgacgcaagaagaagcagctatagcgtacgatatcgcagctatcgagtaccgtggactcaacgccgttactaacttcgacatcagccgttatctgaaactcccggtgccggagaaccctatcgataccgcgaataatctcctcgagagtccgcattctgatcttagcccatttataaaacctaaccacgagtctgacttatcacagagtcaatcttcgtcagaggacaacgatgatcggaaaacaaagctcttgaagtcgtcacctttagtggcagaggaggtaatcggaccatcgacgccacctgagattgctccgcctcgtcggagcttcccggaagatatccagacgtatttcgggtgtcaaaactccggcaagttaacggcggaggaagatgatgttatcttcggtgatttagattctttccttacgcctgatttctacagcgagttaaatgattgctaaagtgttgttcttctgataagttttgttttttagttgttcagaatctcggttgtgaagggg

SEQ ID NO: 4636 - DNA, 2162 bp, Artificial Sequence
  P13734 (35S::G148)
ccaacattgagagatattaaagacaagaaacaacgtagaaagaagagagagagcgagtgagagatgggaagaggcaaagtggaagtgaagagaattgagaacaagatcactagacaagtaaccttctccaaaagaaaaagtggtttgctcaagaaagcctacgaactctctgttctttgtgatgcagaggtttctctcataatcttctccaccggtggcaagctctacgagttcagcaatgtcgggtacgtatatccattcattcaagatcattaattcggttttcctaatgatgaaaacctaggttttcatgggtaatatgattaagatcatccatgtttgatttgtgtctgttcttaagatcaagaaaccaaattctgtcttgtgggtatctgaaaaaggttatgtctttttattctaaccctaactagttaaggttgatcaccatccatcgatctctcaggatccatcggacatatgggtcagtttagcttttagatccggtaaatcttttgaaagaaaacttctttgttttattttgggttttaattgttatcaccagctttgatatgtgtatgtccttaagatccatgaaacctcatatatacgttttgcctctttaaatagatatgtctttctaattctaattagagaaattaattagggtttatcatgggtagccgtagatctataatccattacgcagatatatcttcccagagatttttgtgtaattagaatttcctttagacatgcattaaaagttaacacagaacttaaggttttcgttctttggttttgaatttaagcaaattcagattattaattaaaatatcttgtggtttcttttgttttataaactgtagagttggcagaaccattgagaggtactatcgctgtaaagacaatcttttggacaatgatacgcttgaagatactcaggtcaatcattttttttcttaagtatgttcattttatctttatatatatacggaatttgacctttgttcattctaagtgtatacatagtcaaactaactattatattataacgatgtataaaataaatagagctaagataaattgtagttaatcttctgctttttggtgcagggcttgcgtcaagaggtgacaaagctcaaatgcaaatacgaatctcttcttcgcactcataggtttaactaatcgtactcctcgtaatccattacttcctataattgtacatttcctaatttctgctactaataatcgttttgaatcgttgaaaaaggaatttggttggggaagatcttgaagggatgagtataaaggaattgcagacgctggagagacagcttgaaggagctctttccgcaacccgaaaacaaaaggcatgacatatttcatacgtagaccaatttttcttgcgcatcatttagacctgcaaaatacattattgaaatgtatatctttatatgcatgtatgtatatagacgcaggttatgatggaacaaatggaagagcttcggagaaaggcaagtactcgaaatgatgttctacaatatatgcatgcattgtatgtaaatgtactcatgtgtatatcatttttgtatttggaatggcaggagagggagctcggagatataaacaataagctaaaggttaatgtttttaactggacatccaaattatatatcaagtctttcttagttactatgattttgtgttagttaattagtgtattgtctactcataaatcttataaaatggataatcttcataatcagcttgagacagaagatcatgattttaaaggctttcaagacctactgcttaacccggtgctcaccgccggttgttccactgatttttccttgcaatcaactcatcaaaattatatatcggattgcaaccttggatattttttacagattgggtacgtaataatcgatatttttgcttctctactgatgaaatacaagtcatggttttatgaataaatttggccttattggatacatatataatatgaatatgatacatatgtaggtttcaacaacactatgagcaaggtgaaggatcttcggtgacaaagagtaatgcaagaagtgatgctgagaccaactttgtccaatgatgggtttcgttgtcttggtttggactcattgagtcacgacgaagcg

SEQ ID NO: 4637 - DNA, 1098 bp, Artificial Sequence
  P13746 (35S::G3084)
caattctgacttcacgataatttcaggtttttgtgttggctgaccagatgtattgcagcgatcctccccatcccttgcacttagtggcatcagacaaacaacaaaaagaccacaaactgatcctttcctggaaggtaatgtgttcttgtcttttgtttgttccctgtctgcaatgatgtctcttaactctcctgacactcttagccttagctgcttgatataaatcaacatcattctcacctttctatgtatctgttatgtgctgaatatgtatttgttatagaaaccaacaatggactcagacccactcggtgttttcccaaattctcccaagtatcatccatattactcgcagaccacggagtttggtggcgtaatcgatttaggtctcagcctgagaaccatacaacatgagatttaccactcatctggccaaagtgagtttctttgccgtttccattagtatttccattacctttaatttcttggtaaattttttcaactctgagacggtgtttacttatgagttatgacatgtggcaaaggatattgtagtaatgaaggatacagacggaagtggggttatgtaaaggtcaccatggatggtttggtggtaggtcgcaaggtctgtgttcttgatcatggaagctattcaactcttgctcatcaactcgaggacatgtttggtaagtttttcatgggaagcttgggattcaaagatgagtaagtactataagtagtaatgttcctagtaggcttataccggatgttcattacaatctgtagggatgcagagtgtgtcgggattgaggttgttccagatggagtctgagttctgtttggtctacagagacgaagaaggtctgtggagaaatgctggggatgttccatggaagtaagctcttgatactttctttgtagattactgaaataaagcgtttacatgtgttgtgatttgtaaatgacagtgagttcatagaaagcgtggagcggctgagaatcacaagaagaaacgatgctgtacttcccttttaatattagcttctctctttcttcactctttgttataatttccaagtcagccttgaatcggaaatg

SEQ ID NO: 4638 - DNA, 1335 bp, Artificial Sequence
  P13786 (35S::G1033)
gattcaattcgttggttgtatagttgctacgatgaaaacagcaaaggggaaagataaagttaagaccacaaaggaagccttgaagccagttgatgacaggttaatcccattatcacttggtaacttaaacattaataacgagaaattatggctattgagaaaagtatatcttcttgctaaatcagcttttaaagtagctttgcaaatctgacttagctgaaacagttagtaatcatcatgcttgaagccgttgtttactttgtagcttaggttggacagactggtttaacattgttgcttgtgatttggtctcatatttagttcctgtttaattttcagaaaggtgggaaagaggaaggcaccggctgagaagcctactaaacgagagactcgtaaagagaagaaggctaaaaaggacccaaacaaaccaaaaagagctcctagtgccttctttgtctttctgtaagtatttgtgtatgattttcactctaggagattctcacttgtattgttgaacttcatataaattcttactgttttttttgtttctttgtttcagagaagattttagggtcacgttcaagaaagaaaatccaaatgtgaaggccgtctctgctgtaagcatttggcagattccttgatagtttacatgtacggtagtctttactaggtgaagtcctcatggtctcaccttctcttttccttgtcaaggttgggaaagctggagggcagaaatggaagtcaatgtctcaagctgtaagtatctttgaaacttccctgtctgatactgtgaggaaaatagtgtgagattgacatgagtttcacttcttcctttgtaaaggaaaaagctccatatgaagagaaagctgcaaaaaggaaagctgaatatgagaagcaaatggatgcatacaacaaaaacttggtaagccctaagccttactctcatatatacaaactcgtacatagctaactctgatttccttgcaatggggaacaggaggaagggagtgatgaatctgaaaagtctagatctgagataaatgatgaagatgaagccagtggggaggtaacaattccactaagcaatgtagagtttctctatataatgtcttttattcatgacccattttcttctgtacctggtgcttgctttctgaagatgtatgtttggcttaatatttctctgcaggaagaactattagagaaggaagcggcaggtgatgatgaagaagaagaagaggaagaagatgacgatgatgatgacgacgaggaagaagactaaatcagggatagaaatcagattttgtatctcaagcttaactgcagatccttaag

SEQ ID NO: 4639 - DNA, 1351 bp, Artificial Sequence
  P13789 (35S::G1825)
gagtaattgatctcgagagctagctaaagacactctcgccggagagacatggccgggagatcttcgccgggaaaatgctccacgtggcttgacctgaacagagaagaaacagtggagaagaacaatgaagaagagtcatcagtggaagacgaagaccaaatcacgaataacgttagacagtatattcggtccaacatgcctcggcttcgttggacgcctgatcttcatctctccttcgttcgtgctgtccaacgactaggcggtccagacagtaggattcttgttctctctctccacgtctctttctctctttctctctctcagctttgtaatgtaattgttgtatgattttaaaggagcgacgccgaaattggttcttgagatgatgaatctaaaaggattgagtattgcacatgtcaagagtcatttacaggtaatcttcatcgtctgttattctaagattatctcagttttgttcatctttttcaatgttttcatgtttctgatttcaagatgtatcgaagtaagaagctcgagccgtcttctcgccctggtaagttagttttgatccgcagacatttaccattccttcactgggtttcataattgatggaaatgacttttgaacaggatttggagctttcatgagtggacaaagaagctatttgatggacatgatcgactctcgatgtatccctcatagcgatttaagacatgcctataactctaaaaccgttccttcgaggtcatacaaagaaacaagttccagttactaaaatgtttcacatttgtatatccgatccgaccaaggaagttaaaattgcattcttttctgtagggtactcaatcaagacgcggtcgttacaaatcttggaggtaactttcttatgcgaccttcgagctggtttagcgggttatgcagaaatgaccgagacagcacagagaacaagactctgcctctactcgaggtaactacctactttcgttttaagagttatagaggaacagttttgttaaaaaccgaggaaggtactgtaatcttggtgaaatcttatgcagattaggaagaagaacaatgagaaaagagtccgagatgaagaagtatcatcagtcaaacgattgaaatcaatgtccggaggtgggatacagttgcctgagtttggaaattgcaggcaaaaaccaacagatgatatcaacacaatgctctcgctctctctgttgtcgacatcatcagaaccgtaaccaacatactagagagatgaagtttaactttaaaagagattcaagagtagagacttttgttttccttagccgtttcatgggatgagtacttagccaggatctggatcag

SEQ ID NO: 4640 - DNA, 1043 bp, Artificial Sequence
  P13792 (35S::G2993)
ccttgtggttattctcaagaaaggtttcattttgagataaagtttgctgctctttctggttgtggatagatcaaaagaatggagattgcaagtcaagaagatcctattccaataaacactagttatggtaatagtggaggtgggcatgggaacatgaaccatcatcatcatgccaattctgcaccatcatctctcaacattactacttcaaacccactactagtctcctcaaatagtaatggtcttggtaaaaatcatgatcattctcatcatcatcatgtgggttacaacatcatggttaccaacatcaagaaagagaagcctgtggtgataaagtacaaggaatgcctaaagaaccatgcagctaccatgggaggcaatgctattgatggttgtggagagtttatgccaagtggtgaagaaggttccattgaagctctcacttgctcagtttgcaactgccatagaaactttcatagaagagaaaccgaaggtgaagagaaaacattcttttccccttacctcaaccaccaccaaccacctccgcagcagagaaaactcatgttccaccacaagatgatcaaatcaccattaccacaacaaatgataatgcctattggcgttacaaccgctggatccaactcagagtcagaggatcttatggaggaagaaggcggaggaagcttgacattccggcagccaccaccaccaccatcaccgtatagttacggacataatcagaaggaaaggtttaggacaaagtttacacaagagcaaaaggagaagatgattagttttgcggaaagagttggttggaagattcagagacaagaggaatctgttgttcaacagctttgtcaagagattggaattaggagaagagttcttaaagtttggatgcacaacaacaaacaaaatctctccaagaagagcaacaacgttagtaacaatgtcgacctttctgctggtaataacgacattactgaaaatcttgcttctactaatccttagttaagttcagattgttgttatataacttcact

SEQ ID NO: 4641 - DNA, 820 bp, Artificial Sequence
  P13799 (35S::G3017)
caagggtttgtgttttacccttccggggaaaccattgaagatcataattctttgatggatttcaatgcttcatcattcttcacctttgataatcaccgaagccttatctctcccgtgaccaacggtggtgccttcccggtcgtggacgggaacatgagttacagctatgatggctggagtcatcatcaagtggatagtattagccctagagtcatcaaaactccaaatagctttgaaacaacgagcagttttggattgacttcaaactccatgagtaaaccggccacaaaccatggaaatggagactggttatactctggttcaactattgtaaacatcggttcaaggcacgagtccacgtcccctaaactggctggcaataaacggcctttcacgggagagaacacacaactttcaaagaagccgagtagcggtacgaatggaaagatcaagcctaaggcaacaacttcacctaaagatccacaaagcctagcagccaagaaccgaagagaaaggataagcgaacgcctcaaggtattgcaagaacttgtaccgaatggtaccaaggtggatttggtaactatgcttgagaaagcaattggctatgtaaagtttcttcaagtacaagttaaggtacttgcagccgatgagttttggccggcacaaggagggaaagctccggacatttctcaagttaaagaagctattgacgcaatcctctcatcatcacaacgagatagtaactcaactagagaaacaagtatagcagaataattccgaccaaaacaaaaagtatagcagaataattagttactaaatg

SEQ ID NO: 4642 - DNA, 1134 bp, Artificial Sequence
  P13803 (35S::G1957)
caagaaccatctcgtaaatcaagatttctccaaggaaaatcagataagtcataatggatctatccctggctccgacaacaacaacaagttccgaccaagaacaagacagagaccaagaattaacctccaacatcggagcaagcagcagctccggtcccagcggaaacaacaacaaccttccgatgatgatgattccacctccggagaaagaacacatgttcgacaaagtggtaacaccaagcgacgtcggaaaactcaacagactcgtgatccctaaacaacacgctgagaggtatttccctctagactcctcaaacaaccaaaacggcacgcttttgaacttccaagacagaaacggcaagatgtggagattccgttactcgtattggaactctagccagagctacgttatgaccaaaggatggagccgtttcgtcaaagagaaaaagctcgatgcaggagacattgtctctttccaacgaggcatcggagatgagtcagaaagatccaaactttacatagattggaggcatagacccgacatgagcctcgttcaagcacatcagtttggtaattttggtttcaatttcaatttcccgaccacttctcaatattccaacagatttcatccattgccagaatataactccgtcccgattcaccggggcttaaacatcggaaatcaccaacgttcctattataacacccagcgtcaagagttcgtagggtatggttatgggaatttagctggaaggtgttactacacgggatcaccgttggatcataggaacattgttggatcagagccgttggttatagactcagtccctgtggttcccgggagattaactccggtgatgttaccgccgcttcctccgcctccttctacggcgggaaagagactaaggctctttggggtgaatatggaatgtggcaatgactataatcaacaagaagagtcatggttggtgccacgtggcgaaattggtgcatcttcttcttcttcttcagctctacgactaaatttatcgactgatcatgatgatgataatgatgatggtgatgatggcgatgatgatcaatttgctaagaaagggaagtcttcactttctctcaatttcaatccatgagaag

SEQ ID NO: 4643 - DNA, 1513 bp, Artificial Sequence
  P13804 (35S::G1557)
ggtgaattttcatcgaatcgcgagtttcagtaagatataaaacagatgaagaacccaatcgttagatcttatgttagatcaaaagtgccgcggttgcggtggaactctgatcttcataactcttttgttcaagctgttgaacaactaggtggagaaaatagtaagtggtttcctttctcttctcctaaaactataattatgatttaatttctcttaaatgtttcaaaaatcattcacaatttctgtcattatatatagaacaacttttgaagattactttatcaattataaaacttctgttcttgtgaagttatataatttttaccaatcttgaattcattcaagttcaagataaatgaattcggtttacaatccctaaaattgcaggagcaactcctaaaatggttttacagttaatggatgtgagaggactcacaatatcacatgtgaagagtcatctccaggtcctaacatttaatatctatatacatccatatacttatacaagcatatgtctttatacatatcattatatatgtgtatatatgaatagtatcatattttataagttctggtttgaatattgaaccatatatctttcaacttccaacagatgtataggggcatgaagcttgaagaatccatgcaaggttgataaatatgatcattacatcttaaagtaaattatataaatatgtatgtattgtacatgtgtatataggaccatataaactgatttatacatatatgtatataatatagaaacacattcaatctttgacagaagagatattagcaaagagaagtgttagagtgacaggacaagtaacttggtggcaatttcaacattaccttcataactaccaacgtcttcagggcaatgccaactttttccaaaatcaacaaaggttcgtgtagttattaataaaaatattttagttgatatatatataggttttaacgtgaagcagagagctatatattttcttaataaaagtttcttgtaggcaagaagcgggaatatatgaaaaaattataacatttggacaatcaagtaatgaaactaaggaagtaccaagtgactactttacctgcaagtctctctatgaaacatccagagtaattatcctttttttcatatgcatttatttaactatttaccatgtgtacaagtcatctatgtgttcatctgatttccgaatatatacatgtaaatttagaaatactcttatattatactgcttataaataacaggctccacaaaataaaacgagagatgatgatgaaaatggtgaagctgttgttgctattgaagatgatggtaatgttgttgatgaacatgatgatgaggatgctaatgatgatgaggttactttgtcactaaactcaataaaagtttcaaaaagtgaagaagaattgtcccttgagctcactcttggtctcaaagcataacatgttttgattttgatttttttttttttgtagaaaccgttggaagtatgttgtaggatg

SEQ ID NO: 4644 - DNA, 1225 bp, Artificial Sequence
  P13807 (35S::G2702)
ccatctttccttgcttcttacaatctctccaatttcaaatctgtatactcttcttcaaaaaggctccaccagtccaaaatgatgatgaggaaaccggacattactacgatcagagacaaaggcaagccaaatcatgcatgtggtggtaataacaacaaaccgaagctaagaaaaggactttggtcgcctgatgaagatgagaagctgataagatacatgttgactaatggacaaggatgttggagtgacatcgctagaaatgctggtcttttacgttgtggtaaaagttgtcgccttcgctggatcaattacttgaggcctgatcttaaacgtggatccttctctcctcaggaggaggatctcatcttccatttgcattccattcttggtaacaggtaaactttacaatgagtctcagatttgaaacaatttggccctaaatgattttagtgcataactgtttacattttatcgtcaggtggtctcaaatagctactcggcttccaggtagaacagacaacgagatcaaaaacttttggaactcgacattgaagaagcggcttaagaacaacagcaacaacaatacttcatcaggatcatcacctaacaatagtaatagtaattccttggacccaagagatcaacatgtggatatgggaggcaactcaacttcattgatggatgactatcatcatgatgaaaacatgatgacagtggggaacaccatgcgcatggactcttcctccccattcaatgttggaccaatggttaatagtgtgggcttaaaccaactttatgatcccttgatgatatcagtgccggataacggatatcaccaaatgggaaacacagtgaatgtgttcagcgttaatggtttaggagattatggaaacacaattcttgatccaattagcaagagagtatcagtagaaggtgatgattggttcattcccccctcggagaataccaacgtcattgcttgtagtacaagcaacaacctaaacttacaggcccttgatccttgcttcaatagcaaaaatctttgtcattcagaaagcttcaaggtagggaatgtgttggggatagagaatggttcttgggaaatagaaaaccctaaaatcggagattgggatttggatggtctcatcgataacaactcttcttttcccttccttgatttccaagtcgattgacaatttctctcttttcatttcattctatcttc

SEQ ID NO: 4645 - DNA, 1949 bp, Artificial Sequence
  P13813 (35S::G133)
ctcttcaacaaaaagattaaacaaagagagaagaatatggcgagagggaagatccagatcaagaggatagagaaccagacaaacagacaagtgacgtattcaaagagaagaaatggtttattcaagaaagcacatgagctcacggttttgtgtgatgctagggtttcgattatcatgttctctagctccaacaagcttcatgagtatatcagccctaacaccacgtacaccatctctctaaacaccactcttaaattaagctaattgagttgctttgttttcttataattaaccactacttttttggtgattttgttggttatagaacgaaggagatcgtagatctgtaccaaactatttctgatgtcgatgtttgggccactcaatatgaggtttttttccttcttagatctttcttcttcttcttgatatgtgtttcgctggttggttaaattcttgatgcgttttgctgcagcgaatgcaagaaaccaagaggaaactgttggagacaaatagaaatctccggactcagatcaagtatttgtttctctctcttctcttagatgaggagttttactaaaaaaaatgagtacgaaaatatacatatttttaaaattgtaggcagaggctaggtgagtgtttggacgagcttgacattcaggagctgcgtcgtcttgaggatgaaatggaaaacactttcaaactcgttcgcgagcgcaaggttctcttcatacttttcccttacctagggtttcaattaatcctatatacccaagcttcagttttgaattgaattattaaaaaatgaattttattgttgtatatatgttttagaaaaagaaacattttgtttactgttggataatatatgttaattgtattgtactgtacagttcaaatctcttgggaatcagatcgagaccaccaagaaaaaggtcacatcttctatgtccactcacttttccattttatcatatttatttgtctcaacaattttgtgtcaattgaatttatcaacttactaaaactgttgataacacttttcttggacaattatatttgtgtgtgtgtgtgtgtgtttaagctaatggataaagaaaataccaagtatactatatagtgatgtcataataacttgggtatatatcttcataatttttttgggagggaatatttcttcatcatttctcttgtggtttacacaattgcagaacaaaagtcaacaagacatacaaaagaatctcatacatgagctggtaatatctctttctgtttttctcaaatgttggtttaggcataatacattcatggaatacggagccagttaaaaagatatctagaaatgtagtgtagattgatcagtcactcttatgttttcttgtgattctcttatcgaaatatctcctagttaaatcatatatcaaatgtcatgtcatttcgaattaataatattggttttagttatgtggaatatggcttaaaacatgttttggtgaattaggaactaagagctgaagatcctcactatggactagtagacaatggaggagattacgactcagttcttggataccaaatcgaagggtcacgtgcttacgctcttcgtttccaccagaaccatcaccactattaccccaaccatggccttcatgcaccctctgcctctgacatcattaccttccatcttcttgaataattaaaggctaaaaggtttgctggtgccatcattgtctatctaattatttagtaactacttaaaacataaggcatggtgttgctaaaaccttaaactgtcatgtttcttagttatgtattttaaagcctaaagaaatatggattgtgtgatcagtagtgcttaggcttattgtgtgtggaatgttttcaagacttttatcatgtatcgtattattatattgaccactctacttaattatgctacaaatttactc

SEQ ID NO: 4646 - DNA, 1141 bp, Artificial Sequence
  P13821 (35S::G2983)
atgcatagcatttgctagttttaacatatagcaatgaaggttcatgagttttcgaatgggttttcttcatcgtgggatcaacatgactcgacatcatcccttagcctaagctgcaaacgcctccgtcctctcgcccctaagctctccggcagccctccctcccctccttcttcttcctccggcgtcacttcagccacttttgaccttaaaaacttcattagacccgatcaaaccggtccgacaaaatttgaacacaaacgagaccctcctcatcaagtcagttccattattgtacttcgtacattttacatcgtttctttcgtttgaaaaaagaagaagaattcactctagaagaattttgataattgcggcatacctaatactttgacatttataaattataacgactggagtggttccttttattattaattttatttatttattttaatgtatgattcctaacaaatgtaatgaaataatgtgtgggttcagttggagacgcacccgggagggacaaggtggaacccgactcaagaacagatagggatacttgagatgttgtacaaaggtggaatgcgtactcctaatgctcaacagattgagcatatcacattgcaactcggtaagtacgggaaaatcgaagggaaaaatgtgttctattggttccagaaccacaaagcccgcgagagacagaagcagaagaggaacaacctcatcagcctaagttgccaaagcagcttcacgaccactggtgtctttaatccgagtgtaactatgaagacaagaacatcatcgtcactagacattatggtaggaatttaaggattttgtatagttttgtggttttgatcaactatatttaaggataatttttatgattgtgtagagagaaccaatggtggagaaggaggagttagtggaagagaatgagtacaagaggacatgtaggagctggggatttgagaacttggagatagagaacaggagaaacaaaaatagtagtactatggcaactacttttaataaaatcattgacaatgtaaccctcgagctttttcctctccatcctgaagggagatgaagtcatgaaggtgaggcagaaaattgtggaattcttatgtagatctggtttaggttc

SEQ ID NO: 4647 - DNA, 1278 bp, Artificial Sequence
  P13824 (35S::G961)
aacctcacatgctctattcttgcttgatttttgagttaatcttgaatctctttgatgatgtcaaaatctatgagcatatcagtgaacggacaatctcaagtgcctcctgggtttaggtttcatccgaccgaggaagagctgttgcagtattatctccggaagaaagttaatagcatcgagatcgatcttgatgtcattcgcgacgttgatctcaacaagctcgagccttgggacattcaagagatgtgtaaaataggaacaacgccacaaaacgactggtatttctttagccacaaggacaaaaaatatccgacgggaacgagaactaacagagccactgcggctggattttggaaagcaactggccgcgacaagatcatatatagcaatggccgtagaattgggatgagaaagactcttgttttctacaaaggccgagctcctcacggccaaaaatctgattggatcatgcatgaatatagactcgatgacaacattatttcccccgaggatgtcaccgttcatgaggtcgtgagtattataggggaagcatcacaagacgaaggatgggtggtgtgtcgtattttcaagaagaagaatcttcacaaaaccctaaacagtcccgtcggaggagcttccctgagcggcggcggagatacgccgaagacgacatcatctcagatcttcaacgaggatactctcgaccaatttcttgaacttatggggagatcttgtaaagaagagctaaatcttgaccctttcatgaaactcccaaacctcgaaagccctaacagtcaggcaatcaacaactgccacgtaagctctcccgacactaatcataatatccacgtcagcaacgtggtcgacactagctttgttactagctgggcggctttagaccgcctcgtggcctcgcagcttaacggacccacatcatattcaattacagccgtcaatgagagccacgtgggccatgatcatctcgctttgccttccgtccgatctccgtaccccagcctaaaccggtccgcttcgtaccacgccggtttaacacaggaatatacaccggagatggagctatggaatacgacgacgtcgtctctatcgtcatcgcctggcccattttgtcacgtgtcgaatggtagtggataacggaaatggagggaaagagagagaggcacacacacataagacatttcacatttgtgtaaaaagatataatcataccatatagttgttgaaacatataaaagaaagtcagatttgtgataattacag

SEQ ID NO: 4648 - DNA, 1146 bp, Artificial Sequence
  P13836 (35S::G246)
tctttacatggcaaggtttaagaaacattcaacaactattctataactcacacattttaatacgataaacagagaaatatcacacaacaatacattatgtatctgtttatgtataaatgtaacatagttttggaggagactcatgtttttcaaaataccccttgtgatgtttcattgcagaggccatttaatgggtttggagaaaacaatgcattaccattgagaaagatgcatcaagaggagaagaagaagaaacataggggtggacactggacactttcagaggatctcaaactcaaagagcttgtggcggtttttggtcctcagaactggaaattcattggagagaagatggaaccaagaacaagtaaaatattgttttttttttctttcgtacttactctatttttggacatgaaagttgaatctttttttcttgtttttctatgtgtttgaaggtctaagttgtagacaaaggtggtttaaccagctcgatccgaagattaacaaaagaaatttcactgatgaggaagaagagaagctgcttagagctcacatattatatggtaacaaatggtctaagatcgctaagcttttcaatcgaagaacagaccatgctgttaagaatcattggcacagtctcatgaatagaatcattaggaagcaatcagcttctgacataagatctttcgataacatccagaattatcaaacctccaactttcttcctggtttgtgtctccttaatactaaacaatagatttaaaacaccacacagcaatatgggttcaattctgagttcttgatgtttatttttcttattgtgtggtttacaggtagtgtaagtcatgaaagtactaacctcaatgctcaatatctccaagaaaagaattattcttcatgcatgccattgcaacactcatgtcatcatcatcacttctctaccttccctgcaaattccttggccttattcacacctcatgtctccatctctcaaccatcatcatcatcgttactatcatcatcagaagcagaagatataatgactacaaaaaccccgaggtatatagattttctcggggtaggagattcttgaagaaactacttaagaacttcctaactgtaaccttaattccaatgatgagg

SEQ ID NO: 4649 - DNA, 1904 bp, Artificial Sequence
  P13846 (35S::G2041)
tcgacgagttgagagccatactttcactataccagttgcttcctcagatatgccatcggctgaagaaagtgacaatgtctggtctttaatacctcagcttaagagaaaactgcatttgcaccagaaaaaagcttttgagtttctctggaagaacctagccgggtcagtggttcccgcgatgatggatccgagttcagataagataggtgggtgtgtagtttctcatactcccggagcaggaaaaacatttctaatcatagcttttctcgcgagctacttgaagatatttccgggtaaaagacctttggttcttgctccaaaaacaactttgtacacttggtacaaggagttcatcaaatgggagattccggtccctgttcacttgctccatggtcgtagaacctactgtatgtccaaagagaagaccattcagttcgagggaattccaaaaccaagccaagatgttatgcatgttcttgactgtttagacaaaatccagaaatggcatgcacagccgagtgttcttgtaatgggttacacatcgtttctaactttgatgagggaagattcaaagtttgctcatagaaagtacatggctaaagtactgagagagtctcctggattactggttctagacgagggacataacccgaggagtaccaagtcgagattacgaaaggccttgatgaaagttgatactgacttgaggattctgctttctggtacattgtttcagaacaacttctgtgagtacttcaacactttgtgcttggctagacccaagtttgttcatgaggttctagtggagttggacaagaagttccagaccaaccaagccgagcaaaaggcgcctcacttgcttgaaaatagagctcggaagttcttccttgacattatagccaagaagattgacacaaaagtgggcgatgagcgcttgcagggtctcaacatgttgaggaatatgacgagtggtttcatcgataactatgaagggagtggaagcggaagtggtgatgttctcccaggtttgcagatttacacattgttgatgaattccactgatgtacagcacaagagtcttaccaaacttcagaacataatgtcaacttaccatggatatccactcgagctcgagttactcataacgttagctgctatccatccttggttggtcaaaaccacaacctgttgcgccaaattcttcaaccctcaggagcttttagagattgagaagctcaagcacgatgcaaagaaaggatcaaaagtcatgtttgtgcttaatcttgtgttccgggtggtcaagagggagaaaatcctcatattttgtcacaacattgcgccgatccgcctgtttcttgagctgttcgagaatgtattcaggtggaagagaggccgagagctcctgaccttgacaggggatctcgagctgtttgaaagaggcagagtaatagacaaatttgaagagccaggaggccagtcccgtgttctgctggcttcgattacagcctgtgcagaaggcatcagtctaaccgctgcttcacgggtgatcatgcttgattcagagtggaatccttctaagacaaagcaagcaatcgcacgtgcattcagaccgggacagcagaaagtggtgtacgtttaccagctcttgtcgagaggaacacttgaagaagacaaatacaggaggacgacctggaaagaatgggtctccagtatgattttcagtgaagaatttgtggaggacccatctcaatggcaagctgagaagattgaggacgatgttcttagagaaatcgtggaggaagacaaagtcaaatccttccatatgatcatgaagaacgagaaagcttcaacaggtggctgattgctgaatttttccagttcaagtttctgtttcaccatgccgc

SEQ ID NO: 4650 - DNA, 2435 bp, Artificial Sequence; identical to SEQ ID NO: 1667
  P13851 (35S::G2754)

SEQ ID NO: 4651 - DNA, 2734 bp, Artificial Sequence
  P13862 (35S::G1772)
caccggaactgtgatctcaccggaatatccctcctttatttatcctctactcatccgttttactctctccctccgtcgatcttctctttctcttgatcgcctccgtccattctttatcatttcttaattcagaattgtgatcgatggatgattattttagcgcggaggaagaggcttgctattactcctccgatcaagattctttggatggaattgataatgaagagtctgaattgcagcctctgtcctctaaaagatcaaacactcaggttctcttatatacactcttcttcctctcttcattcttctatctctttcttcttaatatccgtgattgtttcatatttggttgttattggtaattctcttccccctcaatttttgtgggttgttgatatttcgtgaaaattttgaaccttttcaaagtgaatttcattgcaattgtgagattgaaaatctggttccggcatcattgttcatctgaatttctcatttttcacagtgtttaggattctaatttattgcagaattgttctgttctgttcttctctgtttgaaattagggtttgttaacagttattctacaattttgcaggtcatcactcaggaatcgcttctagcagcacaggtaaaatcagcagagatgattttactctcgggtttaattttaagctttagtttggtttgagttattggttttctgatgcagagagaagatttgctaagggtgatggaattgttatcaataaaggagcaccatgcacggactcttcttattcattaccagtgggatgtggagaagttgtttgctgtgtttgttgagaaaggaaaagatagcttgttttctggagctggtgtcactgtcttcgattatcaatatggcaactcttcctttcctcagtcttcacagatgagttgtgatgtttgcatggaggatttaccaggtgatcacatgacaagaatggactgtggccattgcttttgcaataattgtgagtaccctcttgctgtaatttgttgcaaaggttgacatatgatgtaacacagttcttgtttcgttttaggttggacggagcattttactgtgcagataaatgaaggtcagagcaaaaggattagatgcatggctcatcaatgtaatgctatttgtgatgaagatattgtcaggagtctagtcagtaaaaagcgtccagatctagctgcgaagtttgatcgttaccttcttgagtcgtacatcgaagataacagaatggtcaagtggtgtcctagcactccgcattgtgggaatgctatacgagctgaggatgacaagttgtgcgaagttgaatgttcttgtggtcttcagttctgtttcagttgtctgtgtcaagcccactccccttgctcttgtttgatgtgggagttatggagaaagaagtgtcgagatgagtctgagacaatcaactggataaccgttcacacaaagctgtgtcccaaatgttacaaacctgtggaaaagaatggtggatgcaatctcgtgaggtgtatttgtgggcagtgtttttggtaagaactcgagccttgtttcctcaatgcttttttttcctattttgcatttgttttttctatgctttgagacgatcaaatgtcaaatggtggaagtgtctctcatgtttggttattaaaatgtacagttggctatgtggtggagctactggaagtgatcacacttataggagtatcgctggtcacagttgtggtcggtaccaagatgacaaagagaagcagatggaaagagcgaagagagatttaaacaggtatacgcattatcatcaccgatacaaagctcatacagattcatcaaagctagaagataaacttagggatactatccatgagaaagtgtcgaaatcagaaaagagggagttgaagcttaaagacttcagctgggtcaccaatggactcgaccggttattcagatcaaggcgagttctttcatattcgtatgcttttgcatattatatgtttggtgaagagatgtttaaagatgagatgacccctgaggagagagagataaagaagaatttgtttgaggatcagcagcaacaacttgaaagtaatgtggagaaactttcgcagttccttgaggagccctttgatgaatttagtaatgataaagttatggcgataaggattcaaatcatcaatttgtctgtcgccgtcgatacactctgcaagaaaatgtacgagtgcattgagaatgacttactcggatctctccaacttggcatccacaacatctcaccttacagatcgaagggaatcgaacaagcagctcagttttatgcttcctggaattccaaagatgctgacaaattccaacctttggatagtggtacaagcggtaatcaactctcggtgaacgatgatcattgtattctagtaacgaatcaatgaatcaaaatcctaatgagtgataaatatttttatacaggagtgacatcgaggcctgagcaagcttcaggatcaaggagctcggaagacaccatttgctcatcttcacagaaacgtcccaaaaaagaaggaagtttcttaaacaacaaagtcactttattggatttgaacttgccagctgatttcgtcgaccagaactgaactcaaatcctctcttgcttagtccaaatgagatatgatgacatagcaaaaggtgtttgactatatatctatcaccttcaagactcgtgactctggactg

SEQ ID NO: 4652 - DNA, 2621 bp, Artificial Sequence
  P15001 (35S::G1037)
aatctttcgtttctgggtctgttgaaaaacgatgactgttgaacaaaatttagaagctttggatcagtttcctgtaggaatgagagttcttgctgttgatgatgaccaaacttgtctcaaaatccttgaatctctccttcgtcactgccaataccatggttcctctctctctctctctctctctctctctctctctgttttcttggatctgtttttcatcaagtttttagattttatgtctctttgatctgtgatttgatccacatatggtggaatcttttgatatctatctacctaacttcttgtatacacaaatctaaaaaaaacttagctttttttattccattgttagattttgtaagatttgacatttgtcagagagaaagtttcattgttgaattgaattaaaagtttaagactttatggaatctgttgcagtaacaacgacgaaccaagcacaaaaggctttagagttattgagagagaacaagaacaagtttgatctggttattagtgatgttgacatgcctgacatggatggtttcaaactccttgagcttgttggtcttgaaatggacctacctgtcataagtaagtcttattattattattattttctaattaaacttttgtcatttatttccttaatgactcactacaggaataaagttttgatctctagacttggttttgtgatgatgattttcttgttgttgcagtgttgtctgcgcatagtgatccaaagtatgtgatgaagggagttactcatggtgcttgtgattatctactgaagccggttcgtattgaggagttgaagaacatatggcaacatgtcgtgagaagtagatttgataagaaccgtgggagtaataataatggtgataagagagatggatcaggtaatgaaggtgttgggaattctgatcagaacaatgggaaaggtaatagaaaacgtaaagatcagtataatgaagatgaggatgaggatagagatgataatgatgattcgtgtgctcaaaagaagcaacgtgttgtttggactgttgagctgcataagaaatttgttgcagctgttaaccaattgggatatgagagtaagcttatcaatatgtcacttgatatgagagtaagcttatcagtatgtcacttaagttctgttttgtgtgtgttgttttgattgcagaggctatgcctaaaaagattttggatctgatgaatgttgagaagctcactagagaaaatgtggccagtcatcttcaggttacaaagaatctttcatgtttttaacttgcgtaacccgaagatttgttttttaacacctcggaagcttatgactttgttcgctgtggtttgcagaaattccgcctttacttgaagaggatcagtggtgtggctaatcagcaagctattatggcaaactctgagttacattttatgcaaatgaatggacttgatggtttccatcaccgcccaatccctgttggatctggtcagtaccatggtggggctcctgcaatgagatctttccctccaaacgggattcttggcagactcaatactccttcggggatcggtgtccgcagcctttcttctcctcctgcaggaatgttcttgcaaaaccagaccgatatcggaaagtttcaccatgtctcatcacttcctcttaaccacagtgatggaggaaacatacttcaagggttgccaatgcctttagagttcgaccagcttcagacaaacaacaacaaaagtagaaacatgaacagtaacaagagcattgctgggacctccatggcttttcctagcttctctacgcaacaaaactcgctcatcagtgctcctaataacaatgtcgtggttctagaaggtcacccacaagcaactcctccaggcttcccaggacaccagatcaataaacgtttggagcattggtcaaatgctgtatcctcttcgactcaccctcctcccccggcacataacagtaatagtatcaatcatcagttcgatgtctctccattaccgcattctagacccgaccccttggaatggaacaatgtgtcatcaagctactctataccattctgtgactctgccaatacattgagttctccagccttggatacaacaaatccccgagctttctgtagaaacacggacttcgattcaaacacaaatgtgcaacctggagtcttttatggtccatccacggatgctatggctctgttgagtagtagtaacccgaaagaagggttcgtcgtaggccaacagaagttacagagtggtggattcatggttgcagatgctggttccttagatgatatagtcaactccacgatgaagcaggtgtgacattaaagcttttgccaatattaaccattctgatttggagattattgtgatttctgacatgaagattttgtgaatgtgacaggaacagagccagggagatttgtctggaggagatttgggatatggagggtttagttcactcagaacatgcatatgagagaacaaacatttagacataaatcaaatatcatcatcttgtttgtctctttttctcgctaatcttttgtgtattaaaattgtaaactatttgttttcccactggttctagcaattta

SEQ ID NO: 4653 - DNA, 963 bp, Artificial Sequence
  P15002 (35S::G2111)
atttgatactagacatacaaattcctttttattgttgtcattaccatgacgaggaagaagctaaacctatcttacatcaccaatgagtcaatgagaaaagcaacattcaataagagaaagaaagggcttgtgaaaaaaatccacgagctttccgttctctgcggaatcgaagcatgtgcagtgatttatagtccgttcaactcaaaccctgaagtctggccatcgaattcagaagttaaaaatgtaatggaaaattttgagatgttgacaaagttggagcaagagaagaaaatggtgagccacgaaggttttatcagacaaaacatctcaaaaactatggagagtaacaacaaaaagatgatcgataatgcggagaggacgatgaaagaagccatgttccaacttcttagtggaaaaggggagaagcttaatttgactgatagaaaccgtgaagatttgtgtaagtacattgatcaatatcttaaagaactttatcaccacaaaaacaaaaccataaatcaatcacatattgaacctggagaatcttcgggagctacaaatgccatgacaccaacatctgttgttgaagtgagttcttattcctttccaattatctcgatgttttcaactctccttgactaatcaatgatttctcgtctttgaagcctattatctcttcaatccagcgaccaaatcaggttaatatcttctccagtaattttctatctagtgatgctgaccagtaaagttattctctagtgataaatccatttggtgtttatgatcagaatccaaattttaatcatcttagtcataatcaatatcaatatcaacaacagtttggatatccgattttggttcaagatggaatttacaatccgagtcaaattcagaatcaacatgaggaatggctggatgatcatatgatgaatcattctaaggaaataagtcatcctttgatgg

SEQ ID NO: 4654 - DNA, 2268 bp, Artificial Sequence
  P15009 (35S::G380)
ggtttctctcttcaacaatcgtctccccattaggcacattgttgagggcagggtagtctcgtgagttctcttctcctgagtgtaactgtggttaaaagcttagccaagatgcagggggagagggccagtcttggctatttatcagaggccttgaactttgagcatggttcttcttcaagtaatggtgtgatagatcattgggagaatattcacagtcttggtgataatgacttgcaggattacatgattgcaaattctgaatcaaatacttcgcttgcaaactcagtttatcacgagcaacagggtttacgcagatttagccttggtgaggctagctctagtggcacgaaggatgaagcttccagtcacaatgagcaacgaatggaaacaagatgctttgacggacgaggaaatgaaataattgatttagacccagtgtttgcgcagccatcaggcacaaatcaacctgttcagaatgtcaatctgaatgcagagtatatagaaattcacgaggatattaatccatatagaggtcggtctggcttcatagaagctaatggaccagggaccagggtctcacaacctggcagatcttttgaagagaacggtgttggaacaggttcttctgtagagggacgtcgtgcatcctgcaaaagaaaagctcttgaaggcagtattagtcaatcttcttcaggaggttatcatgatttccagcgtggagaaagcagttcgtggaccccaggttctacggtttttaggccaggaaatggtttaaacatatctggctcccttgacaatggaccaagaggaatggtctccggtactgtaccaaattttcctgtttctgcaccaaattttcctgtttctgccattgcagagagctccagtagaaatatatgcgtcaggagtaatccctcagatcatcaagaaactgtaaacccatctacctttgctgcgggaactgttgtcaggcggcctgtccctccatcccagttgaacttgtcaagacacttaccagcagatcagcattcattggacttgagacctggacagtcttttgtcgtttctcgtaacccaaattctactcctgtgagcataccacctggttcaaggactatgctaccaccatttcggtggactgggagctcactagtgggtggaacatcgaactctactgcgcccgttgagagaaatcttcatctagatgaaaccaggtcaagaagcatacccgggaatactcttgagattcccatgtttgcagctcctgaggtaggaaattttgcccgtagtcagagtagcagaaatgtaacaaatggaaacctgaatagtgcatcatcagtgtccaggacaggctcaacaacaagtgttccaccaccaccaccaccatcttctaatctagcgtggacttcttaccagaattcaccacattatcaaagaagaaggactgaaaggtctgaacttgcacgtaggtccttgctttcttcccttgcagcagatgctacaaaccagagatctggtgatcatccaacacttcgttcgttggcccctcctgcctcttcggatgggcttgtgcttcagcctggtggtgataatagtcagatgcataatcgggcttactcgagagcaggtccgttgtttgataggcaaggggatagtgtggttggtattcctcatcctttgcgggccttggcagctgcaagcagaggaagaagcagacttatggtgtcccagatgcagaatgtcttggatgtcatgcgtagggatgctaataataacaacttgcggcttgaggacgttatgcttctaaatcactcagtactatttgatggggctactggtcatgaccggtatagagacatgcgacttgatgtggacaacatgtcatatgaggaattgttggcactagaagagcggattggagatgtttgtaccggtgtaaacgaggaaaccatatcaaaccggttaaagcaacgaaaatacaaaagcaacacaaaatctccacaagatgcagagccatgctgtgtttgtcaggaggaatacaccgaaggagaagacatggggacactagaatgtgggcatgaattccatagccaatgcattaaagaatggctgaaacagaagaatctttgcccaatctgcaagactacaggcttgaacaccgcgaagaagcggaggatagcatgatgatttctcgaaagagctttttttttttcttaactattcaattttataatcaaaaatgaaagaaacagaaggtaccctaagccc

SEQ ID NO: 4655 - DNA, 874 bp, Artificial Sequence
  P15010 (35S::G744)
cgtgggagactggtagatgaacaacttatgtcaacaatgataaattcacaccattggcaggttttattcttactcatctgaatgtgtatggttaaaacagaacattgaaaagtactactgaaagttactatatgaacatgtaaatatagtttttgaagtgtttgaaggatgtctcttatgatcaacgctggcccaaacttctttcagtgtcctgagactatataagaagagctagagtccttagatttccaagatctgtaaattttgttttatatacttttgttcctgcatcttactgtttcgcttgatgtttggcaatcacctctagtttgaatcgatgcagaaagactgatgtaaccagctttgtctaccttttatagttaaggatttccgatgtaagttatgaagagcgggaggatgtttatggtgaactggaagctagaggcttatcgggtgactctttaaggaaactaccatgctatataatgtcaagtgaaatggtcaggaggcaggtcactcactgcacaatttgtctgcaggtttgtctgcttcttggtttttatatgaattgattgaactatcatggccctttcttcatcttataccttggcatttacaggacatcaaaacaggggaaatcacacgaagcttaccgaaatgtgatcatacgtttcatctggtatgtgttgataaatggctcatcagacacgggtcatgccccatttgcagacaggcagttaaagattaaaacacgactgttgccgagctgtgtacatagcaaaaacacattatccttatatgttgttgtaacttgtaagtctaaaacccctttcttctgtatttttcctcatttcatttagagcaatgctcagct

SEQ ID NO: 4656 - DNA, 1570 bp, Artificial Sequence; identical to SEQ ID NO: 581
  P15012 (35S::G752)

SEQ ID NO: 4657 - DNA, 1197 bp, Artificial Sequence; identical to SEQ ID NO: 673
  P15014 (35S::G905)

SEQ ID NO: 4658 - DNA, 1511 bp, Artificial Sequence; identical to SEQ ID NO: 823
  P15018 (35S::G1108)

SEQ ID NO: 4659 - DNA, 500 bp, Artificial Sequence
  P15019 (35S::G1113)
tctttctctcacactcatgggtcttccaacagatttcaaagagcttcagattccaggttacgtactaaaaacactttacgtcatcggtttctttagagacatggtcgatgctctttgtccttacatcggtctaccaagttttcttgaccacaacgagacctctcgatccgacccgacccgactcgctctctccacgtcagcaactcttgccaacgagttaatcccggtggttcgtttctccgatcttttaaccgatccggaagattgctgcacggtttgcttatccgattttgtatccgacgataagattagacagctgccgaagtgtggacacgtgtttcatcatcgttgtttagaccgttggatcgttgactgtaataagataacgtgcccgatttgtcggaaccggttcttaccggaggaaaagtccacgccgtttgattggggtacttcagattggtttagagatgaagtggagagtaccaactaataatgatggt

SEQ ID NO: 4660 - DNA, 869 bp, Artificial Sequence; identical to SEQ ID NO: 1127
  P15024 (35S::G1730)

SEQ ID NO: 4661 - DNA, 1121 bp, Artificial Sequence
  P15028 (35S::G1740)
attggttcttcttttgcatcattcttacaaaatccccaaaatcattcgaaacccctgagtattctccttaactctaagaaataaatttctgaatggatgcatcgtcttcaccgtctccttccgaggaaagcttgaagcttgagcttgatgatcttcagaaacagctgaacaaaaagctgagattcgaagcatccgtttgttctattcataatcttctccgtgatcactactcttcttcctctccttctctccgcaaacagttctatatagttgtatctcgtgtcgctacggttcttaagacaagatatacagctactggattttgggttgctggactgagtcttttcgaagaggctgagcgacttgtctctgatgcttctgagaagaaacatttgaaatcttgcgttgctcaagctaaggagcagttaagcgaagtagataatcagccaacagagagctcacaaggttatctttttgagggacatcttacggttgatcgtgagccgccacagcctcagtggctagtacagcagaatctcatgtctgctttcgcttctatcgttggtggtgaatcctctaatggtcctactgaaaacactattggggaaactgctaacttgatgcaagaacttatcaatggtcttgacatgatcattccagatatactagatgatggtggaccaccaagagctccaccggcaagtaaagaagttgtagagaaactcccagtcattattttcaccgaggaattgcttaaaaagtttggagcagaggcagaatgttgcatctgcaaggagaatctagttattggcgacaagatgcaggaattgccatgcaagcacacatttcaccctccttgcctaaagccttggctggacgagcataactcttgccctatatgccgccatgaattaccaacagacgatcagaaatacgaaaactggaaagagagagagaaagaggccgaagaagagaggaagggcgcagagaatgctgtccgcggaggtgaatatatgtacgtttaaatttcaatcagttatggcacactcccattgtctttccttgaaacatctccgaattgttgttcatcattcacaattataaatcccattttacatata

SEQ ID NO: 4662 - DNA, 515 bp, Artificial Sequence
  P15030 (35S::G2226)
tatcgaatccaacaagtgaaagatgggtctatcaagtcttcctggtccatcagaaggaatgttatgtgtgatattagttaatacagcattatcgatctccattgtcaaaggcattgtaagatcattccttggcatagtaggaatcagtctctcgccgtcttcatcctcgccttcttcggtgacggtatcttcagagaattcatcaacttcagagtcatttgatttccgggtctgccaaccagagagttaccttgaggagttcaggaaccggactccgacactgaggtttgagagcttgtgcaggtgcaagaaacaggcagacaatgagtgttctgtgtgtttgtcgaaattccaaggggattcagagatcaacaagctcaagtgcggccatttgtttcacaaaacatgcttggagaaatggatagactattggaacatcacttgcccattgtgtaggactcctcttgttgttgtgccagaagaccatcagctttcttctaatgtttggtgactgc

SEQ ID NO: 4663 - DNA, 1333 bp, Artificial Sequence
  P15033 (35S::G2312)
gttcagaaatcttcggtggacggataacttgcagagttctgattgaggctggttttgtgagaattatagttgcagcaagaaagcgtttcagatattttttaatggccgctgaggatcgaagtgaggaactaagcagcaatgtagaaaatggaagttgcaattccaatgaaggaattaatcctgaaaccagcagtcattggattgaaaacgttgtcaaggttaggaaaccgtacacagtaactaagcagagagagaagtggagtgaggaagagcatgataggtttcttgaagctatcaagctttatggtcgtggttggcgtcaaatccaagaacacataggtacaaaaaccgctgtacagatacgaagccatgctcaaaagttcttctccaagatggctcaggaagctgacagtagaagtgaaggatcggttaaagcgattgtgatcccgcctcctcgtccaaagagaaaaccggcacatccttatcctcggaaatcgcctgttccatatactcagtctcctccaccaaatttgtcagctatggagaaaggaaccaagtctccaacctcagtgttatcatcgtttggttcagaggatcaagtcaatagatgctcttcgcctaattcgtgtaccagtgacatccaatccattggtgcaacttccattgataaaaagaataactacacaacatccaagcaacctttcaaagatgattctgacattggttcaacacccatttcaagcattactcttttcgggaagattgtccttgtcgcggaagaatctcacaaaccatcctcttacaatgatgatgatcttaaacaaatgacgtgtcaggagaatcactactcagggatgctagttgacactaatttatctcttggtgtatgggaaacgttttgtactggttctaatgcatttggctcggttacagaagcatctgagaacttggagaaaagtgcagagccgataagttcttcatggaaacggttaagctccttagaaaaacaaggatcttgtaatcctgtaaatgcaagtgggttcaggccatacaagagatgcctatcagaaagagaagtaacatcatcattgacgctggtagcttcagatgaaaagaaaagccaaagagcacgtatatgctagttttagccattgtacagtttggagtcaattttgatgatccgtgaacattgttttagccatttgctgggtgacttggatcatagcattccacgaaccaaatcctaaatccgagttggtaagtggttttacttgtccgccacatgtaattcttgtaatgaagtttctcctgctgtctcacgttaagaagacac

SEQ ID NO: 4664 - DNA, 1431 bp, Artificial Sequence
  P15034 (35S::G2575)
cttgatcacccaaagtccacatataacctaacacctaagtttgaagaaccaaatctcttcctcttcttctctttctcctcttcttcaatggatgatcatgttgagcacaattataacacatctttagaagaagtacacttcaagagcttaagtgattgcttacaaagctcattagtaatggattataactcactagagaaggtcttcaaattctcaccttatagttccccttttcaatcggtttcaccgtcagtaaacaacccttacttaaatctcacttcgaattctccggtggtctcatcttcctccaatgaaggcgagcctaaagagaacaccaacgataagagtgaccaaatggaggataacgaaggcgacctacatggtgttggtgaaagctccaagcaactgtgagtttttttcaaccttttacttttctttcggagttcctcacatatttttgttctttatggactagatgtcctgaaacaaaatttagactatataattaacgtgaagcttataaaaatcaacaatcacttgccaacatagaacgtggaaacccttgagattgatatgctttagatggatgggtatggtcaggacaaaacaaggtaaaaagaaaggagagaagaaagagagagaagttagggttgcatttatgaccaaaagcgagattgatcatcttgaagatggttatagatggcgaaaatatggacaaaaagcagtgaagaacagcccttatccaaggttcatttattcactacactctattcaaatccacacatttataagttacagatatatatatcataatggttttgtaagaaaataaagtgtatattatcataatatcataatttgtttatgcgttttcaggagttactataggtgcacaacacagaagtgtaacgtgaagaaacgtgtagagagatcgtttcaagatccgtcgatcgtaattacaacctacgaaggaaaacacaaccatccgatcccatcgacgttgagaggaaccgtggcagctgaacatctactagtccaccgtggtggtggaggcagtttactccatagcttccctcgtcaccatcaagattttctcatgatgaaacattctccggccaattatcaatcggtgggatctctgtcgtacgaacatggccatgggacctctagttacaattttaataataatcaaccagttgttgactatggtcttcttcaggacattgttccttcaatgttctccaagaacgagtcttgagagaggggtatgtacgtactatagatcgtatcgttatggttgcattatataagcataaatcatttgtactatatgtatgtaagtagattcttaggtaatgtatttattcatatctatacatgcatgttaatttatatatatttcactgacacactggcactgctactaatcat

SEQ ID NO: 4665 - DNA, 713 bp, Artificial Sequence; identical to SEQ ID NO: 4609
  P15038 (35S::G1274)

SEQ ID NO: 4666 - DNA, 1205 bp, Artificial Sequence
  P15040 (35S::G2579)
acttactcatcataagatatctttaaccaaaaccctaaaagaaacctcctttcaaaaaaaccatttcttcatcatcatgtcaacctccaaaaccctagaccataataaaccatttgaaacatcccaaacgcaaatgggttttgctctgatccaccaaaacacatccgccaacacaaccaccaccaccacaaccggcgagagacgaggccggagatcaaagcaagcggagccagggaggttcctaggagtccggagacgtccatggggtcgttacgcagccgagataagagatccaaccaccaaagaacgtcactggctaggcactttcgacacagctcacgaagctgctcttgcctacgatagagctgctctttcaatgagaggtactcaagctcgaaccaacttcgtctacactccaactgatgtccacaccatcctcacaaaccctaatctccactctctcattgtctctccttacaataacaaccaatctttcttaccaaactcttctccacagtttgtcatcgatcatcatcctcattatcaaaactatcatcaaccacaacaacctaaacacactctcccccaaactgtcttacccgcggcttctttcaaaacgccagttcgtcatcaaagcgtggatattcaagcgtttggtaatagtcctcaaaactcatcttctaacggctcgttatcttcttcactagacgaagaaaacaacttcttcttctctttaacaagcgaagaacataataagtccaataacaactcgggttacttggattgcattgtcccaaaccactgccttaaaccacctccggaggccaccaccacccaaaatcaagccggagctagtttcacaactccggtagcaagcaaagcctctgaaccatatggagggtttagtaatagctacttcgaagatggtgagatgatgatgatgaatcatcatgagtttggttcgtgtgatctctctgccatgatcacgaactatggtgctgctgccgcttcaatgtcaatggaagattacgggatgatggagccgcaagatttatcttcttcttctatcgctgcttttggagatgtcgttgcagacactacaggcttctactcagtcttttagaacattctatattatatatgttttttatatatgcaataatattattagtatttacgttattcgatggtcgtttgattgttgt

SEQ ID NO: 4667 - DNA, 1765 bp, Artificial Sequence
  P15043 (35S::G2682)
ttgtgtggcgactataatgtgtcaaggaccgatatgacaggaaacgcagattccggcaaaatcgcgacagagaaagaccctaggaagctcgttttcaccaaattggaggtatctcccgtcttccgagaatctcctgttaaagaacttcctctttttcctccgatttctcggtattgttccagtttctctgccaattttcactagagatgcttctcgtttgagtaatttcaatccaaaatctactctctgatctccactggtcttgattttgaagcagagagcattcagaagcaaaggataagacagatgaagaaggcattacttcgaggaaacacaaaggatgtcgatgcaagcagtccaaatgtttaaagttgtaagttcatttcaggatccaagaattacttagtgttaagctgatagagatttgagtataatgttgaatagtgagatttctattatctgctgtagattgatgcattattggatatttgtttgacgcttggttattaggtactgtgactgttttgcatcaggagtggtatgtacagactgtgattgtgttgattgtcataacaactctgagaaatgtgatgctagagaagcagctatggtgaatgtactaggtcgcaacccaaatgccttcagtgaaaaggctttaggtagcctaactgataatcaggtatgttcttgacacctatcacttttgtaggttaagcttcaaagaggtatatttcacatcctttttcatttgtaagtatctgggatgttctgtgttttgtattgtagtgtaaggctgcacctgatactaaacctggactgctttcgagaggctgcaaatgtaaaagaaccaggtgtttgaagaagtactgtgagtgctttcaggctaatcttctgtgctcagacaactgtaaatgcatcaactgcaagaatgttagtgaagcgttccagcctcctgcattttctgctcacaattccccacaagtataccggaggagaagagaccgagagctaactgaggcaagtgaaatatactacttgcttcataacatatatgcacttttgggtttatctccataaaactcatttttctgtccggaatagcagtggaattcttgtccagctccgttattttcgatacctgacaattccattcaaaatgctctgggttcccctatgtcttgctctcctaaacttccttacaggttcgattttgcatttcctaaaatgatagttcatcttccttcacctcataatcataaatattttaactgaattttcattgtgctactagaaagaaaaggtccctcatgggatacacctctacacttcttccggacttgggagatttatgctcacttctcgttgcagcgtcagaatctgctacaacaactgcaggtatatctgtagtctcttacaaaatctacactttactggatctactattcctttggcttcatcaacatacttcctttaaaatctcacttagaggaccagaacaggatatttacaaagcctgatgataaggaagccattgagctgtcaagtgagtctgagagtcgtaatgtggaagaagaaatacaatcacgtggaagattgatcgaactgatagatgttcaatacaatggagaagaggattcccaatgtaagaccaagacaagtgtcaatgaaacagatatatacatggagcaggaaagggcagtgcttgaaactttcagagactgtctccaaaagttcatcaaatcgagactggaatcataacaggtaa

SEQ ID NO: 4668 - DNA, 1436 bp, Artificial Sequence; identical to SEQ ID NO: 4610
  P15046 (35S::G3086)

SEQ ID NO: 4669 - DNA, 1828 bp, Artificial Sequence
  P15051 (35S::G1510)
tgccgtctatgatctctctcaatctctcatcttagctttctttctctctctctttgtgtcttcatttgtttatctcatcaatggattcaaattttcattactcgatagatcttaacgaagatcaaaaccatcacgaacaaccctttttctatcctcttggatcctcttcctcgcttcatcatcatcatcatcatcatcatcatcaagtcccttctaattcttcatcttcttcttcgtccatttcatcgctctcctcttacctccctttcttgatcaactctcaagaagatcaacatgttgcctacaacaacacttatcacgctgatcatctccatctttctcaacccctcaaggtaaatttacaattacatatcaaccttaagtgtgtgtgtataaatgttattcttgtacgatcgttctttttagtttagcagttaaaatcatgcctgatcatgtaaaattcatacaataatattagtttctgaatttgtatgtcgagaattctatatagacgaaatttaatttatcaaataaaaaggagggatcttaagaagccatatcattatattattatgtacaattccatctgttgttgattataaaccttgatcggtgatatatatataccaggccaagatgtttgtggctaacggtggatcatcagcatgcgatcacatggtgccaaagaaggagacaagactgaaactaacgataaggaaaaaagatcacgaagaccaaccccatcctcttcatcaaaacccgacaaaacccgattcagactccgacaagtggttgatgtccccaaagatgcggttgatcaagaaaacaatcaccaacaataaacagctcattgatcagactaataataataatcataaagaaagtgatcactaccctttgaatcataagactaatttcgacgaggatcaccatgaagatcttaatttcaagaacgtcttgaccaggaagaccacggccgcgaccaccgagaatcgctacaatacaatcaacgagaacggttatagtaataacaatggcgtgattagggtttgttcggattgtaacaccaccaagactcctctttggcgaagtggacctcgaggtcccaaggtagattaatcacacttacttcaatcgaaattgtcttgatatatgtcatactatctatatctacctagtttagttcacatttttaaaattaatagttatatttcaagaatgtagatatttaatttatttaaacctgatacatcctttaaacattaatactttaatcaatgatactcataagtccaacattctatgattttttttttgtcatctacagttcgcatactaattttcatttatcattgcagtctctttgtaacgcatgtggtatacggcaaagaaaggcaaggcgagccgctatggccgcggccgctgcagccggcgaccaagaggtggcggtagcgccccgagtgcaacaattaccgctgaaaaagaagttgcaaaataaaaaaaagagatcaaacggaggggaaaaatacaatcactctcctccaatggtggccaaggccaaaaagtgcaagatcaaagaggaagaggagaaggaaatggaagcggaaacggttgccggagattcagagatcagcaaatctacaacttcttctaattcttcgatttcgtcaaacaaattttgcttcgatgatttgacaataatgttgagcaaaagctcagcttatcaacaagtgttcccacaagatgagaaggaggctgctgttttgctcatggctctgtcgtatggaatggttcacggttgatcagatcatcacaatatcctcattac

SEQ ID NO: 4670 - DNA, 1455 bp, Artificial Sequence
  P15056 (35S::G2679)
agaagaagaagagagagctattcaagcttaaagcataaaacaatctctgctccttatatagttcttcactatggaagatttgagtaatcagaatctcctcccgcgtcaatcagatatctccatccctgcggagaagatggattcgtttcaaaagtcgctagaacctccgccgtgttctccggtgaaatcttctcaacaatcagaaacggaagtcacaccgcctcagaaaccaccgcttcaccaatttggtcacaaccaagttcagaagaatcgagtgagcaatcaagatccatcgacctcacgaagacataatgaagttgaatcgaaagagaatactccaaataaacaacaaaaacattgcaattgcaaaaactcaaagtgtttgaaactgtattgtgaatgctttgcttctggatcttattgtaatggttgtaactgtgtgaattgtcacaacaaattggagaatgagtcttcgagacaagtagctatctcggggatcttagagcgtaaccctgatgcgtttaagcccaagattgctggtagtcctcatggaatgaaagatttgcaggagaatgtgcagcaagtgttgcttattggaaagcacagcaaaggatgccactgcaggaaatcaggatgtctcaagaagtactgtgagtgttaccaggcgaatattctatgttcggagaattgtagatgtcaagactgcaagaactttgaaggaagcgaagaaagaaaagctcttcttcatggatctcaggtctcggatacctacatacaacagatgaccaatgcggctgttaaccgtgccatcgacatgtctgcttatctgtaccctcctgaatcaagaaagagaaagagcaaggacatttcagattctgtagtttcatcatacggtgtccaataccagagggcaaaccacgttagaagaaatggtgaaaattctctattttcactccctaacaacaaggccgtgtccggatctaccacaagtgcttacaggtcttcttggtcaaatacattccaaccacatcatgtcagagagctatgttcacttttggtctcaaactcggtgatgtagcaaataaattgtcagacaaagggaggaagaacgacaaaggcccttcttcacttgatggagcccaaagagttgctaatgagatcaatgactcaccagattgtgtccttgatgctaatagaatggacgagaagcctatatctcccgcaacacgtgcattgatgtgtgacgaagaacatgagatcgggtcagagaaagagacatcggcccgagtgaaaacaagccaagagaaagaagacacagacacaagctcggggatttacttagagcaagaaagacagatattgtcaatcttcagggactatctcattcagctctcaaaccgtgcgaggataaatggtaaaaatatcaaaagcaacacaaatccaagttgaaagaaa

SEQ ID NO: 4671 - DNA, 1309 bp, Artificial Sequence
  P15063 (35S::G2227)
aacctctctgtcattactctggtcagcgattcttctttcttcttcttctcagatcctttcaccgagtaagaagattttaaagatgccgtcaacgccgacgacgccgactacaacaacgccgatcacggcttcgtattggtgttacagctgtacgcgtttcgtcagcgtttgggctgatcaaggcacaacaaccgtcggtagcgtcgcttgccctcactgcgacggcggttttatcgaacagattaacgattcttcctccgccgctaccgaattaacgattccggcttctactgaagtaagatcgatcaataacaaccgtagatccgtgattagacgccggagatccggtcgtcgtccgtcctttaatccggtcatcgtacttcaaggaggcgccggcgagagagaagagggagaagaaggagatgcggctagagatcgacgcgcttttgagttttattacgatgacggatccggatcgggtcttagaccgcttccggattctgtatctgagatcttgatgggatctggattcgagcggttacttgaacagctaagccaaatcgaagcgtcggctactggaattggtagatctggaaaccctccggcgtctaaatcggcgattgagtctttacctagagtcgaaatctcggattgccacataggctcggaggctaattgcgctgtttgcacggagattttcgagacggagacggaggcgcgtgagatgccgtgtaaacaccttttccacgacgattgcatcgtaccgtggctatcgattcgaaactcttgtcccgtgtgcagattcgagctaccttcagagcctaatcgacggagcaacaacaacgaggaggataacgccgtggggatgacgatttggagacttcccggtggtggattcgccgtagggaggtttaacgcagcaatgagagacggagagagagttttgccagtggtgttaacagaaatggatggtggtgggattggtaatagccaggatggtcctagacggatctcatgggttaggtcacacggtacactcgaatcggatagtaacggtactggctcaggttccggctccggtggaagattgaggaggatggttcgtggaatggtgtcgttaatgaggagagtgagaccaaaccgtagctcttcttcttcatcagctgcgatatcaacttcttctgataatctggatttgaacattgaagtagaatctagggttttggataggtcaaattcagtgatgagaagatacttcagaagaaacagaagtaacagggattcttcgtcttcagttcttcattgattc

SEQ ID NO: 4672 - DNA, 679 bp, Artificial Sequence
  P15069 (35S::G2251)
tcacccattctccaccttatcatcacaatccaaaactctctctctctctctctctgtctcttgtcttatcatttatctctctaacggcgaggcaatgggttttccggtgggatattctgagctacttctcccaaaaatctttttctacttgttatctttcttaggtttgatacgtaaactcatctccacaatgttcaagatcattggtctaccagatttcttagaacctgaaccggtttcaacctcatggcccgacccaccacccacgttgaccaaacctgactcagcagcaatactagccggagagatgttaccggttgttcgattctcggatataaaccgaccggaatccgagtgttgcgcagtgtgtctctacgatttcgagaacgacgacgagatccgacggctgacgaattgtcgacatatatttcatcggggatgtttggaccgttggatgatgggttataatcagatgacgtgtccactttgtcgtacacagtttatacctgatcatcttcaactggagtttaatcaaaggctctggtctcaatcttctgctgtttcttctcaacttcttgatgaatcatcatcttaggacgtattaaatctttgtcccaaccaaaaaaaaagacatattaaatcctttttttttggtactttcattgggaattgggtttgg

SEQ ID NO: 4673 - DNA, 680 bp, Artificial Sequence
  P15071 (35S::G2261)
caacaacaaaacctcttactcactccaatggctcgccttctctttcgtcttctcgtagaatccaacactccgtctccggcgattgataactccaccgccgcgttgaattctgatctcgtcgtcatcctcgctgctctcctctgcgccttgatttgcgttctcggcttaatcgccgtttctcgatgtgtctggctccgtcgtctcgcagccggaaacagaacagtctccggatctcaaactcaatctcctcaacctccggtggcagcggcgaacaaaggcctgaagaagaaagtccttcaatctctcccgaagcttacgttctcgccagagtcacctgagtcggagaaattcgcagagtgcgcgatctgtctagctgaattctctgccggcgacgagctccgagttttaccgcagtgtggtcacgggttccacgtggcttgcattgacacgtggctaggatctcactcgtcttgcccttcttgccgtcagatcttggttgttgccaggtgtcacaagtgtggaggtttacccggtagctctagctccggacttgaatccgaacccgaaatcgagatccgaatcaagcaaggcgaagatgaccccaactccttcttgccataatcattttagtttcccatttatttattagaaaactctataatttaatgcagatcatttta

SEQ ID NO: 4674 - DNA, 689 bp, Artificial Sequence
  P15073 (35S::G2269)
acgccaatcccacatggccctaacctctttcttcaccatcaaatgtcaaccgccaccctcgtcgtcttccctcctccacctcctgtccctatccctacctatataactagcctcggccttggctactccatagccatagctctaggtttcctcgttcttatctccacaatcattctctcttcttacatctgttgccgcgcctcacgcctccgcttctctgcctccgccgcaaacgcaaacgcaaacgcatcgtttagcgaccgtggcgttatcgtcccaagaatcatattcgtagctgaagacgacgatcttgagtctggaaacgtcgtcgttggaggtcttgatcattcagtcatcaactcttaccctaaattccatttcactaaagatatcaccgccgtagtaaacggtgatgggtttcacgacggagaaggaagagagacgacgtgttcgatctgtttatgtgagtacatggaagaagagatgttaaggatgatgcctgagtgtaaacactacttccatgtttattgtcttgacgcttggcttaagctcaatggttcttgtcccgtttgtcggaattctccacttccgacgccgcaatctacgccgcagtcaactcctttgtcggaagttgtgccgttgtctcaatacgccgccgatcggaggagatccagaagataaaacatttc

SEQ ID NO: 4675 - DNA, 1376 bp, Artificial Sequence
  P15077 (35S::G2394)
gcggttgtgtgttacgagagctagagttgaatttgctttggtcaacacaatggggacttgtggttgctgacttttgtgattttcagttttctacttggatttagatggatgtttcttccattgtgcgaaatacaaccctaactgatcaagatcctttgttaatggaccacggtaaccgcgagcacatcgttgacattacaagcaatgacgaggaggactcttcatcaagatcttctctcgatgagcttactcctcaaggtaactcacatcaaggtgaagagacagtattatcatcatcaaatgctacacaacaacacccaactcatccatctcctcctcagcaaagaccaacttcttctaggagaggagataacgggaatggtcgccgtactaggagtccattgaattctggcctctggatctcagttgagttagttgtcactgtcgctcagattgttgcagccattgtagttatggttctggctaaagatgaacatcctgaagcgccattatttacttgggttattggatatacttgtggctgtctagccactctccctattctctattggcgttttcgcacttataatcgagctacagggcaagactcttcacaacgtgctacctcttctcaaggcaatagtgagtccacaccatatacagcagtctcagttgctcaagcagcagatgaagaaaatagcactggcgtgagtgcagcacctagaaacaatcaagttggggaaagcttaagaacaaggctcaacgggctagtggaccacttcaagatggcgattgattgtttctttgcggtgtggtttgttgtggggaatgtatggatatttggaggtcactcatctccttctgattctcctaaactgtacaggttatgcatagcgttccttactttcagttgcattggatatgcaatgccattcatactatgtgcaaccatatgttgttgtttgccttgcttaatctcggttctcggatttcgagagaacttctcacaaactagaggagccactgccgaggccatcaacgcattgcctgtctacaggttcaaatcaaaaagtagaaatgatttggagttttcagaagaaggtgaaggtggatttcttctcttggggtctcagaagaaacgtcttatatcaggcgaggatgccagctgttgcatctgcttgactagatatggagacgacgaacaagttagagagctgccatgctcacatgtcttccatgtagactgtgtagacaaatggcttaaaatcaatgcgacttgccctctctgcaaaaatgaggttggagaaagcagcagtgcttcctcatagacaaaagctgagttgatcgcaactgtttggaatttgggatccatagtc

SEQ ID NO: 4676 - DNA, 866 bp, Artificial Sequence
  P15088 (35S::G1840)
gatccttcgcattcactaaataagtacatattatcagtttgacaccaaaaaaatggattattcagaaaatgttcaaaacaaaaatttcacccctatttcacaacctcctaacttgacaagagaccaagaacatgctatcatggtttctactttgcgacaagtgatatccaacactggaggtgatacgtcatcatctcactacattgctgcaagtgaggctcttccaccttcggacgctggcccttgtcctctttgcggcgtcaccagttgctacgggtgcgcattcccacagcatgaagagattaagcaggagaagaagcataaaggagtgaggaagaagccatcaggtaagtaaattttgttccaacatctttgagtttgttccatcggtttataactttactaagttattatcaggaaaatggtcggcggaaatatgggatccgagtacaagaacaaggaggtggcttggaacgtttccgacggcagagatggcagcggatgcttacgatgaggcagcggctgcgcttgtcgaaaaaagatcagcgagacgtggctcaaagaagggagaaggaagcattcaccaagaagtcggcggcggagatgactgagaaattaagctatataactatatatcgttttatagggggaaaaatagatgttttgggagaaattaatacattacctagatgggttatatgttttacgagaaaccacttgcgtgtgttttttttttaataagaggttttcaaattaaagttttgatggaaaaaaagttagatagagcccaaaaagttttgagtaaaagacctctattttattggagagtcttctcctctgtagtggcctttaacatttgcattgtg

SEQ ID NO: 4677 - DNA, 590 bp, Artificial Sequence; identical to SEQ ID NO: 1523
  P15094 (35S::G2457)

SEQ ID NO: 4678 - DNA, 1684 bp, Artificial Sequence
  P15096 (35S::G2525)
gctctgaagtcgaagcaaagttaattacagagagagagaaaggatggagagagaactcagacgaccgaacccaatcaacagctctcgccggccggagatattttcttcaggcggtagtagtactcaactaccggaaagcccacgaggcccaatggagttcttgtctagatcctggagtgtctctgccttggaagtctccagagctctccacaccgccaaatcagcttcagccaccaacaggcctccctcatccattaacactccgataccggaagaaacgctaaaccctgagaaagaagaatgtccgccggagaacagtactagtgttagtagccagttctcgttcgctgcctcggccacttcacagcttgttcttgagcgcataatgtctcaatcggaggtgtcaccgttaacgtcggggaggctatcacacagcagcggcccactcaacggcggcggttcttttacggagacagacagtcctcctatctccccttccgatgaattcgacgacgtcatcaagtattttcgcacccacaacaccatacatcctctcttctccggcacaggaggcagccgtggtaccaccggaaatgggagcaatacccccatggctggaaccggtccaaagacagttggtaggtggctcaaggaccgtaaggaaaagaagaaagaagagactaggactcagaatgcacaggttcacgcagctgtttctgttgcagcggttgcatctgctgtggcagctgtagcagcagccacagcagcttcttcccctggtaagaacgagcagatggccagaatcgatatggccatggcttcagcggctgctctggtggctgctcagtgtgtggaggctgcagaaatcatgggagcagatagggatcatttgacatccgtggtgagctctgccgtgaatgttaagtcccatgacgatattgtcacccttactgcagctgctgcaacagctctgcgaggagcagctacactcaaggcaagagcgcttaaggaagtatggaacatagctgcagtattgccagccgagaaaggggcaagttcagcgttgtgtggacaggttgacacaaagcatagtgatagcagctttagtggagaattacctgtggctggggaagacttccttggcgtctgtaaccaggaattactagctaaaggcactgagctcctcaaacgaactcgtggaggtgaactccactggaagattgtctctgtctacatcaacaaagcaggccaagctgtgctgaaaatgaaaagtaaacacgttggagggaccttcacaaagaagaagaaacatatggtgcttgaagtgagaaaggatatacctgcatgggctggcagagatcttttcaacggagacaagcatcactactttggcttaaagacagaaacaaagagggtcattgaatttgagtgcagaaaccaaagggaatacgagatatggactcagggcgtatccaggctacttgccattgctgctgagaagaagcagaaaagttccatgtccaaatggatggcaccttaacaacataagctaggaaagaagtagatgctttgtagaacgaactgcttatgataagaataggtttaaacataatggagtagaagacattcccttttgtaatatccttttattcaattgagtgaacagagatgacttctaaagcta

SEQ ID NO: 4679 - DNA, 1136 bp, Artificial Sequence
  P15106 (35S::G2847)
atattctcggttagtagaaactaggaaaagagatgaatagaggagtgttggagagttcgccggttcaacatctcacggcggctggaaaccctaattggtggaataatgtcagccgcggcttgaggccaccaacgccgttgatgagtcacgagccgccgtctaccaccgcttttattccaagtctcttgccaaacttcttctcttctccgacttcctcttcatcttcttcaccttctttccctcctcctaatagtaaccctaacttctcttcttggcttgaaatgagtgatctgcctcttgatcagccatggagccttagtcaactcctcttgggtggattgatgatgggagaggaagagaaaatggagatgatgaaccatcatcatcatcaaaatcaacaccaaagttaccaagcgaagaggatacaaaattgggaagaacaagttttgaggcaccaagcttccatgaaacaagagagtagtaataataatagttatggaataatgtcctcaccaaactcacctccaaacaaatcttgtgctacaattatcaacaccaatgaagacaacaacaataacattcacagtggtcttaacttgtccgagtgtaatagctcagagatgattgggtcttcttttgctaataagaaaccaaaacttcaagttccttcatcacaatcaactctcaaggtgagaaaggagaaacttggaggcagaatagcatctcttcaccagctagtatctccctttggcaagactgacacagcctctgtcttgtcggaggctattggatacattagattcctccacagtcaaattgaggctttaagtctaccatactttggtactccctcgaggaacaatatgatgcaccaacatgcacaaagaaatatgaatggtatatttcctgaggaccctggtcagcttgtgaatgagtattgcatgaaaagaggagtttcattgtcatcgacggacaatcaaaaatcaaatcctaacgaagaaccgatgaaagatttgagaagtagagggctttgtcttgttcccatctcatgcacactacaagttggcagcgacaatggtgccgactattgggctccggcgttcggaaccactctccagtgaactattcactttctg

SEQ ID NO: 4680 - DNA, 625 bp, Artificial Sequence
  P15113 (35S::G3002)
aaacaaagtctctctcttctaattagagagccaagaagatgcagagtacttgtgtctacagagaatgcatgcgcaaccacgccgcgaagctcggctcttacgccatcgatggctgccgtgaatactctcaaccatccaccggcgatctctgcgtcgcctgtggttgccaccgcagctaccaccgtcgtatagacgtcatatcttctcctcaaatcaatcacacgcgcttcccgttcacgagcttaaggcgcgtgaagcagctggcgaggctgaaatggaaaacggctgaggaaagaaatgaggaggaggaggatgacacggaggagacttcgacggaagagaagatgacggtgcagaggcggaggaagtcaaagttcacggcggagcagagagaggcgatgaaagattacgcggcgaagttgggatggacgttgaaggataagagagcgcttagagaagagataagagtcttctgtgaagggattggtgttactcgttatcattttaaaacttgggttaacaataataaaaagttttatcactaactaattaactaatatccttaattgagataatactataatttagttccaatttcattttcatcccttctgtgttaatttct

SEQ ID NO: 4681 - DNA, 1576 bp, Artificial Sequence
  P15148 (35S::G2784)
tctcaaagtcataatcttcgaatccaaaaacaaaaaaaaacaatggaactatcattagcattaacatcaacagaccataatccatcgccttcagaggcacatccagatactatggactttctgtctcgagaatggtgtaatttcgctgttcaatcacttcatccagaccctatcctctacgatcgttccattgttcccgtcgagacatcgatcgccaagtttcaaggcgactcaagtcctgtttcttgtgctgtaagtaaccagagattgttttttgttatattttcttcaattttgttggttagtgtttaatttatgatgattgtaaaagtagatgatggatacgagcatgaagatggacgatccagattttaagccctcgatgccttcatggaaaaccaatgatgtgaaggtataacaaattaggtgtgcaaaatatagtttttaaaataacaaaaatcacagtaacgtttaacattatgatatcatagttttcaacatatattcctcatttttatgttgtctatgtttatttgatgcacattcgaatgaaaattcggtatatatatgatttaaattgtaatacgacagcatattggaattgtagaaattgaaaataaaactgctacatgatagaatgacatatacaattaagtgaagaaagttaagagattaaatattgatactataatttgttgaatgatgtgaacagtcatggatatggatgcaacaagcaatgcacccggaattgagctacgaaggctttttccgcaagaaacttgtaaaacccttttggccatttcgtttggttttgatttatcaaatcaacaatattggttttctaaaccaaaacaataatggttttgtagaaacttccatggaaaattacgccgtcgataaagaaatggtggaaagagataaaggcgaaacgaaaggaagaagtgaggctacagagagctgaagtccacgccgccgtgtcattggctggtcttgccgctgctctcgccgccgtggcttcagagaacgctggaaaagatggtggaaacggtcgacctagcacgagggagactgctgtggcttctgctgcggctgtggtggcggcacaatgtgcgcaaatggcagagacaatgggagcaaacagagaccagctcagcacgatgattggttcagccatgaccgggacaagtgttagtgagatactcactctcactgcctcagctacaacttgtaagaagattgttttttgtttttgtttctataagaatgctctgtttctgagacattggtgcttggtaaaataagcgttgagaggtgccgcgacgctgaaagcaagaagaggttgcaagattaatagattgaatggctctgcacctgtgttgcctattgaagactcttcttatttgcctcctgaattcgataagaacacatctgttcttgctaagggaacagatctcttcgtcgagacaccagatggtatataaatcctctgtttttcttgttgaactcctttgttttgtagagagactaaagagatctttggattaaaacaggggatttcaaggctaggacggtttct

SEQ ID NO: 4682 - DNA, 950 bp, Artificial Sequence
  P15154 (35S::G131)
tatttatatgtatgtggcaaactgtttttattgttgacgattacaaatatatatatggaaatgcttcatgcggcgaagcagccaaggttgcagttgtaaacgggttcaagagtcagttcgagatcattcctcctcattgccataggatcatcttcttgatacagaccacccatgttgagaaaaggagatggctgatgagagagcatgtaaggatgctggatttggtgctgctgcggtggcagagggggaggcatattgtggccttggttctgctgatcccactgctcctgttgagccctaagaattttttccctctccttgatctgtttagaaagcatgctgttttgctcctgtatggccttctcctttttttggagctcattgatggactcgtacataagttggttttttctagtgcggatgtgcttaagagcagtgtcaagctgctgctccagattctgaagctctttagggctcattgcttgcaagtcttccccaagataatgcctctggtttctctccaaaagctcaatcttagccttaagcctgttatactccatcgaccagtctgtattgacgtcggactcaggtgcaataagctgtctttcggcgtaagagtacctctcatagcgttcaagtatcttctccatacaagaatcagtggagtattcgaagagttttcccttatgggagaagacaacaagagcaacttcagcatcacagagaacagagatctcatgagctttcttcaaaagaccagctcttcttttcgagaatgtcacttgtctattgatcttgttctctatcctcttcaattgaaccctaccccttcccatttttgatccttttttaagaaacttcttactctaaaagaaccaaacaaaacaaagacccccaataagaaactacaagagagatataaagaagagctcagactttggtatgaacca

SEQ ID NO: 4683 - DNA, 869 bp, Artificial Sequence; identical to SEQ ID NO: 517
  P15159 (35S::G651)

SEQ ID NO: 4684 - DNA, 1121 bp, Artificial Sequence
  P15160 (35S::G811)
gagaaagagagagatggaggacgacaatagtaacaacaacaacaacaacaacgtgatcgcacctttcatcgtgaaaacatatcagatggtcaatgatccttccaccgattggctcatcacttggggacctgctcacaacagtttcatagtcgttgatccactcgacttctcgcaacgaatcttacctgcttatttcaaacacaacaatttcagcagttttgttcgtcaactcaacacctatgtaagttaattcataaccgaaactcatacatgaaactggaaacaggggattacgaactaatgatcctttctttatttactttaggggtttaggaaagtggatccggaccggtgggagtttgcgaacgagcattttctaaggggacagaagcatttgttgaataacatagcgcgtaggaaacacgcgcgggggatgtacggtcaagatttggaggacggtgagattgtgagggagatcgaacggttaaaagaagagcagagggagctagaggcagagattcagaggatgaaccggaggatcgaagcgacggagaagagaccggagcagatgatggcgtttctttacaaagtcgttgaagatcctgatcttcttccaagaatgatgctcgagaaagaacggacaaagcaacaacaacaagtttccgacaagaagaagcgtcgtgtcacgatgtcgacggtgaagtcagaggaagaagaagtggaagaagatgaagggagggtctttagggttatgtcatcatcaacaccgtcgccgtcatcaacggagaatctttaccggaatcattcaccggatgggtggattgttcctatgacgcaaggacagtttggtagttacgagacgggtttggtggcgaagtcgatgctctcgaattcaacgtcgtcgacgtcatcatctttgacgtcgacgttttctttgccggagagtgttaacggaggaggaggaggaggatgtgggagtattcagggagaaagaaggtataaagaaacggcgacgtttggaggagtggtagagtcaaatccaccaacaacaccgccttatccattttctctgtttcgaggtggcttttagcgtttagcttcacatgatatatgatctttag

SEQ ID NO: 4685 - DNA, 1002 bp, Artificial Sequence
  P15168 (35S::G2958)
gtgccacattgtctcatcactttccgcacttttgttgttaactaactttcataaatagattaagatattaatgtcaccggaggaatacgttagggtttggccggattccggtgatcttggaggaactgagctgaccctagctttgcctggcactccgacaaatgcatcggaaggtccaaaaaagttcgggaacaaacgtagattcctcgagaccgttgatttaaaactcggggaagcacacgagaacaattatatctcaagcatggtcactaagtacggcatatatatattatattaatttcatttatcgttcatataggtcatatgcatgtttgattgatcttcttaatttattgtggttttagtgaccagttggtgggctggccgccggtagcgacagcgaggaaaacagtgaggcggaaatacgtgaaagtggcgttggatggtgcggcctatctcagaaaggttgatcttgggatgtacgattgctatggacagcttttcaccgctctagaaaacatgtttcaggggataataacaatatgtaagtgatcgagataagtaggaaaaaataaagattttgatgtgtttggatggactgacgaagtgaaggatattatggtaaatttacttacacttggggttttggatggtggtaggtagagtgacagagttggagaggaagggagagtttgttgctacttacgaggataaggacggtgacttgatgttagtcggagatgtgccgtggatgtgagttctcggaattaccctttgtgttgcttttacgtacttttccttttttattcaaaactagaatttctgtactattttgttacttacattcatatcaaaactagaattactgtattattctgctgtgaaggaaactaaattttcttgggattgatgatatttaatttgtgtaggatgtttgtggaatcttgcaaacgtatgaggttaatgaaaaccggagatgctattggattataggtctctatt

SEQ ID NO: 4686 - DNA, 2269 bp, Artificial Sequence
  P15182 (35S::G2771)
tcaagctatgaacttccatactttgaatcttctacttctctttcttcctcttacttgatcttcctatagcatacttccatcatgtaagttcctttttgtatttttatttctcttacttgctaaagttttatcttcacattttttgatgattagggttttggtttgagattaggggtgaagatgatatagtggagctcttatggaacggccaagtcgttcgaaccagccaaccacaaagaccttcctcgggtaaaccttctcctactccacccattctgcgtggtagcggaagcggcagcggagaagaaaatgctccccttccacttccacttctacaacctccacgtcccctgcatcatcagaatctcttcattcgggaagaagaaatgtcttcttggcttcactattcttacactggtgtcacgtccacaccggctactcatccgcaaagttctgtttccctgccaccaccaccacccattgctccgtacatttccgttctttttcctttcattctcttactctttgcaatttgacgagtctgatattttagggtttggattttggtttgaaattaggagtgaagatgatgtggtggaactcttatggaaaagcggccaagtcgttcaaagcatccagacacagagacccattcctcctcccattttccgcggcagcggaagtgggggaggtgaagaaactgttctgcctctgcctcccctgcatccgtctcatcaaaatatcttcatccaggaagacgaaatggcctcttggctttaccatcccctccgtcaagattatttttcctctggcgtcgcctctacttcagctactcgcccgcaaagttccgcctctctagcaccaacaccaccaccacccagtgttccctacggtcagattcccgttgagagaaggacagagaattttatgaacttcttgaggctaagagggaacatattttccggcggtagagttgaagctggtccggtggttatagaatcgacgcagataggctcaagcgcgaccccgtcgtcttcagccgctgaatcctgtgtaataccagcgactcacggcaccgagagtagagcggcggccattaccggagtatcccgtacttttgcagttcctggtcttggtcggaggggaaaggaggtggcaaccgagacggccggaacatcatattcaggggtaaacaaggccgaaacagagcgggttcaaatacaaccggagagggagacgaaaattaccgaagataagaagagagaagaaaccattgcagaaatccaagtgagtcacagctaccataggttcacctgttgacacgtgcagtgtagcagtcaaggcttaattttatcttgtttcttggcgtacagggaactgaagaagctcatggttcaacgtctaggaagaggtcacgagctgcagatatgcataacctctccgaaagggttcttatattttactttctaggttttaataatggactctttgtttcgtctctccattaaaacgtagtttgtataattgtttaacagagacggagggaaaggatcaacgagaggatgaaaactctgcaagaactccttcctcgctgcagaaaggtctctctcagttatttataacctgtggctgttaaacataaaaaaagttagattctgatgacatctgtttctattctgatcagactgataaagtttcaatgcttgaagatgttatcgagtacgtgaaatcgctacagctgcaaatacaggcatgtactcaaaaactgaatgtgtgttaaagcaaaacacaaccggaaattaagtgctgtggaatagttgaacatggttatttgagtgctatggaatggttatactctttgtttatcaaccagcgtctctgcattttaaacaaccaattttttagatttgatttctgcagattcatcttggaagggttttaaagtgtcatggaagataaatgcaaatcttataagtcatgttcttgaggtcttactcttctgtattgcttcacacgtttacaggattatgttgaagaatctacagcttataactgagattttaatatatgaatcaatgttgttatgccagatgatgtcgatgggacatggtatgatgccaccgatgatgcatgaggggaatacgcaacagttcatgccccacatggccatggggatgaagggtatgaaccggcctcctcctttcgtaccgttccccggcaaaacttttcctaggccgggtcatatggcgggtgtaggtccatcatatcc

SEQ ID NO: 4687 - DNA, 998 bp, Artificial Sequence; identical to SEQ ID NO: 1713
  P15184 (35S::G2838)

SEQ ID NO: 4688 - DNA, 897 bp, Artificial Sequence
  P15228 (35S::G2779)
gtgtcaagaagatcatatctcaattcattatattatggcaaatttcgagaatctttcttctgattttcagacaatagccatggatatatattcttccataactcaagctgcagatctaaacaacaacaacagtaaccttcattttcaaacatttcatccttcctctacttctctcgaatcgctcttccttcatcatcatcaacaacaattacttcactttcccggaaactctccagacagtagtaacaatttctcttcaacttcaagtttcctccatagtgatcacaacatcgtcgatgagaccaagaagagaaaagctttgttacctactttgtcttcatcagagactagcggcgtctccgataatacgaatgttattgccactgaaacaggttctttgagaagaggtaagaggttgaagaagaagaaggaagaagaagacgagaaagagagagaagttgttcatgtgagagccagaagaggccaagccactgatagccacagcttagcagaacgggttcggcgagggaaaataaacgagagattaagatgcttgcaagatatggtgcccggatgttataaggctatgggaatggctacgatgcttgacgagataattaattatgtccagtctctacagaatcaagtcgagttcctctcgatgaaactcactgcagcaagttcgttttatgactttaactcagagacagatgcagttgattccatgcagagagcaaaggcacgtgagacagtggagatggggagacaaacaagagatgggagtcctgtcttccatttatcaacatggtccctttgacttttgttttctcttttctcttttccttcttttttattgttttcgaaattattcttctatttatttggatgcgatatgtc

SEQ ID NO: 4689 - DNA, 1471 bp, Artificial Sequence
  P15232 (35S::G3008)
gactaacataaacaatggtggaagtcgaagaattggaaccacttagtccaatggacgatgaagaagaagagataagctatgatgacctcaaaagacgcatgtggaaagaccgaaacctcatggaaaaaaagctcaagcaacagaaacgacacagcaacgacgtcgtttcgtttacaacacaccgagccgaagcttcacggcgcaagaagatggctcgttctcaagattcagtgttgaagtacatgatgaagatcatggaggtgtgtaaagctaaaggttttgtatacggaattgtaccggaaaagggtaaaccaataaccggttcttccgatagcttaagacgttggtggaaagaaaacgttcagttcgaccaaaacgctccagacgctatcacagattacttagcactcgcggctgctgctgctgcagcagagctaatcgataagtcctcatcatcctcgagcttattacacatgttacaggaactgcaagacacgacactagggtcgttactatcagcgttaatgcaacattgcatgccgccacagcggcggtttccgttagagaaaggaattgctccgccatggtggccgacggggacggagctttggtggggagaacaaggagcggcacatgagcacggtgcaccgccatatcgaaagccgcacgatttgagaaaatcttggaaagttagtgttctcgcggctgtgattaaacacatgtcgccgaatttgggaagagtgagacgtctggcgagacaatctaaaagtttgcaagataaaatgatggctaaagagactgatacttggtctcgtgtcttaaaccaagaagaagctcttctcaatatcaaagacctcaagatctcggaagatcaggacgatcaagaatcgtcggggtctaagagaaaaagtgagtctatggaaccgtctaagagtgtttacacttgccaaaactcgagttgtcctaaaagtgatgtgagttttggattcggggacaagaactcgaggacgggtcatgagatccagtgtctttatgggtcgaaccaagaaccgagccagagcggtgaatatacatcttccttgcttgaaacggttccaagtattgttactaattcgactagtgaagatgattattacaatgtgagctcgcgtgcactggacaagcgagatgatgatgatcatagcattaatgggaattggatggaatatttctggttagaaaagatgcagcaggagtttcattgctctaggagattcgaagatgatgagggtactggaacggactttgaccaactcacagaatctgatcgatcggacaacgtgaatttgaaccaacttacaaaatctgatcgatcggacaacgtgaaccggagtgctttttcagtttgggacatgggttgcgaggacaaagacatatacatgttcgattaatagttaagctcgttaattagttgctatgctttacatgtacc

SEQ ID NO: 4690 - DNA, 1130 bp, Artificial Sequence
  P15243 (35S::G1412)
tggttgctgaggaatcgaagtagaagagtataaatgggtgttagagagaaagatccgttagcccagttgagtttgccaccaggttttagattttatccgacagatgaagagcttcttgttcagtatctatgtcggaaagttgcaggctatcatttctctctccaggtcatcggagacatcgatctctacaagttcgatccttgggatttgccaagtaaggctttgtttggagagaaggaatggtatttctttagcccaagagatcggaaatatccgaacgggtcaagacccaatagagtagccgggtcgggttattggaaagcaacgggtactgacaaaattatcacggcggatggtcgtcgtgtcgggattaaaaaagctctggtcttttacgccggaaaagctcccaaaggcactaaaaccaactggattatgcacgagtatcgcttaatagaacattctcgtagccatggaagctccaagttggatgattgggtgttgtgtcgaatttacaagaaaacatctggatctcagagacaagctgttactcctgttcaagcttgtcgtgaagagcatagcacgaatgggtcgtcatcgtcttcttcatcacagcttgacgacgttcttgattcgttcccggagataaaagaccagtcttttaatcttcctcggatgaattcgctcaggacgattcttaacgggaactttgattgggctagcttggcaggtcttaatccaattccagagctagctccgaccaatggattaccgagttacggtggttacgatgcgtttcgagcggcggaaggtgaggcggagagtgggcatgtgaatcggcagcagaactcgagcgggttgactcagagtttcgggtacagctcgagtgggtttggtgtttcgggtcaaacattcgagtttaggcaatgagagagatgtgaagttactgatgggtgaaaaaagtaaaaaaaaaacttggagatagtagagtggcaattgatgtaaataatagggatttatatggggcttttaccgattcggtgaggcttaggattccacaaaggaaaaaggctcgactggggactagtttgatccaacttgacggcccccaaatgtgtaatgtttctcaacgg

SEQ ID NO: 4691 - DNA, 778 bp, Artificial Sequence
  P15260 (35S::G153)
tcgctcaattggttttggtgttagtcttttggggagagagatggggagagggaagatagttatacgaaggatcgataactctacaagtagacaagtgactttctccaagagaaggagtggtttgcttaagaaagctaaagagttatcgatcctttgtgatgcagaagttggtgttatcatattctctagcaccggaaagctctacgactacgcaagcaattcaagtatgaaaacaatcattgagcggtacaacagagtaaaagaggagcagcatcaacttctgaatcatgcctcagagataaagttttggcaaagagaggttgcaagtttgcagcagcagctccaatatctacaagaatgccacaggaaactagtgggagaggaactttctggaatgaatgctaacgacctacaaaaccttgaagaccagctagtaacaagtctaaaaggtgttcgtctcaaaaaggatcaacttatgacaaatgaaatcagagaacttaatcgtaagggacaaatcatccaaaaagagaatcacgagctacaaaatattgtagatataatgcgtaaggaaaatattaaattgcaaaagaaggttcatggaagaacaaatgcgattgaaggcaattcaagtgtagatccaataagcaatggaaccacaacatatgcaccaccgcaacttcaactcatacaactacaaccagctcctagagaaaaatcaatcagactagggctacaactttcctagcaaaacatgtgggacatcgaacaatatgcggcc

SEQ ID NO: 4692 - DNA, 954 bp, Artificial Sequence; identical to SEQ ID NO: 4612
  P15277 (35S::G2999)

SEQ ID NO: 4693 - DNA, 2568 bp, Artificial Sequence
  P15340 (35S::G1341)
ttcagacagagagtgagtacttgaagaaatgggttgttgtcagtcaagaatagatagcaaagagatagtgtctcgttgtaaagcaaggaagagatacttgaaacatcttgttaaagctagacaaactctctctgtttctcacgcgctttatctccgttctctacgcgccgttggctcttcccttgttcacttctcttccaaagagactcctcttcacctccaccacaaccctccgtctccttctcctcctcctccaccgccgccgcgccctcctcctcctcctctaagccctggctctgaaaccaccacatggaccaccaccactacttcctctgttcttcctcctcctccgccgccaccacctcctcctcctccgccttcttctacatgggacttctgggatccgtttataccgccgcctccttcttcctctgaggaagaatgggaggaagagacaaccaccgcgacaagaaccgcaacaggaactggctctgatgctgctgtgacgacggctccgacgacagctactcctcaagcttcgtctgttgtgagtggattctctaaagatacaatgacgacgacgacgactggaagtgagctagcagttgtggtgtcgaggaatggtaaagatctaatggagattattaaagaagtcgatgaatatttccttaaagctgcagattctggtgcacctctctcttctctccttgaaatctcaacctctatcactgacttttctggtcattccaaatcaggtaacaacaatcaagctcttgtcttctcttctttgattgattttgattagtgttttgtgtttgtttcttcagggaaaatgtacagtagtagtaactacgaatgtaatctgaatccgacgtcgttttggacaaggggatttgctccttctaagttgagtgaatacagaaacgcaggaggagtaattggaggaaattgcattgttggtagccattcatctacagtggacagactctatgcttgggagaagaaactttatcaagaggtcaaggtattcactttttgacttcatttcattcataaagttgcaatctttgaacaaaacaattaatctttgatgtatcttcatatgttaagttttgtggaaagagtttgaaaatgttgtttatattcagtttgaagtttgaatattgaaattgcttgcttagatttcatccaaatatggataaatgttttgtttttgggaatttggttgattcatgtgggcattaaaggcttgtggtgggtccaagcgtgagcagatagtgtaagagacccacgtgtgtacttaattctgatgaataatgtgttatgtacactggcacaaatatcttgccaagtagtgagtgagtgtttgttgttttttgaatgtgggttttgttgcagtatgcagagagcataaagatggatcatgagaagaaagtggagcaagtgaggaggcttgagatgaagagagctgagtatgtcaagactgagaaggctaagaaagacgtcgagaagttagaatctcagctctcagtatcttcacaagccatccaaagcgcctctaacgagatcatcaagctcagagagaccgagctttaccctcagcttgtcgagcttgttaaagggtttgttttgtgcattcccattgcttcattaacctaaagtatcttatgttggtcaatgtgaacaaggttcttgtatgaatgtaatgtaggctaatgtgtatgtggaggagtatgtacgagagccaccaggttcaaacccatattgtgcagcagcttaagtaccttaacaccatcccctccactgaaccaacatctgagcttcaccgacaatcaactcttcagcttgagctcgaggtccaacaatggcatcactctttctgcaacttggtcaaggcccaacgtgactacatacaatctctcacgggctggctcaggttaagtctgttccagttcagcaagaatccacttgttaggagtagctacgagtcaaagatctacagcttctgcgaggaatggcatttagctattgacaggatccctgataaagtagcatctgaagggatcaaaagctttctgacagcagtccatggaattgtggctcaacaagccgacgagcataagcaaaagaagagaacagaatccatgttaaaagatttcgagaagaaatcggcttcgctgagagcgcttgagagcaagtatagtccatactcggtacctgagagtaggaaaaagaacccggtgatagagaagagagtaaaggttgagatgctaaaaggaaaagcagaagaagagaaaagtaagcatgagaagtcagtgagtgtgactagagccatgactctaaataacttgcagatgggtttccctcatgtctttcaggcaatggttgggttttcaagtgtgtgtatgcaagcctttgagtctgtgtacaaccaagctaagagcatcggtgaggatcaagaggaggttaagaggttgcttccttaaagagagaaagacaaattgttttaccatttgctctctgtttttgcttgatccaagctaatcttttggttgaatgttaggttga

SEQ ID NO: 4694 - DNA, 2632 bp, Artificial Sequence
  P15341 (35S::G15)
ggtgtgttcgttgtgtaaccaatgattgggttttagcttactacttcgagagattataagaaagaaagagtgaagatacattatagaaagaagagaagcagaaaccaaaaaaagaaaccatgaagtctttttgtgataatgatgataataatcatagcaacacgactaatttgttagggttctcattgtcttcaaatatgatgaaaatgggaggtagaggaggtagagaagctatttactcatcttcaacttcttcagctgcaacttcttcttcttctgttccacctcaacttgttgttggtgacaacactagcaactttggtgtttgctatggatctaacccaaatggaggaatctattctcacatgtctgtgatgccactcagatctgatggttctctttgcttaatggaagctctcaacagatcttctcactcgaatcaccatcaaggtcagtagtagtaatgttggagtttttagttttcttggtgttgatgttgttgtgtcttgtttgatgggaacatgtttggttttagggatttatgttttattttttatactaaggacattttctgttttttttggttgttatttagattcatctccaaaggtggaggatttctttgggacccatcacaacaacacaagtcacaaagaagccatggatcttagcttagatagtttattctacaacaccactcatgagcccaacacgactacaaactttcaagagttctttagcttccctcaaaccagaaaccatgaggaagaaactagaaattacgggaatgaccctagtttgacacatggagggtcttttaatgtaggggtatatggggaatttcaacagtcactgagcttatccatgagccctgggtcacaatctagctgcatcactggctctcaccaccaccaacaaaaccaaaaccaaaaccaccaaagccaaaaccaccagcagatctctgaagctcttgtggagacaagcgttgggtttgagacgacgacaatggcggctgcgaagaagaagaggggacaagaggatgttgtagttgttggtcagaaacagattgttcatagaaaatctatcgatacttttggacaacgaacttctcaataccgaggcgttacaaggttgtttttttattttataatattaaactttgtttgactttcgttagtaatgttacatatacttacttaaaaggttatgtgaaacagacatagatggactggtagatatgaagctcatctatgggacaatagtttcaagaaggaaggtcacagtagaaaaggaagacaaggtctagtgcttttttatttaattatcattaagctaaacatagaaactttttaagtagtttatgatttaacgtattactgacatttgagttttattttcttgttttctctatgtgtgataatgatttgatgatcttcttctcagtttatctgggtaagtacacacttcaatcttcatggattcatgatttccccctcaaatttctcgggaaaataatgatggattttgacttctttatttttgtttgattaaatctttattaggaggttatgatatggaggagaaagctgctcgagcatatgatcttgctgcactcaagtactggggtccctctactcacaccaatttctctgtaaatcatcttttctaaactttatgtctctttgaccttgttgtatgatttatttatataatatgataatggatatttgaaggcggagaattatcagaaagagattgaagacatgaagaacatgactagacaagaatatgttgcacatttgagaaggaagagcagtggtttctctaggggtgcttccatctatagaggagtcacaaggtccttttaaattacatttatataactttatataatacatagtttaataatgtgaatattgactttgtgtgagttttttgtactagacatcaccagcatggaaggtggcaagcacggattggtagagtcgctggaaacaaagatctctaccttggaacttttggtaattcatcatgccgatgattttgattgttaaaacttaacattttcaattgcttgtgtcttacgaaatcttttgacactatcataggaacccaagaagaagctgcagaagcttacgatgtagcagcaattaagttccgtggcacaaatgctgtgactaactttgatatcacgaggtacgatgttgatcgtatcatgtctagtaacacactcttgtctggagagttagcgcgaaggaacaacaacagcattgtcgtcaggaatactgaagaccaaaccgctctaaatgctgttgtggaaggtggttccaacaaagaagtcagtactcccgagagactcttgagttttccggcgattttcgcgttgcctcaagttaatcaaaagatgttcggatcaaatatgggcggaaatatgagtccttggacatcaaaccctaatgctgagcttaagaccgtcgctcttactttgcctcagatgccggttttcgctgcttgggctgattcttgatcaacttcaatgactaactctggttttcttggtttagttgctaagtgttttggtttatctccggttttatccggtttgaactacaattcggtttagtttcgtcgg

SEQ ID NO: 4695 - DNA, 640 bp, Artificial Sequence
  P15343 (35S::G1718)
gtttgtttgcgatggcgacagaacaagaagctgaagttggaacagagacatcctctgtttccggaaggtttttgaggaacagagatttatatctcttcttgccttttctcttaggcttctctgatcaagaatcatcaaacggagatgatgatgatgttgcttcatcgcgtgagagaatcattttagtcaacccttttacacaaggaatgattgtgctcgaaggctcatcaggaatgaatcctctgcttcgtagcttactggagtcacgtgaggaaggtcgtcctcctgcgtccaaggcttccatcgatgcgatgccgatcgttgagattgatggctgtgaaggagagtgtgtgatctgtttggaggagtggaagtccgaggagacggtgaaggagatgccgtgtaagcataggtttcacggtggatgtatagagaaatggttagggtttcatgggtcgtgtcctgtttgtaggtacgagatgcctgttgatggagatgagattgggaagaaaagaaacgatgggaatgagatttgggttaggttcagtttcaacgatggtcggagaattagagatttttctgcgcaggacggtggaaacagtgatggtgttgagtccgagaattaggatttacataagaa

SEQ ID NO: 4696 - DNA, 1228 bp, Artificial Sequence; identical to SEQ ID NO: 1441
  P15351 (35S::G2239)

SEQ ID NO: 4697 - DNA, 1175 bp, Artificial Sequence
  P15354 (35S::G2404)
aagtcgacaagaacacaatgccagtttctgcagagccttcttcatcttcttcaacaacaatcggtcaacacatgagactccaacgacctaggaatcatcgaaatctcccacccatttccaccgccgacgaacctctaatccccaaacctagccgcgtctctaaatccgccatgtcttccttcttcctcttgccagaaactactaagaagaaacccaacggaacggcgtcgtttcgtggtctaggctgcacaacctccgcatctcagcaagtttcagtcccggcagtgattcgctcctccgcggattgggatgctagtaatttcaaaattaagaagacgaagaagaagaacaagaacaagggtagtagtagctacaatggtggttcgattaagatcttgagcgaagctagtactagtagtagcgtcgcttgcgcagcgattcctgatgtttggtgtggtcctggagttgggttttcaacggatgctgtcgtcggaggctccattgacacagttgtttcagatcctccgagaaggaatattccggtgagacgcaaaatcgatggagataaaaccaatagtaacagtaataatcatagagagggttcttcttctcttcttcctagacgatctctcaatcaagagtctaatccttattttgattctgattcgagttttttgacatcgcgggctgagcagactgatagatatcatcgtcatctaagactgccttaccctgatggactcgctgagatgatgatgatgcagaatggttttgtgatgggaggagtattaagctcattcgatcaattccgtgacatgaggctcaatgtcgataacatgacatacgagcaacttttggagcttggtgaaagaattgggcatgtgaacactggacttactgaaaaacagatcaaaagttgtcttcggaaagtcaaaccatgccggcaagatacaacagttgctgatagaaagtgcatcatctgtcaagacgagtatgaggcgaaggacgaggtaggggaattacgatgtgggcacaggttccatatcgactgtgtgaatcaatggcttgtgaggaagaactcttgtccggtctgtaaaacgatggcgtacaataagtcttagttagatattatctcttcctgtgatgtgattcttgatttcggcggccgctttccc

SEQ ID NO: 4698 - DNA, 868 bp, Artificial Sequence
  P15364 (35S::G2997)
tcttaactctcatgaattattggtctctctattatagttttttaagtaacaatctaattgtagtacggatgtctcttgagatgttcaagaattaagaaataaagaaagagggatcggagaatgaattttgaggatcaagaagaagatatggagatgtcaggtgttaatcccccctgcggttacgactctctaagcggtgagggagccacatctagtggtggtggaggagtaggaaggagtaaaggagttggagcgaagataaggtatagagagtgcttgaagaaccatgctgttaacataggtggccacgccgtggacggttgttgcgagtttatgccttccggtgaagatggaacgctcgacgctcttaagtgtgcagcttgcggctgccaccgcaacttccaccgcaaggaaaccgaaagcatcggcggtagagcccacagagttcccacgtactacaaccgcccgccgcagccgcatcagccgcctggatatcttcatctaacatctcccgcggcgccttacaggccacccgcggcatcgggggacgaggaggatacatcaaatcctagcagcagcggcgggaccacgaagaggtttagaacgaagttcacggcggaacagaaagagaagatgttagcctttgcggagaggttggggtggagaattcagaagcatgatgacgtggcggttgagcagttctgtgcggagactggtgttaggagacaagtgcttaaaatctggatgcataacaacaagaactctcttggtaagaaaccctaattttgctcgagacatgatttaaaacactagaggatcataattgtttctttttttggtatgactcttctgtaactacttctgctta

SEQ ID NO: 4699 - DNA, 1381 bp, Artificial Sequence
  P15367 (35S::G372)
atgcagaattcataaacaccgctctggaattttactttttaggataacaaaggagggtcattttatctgttaattgatgggtgaagagatatctagcactgtgaacctggatttgaatctgggtcctgatcctgagttaggtctcgagccagcgacgaattatgctcggtctgattggggtaatggacttgctgctagggaatccgaatctctgagaaggtttagaagtcggtaccggtcacgtttcagacggattgatatgcttccggttcttgctgagacacatagcccggcgatggaattgagtcagttgttgatcacttctggaaatgtagttgctttgcctgctggtgagggaagcatggctagtggagaaagggtcatcgaggactccaaaaagtgcgagaatgggagcaaagtgatggcagaagacaatgtaacagaggagaaaagagatgttgagaagagcgttggcagcgatgggagctttttcgattgttatatatgtttggatttgtccaaggatccagttgttactaattgtggccacctttactgttggtcttgcctttaccagtggctacaggtttcagaggcaaaagaatgcccggtttgtaaaggggaggtatctgtgaaaacagtgactccaatctatggacgtgggatacagaaaagagaatctgaggaggtttcaaacaccaagatcccttcgagaccccaagcacgacgcacagagagtttgaggactacacttaacaggtcaggtcatataccaacggaaatatttagacatttgcaggataggcttgaaagggaatctagtacaggagaaagacgcgccagaccatctcttaaccggtttatgacttcgaggggagttagagcagaggagaaccagtctagtgaagcactggttgaaccttcatcagatgagattaacgatattgatctgatcttaaataatgcccctgaaaatgaagaggaaaacgaaaacctaagctcgtcacgtgctttggcaacccagagacgatgggcacagatgtatgggagggtgtcgtcgtttactttgagctctgctgaaagattagcggatacttatttgataacacatgcattggggaggaaccaagaacaaaacagcagtcctcctgttggtgttgaagacagggattcgttctcaagcatagtaggtgtgataaactcggagagtcaagttgaaacggcggctgagattaattcaatgttgactgtatcgacttcttcgtctgttagaagacatgagaacagttcaagggtctctgatgttgacagtgcagattctcgtccactgaggagaagaaggagattagcttagaagagaatggaggagaagaaagaggaa

SEQ ID NO: 4700 - DNA, 1142 bp, Artificial Sequence
  P15372 (35S::G1327)
gatatagtgaaggtagctatagagaagaaagtagtgtaataagaatggggaaaggaagagcaccatgctgcgacaagaacaaagtgaagagagggccatggagccctcaagaagatctcactctcatcacttttattcaaaaacatggccatcaaaactggagatctcttcccaagcttgctggttagtatttattcacatgcatgtttcggtaatactataaagttttaaataactaagagaaataatgattgatatatatacataggattgttgagatgtgggaaaagttgccgactaagatggataaactatctgagaccggacgtgaagcgaggcaactttagcaaaaaggaggaagatgctatcattcactaccatcaaacccttggaaacaagtttgtactctacctattcatctaatttctttataataagacaatatatagtatgtagagactaattgatatatgtgatcatcaggtggtcaaagatcgcgtccttcttgccgggaagaactgacaacgagatcaaaaacgtgtggaacacgcatctcaagaaacgactcactccatcttcttcttcttcatccctctctagcactcatgaccaaagcacaaaagcagatcatgacaagaactgtgacggggctcaagaagaaatacattcagggttaaatgagagccaaaactcagctacttcgtcacatcaccaaggcgagtgtatgcacacaaaaccagagcttcatgaggttaatggactcaacgagatccagttcctgctcgaccatgatgactttgatgatataacctctgagtttcttcaggataacgatatcttatttccgctagactctcttcttcataaccaccaaactcacatttcaacccaagaaatgactcgagaggtaaccaaatcgcaatcatttgatcatcctcaaccggatatcccatgcggatttgaagacacaaacgaagaatccgacttgaggagacagctggttgaatcaaccacacctaacaatgagtacgacgagtggttcaacttcattgacaaccaaacttactttgatgattttaatttcgtcggagaagtatgtctatgaatgtcaataatatatgcatgaccagtgttgtatccac

SEQ ID NO: 4701 - DNA, 1720 bp, Artificial Sequence
  P15377 (35S::G2536)
ttattcaagaagcaaatttgtaacacaccaaaaaatgggagaagagctttctgtagggtttcggttctatccgaccgaagtagagctccttacgtattacctaagaatccagcttggtggaggaaatgccaccattcatagtctcataccgatcctcgatgtgtttagcgttgagcctactcagcttccaagtacgtatgcaatcattagctatataaataatgtcgatgatatatttgtcgtatatatgtgtagtctttcactgtagagttttccttcttgcgtttcttgagtagagtaacgtgactaacgttatcttgagattgtatgcatgagatttaggtttgtgtttcttgatttcgtggttaattataagttacaaaaaaaaactttacaaacaatcacatttctaaaattaaacaatttcattttcgacaaagtttaactttacatgtaattaaggaaaacgtatacacataaactgaggatttacacaaaaaaaattgagaggtgtgttattggtttgtgtgtttttttgtttgtagatcttgcgggagagaggtgtcgaggagatgcagaacaatggattttctttgtgccaagacaagagcgtgaagctagaggaggcagaccaagtaggaccactggttcaggatactggaaagcaactggttcacctggacccgtgttctcgccggataaccgagtgatcggagtaaagaagacgatggttttctataccggaaaagcacctactgggagaaagacaaagtggaagatgaatgaatataaagcagttgaaacagccagtgtatctaccatcccaaaggtgcataatcacttctttaaaatgaagactttcatcaaataatttttctcaaatataccaaattctatttgtgggattccaatataaaaataactgatgtctcaacacctttttggacaagcatgtgcagtgaactagcagaataatctttaatacaattattacaaacagagattattaaaaacgaatcaccctttgattcatgtcaaaaatctttatcatggttattttatatctcacatatataatcttgtcttacatatatcgttgttttcaaaagttatatatgtggtaaaagagtgtgcgaaaaattacatgtgtttttaagtatttgaaactatccaattaaatatcatgcatacataaatgataaaaaccaaaatattcatgcatgcattcttttgtctattggttatatattagagttatagaatttctaccatccctattagggattccctaagatgcataatgttataatatctaagttactgataatattttagtaaaacaatagttaagctttcattatcaaaacaggttctaacgaagtttgttcctattcaatatagttgaggcccgaattcagtatctgtcgaatctacataaagtcaggaagctcgagagcctttgacagacgtcccacagaagcttatgcgatagagagaaatcttcctagcaatggagttgagacatcatctcgtgccacaatatcaacctcaccagaaacttcacattcaggaggaaaccaagttgatttaccggtgaatgctactactattacacaaagcatctcagatatggttgatgagctatcgcaacctttttgggagtgggaacaaatgaattggtcttaaacgtattaatttacttcttatgttcatttgttac

SEQ ID NO: 4702 - DNA, 4053 bp, Artificial Sequence
  P15431 (35S::G2768)
gctacacgcgtggagtttccttctgtgaagtcgaatcagcgaagtaaaaattgaatctttagggttttcttagtttgtatttacctttttgttttggaaatcaaatctctggcctcgtttttttttttaataatccggaggccttgattagggttttcaaaatctagtagctttgtgtcatgatctttataagataagtaatagatatatgtatttttttgctttttatatcagatacaaattttcaatggcaatttattacaagtttaagagtgcaagggattatgataccattgccatggatggtccttttatatccgtcggtattctcaaagacaaaattttcgaaactaagcatttgggcactggtaaagaccttgatattgtcgtctccaatgcccaaactaacgaaggtttgtcttctatgtcaaatgttgtgctgcgcttttcgtattattagactgtttgcttgcagctgtgatacaatgaactttattttatgttatgattgtttactagctgagctttgtcttattttttttttacttttgtgaactattaggaaatggtttgttggaatatgattcttgaatttctcaggaagctttagtgtactgtgtctcgtgccaatatgattgcaatctgtggcctttatatgttctctgttttgaattttcagagtatctggatgaagcaatgttaatcccaaagaatacatctgtccttattcgtcgggttcctggacgtcctcgcatcacagttattaccacacaagagtactttctcagatctttagtttctatattctttgtctacttatttagctattaaacttaaatagacatgatattaaaagcattgcattttactggtgcatcgttttagctaaacataagttaattgtctgactatcggatttaagaaacttcgggatcctcaatgatgcaaatatcttaactttgcaggcctagaatccagaataaagtggaagacgttcaggctgaaaccaccaattttcctgttgctgatccatctgctgctgaatttgtaagttgattatagtgaacttttctcggcttctgttggcattgactgcacctaattttcttctactacaaaagtactaatgtcatccgtattcacctcttagcctgaagatgagtatgacgagtttgggactgatctttattccattcctgatacccaagatgcccagcatattattccacgtcctcatcttgcaaccgcagacgacaaagtagatgaagaaagcaaaattcaggcgctgattgacactccagcacttgactggcaacaacggtaagcaatcttccagaaatggtgcaggtgaaactgttggattttgtgagaaggtttaacagacctcttatatttattcaatgtaacagacaaggtcaagatacttttggagctggtagaggttatgggaggggtatgcctggaaggatgaatggacgtggttttggtaacttatacttacttttattctttgattttggttgaattctggaatgtcaaaatacagtatacaaaacatttacttctgtcaaaatattttatatttttgttctatttgctcaagttgtaagatacttagtttggttttgctggctggataggaatggaaaggaaaacgccacctccaggttatgtgtgccatcgttgcaatatccctggtatgtcagctctgaaaatctttatttttctctcacttttgtagatggatatataatagataagaagtgttgagagcattttctttgctgtctcaggacattttattcagcattgccccacaaatggagaccctaactatgatgttaagagagttaagccacctactggtatccccaagtccatgttgatggcgaccccagatggttcttattccttgccaagtggcgcagttgcagttctgaaaccaaatgagtaagttgtactgaattagtttgggaatgttgctattgggtacttcttcacatatattgattatagtttaaatgtttgttgtgtcttcaacaaattcagggatgcttttgagaaggaaatggagggattgccatcaacaacacgttctgtaggagaacttccacctgagctaaaatgcccattatgcaaagaagtgatgaaagatgctgcgcttacaagcaaatgttgttacaagagcttctgtgacaagtgtaagttcttttaatgcattctgctgttccacaaaaaccttttctgaccgttgtcagttccagttctacattattatcctttttcactgattcaggtatcagagatcacattatttcaaagtcaatgtgtgtttgtggaagatcagatgtacttgctgacgaccttctaccaaacaagaccctcagggataccataaaccgtattttggaagctggaaacgatagcactgagaatgtgggcagcgttggccatatcccaggtccgtcattattttaaattcatgtgtttttaaactttgtttgattagtcctcactactgaattatcatggacaatatagatttggagtctgcacgctgtccacctcccaaggctctatctcctactacatctgttgcatctaaaggcgagaagaaaccagtacttagtaacaataatgatgcttcaactttaaaggcgccaatggaagttgcagagatcacaagtgcccctcgtgcatctgcagaagtgaatgtagaaaagccagttgatgcatgtgaaagcactcaagggtccgtgattgtgaaagaagcaacagtgtcaaagttgaatacgcaagcccccaaggaagaaatgcagcagcaggttgctgctggagagccaggtaaaataaagatgtactaatattagcttcactggacattgcgaatgattggtgactgatagtccagttcagatttccctactgagattaatcaagctggacctcacatgaaccttttttttttcaattactgaggaacccttgttgtcattcatcaatgtaatacgtacttattgtctctatacaggaaaaaagaagaaaaagaaaccaagagtgcctgggaatggtaaaagctttctttgctacgctgaaggcaatacattgtcagtttcgaagtctatgtgaatcgaatgggaggtctaaaagatggtttgtttatgtgatttattgcagacatgcaatggaatcctgtgccagatctagcaggccctgactatatgatgcaaatgggaccaggtccgcagtacttcaacggcatgcaacctggcttcaatggcgtacaaccaggcttcaacggtgttcaacctggcttcaatggctttcaccctggcttcaatggatttggaggcccgtttccaggcgcaatgcctccatttatgggttacggattaaacccaatggacatgggatttggtgggggtatgaatatgatgcatccagatccattcatggcacaaggatttgggttccctaatataccaccaccccataggtaaaacactcactctatcaaagaagagcaataaagctttctcaacaagtctcatgatggaactttctgtgcatgcgcagggacctagctgaaatgggaaaccgaatgaatctccaacgtgctatgatgggcagagatgaagccgaagcccgaaacgctgagatgttaagaaaacgtgaaaacgagagacgacctgaagggtaaaaagaaaacactcactctatttttactacagattcaaacaaggatatgctaaaacctaaacattggttgttgtttggttgtatatacagtgggaagatgtttagggatggagagaatagcagaatgatgatgaacaacggtacttcagcctctgcatcatccatcaaccctaataaatctgtatgtctccttttgtttgactcatcttcccctctcgctctctctttcttcttttctttgttcacctgtgcttcgctctctcccatttacttttggttatatgttattattatatcagaaaatggctccaaattctcttccctgattccctcattttgcttattttgaaaacc

SEQ ID NO: 4703 - DNA, 561 bp, Artificial Sequence; identical to SEQ ID NO: 1525
  P15446 (35S::G2459)

SEQ ID NO: 4704 - DNA, 906 bp, Artificial Sequence
  P15453 (35S::G145)
aagaaaatgggaagagggagagtagaattgaagaggatagagaacaagatcaataggcaagtgacgtttgcaaagagaaggaatggtcttttgaagaaagcatacgagctttcagttctatgtgatgcagaagttgctctcatcatcttctcaaatagaggaaagctgtacgagttttgcagtagttcgagcatgcttcggacactggagaggtaccaaaagtgtaactatggagcaccagaacccaatgtgccttcaagagaggccttagcagaacttagtagccagcaggagtatctcaagcttaaggagcgttatgacgccttacagagaacccaaaggaatctgttgggagaagatcttggacctctaagtacaaaggagcttgagtcacttgagagacagcttgattcttccttgaagcagatcagagctctcaggacacagtttatgcttgaccagctcaacgatcttcagagtaaggaacgcatgctgactgagacaaataaaactctaagactaaggttagctgatgggtatcagatgccactccagctgaaccctaaccaagaagaggttgatcactacggtcgtcatcatcatcaacaacaacaacactcccaagctttcttccagcctttggaatgtgaacccattcttcagatcgggtatcaggggcaacaagatggaatgggagcaggaccaagtgtgaataattacatgttgggttggttaccttatgacaccaactctatttgaatctttctcacttaatcaatccctctcttttttttttgacatttttaagatgatgtttctattttattacctctctcatgttttctgtcttgtgtgcatgtgtgtgtgtaatgtttatgcccttctattattcaatgatttctcgac

SEQ ID NO: 4705 - DNA, 4045 bp, Artificial Sequence
  P15454 (35S::G2570)
gaggtttgtgcaacctaaatagttcatccatacttgagagaagaaaaaaaactctttgcaaagattattagaatggcttctgctcaatctttctacaaccaaagctctgtcttgaaaatcaatgtcatggttgtggacgatgatcatgttttccttgatatcatgtcacgcatgcttcaacactccaaatacagaggtaattaaatattattatcatattatatataatatgttattgattttttgtttgtgatttcatttagatttttatttctatgatttcttagcatgaaatacaatttttggagaaacaactagcagttttaaaaacaaaacttgaattttgagaaattcaaagatgttatatatatatgtcaaaatttaacaattattcttctaaatcatccggattccgtttacatgtacacatctacaattttcaattgaggtattcttgttttgatgcctttgagacgaatagtttgattgataaaaaaaattctaaccaatatgatatataaagtttattttctttttgtcaaaccatactttatactatgtaacttttttaagagattattgaaaatagtttatttataaaatagtaacctattgttgaattaaaaaaaaaaaaaaaattgtaaatcgtgtttgcaaacgacatgtgatttatcttagtttaaaactagctgatattcttcaaatcgactgttcttataagtaatcaaccaattagcatcaatcacaataaattgtaaacacttcaatgaaaatggtgattttaaagaatatgttttacttatgttatgaactatctcaaatttgtgaaatatttcataactaatgtggaaaactatataacccctccatacaaaacgtaagtaaaatttatgaaatcctatcatttttaaaggttaaaccaatcaaaaagtaataattcttggtacttgcaatatttttgtcattatattttagtttattaattttattttgattaaatggttttagatccatcagttatggagatcgcagttatagctgtagacgatccgaagaaagcattatctactctaaaaattcaacgagacaatatagatctcataatcacagattattatatgcctggtatgaacggtttacaactcaaaaaacaaatcactcaggaatttggaaatttaccggtcttaggtaacattttttgttctttacaacttaaattaaattatgatatttattcttttgttatagtgaaagatatatttatccgtttgtttccccttacattgtttttgatataaagttatgtcatcggacaccaacaaagaagaggagagtttaagttgtggagcgatgggtttcattccaaaacccatacatcctactgacttaacaaagatttaccagtttgctttaagcaacaagaggaacggtaagtcaacactatcgaccgagcaaaaccacaaggacgcagatgttagtgtccctcagcaaatcacgttggttcctgagcaagctgacgtcttaaagaccaagaggaagaactgctcatttaaatcggattcaagaaccgtgaacagtacaaatggaagttgtgttagtacggatggttcaagaaaaaatcgaaaaagaaaacccaacggtggtcctagtgatgatggcgagtctatgtcgcaacccgcgaaaaagaaaaagattcagtggacggattctcttcacgacctattcttacaggctatccgacatattggtcttgatagtaagtgttttgattttcttaaaaaaaacgatatatatatagtacatgatacactgtttgttttcttacaattcaggtcacctgcacactaactaatgttttatgtttgtttactaatcttccaaagaggcggtgccaaaaaagatcctagcgttcatgagcgtaccatacttgacaagagagaacgtagccagccatttacaggtttgatatctcttgtcaaaaatgtttttggattttactgtttaaaatgggaaaaagttggaaaaacctctattaactcgaatcaaacaaataaactttatatcttattaagcacaaaaatcttccaagtttgagttgatttgtcgatttcaacctatccttagtcaacattaagagctcgttataacaccctttaacttaaacttggggacttttttcctccactttaaatacatcataccatgcatagattatgtgtcattctacttgttatttaacttaaattcatttgctatgttatgcagaaatatcggatattcttgagaagagttgcggagcagggtttgtatagcatgttgtcggatagaggcatagactcgatgtttcgacaaactcacattaaggagccgtacttcaactattacacaccatctacttcttggtatgacacaaggcttaacaatagatcattctattccaaacccgtacatggctttggacagtctaaactcttgtccacaacacgtgagcccgtctgcttcaaccagatgccttacaactacatgaaccggtcatccacctatgagccgcaccgtattggatctggatcaaacttgacgctgcccatccagagcaacctcagtttcccaaaccaaccatctcaaaacgaagaaagaagaagctttttcgaaccacccgtgatggcaaacaaaatcgcccaaacatctcaagttcttgggtttggacaacttggaccgtcagctatcagtggtcataatttcaacaataacatgacgagtagatatggaagtttgattccgagccaaccgggacctagccacttctcctatgggatgcaatcgttcttaaacaatgagaacgtaacatataaccctcagccacctgccaatgcaactacacagccaaatcttgatgaacttcctcaactggagaatctcaacttatacaatgatttcggcaacactagtgagcttccttacaacataagtaactttcaattcgatgacaacaaggtatattttcccaaccctaatcttacaatgatatatatatgtatattgaagtaggtgctgtgagatatgtgtttaaataatcggtttgtgcagcatcaacaaggagaagcggatcccaccaaatttgagctcccagctgcaaaattttcgactgaactgaatcatgaagacgatggtgactggaccttcgtgaacataaaccaggtatttacaatttattaagagatcttagcaataacaaaaatcgaatttgagccaacgttctatcaaagattagattttatcaaattaatgttttataaaactatccaccatggaaattttctaactagacttgttagtattagacatttagtagatttgcaaagtttttcatgctgctagctagtcttgtaattagatagaaatcggcatctgttaatgtcttattgacttacatgacttggttgtgaagggtcaatctaatggagaaacatcgaacactattgcttctccggagactaatactccaattttgaacattaaccataatcagaatcaggtacctctaattcatatcagtcagaatatttatatgaaactatgatacttaatatataaaagaaatatttgtttaaatctattctgaaacctggactcggtttttttagggacaagatgttccagagtttaacgattggtcgtttttggatccacaggtaaacgatataatgtttacaagaacttacataaattatttgtatatagtttaactttgaagtttatgagtctttgaaacaagttttggtgaattgtttcttatataggaattggttgatgacgacttcatgaactctctgttcaacaatgacatgaattgaaaaggattctcctctccatgatgttctcaaaaaggaggtgggaagaaataaattcggcgatacctaatagttctttaagcaaatatctatatagctttagtagttctttaagcagaatacttagttagcctttctaagtattggatgttatgtctttttttcagcaagcgtaatgagtgttggtcctgttg

SEQ ID NO: 4706 - DNA, 2143 bp, Artificial Sequence
  P15458 (35S::G1017)
gaatttgggggttacacaacttcgtctagatggagcaagagaaaagcttggatccacaactatggcatgcttgtgcaggatcaatggttcaaatcccttcactgaattcaacggttttttacttcgctcaaggccacacagagcacgctcacgcgcctcctgattttcacgcgccgcgcgttccacctcttatcctctgtcgtgtcgtctccgtgaagttcctcgccgacgctgaaacagacgaagtttttgctaaaattacgcttttgccacttccgggaaacgacttggatctagaaaacgacgccgttttgggtctaactcctccttcttctgacggtaacggtaacggtaaagagaaaccggcgtctttcgctaaaacgttaacgcagtctgacgctaataacggcggtggtttctccgttccacgttattgcgccgagacgattttcccgcggcttgattactcggcggagccaccggttcaaaccgtgattgctaaagacatccacggcgagacttggaaattccggcatatttacagaggaacacctcgccgtcatctcctaaccaccggttggagcactttcgttaaccagaagaaactaatcgccggagactcaatcgtcttcctccgttctgaatccggtgacctctgcgtcggaatccgccgcgctaaacgcggcggtctcggatctaacgcaggatccgacaatccttaccctggattctccggtttcctccgtgacgacgagtcaacaacaacaacatcgaagctaatgatgatgaaacgcaacggaaacaacgacggaaacgccgcggctacagggagggttagagtagaagcagtagcggaagcggtggcgcgtgcagcgtgtggacaagcgtttgaggttgtttattatccacgcgctagtacaccggagttttgcgtaaaagcagctgatgttagatcagcaatgaggataagatggtgtagtggtatgcgttttaaaatggcgtttgaaacagaggattcttctagaatcagttggtttatgggtactgtctccgccgttcaagtcgctgatccaattcgttggcctaattcaccatggcgtctccttcaggtagcttgggacgaaccggatttgttacaaaacgttaagcgggttagtccgtggttagtcgaattggtatcgaacatgcctacaatacatttatctccattctctccgaggaagaagattaggattccgcagccatttgagtttccattccacggtactaaattcccgattttctccccgggattcgccaacaatggcggtggcgagtccatgtgttatctgtcaaacgacaacaataatgctcctgcaggaatacagggagccaggcaagctcaacaactcttcggatcaccatctccgtctttgttgtctgatctcaatcttagtagttacaccggtaacaacaagttacattctccggcgatgtttctatcgagtttcaacccgaggcatcatcattatcaggctagggatagtgagaatagtaataacatttcgtgttctttaactatggggaatcctgctatggttcaggataagaagaagtctgttggttcggttaagactcatcagttcgtgttgttcggtcaaccgattttaaccgaacagcaagttatgaaccgaaaacggtttttggaagaagaggcggaagcggaggaggagaaaggtttagtggctcgtgggttaacatggaattatagtttgcaaggacttgagacgggtcattgtaaagttttcatggaatctgaggatgttggacgcacactcgatctctcggttattggctcgtaccaagaattgtaccggaaattggctgagatgtttcatatagaagagaggtcggatttgttgactcatgttgtgtaccgggatgcaaatggtgttatcaaacgtattggagacgaacctttcagtgatttcatgaaagcaactaaacggctaacaatcaagatggatattggtggcgacaacgtgagaaagacgtggataaccggaatcaggactggtgaaaatggtatagacgcttctacgaagactggtccgctcagcatcttcgcttgaacttgaagcatattgaggaataagcagtggcc

SEQ ID NO: 4707 - DNA, 2525 bp, Artificial Sequence
  P15470 (35S::G707)
tctcatccatggcggatttcttctatcttcattaaatatttccctctttattaaaatctcatgaatttcaacggttttctcgacgacggtgctggagcctcaaagctactctctgatgctccgtacaacaaccacttctctttctccgccgtagacaccatgctcggaagcgccgccattgctccttctcagtctcttcctttctcttcttcaggcctctctctcggactccaaacaaatggagaaatgagtagaaacggagagattatggagtcaaacgtaagtcgtaagagtagtagaggagaagatgtagaaagcagatctgaaagtgataacgctgaagctgtctccggtgacgatttagatacctccgatagacctttaaagaagaagaaacgttaccatcgtcacactcctaaacaaattcaagacctcgaatcggtttttaaagagtgtgcacatccagacgagaagcaacgtcttgatcttagccgtcgacttaacttagatcctcgtcaagtcaagttctggttccagaatcgtcgtactcagatgaagactcaaatcgaacgacatgagaatgctttgttgaggcaagagaacgataagcttcgagctgagaatatgtctgtacgcgaagctatgagaaaccctatgtgtggtaattgcggcggacctgccgttatcggtgagatctcaatggaagagcaacatctgagaattgaaaactctcgtctcaaagatgagttagaccgagtctgtgccttaaccggtaagtttcttggccggtctaatggttcacatcatataccggactcagcacttgttctcggcgttggtgttggttctggtggatgtaatgttggtggtggtttcactctctcttctccgctgttgcctcaagcttctcctagatttgagatttctaatggaaccggttctggtttggtggctacggttaaccgtcaacaaccggttagtgttagtgattttgatcagagatcgaggtatttggatttagctcttgcggctatggatgagcttgtgaagatggctcagacacgtgagccgctctgggttcgaagctcggattctggttttgaagtgctgaaccaggaagagtacgacacaagtttctctcggtgtgttggaccaaaacaagatgggtttgtctcagaagcttctaaagaagctggaactgttatcatcaatagcttagcgctcgttgaaaccttaatggactcggaacggtgggcggaaatgtttcctagtatggtctcaagaacttcaaccacagagattatctctagtggcatgggagggcgaaatggtgcacttcacctgatgcacgcagagcttcaactgctgtctccactcgtgccggttagacaagtgtcgttcttgcggttctgtaaacagcacgcggaaggtgtttgggcagtcgtggatgtctcaattgattccattagagaaggttcttcttcgagctgtagaagattaccatccggttgcctcgtacaagacatggccaatggctactcaaaggtaacatggatcgagcacacggagtatgacgaaaaccacatccaccgtttataccgcccattactcaggtgcggtctagcgtttggtgcgcatcgatggatggctgcattacaacgtcaatgcgaatgcctcacgattctcatgtcctccactgtttccacttccactaatccatcccctataaactgcaatgggagaaaaagcatgctaaagctagcgaagaggatgactgataatttctgtggaggggtttgtgcttcgtcgttacagaaatggagcaaactcaacgttggcaacgtcgacgaagacgttaggataatgactaggaagagtgtaaacaatcctggcgagccgcctgggataattctaaatgcggcgacgtcagtttggatgccggtatctccgaggcggttgtttgacttccttggaaacgaacggcttagatcggaatgggatatcttatccaacggtggaccaatgaaagagatggcccatatagctaaaggccatgaccgttccaactccgtctccctcctccgtgccagcgcgataaatgcgaatcagagtagtatgctgatattacaagagacaagcatagacgctgcaggagcggttgtcgtgtacgcgcctgttgatatcccagcaatgcaagctgtgatgaacggtggagattctgcttacgtggcactccttccttcaggattcgccattctccctaacggtcaggctggtacgcaacgctgcgccgcagaggaacgtaacagtattggtaacggtgggtgcatggaggaaggagggtcgttactaacggtggcgtttcagatactggtgaatagtttgcctacggctaagctaacggtggaatctgtggagacggttaataatttgatatcgtgcaccgttcagaagattaaagctgctcttcattgtgatagcacctgatcatcgagatcagacgatggaggagattgagtcaagaa

SEQ ID NO: 4708 - DNA, 855 bp, Artificial Sequence
  P15472 (35S::G2616)
ggagagaggagaaggcaaagtggtgaaagaggagatggagcaagagagcctaaacggtaggtatggtagtagagtaatgacggatgaacaaatggagactcttcgtaagcaaatcgccatttacgccgttctttgcgaccagctcgtcttcctccacaactctctctcttctgtccctcttctttcatcaggtacgtacactactccataattgtatttggaagaaacttaagggtcacgtaactgaatttgtatggtaatgattatgagaaaatacaataggaatgaatccaatgagaggtgagtattttgatccaatggtggcatcgtcaagcgctcatggaatgtcgactcggcctcgatggactcctacgacaacgcaacttcagattcttgagaacatttacaaggaaggcagtggaacaccaaatccgcggaggattaaagagatcacgatggaactgtctgaacatggacaaatcatggagaaaaatgtataccattggtttcaaaaccgacgagctcggtccaaacgaaagcaacctccgacaacgacaattacctcgagtcaggcggatgatgcggccgtgacaacaactgaggagagagggaggtgtggagatgattctggagggtttgagtcttatgagcatatactgttcccgagtcctgatttaggtaacctcttactatatgatatttatgtgtctatgcatcgtattttggtttaattgagtcagagatgaaaaaatgtggtgaactttttgtggtttcagggattgagcatttgttgaatagggacaagtttatagactgagtgaaacaaagatgatgaactctccaacctctctgttt

SEQ ID NO: 4709 - DNA, 877 bp, Artificial Sequence
  P15479 (35S::G3094)
gcctgaccttgaccttactctctctatctcttccccgagaaaaccacctcccagtgtagataaccagaagaagataagccaagatggaatctggagaatttcctgcatggcttgaggttctgttaaaagacaagtttttcaacgcttgtttggatcatgaagatgataagaagaacgagaagaacatattatgtatcgattgttgtcttaccatctgtcctcactgtctctcttctcatacctctcatcgtcttcttcagataagaagatacgtgtatagagacgttttgagggttgaagatggttctaagctaatggattgctctttaattcagccatacacaacgaacagttcaaaagttgtgttcatcaatgaacggcctcagtctcgacaatttcgtggttccggtaacatttgtatcacctgtgaccggagtctccagtctccttacctcttctgctgtctctcctgcaagattagtgacgtcataatgagacaaagaggactctcagggtttctccgcgtctgcaacgttcttgatttaaccgacgaagtcacgacaacgacaccgagttccactctcgagcccaccgggtcgaaccgaacatcttccgagtcaagtggtaacgaaggagaagacatgttctggtgtcaggcgctcgcttgcaccgccactactgaaatcgttaggaagaaaagaagcagcttgtcgacgacttgcaggagagtcacggaggtggtttcaacgactaacacggaagctccggtgaactttttaaaccgtcggaagaatccgccgcaacgcgccccgctttattaactcgtgacgtttggcgaaatttggttggtccaagtggtaagtagaatgaatacacg

SEQ ID NO: 4710 - DNA, 2088 bp, Artificial Sequence
  P15481 (35S::G2565)
tgattgtgagttctcatattgcttctatgtaacactccttgtaaagctaaatagcccttttgtgctaagtctctgatatctattgttatcttctcaatactgcacttgttcaatgacacttgctagcgattttggttttccatccgctatatcttcatcttttacaattctagaagagagataccacaataactttcctaacactttgtgtgtttcatcaggacaggaatcgatgaataacaaccccgtcccctgtcaggtgtttcctctggtctctggtggtagttctggtgggaatttgttttcatcttcttccggattctgcaatggtgtctatgtttcatcttcctcccaggcacggccatctgtttctaccgtgccaagagacagaattactgttgctcacgtctctggtgaagggcagaggcaggaatgccctgtggaaacacattccttgcaattgatcaatcaacctcaagaacagaaaattatgacttggtcttcagaccagattcggggcttcttcgattttcctgttccagatccacaagcagcgagcagcagaactatggtttcatccaaggaagtgctttcaaaatgcgaatggccagactgggcggatcagttgatctctgatgatagtcttgaaccaaattggtcggagcttctaggtgatcctaatgtactcaatctatattcaaaggttcgtttctttcagctaaatatgaatctctacgcttatttcagctaaatatgattcttctattaagactgactctgataatgtcttacagatagaaacacagtcttctgatatagcaaggcaagagatcgtctttagaaatcagcatcaggtggatccatcaatggagccgtttaatgccaaaagcccaccagctagttcaatgacatctaagcaaagaatgcgttggacaccagaacttcatgaagcatttgtcgaagctatcaatcagctcggtggtagtgaacgtgcgtatgccctttttttttccttctcatgcctgcaaaatttagctgaacaacttattattattctcttggcttataatttcaaaccacaggagccacccctaaggctgttttgaagctcatcaatagccctgggttgaccgtttatcatgtcaaaagccatttgcaggttactattctccatctatgttttcggtttgtatgcttacagctcatcttaaacgtctttatattattggcttgtccagaaatacagaactgcaaggtataaaccagagctttccaaagatacaggtacttgaggcatctaaggattcaaactgtcttctcaatatttcacataagcttattatactttggaaacataatggcatttaaaagactcttgtgtgatgaaacacgtctttatacataatcagcttttcttcttggacagaagaacctctagtaaagaatttgaaaaccattgaagatatcaaatctcttgacttgaagacgtaaggaacattttacttctctgtcagaacagactaagtatcacctaggataatatttcttcatatctaagattttttttttttattcttcttcaggagcattgaaatcactgaagctctccggttacagatgaaagttcaaaaacaactccacgagcaacttgaggtataataattcaaactgcctaaaagaagcttttataaaacaaaacagtgtcctttcctcttcatttgtctgatttcttagtttttggttttagctggtgattttgatcttatattggtcttaatacaatgcagatccaaagatcactgcagttacaaatcgaagaacaaggtcggtatcttcagatgatgattgagaaacaacagaagatgcaagagaacaaaaaagactctacttcctcatcatcaatgccagaagctgacccttcagctccatcaccaaacctttcacaacctttcctccataaagcaaccaattcagaaccatcaataactcagaaactgcagaatggttctagcacaatggatcaaagtgaatctacttctgggactagtaatagaaaacgggttagagaagattagacatctcatgagt

SEQ ID NO: 4711 - DNA, 1468 bp, Artificial Sequence
  P15484 (35S::G253)
aaacaactgtccatataaaatgcttttgtatgcatccatggaaaatagcttaaaaatcaatataaacctaaaatatataattttaaataagttttctcaaaataatttttcataaatcttttcgaacataattatcatagttattctaattttcaaaataaagtttattttatagatactttgaggtattctttgatatacaaaattagatttggatggatccacttaaacaggtttttaaattaacatactctgatccgcatcaaagaatgcatagaacttatttttttggagcagataaatcttggattggatatcagatccctagtattttttttcaagcattatggatgacatcaattgctttgacttgctaaaacctaaaaagatatgtgtgcttttaaaagaaattcattctcctaggaattccatttttagaataaattagccatcaacctaatatcacacaccaacacatatatttgtatggatttgagattttgatacttcacattctgtagacaccgtcaaatgaggttcaagaagaaatcaattcattgaggtggaaacgttggacactttcagaggatttgaaactaaaagagcttgtggctgtgtatggtcctcaaaaatggccgcacattggaaagcaaatgcaaggcagatcaggttagaaatgtgctttcgtttttttttacttttttttccaaagattaatctttttcttcgtttttgtgtgttgaaggtaagtcttgtagatcaaggtggtataaccatttggatccaaggattaggaatgatgtttttagtgacgaggaagaaaaattgctaatcaaagcttacaacgaatggggttgcaaatggtctaagattgctaggcttttccctggaagaacagacagacaaatgcagagactatggcgattggtcatgaaaacaaaattggagaggccataaacttctactcatgaactaactgcaaatgacaaaatagaaggcgagagaaacattcaatgtttttttttcttttttttttgggtctctttgaactaacgacctcatagattctgtgttagggtttgtacgtgataaaagtacaaagatgccacaagaggaaaccactcacctcgaagctaagtatcgcaacgaaacaatgaattacttagctcatcaacgtcgcttctataacatccctaaaggtttcttggcaatgtccacaccgcctgtctccaactctcaaccatcatcatcatcatcatcaccatcattaccatccaaacccgaagatgcaaaggccaatatacccgcaaagtatatagactttctcgggttaggagattctgaaaagaaaaagaagaaactactatagaacttcttgattgtaaccttattacatataatgtggaatctgtaaaatatcaacataacaatgttgtatttttacaagcaataaaactcaatttgtgct

SEQ ID NO: 4712 - DNA, 1856 bp, Artificial Sequence
  P15486 (35S::G2802)
ctccaactctcgggatatgatcgaaagagctttgttattattatctttacaacttcacgcagacgcataagagagagagttgatcaaagatattcgagattgagatgaacaagagtaatcctgctggttcggtgactggttcggatataatagacgccaagatcgaagaacatcaactttgtggatccaagaagtgtcctagctgcggccacaagctcgaaggcaaaccagtcatttgtaaatgttttttaaagaaaaaaaaaagaaaaagaggaaaagaatcaatgaagaacatcaagaatgatgctctctgttttattctatcgcttgcagcaattcaaaatccaaattttaaagcgtctatatacgagtctttatttgtatagttgtatatacttatattctcttgttctttttctttatattaattaagtttttgttttcccctctttttagcaggattgggttggtttaccagcaggagtgaaatttgacccaacggatcaagaattgatagaacatttagaagcgaaagtgttagctaaagacttcaaatctcaccctctcattgacgaattcatcccaaccattgaaggcgaagacggcatttgctacactcatcccgagaaacttcctggagtgactagagatggtttaagccgacacttctttcatagaccatcaaaggcgtacacgacgggaacaagaaagcgaagaaagattcaaacagaatgtgacaataatttgcaaggaagtagtagctccggtgagacgaggtggcataagaccggtaagacaagaccggttatggtaaacggtaagcaaaaaggttgtaagaagattttggttttgtataccaattttggtaagaatcgaaaaccggagaaaaccaattgggtaatgcatcaatatcatttggggacacatgaggaagagaaagaaggagaacttgttgtgtctaagatcttttatcaaactcagcctaggcaatgcaactggtcgtcttctacatcgagcttgaacgctataggtggtggcggcggtgaagcgagtagcggcggaggcggcggagagtatcatatgaggagagatagtgggactactagtggtgggagttgttcttcgtctagagaaattattaatgttaatcctccgaatcgatccgatgaaataggcggcgttggtggtggcgttatggccgtagcagctgcggctgcggcggttgcagctgggcttccgagttatgcaatggatcagctcagctttgttccgtttatgaaaagctttgatgaggtggcgaggagggaaactcctcagactgggcacgctacatgtgaggatgtaatggcagaacaacatcgtcatcgtcatcaaccatcatcatcaacatcacatcatatggctcatgatcatcaccatcatcatcatcaacaacaacaacaacggcatcatgcattcaacataagccagcctacacatccgatatcaaccattatttctccatctacttcgcttcaccatgcctccattaatattcttgacgataatccttatcatgttcatagaatcttgctccccaatgaaaattaccagacacaacagcaactacgtcaagaaggagaagaagaacataatgatgggaagatgggaggaaggtcagcttccggattggaagaactcataatgggctgcacttcttctaccactcatcatgatgtaaaagatgggtcatcatcaatggggaaccaacaagaagcagaatggttgaagtactcaacgttttggccagcccctgactcttctgacaaccaagatcatcatgggtaattgtgccattttccagtctgatgatcttg

SEQ ID NO: 4713 - DNA, 1149 bp, Artificial Sequence
  P15494 (35S::G2632)
agatcgtttcatcgtccaagcggaagaagcgtctccttcaatcaccgtggacacctccgagactgtctccgattgaatgggaattgaagacatgcattcaaaatctgacagtggtgggaacaaggttgattcagaggttcatggtacagtatcgtcgtcgataaatagtttaaacccttggcatcgtgctgctgctgcttgcaatgcaaattctagtgtggaagctggagataaatcttctaagtcaatagcattagcattggaatcaaacggttccaaatcaccatccaatagagataatactgttaacaaggaatcacaagtcacaacgtctccacaatcagctggagattatagtgataaaaaccaagaatctctgcatcatggcatcacacaacctcctcctcaccctcaacttgttggccacacagttgtaacttcccaatatagatatattgttcttatcatttcctttgggaaaattttagctatggttgcttacaatttagttttttcccggttatgaatcatgcagggatgggcatcctcaaatccataccaggatccatattatgcaggagtgatgggagcctatggacatcatcccctggggtttgttccatatggtgggatgcctcattcaagaatgccactgccgcctgagatggcacaagaaccagttttcgtgaatgctaaacagtaccaggcgattctgaggcgaaggcaggcacgcgccaaggcagagctagagaagaagctaataaaatccagaaagccttatctacatgaatctcggcatcaacatgctatgaggaggccaaggggtactggaggacggtttgcaaagaaaaccaacaccgaagcttcaaagcgtaaagctgaagaaaagagcaatggtcatgttactcagtccccgtcatcatctaattctgatcaaggtgaagcttggaatggtgactatagaacacctcagggagatgagatgcagagctcagcttataagagaagggaagaaggagagtgttcagggcagcaatggaacagcctttcctcaaaccatccttctcaagctcgtctagccattaaatgacctcacaaggcggcaattcattcttggctttctctttgttggcttattcggtagcagcc

SEQ ID NO: 4714 - DNA, 1121 bp, Artificial Sequence
  P15495 (35S::G2649)
cggagatgggcatggttggtctaagagatgtattccttgttgctccggcttatcaccaccagaacgccggagtgatatctggatccgatcatatgaacagtaatgcagctgcggcggcggcgctcggtgtcggagtgattcctctactcacggcgggtacaccgcagcaaaacgtggaagactccgacattaacttcctcggaaacaaccggagatggcagaataacaacaacaaccacgaaacgcagtatcttcacttcaagagtactaaccagacaacggtcggaacgagctcgaacaactcggggtctggctcaggcgcatcaggaaccgccacgtgtcaagactgtggaaatcaggcgaagaaagagtgtaagcagaggcggtgtaggacttgctgcaagagccgtggctttgattgttctactcacgtgaagagcacgtgggtctctgctgctcggcggagagagaggcaggtcatgcctaccggcgctaatccaacggctggctcgtctctttcgacctcctccgggacgaagaagccgaggatcgtagggtctcaacaacaacaacaacaacaagccacttctcatacttcaacttctaacacaccacctcaaagtttcgagaccagctccagccgacaagacggaggagggtcaagggaagcatggccagggcaggttagggcagcggcggtgttcaagtgtgttagagtaacggcagtggaggacggggatgatgagtacgcgtaccaagcggtggtgaaaatcggcggccatgtctttaaaggattcttgtacgatcaagggcttgaaccaaaagaaggttttcctagtatgtcggatttgcatttaggtggttcagccaataaccataacggagtttctgcctcggcgcctattctcgacccgcctaatgttgtttatggtggtggtggaggttcaggcggtgggttttacagttaaaccaaattcaagaaagtttactgttttaaagaaaagattttctctaatgtttttatccagtggggttagatacaaacgaatatttcactgttgtatgaattgtccatttggacaaactacttctaatgctgcaacagacgacgtatcgacaga

SEQ ID NO: 4715 - DNA, 525 bp, Artificial Sequence; identical to SEQ ID NO: 1021
  P15499 (35S::G1483)

SEQ ID NO: 4716 - DNA, 748 bp, Artificial Sequence
  P15502 (35S::G715)
ccgaccaatggataccaacaaccagcaaccacctccctccgccgccggaatccctcctccaccacctggaaccaccatctccgccgcaggaggaggagcttcttaccaccaccttctccaacaacaacaacaacagctccaactattctggacctaccaacgccaagagatcgaacaagttaacgatttcaaaaaccatcagcttccactagctaggataaaaaagatcatgaaagccgatgaagatgttcgtatgatctccgcagaagcaccgattctcttcgcgaaagcttgtgagcttttcattctcgagctcacgatcagatcttggcttcacgctgaggagaataaacgtcgtacgcttcagaaaaacgatatcgctgctgcgattactaggactgatatcttcgatttccttgttgatattgttcctagagatgagattaaggacgaagccgcagtcctcggtggtggaatggtggtggctcctaccgcgagcggcgtgccttactattatccgccgatgggacaaccagctggtcctggagggatgatgattgggagaccagctatggatccgaatggtgtttatgtccagcctccgtctcaggcgtggcagagtgtttggcagacttcgacggggacgggagatgatgtctcttatggtagtggtggaagttccggtcaagggaatctcgacggccaaggttaagctcagagtattccagatgatgcttgacctgcttga

SEQ ID NO: 4717 - DNA, 648 bp, Artificial Sequence
  P15510 (35S::G1797)
actgaaatggtgagaggaaagatcgaaatcaagaagattgagaacgtgacaagtagacaagtcacgttttcgaagcgaaggagtggtctctttaagaaggctcatgagctttctgttctatgtgatgctcaagtggcagctatgatcttctctcagaaaggaagattatatgaattcgctagctccgatatcaggaacacgataaagcgatacgctgagtacaagagagagtattttgttgcagaaactcatcctatagagcaatacgtgcaggggctaaagaaggaaatggtgacaatggtgaaaaagattgaagtgcttgaagtccataaccggaagatgatgggacaaagtttggattcttgttcggtaaaagaactttcagagatagccacacagatagagaaaagccttcatatggttagattaagaaaggctaagttatatgaagatgagctacagaaactaaaagccaaggagagggaactcaaggacgagagagtcaggctttctctaaaggttggagaaagaccaatggggatgccgtcgggaagcaaagagaaagaggatgttgaaactgatctatttattggatttctgaagaaccgaccataaaatcgtccttggtcattaaacgtcatttctagc

SEQ ID NO: 4718 - DNA, 1368 bp, Artificial Sequence
  P15514 (35S::G3032)
gagggtaaatttgtgattccatctgcaaattattcctcctatatatatatagaacgtgatgaatcaaatttcttaagttgcaagccatgactaatcttgatgagtttcttgaagagctaagttctattgaatcacattctcagaaaatcgtgaagatagatgagcatttaaaaaagttggatgaagagacgaaagaagatgaagatgaagatgcggcgaagataattcaagatcggagtaccgcgagagaagcagaaattgctctacttatggatctccgtcagaactttcttccaccaccatcgatgtcatcctcctctcttcaaccaccgtcatcgtcaactctcgcaccatcgtcatcatcctctcttcaaccacccgcaccgttgatagacttctttcggtcatcagtgtcatactctcatcaaccaccgtcatcttcaactctcgcaacatcatcgtcaccgtctcttcaaccaccgtcgatgtcatcctcctctcttcaaccacccgcatctttgagggaattctttacgtcgtcagtgtcatactctcatcagccatcttcatcttcaactctcgcaacatcttcgttctttccgtcgtcaatgccatactctgttcgacctcccgattcgtctgatcgaccatctttgagggaattctttccgtcgtcaccatcatcctctattcagccacccgaatcatcatcatctaagcgagcacggcttagtaacatctttccgtcacctttatcctcctctccgtcaccgtttgttaacccgtttctccgtccgcaggcccaagaaccaacaataccaaatttcataaacccaataccacagatctctccaggcctacctgctctattcccaaaccctaaccctaatcctaaccctaacccaatcccaaacccaatccgaaacccagacttggtgtggacaaataggcttcaactagtgtttgatgacgcagttgtcagacttgggggattattcagtgcaacacccaaagccataaacgaactaatttctgaagagggtctcactggtgaccagatccgtagccacttacaagtcttgcgggatcgtcaaaaggctattgcagacaaattagccttggagtgaagaaaatattgaagatgagagataggattaaatagaaagagtgatagtatagaacgtttctttttcttttgttgttaatcttgcatattacaaacaattactatatcataatagaatttatgttaatgttggagttattaaaaaaaaaaaagttaaccataataacattcttactgtacgcatgagtgatcatttatcacaatctattagagcaaccccaatgggtgggatgatgacagtc

SEQ ID NO: 4719 - DNA, 916 bp, Artificial Sequence
  Artificial sequence
  P15518 (35S::G3091)
gggttggtcgactttgctaagataagcagaagagagactgactctctctctctctaactcttcattcttctctcttttaccttctctccaagaaatcttcactttctctctagaaaaaagttggaagctgactcgataaagactctctttttcttcttcttcctgcaaatggcgatcgaggatcaagagaacacaatccgtgaaatcaaacctaagaacagaagaatcatgggagctggtggtccggaggaagaggagaaccggtggccgccatggttgaaacctttgcttaaagagcaattctttgttcattgcaagtttcatggagactctcataagagtgaatgcaatatgtattgcttagactgcaccaatggcccactttgctctctttgtcttgctcatcacaaggatcatcgcaccattcagataaggagatcttcttatcatgatgttataagggtgaatgagatacaaaagtatcttgatataggtgggatccaaacctatgtgatcaatagtgctaaagtcgtcttcctgaatgagaggcctcagcctaggcctgggaaaggagtgaccaatacctgcaaggtttgctatcgtagcctcgttgatgatagcttccgcttctgctctcttggctgcaagattgctggaacatcaagaggctttgaaaagggaagggagaacctgctaatggaaacagaggattcaagtagcagcattgcaattgggaagaacattacaaatctccagagtttcagcccatcaacacctccacttactacatctagtaactgcagaatcgtcaagcgaagaaagggaattcctcaccgatctccaatgggataagaaccgagattacacacaggttttagctaatacagaggcttcttctgtctcttatctttcctcg

SEQ ID NO: 4720 - DNA, 1080 bp, Artificial Sequence
  P15520 (35S::G3095)
cgcctcctcccactaaactcaaatcctctcatagtcttttcaatcaaatctgctcttcttcactgttgaagctggctatcaaaactcacaataactatgggaccgatgatgatgagagcagaagaagataactacaatctaaatcctccaccatggctaatcccaatgctaagagcaaactacttcatcccttgttcaatccacgccgcttccaacaaaagcgagtgcaacatgttctgtcttgactgttcttctgaggccttttgctcttactgtttgctcaatcacagaaaccatcgtgtcctccagatacggagatcatcgtaccacaacgttgtgagagtaaacgagattcagaagtacatagacatatcttgtgttcagacatatataatcaacagcgcaaggatcgttttcttgaacgaacgtcctcagccaagaatcggcaaaggagtcaccaatacttgtgaaatctgttgcagaagccttctcgattctttccgtttctgctctctcggttgcaaacttggaggaatgaagcgtgatccaagtctaaccttctctttgagagggaagcatggaagagagtacgaaggtgagtgggaatctgatgaagcgactacaccaactaagatacgcaagacatgtgctttcaaccgtctgatgagtggtctttccatctccaccgttaaatgtgattacttgtcaggagatcaaccgtcttcgagctccggtgatgagagcggttttaaactttctccggggacaccgccgatatataatcaccggaattcaagtagacggaagggcgtcccacaccgtgctcctttctaaaattaatactaacggaagctaattatatagtgtagattatagaaaatgtggttgttatgttgtaactaaatggttagtagtttttaaccttttgagctaggaatatacatattgtaagacatattacttacaggtattgtttggtttttctttttatagtacatatagaaattaggtatatactgtactcaaagggattgaaatatgttttcatatagtttttttgctgtaaatatacgtttgaag

SEQ ID NO: 4721 - DNA, 1201 bp, Artificial Sequence
  P15531 (35S::G2979)
ttgctaagacaaatatccgaatctcagaaatttctcgtcctctttctctgttttttgtttctggggaaaatgtcttctgcgattgttgtttctcaagatgcggaatcgcttggtctgcaaatttatagccgcaaggagaaatctcttggggttctcgtctccaatttcctgagactgtataaccgagacgatgtggatctcattgggctcgatgatgccgctgggcaattaggagttgaaaggcggcgtatctatgatgtggtcaatatattggagagtattgggattgtggcaagaagagggaagaatcaatactcgtggaaaggttttggagagattcctcgttctctagatgaactcaaggaagaagggatgagagagaggttaggttactcaagttcaaacaattcagacaaggtttcaaatggttgtgaaagagaagaacctttaactttaacacctgatgatcaggagaactcatcatcctctaaaatggaccaaaagaaggaaaaatctctctggcttctcgcacagaattttgtgaagatgtttctatgttcctgatgatgatctcatcacacttgatagtgctgcaaaagccttgctgagcgactctccagattcagtccatatgcgaactaaagttagaagactttacgacattgcaaatgtatttgcctcgatgaatttaatcgagaagactcatataccagtgactaggaaaccagcatataggtggttagggtccaaaagcatagctgaaagaggattaagcttatttaattccggagaaccgaagcgggtatttggaacagagatcacaaacttgagggcaaagagaaacaaaacatattgttcatcaatccgcaagcaaattggatataagaaacatgacgaggaaaacacagagcaggaatcgaaaccagctgcaagtaaatatgtgtttggcccgttctccccaataggagcatctaagacgaacaacgacaaagtcggaaagggaaggttactagagatcgaggcccttgcttctacctaccaaccacagtattgcaatcaagaaataactggtcttcttgggcatttcacggaggcatggaagaaatggtatgcagaggttgatcggaataaataacattactgaggtcacatgttttctctgggtacatgagagcacataactcatccaacatatagcttt

SEQ ID NO: 4722 - DNA, 644 bp, Artificial Sequence
  P15538 (35S::G2559)
gataattcatggtgtgtgtgtatgaagatgctgttttggttagactcgagcaagataagaggatatctctaatcaaagcttgggaagaggctgagaaatccaaagtggagaacaagtgagtcctaaagaagtttatataatccattgttttgatgaatttccaaatttttagttccatgatatttttttttgtgttccctatatatttgtatgtaatctcatttattaactttatgaaacagagctcagaagaagatttcttcagttggagcttgggaaaacagcaagaaagcttctgtggaagctgagctaaaaaagatcgaggtaaaagtgtaattctttattctttcaattttgttgttttatttttaacttttacatgaaatgctttccacttttcacattattctaatttatccgctggaaatatgaatgataacaggagcaactaaataagaagaaagcacactacacagagcaaatgaagaacaagatagctcaaatccacaaggaagctgaggagaagagagcgatgaccgaagctaaacgcggagaagatgttctcaaagccgaagaaatggctgcaaagtaccgtgccaccggaactgctccaaccaagctatttggattcttctgatcggaga

SEQ ID NO: 4723 - DNA, 1283 bp, Artificial Sequence
  P15567 (35S::G1990)
ccgattgatcaattccaatattacgtcctttttttcttgaatctctctatatactcaatggaagcagctgcggaggctgtatcagccgctagggagcaatcattgatccttaaagggaaacggactaagcggcaacgtcctcagtccccaatccctttctctatcattcctcctatgtcttcgcatgaaccggatgctgaagaagagtctactagtcttgtttccaaggagaagagtctcaatgatgaaatcaacaacaataacatcaagaataataacaatactttgatcaatggtgttacatcttcatcttctgcctcttcatcttccaacaacaatgccacattaaaggccacggctgacgaagaagatcaagatatggctaattgtttgatcctcctcgcccaaggtcactctcttccccacctccaaccgcaaccgcacccccaacaacaaacaagacagcttatgatgagttaccaagattccggtaacaacaacaacaatgcgtatagatctagcagcaggaggtttctagagacatcttcatctaacgggaccacaacgaacggtggtggaggcagagccggttactatgtttaccagtgcaaaacatgtgaccggacttttccgtctttccaagctcttggtgggcatagagccagccacaagaagcctaaagccgctatgggtcttcactctaaccatgaccacaagaagtctaactacgatgacgccgtttctctccatctcaacaacgttctcaccacaactcctaacaacaatagtaaccatagatcgcttgtggtatacggcaaaggtagtaataataaggtccatgaatgtgggatatgtggagccgaattcacatccgggcaagcattaggtggtcacatgagacgccatagaggtgcagtggtagccgcagcagccgcctctaccgccaccgtatcggttgcggccattccggctactgcaaacacggctttgtcattgtcgccaatgtcgtttgatcagatgtcggagggtccaattcaggctcccgttaagagagcgaggagcgcggttgtgtcgttagatttagatctgaatctacctgccccggaagatgagaatcgggtcaacggattaagctttgcttcaaagcaagaacacgaacaagaacatgaacaaacacaacagaagaaacagagagaagaacaaaagtctcttgtcttgtcttctgctcctacattggtggattgccattactaaaatcaaaattcattaatacctaatcaaac

SEQ ID NO: 4724 - DNA, 1014 bp, Artificial Sequence
  P15568 (35S::G2639)
ggtcatatatggctggtggtatcggaaaatggcaggatttttctcgttaggacacggcggaggaggaaacactccagacaaccacagaacaaacactaataatccttcttcatcgggaacagaatcttggctttggtgcagaaaccctaactctaacgctgacggtggagaagctggtccttcttacaaaggaacccttgagctatggcaacacccaaacaatcaagaaatcattttccagcagcagcagcaacagcaacaaaggctggatctttacacttccgctgcgggtttaggtgttggaccgagcaaccggagcttaattgaaacttccggcggtgcgttgatgatgatgagaagcggtagcggtagcggcggaccaagctgccaggattgtgggaatcaatctaagaaagactgctctcacatgagatgtaggacttgctgcaagagccgtggccttgactgtcccactcacgtgaagagcacgtgggttcctgccgctaaacgccgagaacgccagcagcagctttctaccggtcagcaaccgcagcaactgggagggagcgtccctaaacgacagagagagcgtatcccggcgagatcgacttccatggcctacactcgtataccttctaacaacacttcagggttggaggttgggaattttccgccggaagttagctcgtcggcagtttttcggtgcgtgcgtgtgagttccgtagatgatgaagaagaagagtatgcatataaaacagctgtgagtataggcggtcacgtcttcaaaggtgttctctacgatcaaggcccggccgagagaagctcctcgggcggtggatctcagccgttgaatctcataaccgcaggcccatcggcctcatcatcaagcccaaacgtgagctgcaacaatggagtcgttggctccacttcagatcattatatcgatcctgcctcacttaattatcctactcccattaacactttcatgactggtacgcacttcttctccaactc

SEQ ID NO: 4725 - DNA, 2361 bp, Artificial Sequence
  P15569 (35S::G2334)
gcaaccaacacatttctctgtctgtctctctttctctctctctcactcactctctctttgttccatggacttgcaactgaaacaatggagaagtcagcagcagaatgagtcagaagaacaaggctctgctgcaactaagatatcaaactttttctttgatcagattcagtcccaaactgctacttctgctgctgcggctcctcttcctctctttgtccctgaacccacttcttcctcttctttctcttgcttctctcctgactcttctaattcttcttcttcttccaggttcctcagtaagttgttttaaaaggacaagacttattcactctaatgttgaagttgtttttgctgatatttaatctgacgtttctatgttacatatatatgtagagatgggaaacttcttcagctgggcacagtggcaagaacttgagctacaagcactgatctatagatacatgttggctggtgcttctgttcctcaagagcttctcttacctattaagaaaagtctcctccatcaatctcctatgcatttccttcaccatcctcttcaacatagttttcctcatcaccaaccttcttgtcagtctctctctcctctctattgtttatgcttctcttatccttgaaatagtctttctttgtaaaaaagattccctttgttttggtgttggagttatatttccaagatctaaaataagtataaggctgctctgcaaccttgcaaggagttaaaaccctatgtgtatgataagcctatttctagaagatctattagcaacatagatagaatcagacaagtacatttcgtaaccaatgtcttgagtgagatttatgtttgttgttactaatgaacaacacacacttaataaaaaacagggtattggggaagaggagcaatggatcctgagccagggaggtgtaagagaactgacggcaagaaatggagatgttcaagggatgttgtagcgggccacaagtattgtgaccgccacattcaccgtggaagaaaccgttcaagaaagcctgtggaaaccgccacaaccaccatcacaacgacagccacaacaaccgcatcttcttttgtcttaggtgaggagcttggtcatggaccaaacaacaaccacttcttctcctctggttcatctcaacctctccaccttagtcatcaacaaaggtacaataaaaaaacacaaacactctgtttaattaaagtcattagtagatttggttaattacaaatattgttgttagggaaatagtgatttcactgtgaagtaatgctgtgaagaaaggggtaatgttggcaatagggtgacaagagagacttatcatacatactttgtgataaaaacattattctttcttttgttgagagataatgataacagttggatttgatagaatctaattttatttactagttgggtgagacttttcaatcatagaaatagaaaagagagagaaagttaaagagatatgtatacttatgttgtatttgaaataatgacatggtaggacctcagtgaaagctgaccaaacctgcatagaagccaaacaaaataaagctctcagattctgcaaccacttcctcttattaacacacacatttgactgattaaattatttctctaaccattttgttgaattgatcagtctacttattattgttcaaatgttggatctttttgttgacaatgtttatgtttatgtttattcctctctgtcacagttgttcttcagagatgaaacaagaaagcaacaacaacaagaggccatatgaagctaacagtggattcagcaatggaagatcagacgatggtcacatcttgaggcatttctttgacgattggccacgatcatcagactctacctccagtccaatgagctcatccacttgtcatctttcaatctccatgcccggtaacaacacgtcctcagatgtttctctaaaactttccacaggcaatgaagaagaagaagagaacatgagaaataacaacaatgagagggagcaaatgaattggtggagcaatggagggaatcaccacaacaatatgggaggaccattagctgaggctttgaggtcagcttcttcgacgtcaagtgttcttcatcagatgggaatctctactcaagtttttcattaaagaaaagtgtttgtaatctttttggtttgtgctctttgaatctttattttctgcagaaaataatctttgaatttgtcttcttttggaattgtgagttctgcttttggaattgttttgttccttactctgctattatatttatgtttaaagcttgacaattttgtataagcaatgaaactaatatgatcctctgcctgcaagtaag

SEQ ID NO: 4726 - DNA, 2139 bp, Artificial Sequence
  P15573 (35S::G268)
cgctgatccttcacacgcaagctaatgaagcctctcactaatggcgatctgttcaaatccccaactctgatcaagatctccgccttagttttcgtcaccgtcgctttcttctacttaggcaagcattggtccgacgatggctaccaacagctcgtcttcttctcctcttccacttccggtagctcgatcccggaggtctccgtttcaccgaatagtaacagagtctttaatttatcagcgataattcctactaaccatacccagattgaaatccccgccacaatacgacaacaacctccgtcggtggtggcggacacggagaaggttaaggtggaagctaatcctcctcctcctccacctccttctccttcacctcctcctccgcctggtccggttaagagctttgggatagttgatgcgaacggtgtgatgtctgacgattttgaggtgggtgaggttgagagtgatacagtggaagattgggggaatcagactgagatcgttgaggcgaaaagcgacggtgattctaaggctagggttagaattaagaaatttgggatgtgtcctgagagtatgagagagtatataccttgtttggataatactgatgtgataaagaagcttaaatcgacagagcgaggtgagagattcgagcgtcattgtcctgagaaaggtaaaggcttgaattgcttagttccacctcctaaaggttaccgtcagccgattccatggcctaaaagccgtgacgaggtatggtttagcaatgttcctcatactcggcttgttgaagacaaaggaggtcagaactggatttcacgagacaagaacaagttcaagtttcctggaggtggtacacagtttattcatggggctgatcagtacttggaccagatgtctaagatggtttctgatattacgtttggcaagcatattagggttgctatggatgttggttgtggtgtggcgagttttggtgcttatctattgtctcgtgatgtcatgacaatgtctgttgcaccaaaagatgtccatgagaaccaaattcaatttgctcttgagcgtggtgtgcctgctatggcggcagcatttgcgacaaggcgtttgttatatccaagccaagcttttgatcttattcattgttcaagatgtagaatcaactggactcgtgatgatggaattttgctccttgagatcaatagaatgctgcgcgctggaggatattttgcttgggctgcacagcctgtttataagcatgaacccgctttggaagaacaatggacagaaatgctgaatcttactattagcctctgctggaaattggtaaagaaggaaggatacgttgcaatctggcagaagcctttcaacaacgactgctatttgagtcgtgaggctgggactaaacctcctctttgtgatgaatcagatgatcccgataatgtttggtacacaaatctgaaaccttgcatcagtcgcatacctgagaaagggtacggaggaaacgtccccttatggcctgcccgtctgcatactccacctgataggctgcagacgataaaatttgattcctacattgctaggaaagagctattcaaggcagaatcaaaatattggaatgaaataattgggggctatgttcgcgccttaaaatggaaaaagatgaaactaagaaatgttttggacatgagagcaggctttggcggatttgcagctgcactaaatgatcataaactcgattgctgggttctaagcgtggttcctgtcagtgggcctaacacattgcctgtcatttatgaccgtggactgttaggagtgatgcacgattggtgtgaaccatttgatacatacccacggacatatgacttcttacatgcctctggactcttctcgatcgagagaaaaagatgtgagatgtcaaccatattgttagagatggaccggatattaagacccggtggaagagcatacattagggattcaattgatgttatggatgaaattcaagaaatcacaaaggccatgggttggcatacttctctgcgtgacacatccgagggtcctcacgcaagttacaggattctaacatgcgagaagcgtctccttcgagcttaataccacacaagttactgcactagtcaacac

SEQ ID NO: 4727 - DNA, 3318 bp, Artificial Sequence
  P15595 (35S::G2907)
tcatcgtacggattcctatctctcactactcagatgcttccttcttcactttaatcacccttttcgattttcgttttccagctttttgattcctctgtttcaccaagtagacgaagtagaagaagaagaagaagaagaaagttttcacctttactctaaaagtttcactttttatgtctgctttgaagctctgagatcggagaaagcaatatctatggcggaagcaagacgattcagcccagttcatgaattagatgttggacaaatactctcagaagcacgacatcgatggcttcgtcctcctgaaatctgtgaaattttacagaattaccaaagatttcaaatttctactgagccacctactacaccatcaagtgggtctgtttttatgtttgatcgaaaggtgctcagatacttcaggaaagacggtcacaattggaggaagaaaaaagatggaaagactgtgaaggaagctcatgagaggttgaaggcgggaagcgttgatgttctacattgttactatgcgcatggacaggacaatgaaaactttcaaagacgcagttactggttgcttcaggaagaactttcccacatagtttttgttcactacctcgaagttaagggtagtagagtttctacttcttttaaccggatgcaaaggactgaagacgcggctcggtctcctcaagaaactggggacgccttgaccagtgaacatgatggttatgcttcttgcagcttcaatcaaaatgatcatagcaatcattcacaaactactgactcagcaagtgtcaatggttttcactctccagaacttgaagatgctgaatcagcatacaatcagcatggaagttccacagcttactctcatcaagaacttcagcagcctgcaacaggaggaaaccttactggttttgatccttactatcaaatctctttgacgcccagggatagttatcaaaaagagcttcgcacaatccccgtaactgattcttcaattatggtagacaaaagcaaaactatcaacagtcctggagtaacaaatgggttaaaaaacagaaaatccattgattcccaaacctgggaagagattctgggaaattgtggttctggagttgaagccttacctttgcagcctaacagtgagcatgaagtgctggaccaaatactcgaaagctcttttacaatgcaagattttgctagtctacaagagtccatggtcaaaagccagaatcaggagttaaattcaggacttacatctgatcgtaccgtgtggttccaaggacaagatatggagctaaatgctataagcaatctagcttcgaatgaaaaagctccatatctatctacgatgaaacaacatctgttacacggtgcattgggcgaagaaggtctgaaaaagatggacagtttcaatcgctggatgagcaaagaacttggagatgttggtgttatagctgatgcaaacgagtcctttactcaatcaagttcaagaacctactgggaagaagttgagagtgaggatgggtccaatggtcacaactctaggagggacatggatggatatgttatgagtccttccctctcaaaggaacagctctttagcatcaatgacttctctccaagctgggcttatgtgggttgtgaagtggtggtttttgtcactggaaaattcttaaagactcgggaggagactgaaattggcgagtggtcttgcatgtttgggcaaacagaagttccagcagatgttatatctaatggtattctccaatgtgttgctcctatgcatggggctggaagagttcccttttatgtaacatgttccaacagattggcatgcagtgaagtgcgtgaattcgagtataaggttgccgagtctcaagtttttgatagagaagcagatgatgagtctactattgacattcttgaggcaagatttgttaaactgttgtgctcgaaatctgaaaatacaagccctgtttctgggaatgacagtgatttgtcacaattgagcgagaagattagtttactacttttcgagaacgatgaccagttggatcagatgctcatgaatgaaatctcccaagaaaatatgaaaaacaaccttttgcaggaatttctgaaagaaagcttacactcatggcttttacaaaagatagcagaaggtggaaaaggtccaagtgttttggatgaaggtggccaaggtgtattacattttgcagcttctcttggttacaactgggccttagaaccaacaataatcgctggtgtaagcgttgattttcgcgatgtaaatggttggaccgcacttcattgggcagctttctttggcagggagaggataattggttcactcatagctcttggtgctgctcctggaactttaactgacccaaatccagatttcccatcaggaagcacaccttctgatctagcctatgctaatggtcacaaaggaattgctggttatctctcagaatatgccttaagagctcatgtttctttgctcagtctaaatgataaaaatgccgaaactgttgagatggctcctagcccatccagctcatcattgacagactcgttgacagctgtacgtaacgctactcaggcagcagctcggattcatcaggttttcagggctcagtctttccagaagaagcaactaaaagaatttggagataaaaagcttggaatgtcggaggagcgtgctctttcgatgcttgctcctaaaacacacaaatcaggaagggcacatagtgatgattccgtgcaagccgctgctattcggattcagaacaagttccgaggttacaagggaagaaaagactatttgattaccagacaaagaatcatcaaaatacaggctcatgtgagaggttatcagtttaggaaaaactacagaaagataatttggtcagtgggggtattagagaaggtgatattacgttggagacggaaaggagctggtttgcgcgggtttaagtcagaagcacttgttgagaagatgcaagacggaacagagaaagaagaagatgatgattttttcaaacaaggaagaaagcaaacagaggacaggctacaaaaagctcttgcaagagtgaaatccatggttcaatatcctgaagctagagatcaataccgtagattgctaaatgttgtcaacgacatccaagaaagcaaggttgaaaaagctcttgaaaattcagaagcaacttgttttgatgatgatgatgatctgatagatattgaagcattgttggaagatgatgacacattgatgttgcctatgtcctcatctttgtggaccagttaaatcac

SEQ ID NO: 4728 - DNA, 1069 bp, Artificial Sequence
  P15600 (35S::G2866)
cactgtctcatcattccaccattttctttaattaaaaaaaaaacatatcagaaagaccattccaatattattacttcttccttttaagctctaacaattaaataaaaatttccattctctatatataatacacacacgttcaaatcattaatcacctgttttagataaaatcatagagagagagaaatagtaaaagaaataaaaaaaaatgggaagagggagaagctcatcgtcttcatcgatagagagcagctgcaaaagcaacccatttggtgtgtcttcgagtaatactcggaacctaagcacggacctgagactcgggctcagcttcggatcatcttccggacaatattacaacggtggagataaccatgaatatgatggagtcggtgcggcagaggaaatgatgatcatggaagaagaagagcaaaacgagtgtaatagtgtcggaagcttctacgtgaaagtgaacatggaaggagttcctattgggagaaagatcgatcttttatctcttaatggatatcatgatttgatcacaactctcgactacatgttcaatgcttcaatcctttgtaagtatctacacacacttaattacatctttgcatgtagacttagttaatatttatatttgttatacctctctttgcatgtatatagttaagaccaaaactaatggcaataaaaaaattgtgaaaataggggctgaagaagaagatatgtgtagtgagaagagtcacgtgctaacgtacgcagacaaagaaggtgactggatgatggttggagatgttccttgggagtaagttcttttttaattttagtgtattaaaaatctctagttaagtattttttttgacataattatgtaaaaattccctttaattaatggggacttaattgattatgtaggatgttcttgtctagcgtgagaagactaaagatctcaagagcttatcactactgattttctaaaagcaaacttggaagaatctaggattgaccaatacagtcagtggtggtgggggaaaaagttagttttgtctgaatgtaaatcacttgttcgaga

SEQ ID NO: 4729 - DNA, 3257 bp, Artificial Sequence
  P15601 (35S::G2869)
tggtagcgagagaagttgaggaaagagagaaaattgtataataactgttgagataacatattttggtataccgatctttaggtacgagcttatggaaagtggcaacgttgtgaatacacaacctgaattatcaggcataagtaagaaattttgatttttttattttattgaaaacttgttttagttataatgttttgatttttgttcggcagttgatggatccaagagttatatgtacgagcagttatggaaactctgtgcgggacctttgtgtgatattccaaaacttggagaaaaggtttattactttcctcaaggccatatagagcttgtgagttctctctctctatattctttctctcttctttctctctctctctctctctctctctctctctctctctctctctctctctctctctctcctttctctctcttctctctcttctctctctcgcctctttctctctctctctctctctctctccttctctctcatgtatgaaaccttttgacggctttttcaggttgaggcatctacaagagaagagttgaatgagttacaaccaatttgtgattttccttctaagcttcaatgtcgtgttattgctattcaacttaaggtatatctctattatgttttagcgaatacgcatgatttttatagttgatctaattataaacagaaataattggttaattgtttgatgtttgattttaggtggaaaacaatagtgatgagacttatgctgagatcactttgatgccagatacaactgtaagtgaaaatttagtatttctcttttattttcagttaattctatttttctcctattatatctcattgattttctgattttgttaaatttttagcaagttgtaatccctactcagaatcaaaatcaatttaggccattagttaattcctttacgaaggttttaacggcctcagatacaagcgttcatggtggattctctgttccgaaaaaacatgccattgaatgtctccctccgctggtatttaattttatagttttttaaacgaatttgaattttaagctttcattagacattacatattaaattttggtttaggatatgtcacagcctctaccgacacaagaaattcttgctatagatcttcatggtaatcaatggagattcagacacatctatagaggtaataattccttttattatataattaaaacacagctattgaggtaataaatcctagagaagtaactaataatcttcttattccatgtaggtacagcgcaaagacatttgttaacaattggttggaatgcattcacaacatcaaaaaaattggttgaaggagatgttattgtattcgttaggtataatattggttcttctaatatatctttgtgttcttgagttttggactttaaactatatacttgtggttttaggggagagactggagagttacgagttggtatcagacgagcaggacatcaacaagggaatataccttcatcaatagtatcaatagaaagtatgagacatgggataattgcttctgcaaagcatgcttttgataaccaatgtatgttcattgtggtttacaagccaaggtaatttcaaagaaccatttgaactcacattttagattatattgatttatcaataaattagtttcttcaacatgtaggtttatattttgtgtctttataagtatcaggtcaagtcaatttattgtcagttacgacaaattcttagacgttgtgaacaataagttcaatgtcggttcaagatttacaatgcggtttgagggtgatgatttctctgaaagaaggtaacattagatgaaaaaaaaaattgcttaaatattttggtaatgtctaatattatctgtgataacacattttgttctatcgattaagatcttttgggacaattattggagttagtgatttctctcctcattggaagtgttcagagtggcgcagcttagaagtaaaatttcattcacactttataacattattttagaaatacgtttttgagtgcaataaatagcatatcactaattaactctaatgttgcaggtgcagtgggatgaatttgcatcatttccgagaccaaaccaagtttcaccatgggacatcgaacatttaacgccttggtcaaatgtttccaggtcatcttttctcaagaacaagcgttcacgagaagttaatgaaatcggtataaaaaaagacacttataatcttctatttaatgaatttaagattctttaataccttctcaatatacctattttatatacaggttcttcctcatcacatctcttgcctcctacattgacacaaggacaagaaattggacaacaaagcatggccaccccgatgaatatttctcttcgttatcgtgatattactgaagatgctatgactccttctagattgctaatgagctaccctgtccaaccaatggccaaactaaattacaataatgtggttacaccaatagaagaaaatataacaaccaatgcagtcgctagttttaggttgtttggagtctctctggccactccttcggtgatcaaagatcccgttgaacaaattggcttggagatttctagacttactcaggaaaaaaagtttggtcaaagccaaattttgagatcaccaacagagatccaaagcaagcagttcagttctaccagaacttgtaccaaagtaagtataagttcaatatattcttattctttatatatgaaattttttctcattatactcaactcacgcaatcttaatatggaataggttcaaatgcaaggtgtaacaataggaagagctgtggatttaagtgttcttaatggatatgatcagttaatactagaattggagaagctcttcgatctcaaaggccaattgcaagctcgcaaccaatgggaaatagctttcacaaataatgaagaggataagatgcttgttggagaagatccatggccgtaagttttctttctatttctatcgattgaaagattagttaaaatcttgagagacattgatatttcatttttttttttttcatgtagtgaattctgcaacatggtgaagaagatattcatatattcaaaagaggaggtcaaaaacttgaagtccaggaagagtctctcaagttgaattaagaatcaaaacatatgtaataaaaaggggtcgaaaatgttaccggtgtttgttctatttttatttttctcttatttggtgttgcatacatttgtg

SEQ ID NO: 4730 - DNA, 3008 bp, Artificial Sequence
  P15631 (35S::G1150)
ctctgtagctccttttcctctcagcagccatggaagaaaaaactcatcatcatcatcacagtaccaacaaacacatccctagttccaaatcaagaacacctcttctccacaagccttatcatcaccatgttcaaaccaatcctcctccttttcttttgcacccttcttctcaccaaaacctcaatcttgttgcctcaaatcttccttctagctactactactattactactgctacttctactctcaatttcacaactctcttcctcctcctcctcctcctcatcttcttcctctttctcctcctcttcctcctttacttcctcttcctcctcctcactcaatgacccgtttccacaaatctctccctgtttctcaagttgtggagagaaagcagcaacaccaacagaagaagaagatacaagtttctaacaacaaagtgagtggatccatagcaatagaagaagcagcattagtggttgctaaaagaccggactttggtggtcaagatggttctgtcatttatctcctcgccaaccattttcttgtcaagtttgattcgtcacagaggatttaccattacaatgttgagatatctccacagccttcaaaggaaattgctagaatgatcaaacagaagcttgttgagacagatcgtaatagcttctctggtgttgttccggcttttgacggcaggcaaaacatttacagccctgtggagtttcagggagataggcttgagttctttgttaatctccctatcccatcttgcaaggctgtgatgaattacggtgacttgcgtgagaagcaacctcagaagaagattgagaaactgtttagggttaatatgaagcttgtgtccaagtttgatggtaaagaacagagaaaggaaggagaggattgggctcctctgcctccagaatacattcatgctcttgatgttatcttgagagagaatccaatggagaagtgtacatcgatcggaagatcgttttactcgagttctatgggtggatctaaggagattggaggaggagctgttggactcagagggtttttccagagtcttagacatactcagcaaggtttagcacttaacatggatctctcaatcacagctttccatgaaagtattggagtaatagcttacttgcagaagcggctcgagtttcttacggaccttcctaggaacaaaggtagagaattgagtttagaggaaaagagagaagtggagaaagcacttaagaacataagagtctttgtttgccatagagaaacagttcaaaggtatcgagtttatgggttaacagaggaaattacggagaatatatggtttcctgatagagaagggaaatatctaaggcttatgagttacttcaaagatcattatggttatgagattcagttcaagaacttgccgtgtctgcaaatcagtagggcaagaccttgttaccttcctatggagctatgcatgatttgtggaggtcaaaagtttcttggaaagctatcagatgatcaagctgcaaagatcatgaaaatgggctgccaaaaacctaatgaaaggaaagctattattgatatggttatgacaggatcggtcggtccatcgagcggaaaccaaacaagagaattcaaccttgaggtttcaagagaaatgacattgctgaaaggaagaatacttcagccaccaaagcttaaacttgaccggccaaggaaccttaaagaaagtaaagtttttaaaggaactagaattgagagatgggctttgatgagtattggaggcagctctgatcagaaatctaccattcccaagttcataaacgagcttactcaaaagtgtgagcatttgggagtcttcttaagcaagaacacattaagcagtaccttctttgaaccatcacacatactcaacaacatttcgcttctcgaatcaaaactgaaggagattcaaagagcggcatcgaacaatctccagctgattatttgtgtaatggagaaaaaacataaagggtacggagatctaaagaggatatcagagacaagaattggtgttgtgacacaatgctgcttataccctaacatcactaagctcagttctcagttcgtttcgaacttagctctcaagataaacgccaagatcggtggatccatgaccgagctctacaactcgataccttctcacatccctagactgcttagacccgatgagccggttatcttcatgggagctgatgtaacgcatcctcatccattcgatgattgtagcccttcagtagcggctgtggtagggagcataaactggccagaagctaaccgatacgtctcaagaatgaggtctcagactcataggcaagagatcatacaagatcttgacttgatggtcaaggaacttcttgatgatttttacaaagcggtaaaaaagcttccgaatcgaatcatattcttcagggacggtgttagcgagacacagttcaagaaagttctccaagaagagcttcaatcgataaaaactgcttgttcgaagttccaagattacaatccaagcatcacattcgccgtggttcagaaaagacaccacacaaggctgttccggtgcgatccagaccatgagaacatacctcctggtacagtggttgatacagtgataactcatccgaaagagtttgatttttatctctgtagccatttaggagtgaagggcacgagcaggccaacgcattaccatattctatgggacgagaacgagttcacttcagacgaattgcagagacttgtgtataatttgtgttacactttcgtgaggtgcacgaaacctatatcgattgtgccaccggcttattatgctcaccttgctgcgtacagaggaaggctatacatcgagagatcatctgaatctaatggaggatccatgaatccttcttctgtgtctcgtgttggtcctccaaagacgattcctcttcctaaattaagtgataatgtcaagaatctcatgttttactgctgattcttt

SEQ ID NO: 4731 - DNA, 1389 bp, Artificial Sequence
  P15643 (35S::G2051)
ttcaacctcttgtctttaattttgttcaaagagggaatttgaaatcttgaaacccttatttagaaataaatttcgtgttcttgtttttctctgatatcataatctgttttttttttctcacttgttccttgagctttaagaaagacaactataggacttagggtttctgttttgtggaagtttcacactgttttcgacaagaaattttttaaatcaagatcaagaatacgactgagtaaatcatttgaagaaattatagataaagaaaatggtaggatcatttttaccacctggtttcagattttatccaacagatgaagaacttgtaggttattacctgcacagaagaaacgaagggcttgagatcgagctcgaaataatcccattaatggacttatacaagtttgatccttgggaacttccagagaaatccttcttgccaaatcgagatatggaatggtttttcttctgtcatcgcgacagaaaataccagaacggatctcgaataaacagagcaactaaatctggttattggaaagccactggcaaagatcgaaaaatcgtttgccactcttcttcttcttcatcatcttcctctatcaccggctgccgaaaaaccctagttttttatatgggtcgagctccttttggtggtagaaccgagtgggtaatgcatgagtatcgcctcttcgacaacgatacttcacaaggatcactaaacttcaagggagacttcgcgctgtgtcgtgtgataaagaggaatgagcatacgcttaagaaatgtgaaattatctcaccagaggtttcagatgagtcattaagcaataatgttaacaatttttgtcaagcaagtgacctagaaaagggttcttgtgatgcaagtaacacacgtttgtcttctcctgatttcatccttgaatcatcttttcagggaaattcacattcaaaaacagaagaagattccggtttccaagtatttacattacccgaattcgaatatccgctagaggtttttgcagatttgaatttcgatttggaaatggaggatccattcatgttcgattatcatccagagcctcatatgaacaatgaagtcatgagccatcacattcgtgggtaaagaaaaatattatagttcactagactgaatctcaaaaccaaacactcgagatggatcaagatctaactacaatcacatttattgaatatagatttgtttgtgtgtatagttgcatattataaaatgtaaagctacaagattctcttcagcatcaactagtagactagtagttatagatacgctttttaaagactttttaggtctcaaaagtatgtataatcaatgttgtatatctactaattacataaataaaagtgacctataaaaaa

SEQ ID NO: 4732 - DNA, 2750 bp, Artificial Sequence
  P15647 (35S::G386)
ttctgtgtgattcagttctcgatccatcttttcgtgaaaagtatcaatcttttaattctctagttgtttgtcaaatctggttagtttcttctcttgtatttatttgatgaacttcggtagtctcttcgataacacacccggtggtggctctaccggagcaagacttctctccggtttaagttatggcaaccacaccgccgcaactaacgtcttacccggtggtgctatggctcaagcggcagcggctgctagtctcttctctcctcctctaacgaaatctgtttacgcttcttctggcctctctctagccctcgtacgacgtcgtcttcctctactactaatacttatctttttatacttaaacctaatttgtgttttggataggagcaaccggagagaggaaccaaccgtggagaagcatcgatgaggaacaataataacgtcggaggaggaggcgatactttcgatgggagtgtgaacagaagaagccgagaagaagaacatgagagtagatctggtagtgataacgttgaaggtatctccggtgaagatcaagacgctgctgataagcctcctcggaagaaacgttatcaccgacacactcctcaacaaatccaagaactcgaatctatgttcaaagagtgtccgcatccagacgagaaacaaagattagaactaagtaagagactttgcttagagacaagacaagtcaagttctggttccagaatcgtcgcactcagatgaagactcaattagagaggcatgagaacgcgttattgagacaagagaacgataagttaagagctgagaacatgtctattcgtgaagcaatgaggaatccaatctgcaccaattgtggtggacctgccatgcttggtgatgtctctcttgaagaacatcatctccgtatcgaaaacgctcgtttaaaagacgagcttgatcgtgtctgtaacctcaccggtaagttccttggccaccaccataatcaccactacaactcctccttagaactcgctgtcggcaccaacaacaacggtggacatttcgctttccctcctgatttcggcggtggtggtggttgcttacctccgcagcagcagcagtcgacggtgattaatgggattgatcagaagtcagttttgctggagctggctttaactgctatggatgagttagtgaagcttgctcagagtgaagaaccgttatgggtcaaaagcttggacggtgagagagacgagcttaaccaagatgagtacatgagaacattttcatctactaaaccaaccggtttagctactgaagcttctagaacctctggtatggtcatcatcaatagcttagctctcgtcgagactttaatggactccaatcggtggacggagatgttcccgtgtaacgtcgcaagagctacaaccaccgacgttatatccggtgggatggctggaacaataaatggtgcacttcaactgatgaatgcagagctacaagttttgtctccactggttccggttcgtaatgttaatttcctccggttctgcaaacagcacgcggagggtgtgtgggcggtggtggatgtatcaattgatcctgtcagggaaaactctggtggtgccccggtaatccggcgactaccatcaggatgtgtggtgcaggatgtgtctaatggatactctaaggtcacgtgggtggagcatgcagaatacgacgagaaccaaatccaccagctgtacaggccgttgctacggtcaggccttggttttggctctcaaagatggctcgctacacttcagagacagtgcgagtgtctcgccatcctcatttcttcctccgttacatctcacgacaacacatcaataacgcctggtggtcgaaaaagcatgctgaagttagctcaacgcatgacgttcaacttctgttcgggaatctcggcgccgtcggtccacaattggagcaagctcactgttggaaatgttgacccggacgttcgagttatgacccgtaagagtgtggacgatccaggagagcctccggggattgttttgagtgctgccacttctgtttggctacctgctgcaccacagcgtctgtatgatttcttgcggaacgaacggatgagatgcgaatgggatattctatccaacggtggtcccatgcaggagatggcccatatcaccaaaggtcaagatcagggtgtctctctgctccgctccaatgcaatgaacgcgaatcagagtagtatgctaattcttcaggagacatgcattgacgcatctggagcgcttgtagtatacgcgcctgtcgacattcccgccatgcatgtggtgatgaacggtggtgattcatcctacgtggctctccttccgtccggtttcgctgttcttcctgacggaggcattgacggtggtgggtcaggtgatggtgaccagcgaccggttggtggtggatccctcttgacagtggcgtttcaaatccttgtaaacaatctcccaacggcaaaactcacggttgagtcggtggagactgtcaacaacctaatatcatgcaccgttcagaagattcggccgctttacaatgcgaaagctgatcttgatcaagactggcgcgtgcgtgtgtttcgcggccgctctagacaggcctcgtaccggatcctctagctagagctttcgttcgtatcatcggtttcgacaacgttcgtcaagttcaatgcatcagtttcattgcgcacacaccagaatcctactgagtttga

SEQ ID NO: 4733 - DNA, 976 bp, Artificial Sequence
  P15660 (35S::G1468)
caagaagacaccaaacccgttacttccactaaaaacaagggctttcttctttttaattcacaccaaaacactttgaacacacacatgcatggagccatgaactcaccatgcattgatttcgtaatgttcagtcgtggacaacacgatgaggacaacatgtcacgtcgtcctccgtggaagagggagagatcgatgtccactcagcatcatcatcttaacttgtctccaaacgaagacgaagagcttgccaactgtcttgtcttgttgtccaattcaggggatgcgcatggtggtgatcagcataaacaacatggacatggtaagggcaaaaccgtcaaaaagcaaaaaaccgcccaggttttccaatgcaaagcttgcaagaaggtgttcacgtcgcatcaggcattgggtggacacagggcaagccacaagaaagtgaagggttgttttgcctctcaagataaagaagaggaagaggaagaggaatacaaagaagacgacgacgacaacgacgaggacgaagatgaggaggaggatgaggaagacaaatcaacggctcatatcgcaagaaagagatccaacgctcacgaatgcaccatctgccatcgcgtcttctcttcgggacaggccttaggaggccacaagcgatgccattggctaacaccttccaattatcttcgtatgacgtcgctccacgatcatcatcattccgtcggcagaccgcagccgttagatcaaccatctctcgatctcaacttagcttgccaagaatattccgtcgatccaacggccatgagcgtagggatgatcgagagagatggtggtggcaataatcacaacgctacttcatcttcgtggttaaaactcgcaagtggtgattggtcttgacgactgactaatttaattaagttgctaattatattcttttaactttcattcgtttatattctttacatatatacaattaagtgcatga

SEQ ID NO: 4734 - DNA, 2776 bp, Artificial Sequence
  P15661 (35S::G3070)
ctttataattcacatctctcccagtgaatccaaagacggatcttgaacaaacatgcgtggggtttggctttatctcaagaagtctcttagctgctgcaaggcacagaagtcaactgtagcttgtgatccagacaagatccaaattcagaagaaggagaatccatctggatgctcaagaagatcaatgtcgaatctgagagatgtctttgtaactaatggagatgaaggagctatgcagaatgtaagctgctgcagctcacggtctcttgagagctccaggtttgtaaacacagtgaaatttgaggagaatgcaggttattcagacagattcaaaggtttgcttagcggagcatcttcttctgatttacttcccggtcgttgttcagagagatttgatgttgttggctctgacatctgcggtttcggagttcttgcttgtcaaaaatgtcatgagagagtcagagatcttgacgcgtttgaagcacattacctctctaaccactctggtaagacttgaattagatgaactttttcattgacttttagccaatgttgtgaggagaatttgatttgttttttcttttttgcagtcgttagactcttagcaggagatttctcaagaacaactgtggaactaatctgcaacacaggctattctcacaagctaggcaaaatgaaagggaacaacatttcagcgatctttaaaatccagaacttgcagagagttgttgcagactttgaagattacagagagctcgtgaaaataagagcaaacaagctttcaaagaagcactctcgttgtatggctgatggcaacgagtttcttgggttccacggtacaactctttcttgcactctcggtttcagtaacagctcttcaaacctctgtttctcggatcactgtgaagtttgtcatattctaagacatggtttcagtcctaaaacaagaccagatgggataaaaggagttctcacagcatcaactagctctacagctcttgaatctatcgaaaccgatcaaggaagaaatagaggttcattgatagctgttgtgctatgtagagtgattgcagggagggttcataaacctatgcagacgtttgaaaattctttagggttttctgagtttgattcactagctttgaaagttggacaaaattcaagaattgaagagctttacctgttgagtacaaaagctttgttaccttgctttgtgataatcttcaagccatgaaacaagcccgtatatgcaaaatttattctttaggtttttgtatagttttctcatcttcttttttcttgcaaaatttggtgggcctgtaataggttaaaaatgttgggctttccccaaaattgaaagatggaaaacttgctggacaagtctatgcccagcctctatatttaaagggtgaagaagactgtaactgttagtgctaccattttcttcaattagggtttctttgactagctcttcgctaagaacactcatgtctcctctgcttctgagccggccttcagtgttctccctccggaaacctctgtttgtaagatactattctcttctctccccaatcacactttgttctttttttttttttttgatgatgttttgctgatgtgagatcactacaattatactcagagacgccctagtgttgggtgcttgtcatctcgacgctgaaccttgcggattgggtatgggaaaactcatgattgcaattagtagtgataattcgatgtgggttttggagaagaaggcccctgtggagttggtggaaggaggaaagggaattgtaggagcatcccatgggtgggtagctactttgaaagacggagtagtgtgtctccaagatgatctaaacccaagcacatcgaattcagacccgaaacgcatctcattgcctagtctagtaactctacctcattgccaaacccaagttgtcaccaacatggccatgtcttgctcatctcctgaggaaaatgactgtgttgtggctataagtcttaggaccacaactcagcttatgttgacccgctcaaagtaaccctgagtggatcaacatcgagattcagaactcaagcttcttctcttcccctgtcatgttttccaagagagttgagatgttctgcataccttcttctggaggtcacgttactggatcgtgggatctccacaaacacaagttgcagagggtgcgatttcgaaaccttgctaagttgacaaagaaggaatggaagcttttggattcgtgtagcaggagcgaacatttggtggagtcagcagaaaatgaaactttcttggttaagtggtacaggaagaaaagcaaagatttgaagagaatgatgacaacaaaggctgtaatggtgttcaagcttgacaaagaaggaaatgctaaaaaaaaaaaaaaaaaaaaaaaaaaaaaaaaaagaaggaaatgctgtttacactcgagacattggagatctctgcattttcctctcaaaatctgaatctttctgtgtctctgcaactagtagctacaaatccgttccttccctagtccgtaaccacgtctatgtccaggcttacgacgagtatggattcatggatatcgccaagccttttgacgattcctgggtcattcctgcctcacctgatgcgaacccgaatcctttctatattccacctcaaactatagaatatactttatctacgatgcacccggatctatgaattttttactttgtcgtctcccgttactagttttcgtacccgtttcaatgctacttagtcagg

SEQ ID NO: 4735 - DNA, 4643 bp, Artificial Sequence
  P15666 (35S::G2884)
ggccggacaccttcacaaaaacacgcagagtgtttatatgcagccattaaatatggctgagatattggatcaccgtggagtcttgaccgacggtgatgatggtccatttagaaatctaacaaacttctatgatatgttttcaagcaactttcctgaaggtttgcgagtgttagtcttcgatgaagatccatcgtatcttctgatattggagagacatctccaaaagtttcaataccaaggtagctatttaaccattttcgaagttgatctagtgtttatttaagtctatattcaaagctggtctaacattttcaaatgtatgaaaaagttttgttccccttttcatatagtcgttgacaaaaaaaaaacctaaaacatttctcccaaattttgacctatatttgaggccatgacatgctttggactagatctctccatattaatggcgatgtgtatttttgcagtgactatatgcaacgaagtgaacaaagctatgcatacactccgcaaccataggaataggttcgacctcgctatgatacaagtaaataatgcagaaggtgatatattccggtttctctcggaaatcggatcggaaatggatcttccaatcatcagtaagatatctaatcacccaagaacagagcacataaagctctaatcctctttactcatcaatcatcacgcaggatgtctttctctctactctctcttactattttataagcgtatcataattttaataaaaatgtcatttcattgaactaagtgtaaattcgatatgcaacaagaaaacacacctttttttataccgcagtaatatctgaagacgattcagtgaagtcggtgaagaaatggatgattaacggtgctgccgactatcttataaaaccgataagacccgaagatctacggatagtattcaaacatttggtaaagaagatgagagaaaggaggagtgtggtgaccggagaggcagagaaagcagcaggtgagaaatcatcctctgtcggagattccaccataagaaaccctaacaagagtaaaagaagtagttgccttgaagcagaagtcaacgaggaggatcgtcatgatcataatgatcgtgcttgtgcttctagtgccaagaaaagacgagtcgtttgggacgaggagcttcaccaaaactttctcaacgccgtggattttcttggactcgaaagtgagtcacaaacactaatattattgtttataattaccattcccaatttattatatatactatacctctctatatttatataataaatgtgtgaataattatattttcatgcaggagctgttcccaaaaaaatattagatgttatgaaggttgattacatcagtcgagaaaacgtagccagtcatcttcaggtaacgtttcttatatacaacataattgttcattttcaacaacatttttgcttttattcttgaatagcatctccattttttttatacttcaaaatggagtaagatttcaaatctatttagttattgattttcagaatgaccctttataatttacttatgaaaattacaaattcaacccatatatttgtaattttaccttagttatgttatactctgatccctcatcattataagtgatgtttaaggtttctacacataaattatgaaaacataaatctttcatttaatatacctcttttacatagaaacaaaactaaataaaatgaattcaaccaatttgaaaacatactctaaaatataattggtcgaaaaaaacaacatttagatattgaattattgcatagaaacatgagagcatcacttaaaatgaaacaaaataaattttcttaaacatcacttaaagttatacatagggagtaggtaatatatgtcattttaatattaaaatattagttaaccacataattaacattattgtttatatgttttaactatgagatagtagcaaataactttatttgagtataaagtaaaaaaaaactataatttaatggattgagttacaaatttttttctataaaactaaaaaaaaaatagtttttaactaaaaggatagattaaaaaacaaaaaacacaccacgaacccttccaaactttttacctcaccttgcatcggtttcaggttgctcttcagatccaatcgaagaaggaaggatgagacattgtgctcttcccttctcccactctttccctgcatctccttggacactcccttcagatctgcttccctttgtaggaaaggctacgaacccctggaacctcaacacaaccacggtcagagtctgccccattttggcatcctgaagtgaacctagggttttccccagtggacctagactcttctgttggcccattacctataataaggtccaagcccacctgctggtttaatcattctaaggcttttaatcttaggtctgaactcattattcttatgcttagcccattactttctttgtgtcgatctcctctgttctatggtcatggactccatgtgaaagagacatcaacattgacggtttgggttttcatttaccttatgcgaaccttggttttagctacctttaaggctttatggtatccttataaagaattgaagattgttgtgctaagttccttgaatcgttcttattgttgtggcatttgtggtattggattattctttttcgttgctcatttgccactaagcagctcacttttcgtcttcaaacactgtaccctctttatcatctccatcttccagaccatatgcttcatagtctttgccgctattgaccggagagatcctcattcgagttggtttctaaagccaccctcacctgactatcgcaccatagtctcccgaatccttggtatcgtgttactgtgggtaatgaagcttgctccggcgagattcatatcattgatccgtttgtcaatgtcactatatccttcgactgtgactaatccgtcgtccttcgaactcttcgaggatgatctctcgatttaccgtgacctctcatggtgcattgcgcttccttgccttttccaaaaatgatattttcacaatttctctttacaatttcctttttttttttgtggtcaaccgattttgcatgtttttaattagatgatattaaaaatgtaacagattagaccatggtgttaccagtatgtttttatcagctgaatatcttagtcatcattacccatatttttgatcactctactaatagagatgttaggagaaataatagagaggtgttcacccaataaaatgcttatagatcatcttttgttagttattttattttaaagttatgtgtattagtgtgattttcagatttcttctgataacagtcacagaggttttccgtttttttaattgatattcatatatagttcatgacctcttacttattgttttaaatcatgatacagaccatactaagacatacttagtagttaaaattttgtatttgctttctagtctttcttttttgggaactttaattcatgggtagattccattcaactattttcttatttagaaataaagtagttctttcttttcttttgttggtaaaatattagcatgatttagctctttctttctttttttggtaaaattttaacatgatttagttcttattgaactgttggggataaataagtaagacaataagacatcatatacataaatcagagtatatggatgttaatatactagttatattatcagaaagctcaactaattaaactacaccaaattaaatatggttgacacaaatttagagtaaaatacatttaaaaatgtcaaaagataatccttatttggttatgttttaatatatatatatatcgtactaattttcttttgtcctgaattgggtgtgtagaaattccggctcatgctgaagaaggagaatgatgaaaagattaagaaagaggagatgaacaaatctttaataaccccacaaaatggaagaatgtatgttggagaagatccatcaaatttctacagaggaagaaatgatcatttcccaacacatcatgtcaacaatattcctcaaccttcttatgtgccgcaacacaccttgaaccctaacaatctcaacacacagctcataccatctctcggacatcattttgatcatcgaggctctattgtggttcccgatacaaacctagagatgaatcaacaattttttcaccaccaacagacctcggacttcacgccagaagagaatcttggtgataacaactttactgaggaagatttaatgatggcatcaacatattatttgagcgagccggatgatgcttcttttgaaaagaagaatgggcatgaagttgtgccatcgcccatatttcattcgccgttttcctctaataagtaccaacgtagttcctttcttgatcaggtgatgaggcttatgtttcttacaagtcttatgtttcttgaataaacattatgtgttattcatatctttgtattttgtgtgtgtgtgcttcttcagcaagaaagtggaggacttagctacaatactgttttttctaatgatgaatccaacattgggatttgcaagaagggatcaagatgggtcaagatcggagccaagcatgaagacggaagatgatgtacgtactac

SEQ ID NO: 4736 - DNA, 3119 bp, Artificial Sequence
  P15686 (35S::G846)
gaacaacaattggcttcacactctctcttttctcaattttgcttcttacttctttccccggctgattagaaacttgaccgcttgattctcttaaaggaggtcttgcgatggattccgctattgatatcagttctgatagtgatgtcgagatacaagaaactagaaccaggcctcaacatcccccacggatagctgaaggatctcatagaagagatctctctacgctgagaccgcactttcttagtgggagttcttccggtgcaaatggccacactaaaacaggacttacaaatctcgactcacgtaatggttttgaatccaagccactgcctcgggcagaacaccatacacatattccgggaaatgggagtatcgtaacttccagaattcccaatatctctgttggtgattatgagaaattttcatctcaacaagcttttaaaaggacacatccaccaacctttagtcgacctccttttcctcctagacctgatattggtacaagtaacgggaatgcgagtcactttcgtggtggagcacatgatgatctaggcatggggcgtgtgactaacggcactcggatcctacctccatctgtggcgcacggaacatctgcgtctccttcacattttaatggattaagtgatccaatgcataggaatggcataggcgaagaaaggaattcggaaaatgacgagaggctgatctatcaggctgcactacaggaactgaatcaacccaagtccgaggtcgatttacctgctggtcttctttcggttccccttatgaagcatcagaaaattgcattggcatggatgtttcagaaggaaactaatagtttgcactgtatgggagggatattagctgatgatcagggccttggtaagacagtctcgactattgcgcttatcctaaagcaaatgcacgaggcaaaattaaagtccaagaattcaggcaatcaagaggctgaagcattggatctggatgctgatgatgagtcagaaaatgcatttgagaaaccagagtctaaggcttcaaatggtagtggtgtgaatggtgattcaggcataaagaaagccaagggagaagaagcgagtacttcaacacgcaaattcaacagaaagagaccagctgctggtactttaattgtttgtccagcaagtgttgtgcggcagtgggcaagagaacttgatgagaaggttactgatgaagccaaactttctgttttaatataccacggcggtaacaggaccaaagatcctattgaactagcaaaatatgatgtggttatgacaacttacgccattgtttcaaatgaagttccaaagcaacccctggttgatgacgatgagaatgatgaaaaaaattctgaaaaatatggtctcgcttctggcttctccatcaataagaaacggaaaaatgtagtgggtactactaagaagagtaagaagaaaaaaggtaacaataatgctggcgattcatctgaccctgactctggtactctagcaaaagttgggtggttcagagttgtactagatgaagctcaaacaattaagaatcatagaacccaggtggcaagagcatgttgcggtcttcgagccaaaaggaggtggtgtttgtctggaacaccaatacaaaatacaatagatgatttatacagctatttcaggtttctaaaatatgatccatatgctgtgtacaagtcattctgccaccaaattaagggtccaatttccagaaattcccttcaagggtacaagaagcttcaggctgttctaagggctataatgctacgccgtacgaaaggaacattgcttgatggccagcctataattaatctaccaccaaagacaattaatttgagccaggtggacttttcggtagaggagcggtctttctacgtgaagcttgaatccgattcccgttctcagttcaaggcatatgctgctgcaggaactttgaatcaaaactatgcaaacattcttctcatgcttttgcgactacgccaagcttgtgaccacccccaacttgttaaaagatataactcagattctgttggaaaagtatcagaagaagctgttaaaaaactccctaaagaggatctagttagcctgctcagtcgcttagaatcgtctcccatctgttgtgtctgccatgatccaccagaagaccctgttgttactttgtgtggccatatattctgctatcagtgtgtatcagattatatcacaggggatgaggacacgtgccctgcgcctagatgcagagaacagcttgcgcatgatgttgttttctctaaatccacgcttagaagttgcgttgctgatgatttgggttgtagttcctcagaggataatagtcatgataaatcagtttttcagaatggcgagtttagttcatcaaagatcaaagctgtcttagatattctgcagtcgctttctaaccaaggcacttcaaactcaacacagaatggtcaaatggcttcttcctcgcagcagccgaatgatgatgatgatgatgatgatgatgatgtcaccattgtcgagaaaacgagtctgaagtcaactccttctaatggaggaccaataaaaacgattatattttctcagtggactggtatgcttgacttggtggagctatctctaattgaaaatagtatagaattcagaagattagatggtacaatgagtctaattgccagagacagagctgtgaaagaattcagcaacgatccagatgtaaaagtgatgataatgtctttaaaagctggaaatcttgggctgaatatgattgctgcatgtcatgtcattcttcttgatctatggtggaatccaactactgaagatcaggctattgatcgagcacatcgtattggacaaactcgacctgttactgtaactcgtattacgataaaaaatactgtggaggatagaattttggctctccaggaagagaaaagaaaaatggttgcgtctgcctttggtgaagatcatggtggaagctctgcaactcgattaacagttgatgatctcaaatatctattcatggtgtagctgttcttaaatcttgggttggcgaagtttcgcttctttcagaattttgatcatgagctgcattct

SEQ ID NO: 4737 - DNA, 904 bp, Artificial Sequence; identical to SEQ ID NO: 1079
  P16175 (35S::G1591)

SEQ ID NO: 4738 - DNA, 1089 bp, Artificial Sequence; identical to SEQ ID NO: 1681
  P16177 (35S::G2774)

SEQ ID NO: 4739 - DNA, 1271 bp, Artificial Sequence
  P16178 (35S::G1556)
ctataaataattggtgcacactctcaatattatcaaactaaaaattttacgagagataaaaaaaatgcaagatccgatggttagatcttacattaggtcagacaatccgcgaatgcactggaccgacgatcttgatatccgttttattcaagttattgaaaaactcggtggcgaagagagtaagcggttttctttccatatcgcaaaactataacaagacgattcttctgaaataaattcaaagaaaaaaaaattgtcattgaaatcaacaatcttttttttccttttaagacctttccatgattaatgttctctttatatccttttttagattaattcactatagtcgatattattgttctccttaaatttgcaggtgcaactcctaagagaattttgagtcttatgggtgtgagagacctcacaatatcacatgtcaaaagtcatctccaggtctttataattatatagtgtataaaacttatctacaaaacatatactatctaagatggcaagtactgaattattttttatttttttactttcaatagatgtataggaacaaaaagaaagaagaatctagtaaaggtaaaataactatcttacattttaaattaaattttaataaatatgtttgtcgtgtaactttgcataaggaatatttagattttcaacataatgcatagtgaagtttatatccgtttattcataattatgcacctccaatcctttgacagaaataaaaatgatgcgggagatgacacagaggcaatctcagcaatatcttcaaatctatgaacgtgctacccaatttatccaaaatcaacaaaggttcttatgttcatgtatcaacttagtttttcatataattaatcgttttttggtttcgtgagtaaaacaatcttctttttcaatttcttctaggctacaactggataatactgagaagataaccccagttttgggatcaagtaacaagtctctagatcaatcttcaaaggtaatttttttttccttttgtaatttttatattactaaatatcatgcatgattatcaacatgttgatttgatgcctatgaaactagattaatgtatattttatggcaggttggactaaatgaaaacagaggcaatgatgttgttgttgttggtggtgcaactggtgaagaagaattgtcccttgaactcactcttggtcgcaagtactaagaggagtttggtttctatctttttttttatgcttgctctctattttatgtaatgcttatcc

SEQ ID NO: 4740 - DNA, 1881 bp, Artificial Sequence
  P16180 (35S::G2550)
catcaatcggatgaaactcacttaaacaacaaaacactttcgatttattatccaatggctgtgtattaccctaatagtgtcggcatgcaatctctttaccaagaatccatttacctcaacgaacaacaacaacaacaacaacaagcttcttcttcctctgctgcatctttctccgagattgtttccggtgatgttcgaaacaacgagatggtatttatcccaccaacaagcgacgtagccgtcaacggaaacgtaacggtgtcaagtaacgatctaagctttcacggtggaggactttctttaagtcttggtaatcagatccagtcagctgtctctgtttctccgtttcagtatcattaccagaatctttcgaaccaattgagttacaataatcttaatccttctactatgtctgatgagaatgggaagagcttgagtgttcatcagcatcactctgatcaaattttaccttcctctgtttacaacaacaatggtaataatggtgttggattctacaacaattaccgttacgagacatcagggtttgtgagtagtgtactgagatctcgttaccttaaaccaacacaacaattgcttgatgaagttgttagtgtaaggaaagatttgaaattggggaataagaagatgaagaatgataaaggtcaagactttcacaatgggtctagtgataacattacagaagatgataaatctcaatcgcaggagttgtctccttcagaacgtcaggagctacagagcaagaagagcaagcttttaacaatggtggatgaggtaagactaaatcaaatttgaatactttaaagtgagagagagactttggagttttgagttttgaaaacatttttgcaggtagataaaaggtataaccaataccatcatcaaatggaagctttagcatcgtctttcgagatggtaacaggtcttggagcagctaagccttacacatccgtagctctgaatagaatctctcgccatttccgctgtttacgcgacgcgataaaagaacagattcaggtgatcagagggaagcttggggagagagagacttctgatgaacaaggagagaggataccgcgtcttaggtacttagatcaacggttgagacaacagagagctttgcatcaacaacttggaatggttagaccagcttggagaccacaaagaggcttacctgaaaactctgtctctatacttcgagcttggctctttgagcatttccttcatccgtaagtttgttgtttgtaagacactttctttctgctcctcattgcttcattgataaccatttcaatcgtttttgtagatatcctaaagaatcagagaaaatcatgctttcaaagcagacaggactatcgaaaaaccaggttcttattggctcaatctttggtcttgcttttatatgagtggtattctgattcttggcaatttaggttgcaaattggtttattaacgcgagagttcgactatggaaaccaatgattgaagagatgtataaagaagagtttggagaatcagcagagttactctctaactctaatcaagacaccaaaaaaatgcaggaaacatctcagctcaaacacgaagactcttcgtcttcgcaacaacagaatcagggaaacaacaacaacaacatcccatatacatctgatgcagaacaaaacctagtctttgcagatcctaaaccagaccgtgctactactggagattacgacagcttgatgaactatcatgggtttggtattgatgattacaatcgttacgttggccttggaaaccaacaagatggcagatattctaatccccatcaattacacgactttgttgtctaaaagattcctgagcttttcacaagcttaagat

SEQ ID NO: 4741 - DNA, 1664 bp, Artificial Sequence
  P16190 (35S::G1928)
tatgatgaacaaagacatgttacttcaccagcatcagcaaccacaacaagacgagaatatgtcgaatctaacatcagcttccggggatcaagcaagtgtctcttcaggaaatataactgaagcaagtggttctaattacttccctcatcatcagcaacagcaagaacaacaacaacaacagttagttgttccagattcgcagactcaaaagaagaggagaaaccaaccagggaatccagacccagaatcagaagtgatagctctatcaccaaaaacactaatggcaacaaacagattcgtgtgtgaaatctgcaacaaaggttttcaaagagaccagaatctacagcttcatagaagaggtcacaatctgccatggaagctgaaacaaagatccaacaaagaagtgataaggaagaaagtgtatgtatgtccagaagcaagctgtgtccaccatgatccatctagagctctcggtgacttaaccggaatcaagaagcatttctgtagaaaacatggtgagaagaagtggaaatgtgataagtgttcaaagaaatatgctgttcaatcagattgcaaggctcattctaagacttgtggcaccaaagaatacagatgtgactgtggcactctcttttctaggagggatagtttcataactcatagagcattttgtgaagcattggctgaagagactgcaagagaagtagtaataccacaaaaccagaataataatcaaccaaaccctcttttgattcatcaatctgcttctcatcctcatcaccatcatcaaacacaaccaaccataaacgtctcttcttcttcatcttcctcccacaaccacaacatcatcaatagccttcacttcgacaccaacaatggtaatactaataatagtaacaacagcaacaaccatctccatacatttcccatgaagaaagagcaacaaagcaatgaccatatcatgaattaccaccatagtatcatccctccttggcttgctcctcagcctcacgcactcacatcttcaaaccctaaccctagtaatggtggaggaggaggaggaagtttgttctctcttgcttctccggctatgtcagccaccgcattgctccagaaagcagcccaaatgggctctacaaagacacctcctttaccaccaaccacggcctacgagaggtcaactcataataacaacctcacaacgacaatggcggcgatgatgacgtcaccatctggattcatcagctccaacaacaacaatcatgttttgtttcaagactacaacgcatccgggtttgataatcacggcagagaagaagcattcgacgatacatttggcgggttcttgagaacaaacgaagttacagccgccgcaggatcagagaagagtactaaaagcggtggaggagaaggtttgacgagagatttcttggggctaagaccgttaatgtctcataacgagattctaagttttgctggtcttggaagttgcataaatagctctgcttctgatcagcttcatccaaagccttggcagggttagttaggttttttgctcataatatataatatgtgtatatatatttatatatctagttttgcatctttctcttgttttgttcttcgttttataaatttatatgttgaatgctcatcaaaggaaa

SEQ ID NO: 4742 - DNA, 1157 bp, Artificial Sequence
  P21111 (35S::G682::INTPDK::AG682)
tcgacggaaccgctggagaaattgagaggttttgggtcatgaaaaattgaaaagtgatcaatatatctctatagtttcactgattgtttcgattatattccgttgtattttaaatttaccaactctgttataagaagaaaactttcttaaatcccaacgaattcggtagcccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcaattttatatagtattatttttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgggaaattgggttcgaaatcgataagcttgcggccgctctagagaattcgttgggatttaagaaagttttcttcttataacagagttggtaaatttaaaatacaacggaatataatcgaaacaatcagtgaaactatagagatatattgatcacttttcaatttttcatgacccaaaacctctcaatttctccagcggttccgtcgacg

SEQ ID NO: 4743 - DNA, 1855 bp, Artificial Sequence
  P21117 (35S::G1073::INTPDK::AG1073)
gccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttcgaattcggtagcccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcaattttatatagtattatttttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgggaaattgggttcgaaatcgataagcttgcggccgctctagagaattcgaagattgtagaaagcaacacctcctccaccatttccaccttggaggtttgactcacacgcctgggccccactccccgtaacctccgacgactgagacgcctccggctgctgctgctgcaccccggtggttctcggcggtggggtttcttcctcttcaatcggtaacctatcataaactgcgtttgcaaaagaagcagccatcaacactaccggtcccgaagcaattaacgaaccagccacattccctcctacaacttgtccttgacctccggctagatacaccgtcaaacctcctgctcccggtggtgcaggcggtggaagcgcagtaccggtcaaagacaaaatgtcaaaccgaccatgcagggtaatcacacctccaccagccggagccgcaggttgccgtatcgtgacgttagtgaccgcacccgtgccgcttataatgcaaacgccgcagccgcgacgagtggcgtaggtggagactgcctcggatatgtccgaaccggcgtcgac

SEQ ID NO: 4744 - DNA, 598 bp, Artificial Sequence
  P21144 (35S::G682::GAL4)
taatacggtgccgtttgacatggataaccatcgcaggactaagcaacccaagaccaactccatcgttacttcttcttctgaagaagtgagtagtcttgagtgggaagttgtgaacatgagtcaagaagaagaagatttggtctctcgaatgcataagcttgtcggtgacaggtgggaactgatagctgggaggatcccaggaagaaccgctggagaaattgagaggttttgggtcatgaaaaatgaattccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtagtaa

SEQ ID NO: 4745 - DNA, 1208 bp, Artificial Sequence
  P21145 (35S::G1073::GAL4)
tacagagacctgaagattccagaaccccacctgatcaaaataacatggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgtttgaattccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtagtaa

SEQ ID NO: 4746 - DNA, 792 bp, Artificial Sequence
  P21146 (35S::G481::GAL4)
cccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctgggaattccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtagtaa

SEQ ID NO: 4747 - DNA, 1351 bp, Artificial Sequence
  P21159 (35S::G2345/G482::INTPDK::AG482/G2345)
tcgacaggaatgcgtctctgagttcatcagcttcgtcaccagcgaggctagtgataagtgccaaagagagaagaggaagaccatcaatggagatgatttgctttgggctatggccactttaggatttgaggattacgcggccgcggagcaagacaggttcttaccgatcgctaacgtcagccggatcatgaagaaggccttgcccgccaacgccaagatctctaaggatgctaaagaaacgatgcaggagtgtgtgaattcggtagcccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcaattttatatagtattatttttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgggaaattgggttcgaaatcgataatcttgcggccgctctagagaattcacacactcctgcatcgtttctttagcatccttagagatcttggcgttggcgggcaaggccttcttcatgatccggctgacgttagcgatcggtaagaacctgtcttgctccgcggccgcgtaatcctcaaatcctaaagtggccatagcccaaagcaaatcatctccattgatggtcttcctcttctctctttggcacttatcactagcctcgctggtgacgaagctgatgaactcagagacgcattcctgtcgacg

SEQ ID NO: 4748 - DNA, 1045 bp, Artificial Sequence
  P21160 (35S::G2156::INTPDK::AG2156)
ccgtccacgtggtcgtcctgcgggatccaagaacaagccgaagccaccggtgatagtgactagagatagccccaacgtgcttagatcacacgttcttgaagtcggaattcggtagcccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcattttatatagtattattttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgggaaattgggttcgaaatcgataatcttgcggccgcgaattccgacttcaagaacgtgtgatctaagcacgttggggctatctctagtcactatcaccggtggcttcggcttgttcttggatcccgcaggacgaccacgtggacgggtcgac

SEQ ID NO: 4749 - DNA, 1311 bp, Artificial Sequence
  P21162 (35S::G867::INTPDK::AG867)
gaagccgaatcaagaaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattcggtagcccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcaattttatatagtattatttttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgggaaattgggttcgaaatcgataatcttgcggccgctctagagaattcaagaaatcgacctcgtcttcgtccatcttcacgtctttgaaatttgtgacggcgtcacggcgacggaacctgtgaaccgcgacgtcgtaggcacgagcggcttcgtcttcttcgttgaatgtcccgagccacacgcgctggtgtttctcgtaaatctgagctccccatcttccgtttggttgtggcaccacacctttgtattttgacgacggaagctttcttgattcggcttcgtcgac

SEQ ID NO: 4750 - DNA, 1389 bp, Artificial Sequence
  P21193 (35S::G867::GAL4)
taaatggaatcgagtagcgttgatgagagtactacaagtacaggttccatctgtgaaaccccggcgataactccggcgaaaaagtcgtcggtaggtaacttatacaggatgggaagcggatcaagcgttgtgttagattcagagaacggcgtagaagctgaatctaggaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattctcattcgaaatctgagatcgttgatatgttgaggaaacatacttataacgaagagttagagcagagtaaacggcgtcgtaatggtaacggaaacatgactaggacgttgttaacgtcggggttgagtaatgatggtgtttctacgacggggtttagatcggcggaggcactgtttgagaaagcggtaacgccaagcgacgttgggaagctaaaccgtttggttataccgaaacatcacgcagagaaacattttccgttaccgtcaagtaacgtttccgtgaaaggagtgttgttgaactttgaggacgttaacgggaaagtgtggaggttccgttactcgtattggaacagtagtcagagttatgttttgactaaaggttggagcaggttcgttaaggagaagaatctacgtgctggtgacgtggttagtttcagtagatctaacggtcaggatcaacagttgtacattgggtggaagtcgagatccgggtcagatttagatgcgggtcgggttttgagattgttcggagttaacatttcaccggagagttcaagaaacgacgtcgtaggaaacaaaagagtgaacgatactgagatgttatcgttggtgtgtagcaagaagcaacgcatctttcacgcctcgcaattccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtagtaa

SEQ ID NO: 4751 - DNA, 1267 bp, Artificial Sequence
  P21199 (35S::GAL4::G1073)
atgcccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagggtaccgtcgacgaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttagagttttagcgttttggtgacaccttttgtcgcgtttgcgtgtttgacctcaaactactaggctactagctatagcggttgcgaaatgcgaatattaggtt

SEQ ID NO: 4752 - DNA, 1526 bp, Artificial Sequence
  P21201 (35S::GAL4::G867)
atgcccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagggtaccgtcgacgaatcgagtagcgttgatgagagtactacaagtacaggttccatctgtgaaaccccggcgataactccggcgaaaaagtcgtcggtaggtaacttatacaggatgggaagcggatcaagcgttgtgttagattcagagaacggcgtagaagctgaatctaggaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattctcattcgaaatctgagatcgttgatatgttgaggaaacatacttataacgaagagttagagcagagtaaacggcgtcgtaatggtaacggaaacatgactaggacgttgttaacgtcggggttgagtaatgatggtgtttctacgacggggtttagatcggcggaggcactgtttgagaaagcggtaacgccaagcgacgttgggaagctaaaccgtttggttataccgaaacatcacgcagagaaacattttccgttaccgtcaagtaacgtttccgtgaaaggagtgttgttgaactttgaggacgttaacgggaaagtgtggaggttccgttactcgtattggaacagtagtcagagttatgttttgactaaaggttggagcaggttcgttaaggagaagaatctacgtgctggtgacgtggttagtttcagtagatctaacggtcaggatcaacagttgtacattgggtggaagtcgagatccgggtcagatttagatgcgggtcgggttttgagattgttcggagttaacatttcaccggagagttcaagaaacgacgtcgtaggaaacaaaagagtgaacgatactgagatgttatcgttggtgtgtagcaagaagcaacgcatctttcacgcctcgtaacaactcttcttctttttttttcttttgttgttttaataatttttaaaaactccattttcgttttctttatttgcatcggtttctttcttcttgtttaccaaaggttcatgagttgtttttgttgtattgatgaactg

SEQ ID NO: 4753 - DNA, 987 bp, Artificial Sequence; identical to SEQ ID NO: 1875
  P21243 (35S::G3407)

SEQ ID NO: 4754 - DNA, 1143 bp, Artificial Sequence; identical to SEQ ID NO: 1871
  P21244 (35S::G3400)

SEQ ID NO: 4755 - DNA, 1064 bp, Artificial Sequence; identical to SEQ ID NO: 1877
  P21246 (35S::G3408)

SEQ ID NO: 4756 - DNA, 516 bp, Artificial Sequence
  P21248 (35S::G3394)
agggagcaggacaggttcctccccatcgccaacatcagccgcatcatgaagaaggccatcccggccaacgggaagatcgccaaggacgccaaggagaccgtgcaggagtgcgtctccgagttcatctccttcatcaccagcgagtgagtcgtcgccctcgtcctcccccctcttgtgctctgctctgctctgctctgtcttcttttgagttttgagctttgagctcgttgtttgacttgtcgttggcggcgatgagatgtgactgggtttttgttgtggtggggcaacattacagggcgagcgataaatgccagagggagaagcgcaagaccatcaacggcgacgacttgctgtgggcgatggccacgctgggcttcgaggactacatcgagcccctcaaggtctacctgcagaagtacagagaggtgcgtactgatgtggatgtttggaattggggtgattctctgttgatttaaaaaggtttagttattgctttgcgagttaggtagggacatc

SEQ ID NO: 4757 - DNA, 633 bp, Artificial Sequence
  P21251 (35S::G3429)
tgcattcaaagtggtaattaagaatcggatgatcattttgattgttcctcttcatttgttttggatgtcaggtggcaggaacatggatcaggtcaagaaggcggcagtgagatcggatggggtgggaggtagtgcgaccaacgccgagctgccgatggccaacctcgtacgcctgataaagaaggtgctcccagggaaagcgaagatcgggggagcagccaagggtctcacccatgattgcgcggtggagttcgtcgggttcgtcggcgacgaggcctccgagaaggccaaggcagagcaccgccgcaccgtagcgccggaagactacttgggctcattcggcgaccttggcttcgatcgctacgtcgaccccatggatgcctacatccatggttaccgtgagtttgagagggctggtgggaataggagggtggcgccgcctcctccggcggcagctacaccgctgacgcccggtggaccgacattcactgacgcagagctgcagtttctccggtcggtgatcccctccagaagtgatgatgaatatagcggctcatcaccagccataggcggctatggctatggatatggctatggaaaaaatatgtgaacaacttgatgcatgtgtgtgtg

SEQ ID NO: 4758 - DNA, 761 bp, Artificial Sequence; identical to SEQ ID NO: 1867
  P21252 (35S::G3398)

SEQ ID NO: 4759 - DNA, 610 bp, Artificial Sequence; identical to SEQ ID NO: 1861
  P21253 (35S::G3395)

SEQ ID NO: 4760 - DNA, 356 bp, Artificial Sequence; identical to SEQ ID NO: 1857
  P21254 (35S::G3393)

SEQ ID NO: 4761 - DNA, 1076 bp, Artificial Sequence
  P21255 (35S::G3392)
gctctaaactaccataaaatcttaactcggcattttttttttcacgctaatggaaagtagcggtggaagccagctgggaaagaattccaaaacaagtgatggtcgtgaaacaaaaggttagttgtatctttgttttcttgttcttccttttagccacttcatccttgcttctcttaattacggctattcatttcgtagcattatgtccaaaaggggaaaatgaagatgccagaaaaggtgtatatcattttactagtgtcattttgttaatgtttactgatatttaacctgcctattgtcacacgggtatttttaccatccttgagaaggtacctagaggtaccgtattttctagtgtaaaatttggtacctctaggtactaggtatctcaaggtatcaaaaattttaatgtaaaatttaggtatttgaatgtactttctaaaaaactgtaaaataccttactgtcaccctttgcatcttgatgctttttttggttatgtcaatggagagaacaaaaggaaacgagaagtcagaaagaaacaaggaatttgcaatttgaaaaattctagtggacatacaaattgtaatataaaccataaaattgtaacttgaaacatatttcaagatggtttggctactgggctattttgcttactctggtcaccatattttttgtaaattcgcagaagttaatagcactgcgcaaaattttgttcatttcacagaagaagaggaagatattgttttcagaatgcacaggcttgtcgggaacaggtatcctaatacacatacctgtaatgtgcatcaagtgaaaatgaagacacagtgtctttttaatcgatctagcttatactatgattatttcatagtatgaaagtttatgaaatccataagtcagcctgttccaggcaaatacattatttgcagttccctaactttgctccttctatgatgtttaggtgggaacttatagctggaagaataccgggaaggacagcagaagaagtagagaagttctgggcaattaaacatcaagccacatgatagcagaaagaggatgtttgccccaaaagtag

SEQ ID NO: 4762 - DNA, 321 bp, Artificial Sequence
  P21256 (35S::G3393)
caagatctcaactcggcatttcattggagtttttcacgcctaatggatagcagcagtggtagccagggaaagaattccaaaaccagtgatggttgtgaaacaaaagaagttaataacactgcacagaattttgttcatttcacggaagaagaggaagatctcgttttcagaatgcacaggcttgttgggaacaggtgggaacttatagctggaagaatccctggaagaacagcaaaagaggtagaaatgttctgggcagtaaagcaccagaatacataaggggggaaaaagggtgtatgccctaaaagtagcgtacaattt

SEQ ID NO: 4763 - DNA, 1338 bp, Artificial Sequence; identical to SEQ ID NO: 1855
  P21257 (35S::G3391)

SEQ ID NO: 4764 - DNA, 1068 bp, Artificial Sequence; identical to SEQ ID NO: 1853
  P21260 (35S::G3389)

SEQ ID NO: 4765 - DNA, 1003 bp, Artificial Sequence; identical to SEQ ID NO: 1873
  P21264 (35S::G3401)

SEQ ID NO: 4766 - DNA, 720 bp, Artificial Sequence; identical to SEQ ID NO: 1865
  P21265 (35S::G3397)

SEQ ID NO: 4767 - DNA, 932 bp, Artificial Sequence
  P21266 (35S::G3388)
acgagcggcacgcgcgggtgtggctcgggacgttccccgacgaggaggcggcggcgcgggcctacgacgtggcggcgctccggtaccgggggcgcgacgcggccaccaacttccccggggccgcggcgtcggccgccgagctcgcgttcctcgccgcgcactccaaggccgagatcgtcgacatgctccggaagcacacctacgccgacgagctccgccaggggctccgccgcggccgcggcatgggcgcccgcgcccagcccacgccgtcgtgggcgcgcgagccgctgttcgagaaggccgtgacgcccagcgacgtcggcaagctcaaccgcctcgtggtgcccaagcagcacgccgagaagcacttcccgctccgccgcgcggcgagctccgactccgcctccgccgccgccaccggcaagggcgtgctcctcaacttcgaggacggcgaggggaaggtgtggcgattccggtactcgtactggaacagcagccagagctacgtgctgaccaaggggtggagccgattcgtgagggagaagggcctccgcgccggcgacaccatagtcttctcccgctcggcgtacggccccgacaagctgctcttcatcgactgcaagaagaacaacgcggcggcggcgaccaccacctgcgccggcgacgagaggccaaccacaagcggcgccgaaccacgcgtcgtgaggctcttcggcgtcgacatcgccggcggcgattgccggaagcgggagagggcggtggagatggggcaagaggtcttcctactgaagaggcaatgcgtggttcatcagcgtactcctgccctaggtgccctgctgttatagcatcaaatcaaattcatatatagatcaaatcaaatcttcttctcttccatcttttttgttgttcatcgtctgttgtttcatcttcga

SEQ ID NO: 4768 - DNA, 959 bp, Artificial Sequence; identical to SEQ ID NO: 3
  P21267 (35S::G3430)

SEQ ID NO: 4769 - DNA, 1157 bp, Artificial Sequence
  P21269 (35S::G3399)
ggtgaggagcgagttgtagaggaggagggacaccgatcaaccgggaagctggcggccgggaagtggtgggagcggccagatgacacggccatggccgggatggaccctggcgggggcggcgccggcgccggcagctcacggtacttccaccatctgctccgaccgcagcagccgtcgccgctgtcaccgctgtcgccgacatcccatgtcaagatggagcactccaagatgtcacccgacaagagccccgtgggcgagggagatcacgcgggagggagtggaagcggcggcgtcggcggtgaccaccagccgtcgtcgtcggccatggtgcccgtcgagggtggcagcggcagcgccggcggtagtggctcgggtgggccgacgcggcgcccgcgcgggcgcccgcccgggtccaagaacaagccgaagccgcccatcatcgtgacgcgcgacagcccgaacgcgctgcactcgcacgtgctcgaggtcgccggcggcgccgacgtcgtcgactgcgtggccgagtacgcccgccgccgagggcgcggcgtgtgcgtgctgagcggcggcggcgccgtcgtcaacgtggcgctgcggcagccgggcgcgtcgccgccgggcagcatggtggccacgctgcggggccggttcgagatcctatctctcacgggcacggtcctgcagcctcccgcgccacccggcgcgagcggcctcaccgtgttcctctccggcggccagggccaggtgatcggcggcagcgtggtgggcccgctggtcgccgcggggcccgtcgtcctgatggcggcctcattcgcgaacgccgtgtacgagcggctgccgctggagggcgaggaagaggaggtcgccgcgcccgccgccggaggcgaagcacaagatcaagtggcacaatcagctggacccccagggcagcaaccggcggcgtcacagtcctccggcgtgacaggaggcgacggcaccggcggcgccggtggcatgtcgctctacaacctcgccgggaatgtgggaggctatcagctccccggagacaacttcggaggttggagcggcgccggcgccggcggagtcaggccaccgttctgacccatgtcttagcatccagttcaaaaattctccaaattaagaattgcgcagtgcag

SEQ ID NO: 4770 - DNA, 144 bp, Artificial Sequence
  P21271 (35S::G1073(DBD1))
tcgaccagctcagccatggcctctggctcttcctccggacgtcgtccacgtggtcgtcctgcaggttccaaaaacaaacccaaacctccgacgattataactagagatagtcctaacgtccttagatgacacgttcttgaaggc

SEQ ID NO: 4771 - DNA, 463 bp, Artificial Sequence
  P21272 (35S::G1073(DBD2))
tcgaccagctcagccatggcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgtagatggctgcttcgc

SEQ ID NO: 4772 - DNA, 236 bp, Artificial Sequence
  P21274 (35S::G481(DBD2))
tcgacgatgctatggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatgaggaaagagtggagatggc

SEQ ID NO: 4773 - DNA, 419 bp, Artificial Sequence
  P21275 (35S::G867(DBD1))
tcgaccttatacaggatgggaagcggatcaagcgttgtgttagattcagagaacggcgtagaagctgaatctaggaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattctcattcgaaatctgagatcgttgatatgttgaggaaacatacttataacgaagagttagagcagagtaaacggcgtcgtaatggtaacggaaacatgactaggacgtagttaacgtcggc

SEQ ID NO: 4774 - DNA, 548 bp, Artificial Sequence
  P21276 (35S::G867(DBD2))
tcgacctgagatcgttgatatgttgaggaaacatacttataacgaagagttagagcagagtaaacggcgtcgtaatggtaacggaaacatgactaggacgttgttaacgtcggggttgagtaatgatggtgtttctacgacggggtttagatcggcggaggcactgtttgagaaagcggtaacgccaagcgacgttgggaagctaaaccgtttggttataccgaaacatcacgcagagaaacattttccgttaccgtcaagtaacgtttccgtgaaaggagtgttgttgaactttgaggacgttaacgggaaagtgtggaggttccgttactcgtattggaacagtagtcagagttatgttttgactaaaggttggagcaggttcgttaaggagaagaatctacgtgctggtgacgtggttagtttcagtagatctaacggtcaggatcaacagttgtacattgggtggaagtcgagatccgggtcagatttagatgcgggtcgggttttgagattgttcggagttaacatttgaccggagagttcgc

SEQ ID NO: 4775 - DNA, 1502 bp, Artificial Sequence
  P21281 (35S::G481::GR::6XHA)
cccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctgggcggccgctgaagctcgaaaaacaaagaaaaaaatcaaagggattcagcaagccactgcaggagtctcacaagacacttcggaaaatcctaacaaaacaatagttcctgcagcattaccacagctcacccctaccttggtgtcactgctggaggtgattgaacccgaggtgttgtatgcaggatatgatagctctgttccagattcagcatggagaattatgaccacactcaacatgttaggtgggcgtcaagtgattgcagcagtgaaatgggcaaaggcgataccaggcttcagaaacttacacctggatgaccaaatgaccctgctacagtactcatggatgtttctcatggcatttgccctgggttggagatcatacagacaatcaagtggaaacctgctctgctttgctcctgatctgattattaatgagcagagaatgtctctaccctgcatgtatgaccaatgtaaacacatgctgtttgtctcctctgaattacaaagattgcaggtatcctatgaagagtatctctgtatgaaaaccttactgcttctctcctcagttcctaaggaaggtctgaagagccaagagttatttgatgagattcgaatgacttatatcaaagagctaggaaaagccatcgtcaaaagggaagggaactccagtcagaactggcaacggttttaccaactgacaaagcttctggactccatgcatgaggtggttgagaatctccttacctactgcttccagacatttttggataagaccatgagtattgaattcccagagatgttagctgaaatcatcactaatcagataccaaaatattcaaatggaaatatcaaaaagcttctgtttcatcaaaaatctagttacccatacgatgttcctgactatgcgggctatccctatgacgtcccggactatgcaggatcctatccatatgacgttccagattacgcttctagatacccatacgatgttcctgactatgcgggctatccctatgacgtcccggactatgcaggatcctatccatatgacgttccagattacgc

SEQ ID NO: 4776 - DNA, 1728 bp, Artificial Sequence
  P21287 (35S::GR::G481::12XHA)
atgaaccttgaagctcgaaaaacaaagaaaaaaatcaaagggattcagcaagccactgcaggagtctcacaagacacttcggaaaatcctaacaaaacaatagttcctgcagcattaccacagctcacccctaccttggtgtcactgctggaggtgattgaacccgaggtgttgtatgcaggatatgatagctctgttccagattcagcatggagaattatgaccacactcaacatgttaggtgggcgtcaagtgattgcagcagtgaaatgggcaaaggcgataccaggcttcagaaacttacacctggatgaccaaatgaccctgctacagtactcatggatgtttctcatggcatttgccctgggttggagatcatacagacaatcaagtggaaacctgctctgctttgctcctgatctgattattaatgagcagagaatgtctctaccctgcatgtatgaccaatgtaaacacatgctgtttgtctcctctgaattacaaagattgcaggtatcctatgaagagtatctctgtatgaaaaccttactgcttctctcctcagttcctaaggaaggtctgaagagccaagagttatttgatgagattcgaatgacttatatcaaagagctaggaaaagccatcgtcaaaagggaagggaactccagtcagaactggcaacggttttaccaactgacaaagcttctggactccatgcatgaggtggttgagaatctccttacctactgcttccagacatttttggataagaccatgagtattgaattcccagagatgttagctgaaatcatcactaatcagataccaaaatattcaaatggaaatatcaaaaagcttctgtttcatcaaaaaggtaccgtcgacgcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtgcggccgctctagttacccatacgatgttcctgactatgcgggctatccctatgacgtcccggactatgcaggatcctatccatatgacgttccagattacgcttctagatacccatacgatgttcctgactatgcgggctatccctatgacgtcccggactatgcaggatcctatccatatgacgttccagattacgctactagttacccatacgatgttcctgactatgcgggctatccctatgacgtcccggactatgcaggatcctatccatatgacgttccagattacgcttctagatacccatacgatgttcctgactatgcgggctatccctatgacgtcccggactatgcaggatcctatccatatgacgttccagattacgctactagacaggcctcgtaccggatcctctag

SEQ ID NO: 4777 - DNA, 1651 bp, Artificial Sequence
  P21294 (35S::G481::INTPDK::AG481)
tcgacggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattcgattcactcgaattcggtagcccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcaattttatatagtattatttttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgggaaattgggttcgaaatcgataatcttgcggccgctctagagaattcgagtgaatcgaataacaacaggatgtggacaaatttttccttcattcaagtgttctcaacatctaacagagaaatctttaaatacaaccaactaaaccggaaacaataaaccaaacgttcaaactaacataaccgaaattgagagtaaacccgaaatagttgtcgatcagctcaactataaacaactcactgatctctaatttcccttgatcatttggcgattgttcttaatcactacttgcaacttcttttaccagctcggcatttcttcaccagaaacaccgccaccagcatctctatttgatccatctccactctttcctgatcccttattatcaccctccaactccctgtacctcgctaggtatatctttagaggttccaggtaatcctcaaatccgtcgacg

SEQ ID NO: 4778 - DNA, 1445 bp, Artificial Sequence
  P21299 (35S::G682/G226::INTPDK::AG226/G682)
tcgaccttcttgttccgaagaggtgagtagtcttgagtgggaagttgtgaacatgagtcaagaagaagaagatttggtctctcgaatgcataagcttgtcggtgacaggtgggagttgatcgccggaaggcgcggccgcggaagtgagtagcatcgaatgggagtttatcagtatgaccgaacaagaagaagatctcatctctcgaatgtacagacttgtcggaaataggtgggatttaatagcaggaagagtcgtaggaagaaaggcaaatgagatagagagatactggattatgagaaacgaattcggtagcccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcaattttatatagtattatttttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgggaaattgggttcgaaatcgataatcttgcggccgctctagagaattcgtttctcataatccagtatctctctatctcatttgcctttcttcctacgactcttcctgctattaaatcccacctatttccgacaagtctgtacattcgagagatgagatcttcttcttgttcggtcatactgataaactcccattcgatgctactcacttccgcggccgcgccttccggcgatcaactcccacctgtcaccgacaagcttatgcattcgagagaccaaatcttcttcttcttgactcatgttcacaacttcccactcaagactactcacctcttcggaacaagaaggtcgacg

SEQ ID NO: 4779 - DNA, 1351 bp, Artificial Sequence; identical to SEQ ID NO: 4747
  P21300 (35S::G2345/G482::INTPDK::AG482/G2345)

SEQ ID NO: 4780 - DNA, 1053 bp, Artificial Sequence
  P21301 (35S::G2156::INTPDK::AG2156)
tcgacccgtccacgtggtcgtcctgcgggatccaagaacaagccgaagccaccggtgatagtgactagagatagccccaacgtgcttagatcacacgttcttgaagtcggaattcggtagcccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcaattttatatagtattatttttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgggaaattgggttcgaaatcgataatcttgcggccgcgaattccgacttcaagaacgtgtgatctaagcacgttggggctatctctagtcactatcaccggtggcttcggcttgttcttggatcccgcaggacgaccacgtggacgggtcgact

SEQ ID NO: 4781 - DNA, 1317 bp, Artificial Sequence
  P21303 (35S::G867::INTPDK::AG867)
tcgacgaagccgaatcaagaaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattcggtagcccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcaattttatatagtattatttttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgggaaattgggttcgaaatcgataatcttgcggccgctctagagaattcaagaaatcgacctcgtcttcgtccatcttcacgtctttgaaatttgtgacggcgtcacggcgacggaacctgtgaaccgcgacgtcgtaggcacgagcggcttcgtcttcttcgttgaatgtcccgagccacacgcgctggtgtttctcgtaaatctgagctccccatcttccgtttggttgtggcaccacacctttgtattttgacgacggaagctttcttgattcggcttcgtcgacg

SEQ ID NO: 4782 - DNA, 1107 bp, Artificial Sequence
  P21304 (35S::G867::INTPDK::AG867)
tcgacgaaagcttccgtcgtcaaaatacaaaggtgtggtgccacaaccaaacggaagatggggagctcagatttacgagaaacaccagcgcgtgtggctcgggacattcaacgaggaagaagaagcccgctcggaattcggtagcccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcaattttatatagtattatttttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgggaaattgggttcgaaatcgataatcttgcggccgctctagagaattccgagcgggcttcttcttcctcgttgaatgtcccgagccacacgcgctggtgtttctcgtaaatctgagctccccatcttccgtttggttgtggcaccacacctttgtattttgacgacggaagctttcgtcgacg

SEQ ID NO: 4783 - DNA, 1351 bp, Artificial Sequence
  P21305 (35S::G2345/G485::INTPDK::AG485/G2345)
tcgacaggaatgcgtctctgagttcatcagcttcgtcaccagcgaggctagtgataagtgccaaagagagaaaaggaagaccatcaatggagatgatttgctttgggctatggtcactttaggatttgaggattacgcggccgcggagcaagacaggttcttaccgatcgctaacgttagcaggatcatgaagaaagcacttcctgcgaacgcaaaaatctctaaggatgctaaagaaacgatgcaggagtgtgtgaattcggtagcccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcaattttatatagtattatttttcaatcaacattcttattaatttctaaataatacttgtagttttattaacttctaaatggattgactattaattaaatgaattagtcgaacatgaataaacaaggtaacatgatagatcatgtcattgtgttatcattgatattacatttggattgattacagttgggaaattgggttcgaaatcgataagcttgcggccgctctagagaattcacacactcctgcatcgtttctttagcatccttagagatttttgcgttcgcaggaagtgctttcttcatgatcctgctaacgttagcgatcggtaagaacctgtcttgctccgcggccgcgtaatcctcaaatcctaaagtgaccatagcccaaagcaaatcatctccattgatggtcttccttttctctctttggcacttatcactagcctcgctggtgacgaagctgatgaactcagagacgcattcctgtcgacg

SEQ ID NO: 4784 - DNA, 735 bp, Artificial Sequence; identical to SEQ ID NO: 1887
  P21314 (35S::G3435)

SEQ ID NO: 4785 - DNA, 803 bp, Artificial Sequence; identical to SEQ ID NO: 1889
  P21315 (35S::G3436)

SEQ ID NO: 4786 - DNA, 1290 bp, Artificial Sequence; identical to SEQ ID NO: 1883
  P21318 (35S::G3432)

SEQ ID NO: 4787 - DNA, 268 bp, Artificial Sequence; identical to SEQ ID NO: 1893
  P21320 (35S::G3444)

SEQ ID NO: 4788 - DNA, 257 bp, Artificial Sequence; identical to SEQ ID NO: 1881
  P21324 (35S::G3431)

SEQ ID NO: 4789 - DNA, 862 bp, Artificial Sequence
  P21328 (35S::G3456)
aacttcaacttttgttatggccaaccggtggtggaccgggtcggtgggtctagagaactctggccactcgatgaaaaaaccggatctggggttttccatgaacgagagtacggtgacggggaaccatataggagaagaagatgaggacagagaaaacagcgacgagccaagagagggagctattgacgtcgccaccacgcgccgccctaggggacgtccaccgggctccagaaacaagccgaaaccgccgatattcgtcacccgagacagccctaacgcgctgcggagccacgtcatggagattgccgtcggagccgacatcgccgactgcgtggcgcagttcgctcggaggcgccagcgcggggtttccattctcagcggcagcgggaccgtcgtcaacgtcaatctccggcaacccacggcacccggcgccgtcatggcgctccacggccgcttcgacatcctctccctcaccggctcctttctccctgggccgtcccctcccggcgccaccgggctcacaatctacctcgccggaggccaggggcagatcgtcggcggcggagtggtgggcccgctcgtggcggcgggccccgtattggtaatggcggctactttttccaatgctacgtatgaaagattgcctttagaggatgatgatcaggaacaacacggcggcggaggcggaggaggttcgccgcaggaaaaaaccgggggtcccggcgaggcgtcgtcgtcgatttcggtttataacaataatgttcctccgagtttaggtcttccgaatgggcaacatctgaaccatgaagcttattcttctccttggggtcattctcctcatgccagacctcctttctaatta

SEQ ID NO: 4790 - DNA, 902 bp, Artificial Sequence
  P21331 (35S::G3459)
tggatgtgtctatggctggtttggatttaggaagcgcctcacgctttgttcaaaaccttcacagaccagacttgcacttgcaacaaaatttccagcagcaccaggaccagcagcaccagcgtgatttggaggagcagaaaactcctccgaatcacagaatgggggcgccgttcgacgatgatagcgatgatagaagcccgggcctggagctcacttcaggtcctggcgacatcgtcggacggcgcccgcgtggcaggcctcctgggtcgaagaacaagcctaagccgcccgtcataatcacccgggagagcgccaacacgctgagggcgcacatcctcgaggtcggaagcggctccgacgtcttcgactgtgtcaccgcgtatgcccggcggcgccagcgtgggatctgcgtcctcagtggcagcggcaccgtcaccaatgtcagtctccggcagcctgcagctgccggtgccgtcgtcacgctgcacggcaggttcgagattctctccctctctggctcgttcctcccgccgccggctccgccgggagccaccagcctcacaatctacctggccggcgggcaggggcaggttgtcggaggaaacgtcatcggagaattaaccgcagcagggccagtaatcgtcatcgcagcgtcgttcaccaacgtggcttacgagaggttacccttagaagaagatgaacaacagcagcaacaacagcagcttcagattcagccacctgcaacgacgtcgtctcaaggaaacaacaacaacaataaccctttccccgacccttcttcaggacttcccttcttcaatttaccactcaatatgcagaatgttcagttaccagttgagggttgggctgtaaaccctgcttcacgtccacaacctttttgagag

SEQ ID NO: 4791 - DNA, 859 bp, Artificial Sequence
  P21332 (35S::G3460)
tatggctggtttggatttaggaagcgcgtcacgctttgttcagaatcttcacttaccggacttgcacttgcaacaaaattaccagcaaccccggcacaagcgcgattcggaggagcaagagactcctccgaacccgggaacagcgctggcgccgttcgacaacgatgatgacaaaagccagggcctggagctggcttcaggccctggggacatcgttggacggcgcccacgcggcagaccttccgggtccaagaacaagccgaagccaccggtgataatcacccgggagagcgccaacacgctgagggcgcacattctcgaggtaggaagcggctccgacgtcttcgactgtgtcaccgcttatgcgcggcggcgccagcgcgggatctgcgtcctcagcggcagtggtaccgtcaccaatgtcagtctccggcagcctgcggctgccggagccgtcgtcaggctgcacggaaggttcgagattctctctctctccggctcgttcctcccgccgccggctccgccgggagccaccagtctcacaatctacctcgccggcgggcagggccaggtcgtcggaggaaacgtcgtgggagaattaaccgcggcagggccagtaatcgtcatcgcagcatcgttcaccaacgtggcttacgagaggctccccttagaagaagatgaacaacaacaacaacagcttcagattcagtcacccgcaacgacgtcatctcaaggaaacaacaacaataaccctttccctgacccttcttcaggacttcccttcttcaacttaccactcaatatgcagaatgttcagttaccacctttttgagggttcatgaatctgataatatgagac

SEQ ID NO: 4792 - DNA, 555 bp, Artificial Sequence; identical to SEQ ID NO: 1921
  P21341 (35S::G3470)

SEQ ID NO: 4793 - DNA, 556 bp, Artificial Sequence; identical to SEQ ID NO: 1923
  P21342 (35S::G3471)

SEQ ID NO: 4794 - DNA, 553 bp, Artificial Sequence; identical to SEQ ID NO: 1929
  P21344 (35S::G3474)

SEQ ID NO: 4795 - DNA, 528 bp, Artificial Sequence; identical to SEQ ID NO: 1933
  P21345 (35S::G3476)

SEQ ID NO: 4796 - DNA, 600 bp, Artificial Sequence; identical to SEQ ID NO: 1931
  P21347 (35S::G3475)

SEQ ID NO: 4797 - DNA, 547 bp, Artificial Sequence; identical to SEQ ID NO: 1925
  P21348 (35S::G3472)

SEQ ID NO: 4798 - DNA, 602 bp, Artificial Sequence; identical to SEQ ID NO: 1935
  P21350 (35S::G3478)

SEQ ID NO: 4799 - DNA, 285 bp, Artificial Sequence; identical to SEQ ID NO: 1905
  P21351 (35S::G3450)

SEQ ID NO: 4800 - DNA, 302 bp, Artificial Sequence; identical to SEQ ID NO: 1895
  P21352 (35S::G3445)

SEQ ID NO: 4801 - DNA, 257 bp, Artificial Sequence; identical to SEQ ID NO: 1897
  P21353 (35S::G3446)

SEQ ID NO: 4802 - DNA, 250 bp, Artificial Sequence; identical to SEQ ID NO: 1899
  P21354 (35S::G3447)

SEQ ID NO: 4803 - DNA, 264 bp, Artificial Sequence; identical to SEQ ID NO: 1901
  P21355 (35S::G3448)

SEQ ID NO: 4804 - DNA, 268 bp, Artificial Sequence; identical to SEQ ID NO: 1903
  P21356 (35S::G3449)

SEQ ID NO: 4805 - DNA, 803 bp, Artificial Sequence
  Artificial sequence
  P21381 (35S::G3436)
tttgacttgaccggacagtgctgttcggtggctcggccgcgatgccggactccgacaacgagtccggcgggccgagcaacgcggagttctcgtcgccgcgggagcaggaccggttcctgccgatcgcgaacgtgagccggatcatgaagaaggcgctcccggccaacgccaagatctccaaggacgccaaggagacggtgcaggagtgcgtgtcggagttcatctccttcatcaccggcgaggcctccgacaagtgccagcgcgagaagcgcaagaccatcaacggcgacgacctactctgggccatgaccacgctcggcttcgaggactacgtcgagccgctcaagctctacctccacaagttccgcgagctcgagggcgagaaggcggccacgacgagcgcctcctccggcccgcagccgccgctgcacagggagacgacgccgtcgtcgtcaacgcacaatggcgcgggcgggcccgtcgggggatacggcatgtacggcggcgcgggcgggggaagcggtatgatcatgatgatgggacagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggacaggttgtgaccgtcgccgtccatgcttgcatggccatggccatggcatggctcccgccgccggcttcttgcttggtgtcggtaattagcgctggtggcctgcgctggttaagttaacctt

SEQ ID NO: 4806 - DNA, 451 bp, Artificial Sequence
  P21401 (35S::G3515)
agcggttgcgtccgcatggaggacgacaagagtaaggaggggaaatcgtcgtcgtcgtaccgcggcgtgcggaagcggccgtggggcaagttcgcggcggagatccgcgacccggagcgcgggggagcccgcgtgtggctcggcacgttcgacaccgcggaggaggccgcgcgggcgtacgaccgcgccgcattcgccatgaagggcgccacggccatgctcaacttcccgggagatcatcatcacggcgccgcaagcaggatgaccagcaccggctcttcttcgtcctccttcaccacgcctcctccggcgaactcctccgcggcggcgggccgcggcggctccgatcggacgacggacaaggtggagctggagtgcctcgacgacaaggtcctggaggacctcctcgcggagaccaactatcgtgataagaactactagctagctagct

SEQ ID NO: 4807 - DNA, 393 bp, Artificial Sequence
  P21402 (35S::G3516)
atggaggacgacaagaaggagggcaagtaccgcggcgtgcggaagcggccgtggggcaagttcgccgcggagatccgggacccggagcgcggcggctcccgcgtctggctcggcaccttcgacaccgccgaggaggccgccagggcctacgaccgcgccgcattcgccatgaagggcgccacggccgtgctcaacttccccgccagcggaggatcgtcagctggcgcggctcccggcggccggaccagcggcggctcctcctcgtccaccacgtcggctccggccagcagggggagggcccgtgttcccgactcggagaaggtggagctggagtgcctcgacgacagggtcttggaggagctgctcgcggaggacaagtacaacaagaactaa

SEQ ID NO: 4808 - DNA, 444 bp, Artificial Sequence
  P21403 (35S::G3517)
acagccatcatcgccacccgcgcgcttatggatggcgagtggtccaaggacggcggaggcggcgagccgaccaagtaccgcggcgtgcggcgtcggccctggggcaagtacgcggcggagatccgcgactcgagccggcacggcgtccgcatctggctcggcacgttcgacaccgccgaggaggccgccagggcgtacgaccgctccgccaactccatgcgcggcgccaacgccgtgctcaacttcccggaggacgcgcccgcctacgccgccgccgcctcccgtggctccgccggcggatcctcgtccagaccggcgggctccggccgggacgtgatcgagtttgagtacctcgacgacgaggtgctgcaggagatgctcaggagccaggagccgtcggcggcggcggcgcagaagaagaagtagcgcgagcgccacaggtgg

SEQ ID NO: 4809 - DNA, 604 bp, Artificial Sequence
  P21404 (35S::G3518)
gttaattctaagttctaagagaagaaaaatggagggtggaagatcatcagtttcaaatgggaatgttgaggttcgttatagagggattagaagaaggccatggggaaagtttgcagcagagattcgtgaccctacaaggaaaggaacaaggatatggcttggaacatttgacactgctgaacaagctgcacgagcttatgatgctgctgcttttcattttcgtggccacagagcaattctcaacttcccaaatgagtatcaatctcataatccaaactcttctttgcctatgcctctagctgtgtcagctcctccttcttattcttcttcttcttccacttctaattattccggtgatgataataataaccaccttgtgagaccagctttttctggagaaataatgcaaggtggtgatcatgatgatgatacttttgagttggagtacttcgataataagttgctcgaggaactccttcagatgcaagataacagacacttctaaaagtaaaatataacacaagccagctatgttgtgttagtcactggcatgaaataaaatgcaaagaaatattgttgattttatttaatatattttgtttga

SEQ ID NO: 4810 - DNA, 486 bp, Artificial Sequence
  P21405 (35S::G3519)
tcgacattaagttctaagagaataacaatggagggtgggaagatcatctgcttcaaatgggaattgtgaggttcggtatagagggattagaagaaggccatggggcaagtttgcagcagagattcgtgaccctacgagaaaagggacaaggatatggcttggaacatttgacactgcggaacaagctgctcgagcttatgatgctgctgcttttcattttcgtggtcatagagcaattctcaacttcccaaatgagtaccaatctcataatccaaactcttctttgcctatgcctctaattgtgcctcctccttcttattcttcttctttcacttctaattattctggtgatgataataaccaccttgtgagacctggagaaataatgcaaggtggtgatcttgatgacacttttgagttggagtacttggataataagttgctcgaggaactccttcagatgcaagataacagacacttctaagc

SEQ ID NO: 4811 - DNA, 576 bp, Artificial Sequence
  P21406 (35S::G3520)
gtagggatgacgcacaatcccactatccttcgcaagacccttcctctatataaggaagttcatttcatttggagaggacacgctgacaagctgactctagcagatctggtaccgtcgacaaggcacacaatggaagaggagtcaaaggagaaaaagaaggacactaaggaggaaccacgttatagaggagtgcggcggcggccgtgggggaagttcgcggccgagattcgggacccggcccggcacggtgcccgagtgtggctggggacatttctcacggcggaggaggctgctagggcttatgaccgagctgcctatgagatgaggggcgctttagccgttctcaattttccaaatgagtatccttcatgctcttctatgaactcatcttcaacattagcaccttcatcttcttcttcaaattcaatgcttaaaagtgatcatggtaaacaagttattgagttcgagtgcttggatgacaaattgttagaggaccttcttgattgtgatgactatgcctacgagaaagacttgcctaagaactgaacggtttgatcaagcggcgccttttccaaa

SEQ ID NO: 4812 - DNA, 479 bp, Artificial Sequence
  P21460 (35S::G3380)
ggtccgatccgtaacagtagtagctagttaatttgattattgtccgtccgcggccggtcagtggtcgcaatcgatcgatcgatatcatggacggcgacggcggcggcggatgggacgatcagggcaacggcggcggcgagacgaccaagtaccgtggcgtgcgtcgccggccttctggcaagttcgcggcggagatccgtgactccagcaggcagagcgtccgcgtctggctgggaaccttcgacaccgccgaggaggctgcgcgggcttacgaccgcgccgcctacgccatgcgcggccacctcgccgtcctcaacttccctgctgaggcgcgcaactacgtgcggggatcaggctcgtcgtcctcgtcccgacagcatcagcagcggcaggtgatcgagctggagtgcctagacgaccaagtgctgcaagagatgctcaagggtggcgacgatcagtacaggtcagcagctgggagc

SEQ ID NO: 4813 - DNA, 514 bp, Artificial Sequence; identical to SEQ ID NO: 1847
  P21461 (35S::G3381)

SEQ ID NO: 4814 - DNA, 1160 bp, Artificial Sequence; identical to SEQ ID NO: 1869
  P21465 (35S::G3399)

SEQ ID NO: 4815 - DNA, 534 bp, Artificial Sequence
  P21466 (35S::G3434)
tcgacaagggttgcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctagc

SEQ ID NO: 4816 - DNA, 869 bp, Artificial Sequence; identical to SEQ ID NO: 1915
  P21467 (35S::G3456)

SEQ ID NO: 4817 - DNA, 534 bp, Artificial Sequence
  P21469 (35S::G3474)
atggctgagtccgacaacgagtcaggaggtcacacggggaacgcgagcgggagcaacgagttgtccggttgcagggagcaagacaggttcctcccaatagcaaacgtgagcaggatcatgaagaaggcgttgccggcgaacgcgaagatatcgaaggaggcgaaggagacggtgcaggagtgcgtgtcggagttcatcagcttcataacaggagaggcttccgataagtgccagaaggagaagaggaagacgatcaacggcgacgatcttctctgggccatgactaccctgggcttcgaggactacgtggatcctctcaagatttacctgcacaagtatagggagatggagggggagaaaaccgctatgatgggaaggccacatgagagggatgagggttatggccatggccatggtcatgcaactcctatgatgacgatgatgatggggcatcagccccagcaccagcaccagcaccagcaccagggacacgtgtatggatctggatcagcatcttctgcaagaactagatag

SEQ ID NO: 4818 - DNA, 568 bp, Artificial Sequence
  P21471 (35S::G3477)
tcgacttgtagggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaatgctcagcttgttcatcagggttcgctgaactatattggtttgcaggtgcaaccacaacatctggttatgccttcaatgcaaggccatgaatagtttagatgcttctacgcatcgc

SEQ ID NO: 4819 - DNA, 803 bp, Artificial Sequence; identical to SEQ ID NO: 2033
  P21493 (35S::G3556)

SEQ ID NO: 4820 - DNA, 1304 bp, Artificial Sequence
  P21495 (35S::G3455)
ctcttagaatccgtacggtctaatcaacacaacaaaatggatgcaattagttgcctggatgagagcaccaccaccgagtcactctccataagtcaggcgaagccttcttcgacgattatgtcgtccgagaaggcttctccttccccgccgccgccgaacaggctgtgccgcgtcggtagcggtgctagcgcagtcgtggattccgacggcggcggcgggggtggcagcaccgaggtggagtcgcggaagctcccctcgtccaagtataagggcgtcgtgccccagcccaacggccgctggggctcgcagatttacgagaagcaccagcgcgtgtggctgggaacgttcaacgaggaagacgaggcggcgcgtgcgtacgacgtcgccgtgcagcgattccgcggcaaggacgccgtcacaaacttcaagccgctctccggcaccgacgacgacgacggggaatcggagtttctcaactcgcattcgaaatccgagatcgtcgacatgctgcgtaagcatacgtacaatgacgagctggaacaaagcaagcgcagccgcggcttcgtacgtcggcgcggctccgccgccggcgccggaaacggaaactcaatctccggcgcgtgtgttatgaaggcgcgtgagcagctattccagaaggccgttacgccgagcgacgttgggaaactgaaccgtttggtgataccgaagcagcacgcggagaagcactttcctttacagagcgctgctaacggcgttagcgcgacggcgacggcggcgaagggcgttttgttgaacttcgaagacgttggagggaaagtgtggcggtttcgttactcgtattggaacagtagccagagttacgtcttgaccaaaggttggagccggttcgttaaggagaagaatctgaaagccggtgacacggtttgttttcaacggtccactggaccggacaggcagctttacatcgattggaagacgaggaatgttgttaacgaggtcgcgttgttcggaccggttgtcgaaccgatccagatggttcggctctttggtgttaacattttgaaactacccggttcagattctatcgccaataacaataatgcaagtgggtgctgcaatggcaagagaagagaaatggaactcttttcattagagtgtagcaagaaacctaagattattggtgctttgtagcgttacgttactttttttgagttttttttttttttttgagttttgtgactgatgaaagaaagaaggtacaagaagaacggcggtgtagtggcatagtggcatcgcaagttggc

SEQ ID NO: 4821 - DNA, 1253 bp, Artificial Sequence; identical to SEQ ID NO: 1907
  P21500 (35S::G3451)

SEQ ID NO: 4822 - DNA, 1081 bp, Artificial Sequence; identical to SEQ ID NO: 1909
  P21501 (35S::G3452)

SEQ ID NO: 4823 - DNA, 980 bp, Artificial Sequence
  P21521 (PRSUC2::G1073)
tcgaccccccgacctgcctctacagagacctgaagattccagaaccccacctgatcaaaaataacatggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttagagttttagcgttttggtgacaccttttgttgcgtttgcgtgtttgacctcaaactactaggctactagctatagcggttgcgaaatgcgaatattaggttgc

SEQ ID NO: 4824 - DNA, 847 bp, Artificial Sequence
  P21522 (PRSUC2::G481)
tcgacccacgcgtccgagcgtttcgtagaaaaattcgatttctctaaagccctaaaactaaaacgactatccccaattccaagttctagggtttccatcttccccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaataccaaatccttaaattaa

SEQ ID NO: 4825 - DNA, 1297 bp, Artificial Sequence
  P21524 (PRSUC2::G867)
tcgacccacgcgtccgcacaacacaaacacatttctgttttctccattgtttcaaaccataaaaaaaaacacagattaaatggaatcgagtagcgttgatgagagtactacaagtacaggttccatctgtgaaaccccggcgataactccggcgaaaaagtcgtcggtaggtaacttatacaggatgggaagcggatcaagcgttgtgttagattcagagaacggcgtagaagctgaatctaggaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattctcattcgaaatctgagatcgttgatatgttgaggaaacatacttataacgaagagttagagcagagtaaacggcgtcgtaatggtaacggaaacatgactaggacgttgttaacgtcggggttgagtaatgatggtgtttctacgacggggtttagatcggcggaggcactgtttgagaaagcggtaacgccaagcgacgttgggaagctaaaccgtttggttataccgaaacatcacgcagagaaacattttccgttaccgtcaagtaacgtttccgtgaaaggagtgttgttgaactttgaggacgttaacgggaaagtgtggaggttccgttactcgtattggaacagtagtcagagttatgttttgactaaaggttggagcaggttcgttaaggagaagaatctacgtgctggtgacgtggttagtttcagtagatctaacggtcaggatcaacagttgtacattgggtggaagtcgagatccgggtcagatttagatgcgggtcgggttttgagattgttcggagttaacatttcaccggagagttcaagaaacgacgtcgtaggaaacaaaagagtgaacgatactgagatgttatcgttggtgtgtagcaagaagcaacgcatctttcacgcctcgtaacaactcttcttctttttttttcttttgttgttttaataatttttaaaaactccattttcgttttctttatttgcatcggtttctttcttcttgtttaccaaaggttcatgagttgtttttgttgtattgatgaactgtaaattttatttataggataaattttaaaaaaaaaaaaaaaaaaaa

SEQ ID NO: 4826 - DNA, 468 bp, Artificial Sequence
  P23304 (35S::G3396)
tcgacaaaaactaagcgatgtcggaggggttcgacgggacggagaacggcggcggcggcggcggaggcggagtagggaaggagcaggaccggttcctgccgatcgccaacatcggccgcatcatgcgccgggccgtgccggagaacggcaagatcgccaaggactccaaggagtccgtccaggagtgcgtctccgagttcatcagcttcatcaccagcgaagcaagcgacaagtgcctcaaggagaagcgcaagaccatcaatggggacgacctgatctggtcaatgggcacgctcggattcgaggactatgtcgagcctctcaagctctacctcaggctctaccgggagacggagggtgacacaaagggttcaagagcttctgaactgccagtaaagaaagatgttgtacttaatggagatcctggatcatcgtttgaaggcatgtaggacgaggagtgtgatagct

SEQ ID NO: 4827 - DNA, 649 bp, Artificial Sequence; identical to SEQ ID NO: 3832
  P23322 (PRCUT1::G682)

SEQ ID NO: 4828 - DNA, 649 bp, Artificial Sequence; identical to SEQ ID NO: 3832
  P23328 (PRLTP1::G682)

SEQ ID NO: 4829 - DNA, 1141 bp, Artificial Sequence
  P23348 (35S::G3453)
caaagttagttcgttaaccgttacaaacacaaaatggatggaggcagtgtcacagacgaaaccaccacaaccagcaactctctttcggttccggcgaatctatctccgccgcctctcagccttgtcggcagcggcgcaaccgccgtcgtctaccccgacggttgttgcgtctccggcgaagccgaatcccggaaactcccgtcctcgaaatacaaaggcgtggtgccgcaaccgaacggtcgttggggagctcagatttacgagaagcaccagcgcgtgtggctcggcaccttcaacgaggaagacgaagccgccagagcctacgacatcgccgcgcatcgcttccgcggccgcgacgccgtcactaacttcaagcctctcgccggcgccgacgacgccgaagccgagttcctcagcacgcattccaagtccgagatcgtcgacatgctccgcaagcacacctacgacaacgagctccagcagagcacccgcggcggcaggcgccgccgggacgccgaaaccgcgtcgagcggcgcgttcgacgcgaaggcgcgtgagcagctgttcgagaaaaccgttacgcagagcgacgtcgggaagctgaaccgattagtgataccaaagcagcacgcggagaagcactttccgttaagcggatccggcggcggagccttgccgtgcatggcggcggctgcgggggcgaagggaatgttgctgaactttgaggacgttggagggaaagtgtggcggttccgttactcgtattggaacagtagccagagctacgtgcttaccaaaggatggagccggttcgttaaggagaagaatcttcgagctggtgacgcggttcagttcttcaagtcgaccggactggaccggcaactatatatagactgcaaggcgaggagtggtaaggttaacaataatgctgccggtttgtttattccggttggaccggttgttgagccggttcagatggtacggcttttcggggtcgaccttttgaaactacccgtacccggttcggatggtattggggttggctgtgacgggaagagaaaagagatggagctgtttgcatttgaatgtagcaagaagttaaaagtaattggagctttgtaacattacatagtttttgagt

SEQ ID NO: 4830 - DNA, 488 bp, Artificial Sequence
  P23384 (35S::G3394)
tcgacggaggtgggatggcggatgggccggggagcccggggggaggaggggggagccaacatcagccgcatcatgaagaaggccatcccggccaacgggaagatcgccaaggacgccaaggagaccgtgcaggagtgcgtctccgagttcatctccttcatcaccagcgaggcgagcgataaatgccagagggagaagcgcaagaccatcaacggcgacgacttgctgtgggcgatggccacgctgggcttcgaggactacatcgagcccctcaaggtctacctgcagaagtacagagagatggagggtgatagtaaattaactgcaaaggctggtgatggctctgtgaaaaaggatgtacttggttctcatggaggaagcagttcaagtgcccaagggatgggccaacaagcagcatacaatcaaggaatgggttatatgcaacctcagtaccataatggggatgtctcaaactgaagataggacct

SEQ ID NO: 4831 - DNA, 708 bp, Artificial Sequence
  P23418 (35S::G3660)
tcgactctgtaataataatgtacggacatggcgagataaccacggcagcagaatcagattacgctttgctggagtcaatacgacgtcacttgctaggtggagacaacgagttacgattcagtgagtcaataccgagttcatgtttcactcagagttggggagacttgccattgaaagagaacgactccgaggatatgttagtgtacagtgtcctcaacgacgccttcaacggagcctttgaaacgtcgtcgccgtcgtcggacttgagctgtctcagcgattttaacgattttccggcggttaaaatggaaacttcggagaacttagcagcggaggcggaaaaaatgaaggcggtggcggcgccgccgtcaaagggaaagcattacagaggggtgagacagaggccgtgggggaaattcgcggcggagatacgtgatccggcgaaaaaaggagcgagggaatggttagggacgtttgagacggcggaagatgcagctttggcttacgatagagctgcttttaggatgcgtggttcccgcgctttgttgaattttccgttgagggttaactccggtgaacctgacccggtaaggatcaagtcaaagaggtcttataagtcttcttcgtcgtcctcttctgaaaacgggaagccgaagcagaggagaagaacagagaacgtgccatagttcaggtgaagggcgatgttgt

SEQ ID NO: 4832 - DNA, 844 bp, Artificial Sequence
  P23419 (35S::G3661)
tcgaccaggatgctgctgaacccggcgtcagaggcgtcggtgctagacaccatccggcagcacctcctcgaggagccagccgacgagagcttcgggagcctggtggcggaccagtggagcggctcgctcccgttccgcaccgacgacgccgacgacatggtggtgttcggggcgctgcaggacgccttcgcctacggctggctgcccgacggctcattcgtgcacgtgaagcccgagccggtgcggtcccccgactcgtcctcctacccctgctcctacgacggctcaccctgcttcggcctcctggacccggagccgccgctgacgcccggcaccaccacgcccagtagtagggggcaggaggaggccgcggcggccatggcccggggcaagcactacaggggggtgaggcagcgcccgtggggcaagttcgcggcggagatcagggaccccgccaggaacggcgcgcgcgtctggctcggcacgtacgacaccgccgaggacgccgcgctcgcctacgaccgcgccgcctaccgcatgcgcggctcgcgcgcgctcctcaacttcccgctccgcatcggctccggggacaagcgcccgtcgccggcgccgcccgagcccgccacctcctcggactcctcctcgtcttcggccagcggctcgcacaagaggcggaagcgaggcgaggccgcggctgccaacatggccatggcgctggtgcccccgccctcccagcttaaccggccggcccagccgtggttccctgccgcgccggtcgagcaggcggcgatggctccgcgcgtggagcagatcgtcgtctagtctagccatgcgccggagaaat

SEQ ID NO: 4833 - DNA, 803 bp, Artificial Sequence
  P23421 (35S::G3717)
tcgacggagaccaccggagatatgtacggacggagtgattcttacgaatccgatttggcgcttctggattcgattcgccgccacttgctgggagagtccgaattgatattcggagccccgaatttcggttcgggtcggagctccagtttcagcagcttggactcgtgtttgagtgatgattggggagagcttccgtttaaggaggacgattcagaagatatggtgttgtacggcgttctccgtgacgcagttaatgtggggtgggtcccatccctcgatgccggctcgcccgagagcgtctcgtcgggttttccggcggtgaagctggagcctgatgtcatgccggcgttgattaatccgtgtccgcctccggcgccggcggtggaggagaagaaggttgttccgccgaaggggaagcactaccgcggcgtgcggcagcggccgtggggaaagttcgcggcggagatccgggacccggcgaagaacggggctagggtttggctggggacgtttgagacggcggaggacgcggcgttggcgtacgaccgcgccgcctaccggatgcgagggtcgagggcgctgctgaattttccgttgagggttaactccggcgagccagatccggtgagggtgacgtcgaagcggtcgtcgtcgccggaaagtatggcggcggcggcgccgaagagaaagaaagttatggtggtggggacggtgcaagagcaagtggggagtcaagtggtggagtgtacacgtggcgaacagttattggttagctgagagagattctaaaattggtattgtgt

SEQ ID NO: 4834 - DNA, 1018 bp, Artificial Sequence
  P23423 (35S::G3718)
tcgaccacgaaatgtacggacaaagtagctatgagtccgatttggcccttttggactccattcgccgccacttactcggcgactccgaggaacacagattcggagccccgaatgttaattcgggtagcactccattgtactctcggagctccagtttcggcaggttgtacccttgcctgagtaacgattggggcgaacttcctcttatggaagacgattcagaagacatgcttctttatggtgttcttcgcgacgccgtgaacgtaggctgggtcccatctctcgacgcttcctcaccggagagtttctcgtcggctttcatgccgccggtgaccgtgaaatccgaaacggatctatttccggcaccggaaccgatttgtaaccctccggtggttcagggcccggcgccggcggtagttccggcgaaagggaagcactaccggggcgtgcggcagcgaccgtggggaaaattcgcagcggagatccgcgacccggctaaaaatggggctcgggtttggcttgggacttttgagacggctgaggacgccgcgctggcttacgatcgagccgcgtatcgaatgcgcggctcgcgggctttgttgaattttccgctccggattaattcgggcgagcccgaaccggttcgagttacggcgaagcgggcttcagcagaaccgtgttcttcgtcggagagtggatcttgggtgaagaagcggaagaaggtggtgggttgagaacggggcacgtggagagcagttgttggtgaagtaatttgtgatgctaaaaaggggtggaataaatgggttggcatgctcactcattgctcaagtgggactgtgggactgatcaaatctaaagctaaaaaagaaaacaaaccacatttggaaaaactgattagggtcgaggttctgtttggctttgtgaatacagttacaagatttcttattttttggttcaattctataataatatctgtaacatagttgggtagggcacccaccctgtgctgaactaagtt

SEQ ID NO: 4835 - DNA, 821 bp, Artificial Sequence
  P23441 (PRCUT1::G28)
tcgagctgttatgtcgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagatccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataattgc

SEQ ID NO: 4836 - DNA, 783 bp, Artificial Sequence; identical to SEQ ID NO: 2053
  P23452 (35S::G3659)

SEQ ID NO: 4837 - DNA, 869 bp, Artificial Sequence
  P23455 (35S::G3644)
tcgacctcacgtaccggccagaaatatcacagcacacacacacggttaacttttttcccgcgcgaaatctctcgaagtgaaacatcccaagcaaaaatccgatcgattcggcgagctagcaggtcaactcgccatggctgacctcccatgcatatatatacgcgtagtacgtacacttgctttcccaacgctcgcgaatcaaatcgagggtgaaattaagtcaagaacggagagagatcacggtgaggttgatctcagctcgccggaggaggcaatgagccgggcggagtgcggcggcggcgaggaggaggagcggtgcaggtacaggggcgtgcggcggcggcggtgggggaagtgggtgtcggagatccgggtgcccggcacgcgggagcggctgtggctggggtcctacgccacgccggaggccgccgccgtcgcgcacgacacggccgtctacttcctccgcggaggcgcgggcgacggcggtggcggcggcgcgacgctcaacttcccggagcgcgcggcggccacgtacggcggcggcgccgccgtggcgcgcctgtcgccgcggtccgtgcagcgcgtggcgtccgacgccggcatggccgccgacgcgcagctcgtggcggcgcgggacgccgcgcccgcgcccgcgccggcgacggcgtacgcgcgcccggatcactgcgccggcgcgacgacggcgcggcacgacgagctggcgcgccgcgggatgtacggcgctcacgcgcatgccgccggcgcgaacgccaggacgagcggcgagcggcagctcgtctgtgccgaggagattagcgtggatgacatggagatcctgatgtaatcacgcagtgacaaaatagcaaagc

SEQ ID NO: 4838 - DNA, 707 bp, Artificial Sequence
  P23456 (35S::G3649)
acgagctcgagctcagagtgatctcagatcgtcgtcgcggtcagcgccgacgacgagcaagcttcgccggagggggaagacggtacgtacatgggccgggtggcggcgagcggcggcggcggcggcggaggggagatgatgaggtacaggggcgtgcggcggcggcggtgggggaagtgggtgtcggagatccgggtgcccgggacgcgggagcgcctgtggctcggctcctacgccaccgccgaggccgccgccgtcgcgcacgacgccgccgtctgcctcctccggctcggcggcggccgccgcgccgccgcaggcggaggcggcgggctcaacttccccgcccgcgcgctcgccgcggcggcggccgcctcctcctacggcggcgccggcggtctcctgtccccgcgctccgtgcagcgcgtggcgtccgacgccggcatggccgccgacgcgcagctcgtggacctgcgccgcgaccacccgcccgccgccgccgccgcctcatcctccggcagcggcgtggcgggagacggtgcaagaaagcaagggacacgtggcgaggttagcgacacgtattggtgtaggaatggagaggatgggagcagaagccggagctccgggagtgaggagctcattgtttacgagggcttaagtgtagatgacatggaaattttgatgtaaacagtgattattttattaatatg

SEQ ID NO: 4839 - DNA, 631 bp, Artificial Sequence
  P23465 (35S::G3643)
tcgacgcgtccgcttcttctctcagaatacacaacacaaagtcaatataattatagtatatccctatgagtaggagttcggcgatgcatggaattacaagcacaaacaacaagttgaagggagttcggcgtcgaaaatggggcaaatgggtgtcggagattcgtgttccgggcacgcaagagcgtttgtggttgggaacctacgccacgccggaggctgccgcggtggctcacgacgttgccgtctactgtctaagtaggccttcttcgttggacaaacttaacttccccgaaaccttgtcttcgtacagtgttcagctcagggacatgtctccgaggtctgtgcagaaggtggcttccgatgttggcatggatgttgatgcaagaaacattgttgcgggcaaaacttcaacggtgggggcagaaactaattgcgagagtgatgagaggactagtactgcgtctgtgtgtaatgttgttggagaaggtggtgctgatcattcggatgtgttttggtgggatgatgatggtgggtcttggcatggaagtggtggagattctacggaaagggatgccttgagcatttccattgaagattatctttagctgttctaggtttcaactttagttgc

SEQ ID NO: 4840 - DNA, 517 bp, Artificial Sequence
  P23481 (35S::G3394)
tcgacggaggtgggatggcggatgggccggggagcccgggggggggtgggggggtgagggagcaggacaggttcctccccatcgccaacatcagccgcatcatgaagaaggccatcccggccaacgggaagatcgccaaggacgccaaggagaccgtgcaggagtgcgtctccgagttcatctccttcatcaccagcgaggcgagcgataaatgccagagggagaagcgcaagaccatcaacggcgacgacttgctgtgggcgatggccacgctgggcttcgaggactacatcgagcccctcaaggtctacctgcagaagtacagagagatggagggtgatagtaaattaactgcaaaggctggtgatggctctgtgaaaaaggatgtacttggttctcatggaggaagcagttcaagtgcccaagggatgggccaacaagcagcatacaatcaaggaatgggttatatgcaacctcagtaccataatggggatgtctcaaactgaagataggacct

SEQ ID NO: 4841 - DNA, 624 bp, Artificial Sequence
  P23482 (35S::GAL4::G682)
gatctatgcccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagggtaccgtcgacatggataaccatcgcaggactaagcaacccaagaccaactccatcgttacttcttcttctgaagaagtgagtagtcttgagtgggaagttgtgaacatgagtcaagaagaagaagatttggtctctcgaatgcataagcttgtcggtgacaggtgggaactgatagctgggaggatcccaggaagaaccgctggagaaattgagaggttttgggtcatgaaaaattgaaaagtgatcaatatatctctatagtttcactggc

SEQ ID NO: 4842 - DNA, 267 bp, Artificial Sequence
  P23516 (OPLEXA::G682)
tcgacatggataaccatcgcaggactaagcaacccaagaccaactccatcgttacttcttcttctgaagaagtgagtagtcttgagtgggaagttgtgaacatgagtcaagaagaagaagatttggtctctcgaatgcataagcttgtcggtgacaggtgggaactgatagctgggaggatcccaggaagaaccgctggagaaattgagaggttttgggtcatgaaaaattgaaaagtgatcaatatatctctatagtttcactggc

SEQ ID NO: 4843 - DNA, 512 bp, Artificial Sequence
  P23517 (OPLEXA::G682)
tcgacccacgcgtccgctctctcagagtactctcttagtttctttcttcttcttctttgtaatacggtgccgtttgacatggataaccatcgcaggactaagcaacccaagaccaactccatcgttacttcttcttctgaaggtaagctgaaaacttaaacaccttcgttttctcatttttccatgtttttttatacttatctatatataatgagaaatctgaattttggtgatgacaaggaacagaagtgagtagtcttgagtgggaagttgtgaacatgagtcaagaagaagaagatttggtctctcgaatgcataagcttgtcggtgacaggtttgatcttttaactaataatgaatactatttcgtaggaaaataatttaattgtaacaccatagtaaaagctgaattttgtgtgttattatttgatgaaaggtgggaactgatagctgggaggatcccaggaagaaccgctggagaaattgagaggttttgggtcatgaaaaattga

SEQ ID NO: 4844 - DNA, 544 bp, Artificial Sequence
  P23523 (35S::G3383)
tcgaccactcatcatatatcaaagcaagcagagctagctctagctagcttaatccatcttcgtcttcctctcgatcgatcgatcgatcgctgccatggaggacaaccggagcaaggacacggcgaccaagtaccgcggcgtgaggaggcggccgtggggcaagttcgcggcggagatccgcgacccggagcgcggcggggcgcgcgtctggctcggcaccttcgacaccgccgaggaggcggcgcgtgcctacgaccgcgcggcctacgcccagcgcggcgccgccgccgtgctcaacttcccggccgccgccgccgccggcaggggtggaggagccggcggcgccgcttccgggtcgtcgtcgtcgtcgtccgcgcagcgcggcaggggcgacaagatcgagttcgagtacctcgacgacaaggtgctcgacgatctcctcgacgacgagaagtaccgtggtaaatgatcaagatcatgatcagagctaggcatcttgttcttgcatgcatgcacaagaacaaatgacctaattaaacaacgc

SEQ ID NO: 4845 - DNA, 814 bp, Artificial Sequence
  P23541 (PRARSK1::G28)
ctgttatgtcgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagatccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataatt

SEQ ID NO: 4846 - DNA, 814 bp, Artificial Sequence; identical to SEQ ID NO: 4845
  P23543 (PRLTP1::G28)

SEQ ID NO: 4847 - DNA, 814 bp, Artificial Sequence; identical to SEQ ID NO: 4845
  P23544 (PRRBCS3::G28)

SEQ ID NO: 4848 - DNA, 821 bp, Artificial Sequence
  P23554 (35S::G3000)
tcctcccctctaacaataagcagcatctctataatccctaagattcacaatggagcttggaggaaaatgcaatgcaattacaaccacaacaatgatctcaacagaagtaaagccacatacggatccggaaccagaagccaaacccgaatcagatccatccatggctttattcccgatcaagaaagaaaaccaaaaaccaaagacacgtgtcgaccaaggagctaagtaccgggaatgtcagaagaaccacgcggcctcaaccggaggacacgtggtggacggatgctgcgagttcatggccggcggagaagaaggtacactcggtgctttaaaatgcgccgcctgtaactgtcaccggagcttccaccggaaagaagtgtacggacacaggaacagtaaacaagatcatcagctgatgataactccggcgttttacagcagtaacagctcgtacaagccacgtgtaatgcatccaacgggtgagattggacggaggacttcatcttcaagcgaggatatgaagaagattctgagtcatcgtaaccaaaacgttgatgggaaaagtttgatgatgatgatgatgaggaagaagaagagagtgaggacaaagatcaatgaagaacaaaaggagaagatgaaggaatttgcagagagattagggtggaggatgcagaagaaagatgaagaagagattgataagttttgtaggatggtgaatctgaggagacaagtttttaaggtttggatgcataataacaagcaagcaatgaagagaaacaatagtaacattagtgaatagtttgatgatctgataaaagtga

SEQ ID NO: 4849 - DNA, 1302 bp, Artificial Sequence
  P25086 (35S::G30::GR)
atggatcaaggaggtcgtagcagtggtagtggaggaggaggagccgagcaagggaagtaccgtggagtaaggagacgaccttggggtaaatacgccgcggaaataagagattcgaggaagcacggagagcgtgtgtggctagggacattcgacactgcggaagacgcggctcgagcctatgaccgagccgcctattcaatgagaggcaaagctgccattctcaacttccctcacgagtataacatgggaaccggatcctcatccactgcggctaattcttcttcctcgtcgcagcaagtttttgagtttgagtacttggacgatagcgttttggatgaacttcttgaatatggagagaactataacaagactcataatatcaacatgggcaagaggcaagcggccgctgaagctcgaaaaacaaagaaaaaaatcaaagggattcagcaagccactgcaggagtctcacaagacacttcggaaaatcctaacaaaacaatagttcctgcagcattaccacagctcacccctaccttggtgtcactgctggaggtgattgaacccgaggtgttgtatgcaggatatgatagctctgttccagattcagcatggagaattatgaccacactcaacatgttaggtgggcgtcaagtgattgcagcagtgaaatgggcaaaggcgataccaggcttcagaaacttacacctggatgaccaaatgaccctgctacagtactcatggatgtttctcatggcatttgccctgggttggagatcatacagacaatcaagtggaaacctgctctgctttgctcctgatctgattattaatgagcagagaatgtctctaccctgcatgtatgaccaatgtaaacacatgctgtttgtctcctctgaattacaaagattgcaggtatcctatgaagagtatctctgtatgaaaaccttactgcttctctcctcagttcctaaggaaggtctgaagagccaagagttatttgatgagattcgaatgacttatatcaaagagctaggaaaagccatcgtcaaaagggaagggaactccagtcagaactggcaacggttttaccaactgacaaagcttctggactccatgcatgaggtggttgagaatctccttacctactgcttccagacatttttggataagaccatgagtattgaattcccagagatgttagctgaaatcatcactaatcagataccaaaatattcaaatggaaatatcaaaaagcttctgtttcatcaaaaatctagacaggcctcgtaccggatcctctag

SEQ ID NO: 4850 - DNA, 445 bp, Artificial Sequence
  P25089 (35S::G3737)
atacaagtagtagtgagcatggaggacgacaagaaggaggcggcgagcaagtaccgcggcgtacggaggcggccgtggggcaaattcgcggcggagatccgcgacccggagcgcggcggctcacgcgtctggcttggcacgttcgacaccgccgaggaggccgcgcgagcgtacgaccgcgccgcattcgccatgaagggcgctatggccgtgctcaacttcccaggcaggacgagcagcaccggctcttcgtcgtcatcgtcatccacgccgccagctccggtgacgacgagccgccactgcgccgacacgacggagaaggtggagcttgtgtaccttgacgacaaggtgctcgacgagctccttgcggaggactacagctaccgcaacaacaacaactactgatccggccgtcgatgaactgagacggatcgacatggggccg

SEQ ID NO: 4851 - DNA, 484 bp, Artificial Sequence
  P25090 (35S::G3739)
gtcgccatcgctatggacggcgactggtccaaggacggcggaggtggagagccgaccaaatatcgcggcgtgcggcggcggccctggggcaagtacgcggccgagatccgcgactcgagccgccacggcgtccgcatctggctgggcaccttcgacaccgccgaggaggccgccagggcgtacgaccggagcgcctactccatgcgcggcgccaacgccgtcctcaacttcccggaggacgcgcacgcctacgccgccgcctgccgcggctccggatcctcctcatcctcgtccaggcataggcagcagcagcagcagggctccggcagggacgtgatcgagctcgagtacctcgacgacgaggtgctgcaggagatgctcaggaaccacgagccgtcgtcgtctgcgaggaagaagatgtaatgcaagacgactggtacacgtggcgaatgcacgttgcacatcagaatgccatgtatgcgtg

SEQ ID NO: 4852 - DNA, 422 bp, Artificial Sequence
  P25092 (35S::G3794)
agaccactgtgatatcgatggacgacggcggcgagccaaccaagtaccgcggcgtgcggcgccggccgtcggggaagttcgccgccgagatccgcgactccagccggcagagcgtgcgcatgtggctgggcaccttcgacacggccgaggaggccgcaagggcgtacgaccgcgcggcctacgccatgcgcggccaaatcgccgtgctcaacttccccgccgaggcgcgcaactacgtgcgcggcgggtcgtcgtcgtcccgccagcagcagcagggaggaggaggaggaggaggaagtggcggcggcgccggtcagcaggtgatcgagctggagtgcctggacgatcaggtgctgcaggagatgctcaagggcggcgacgggaaaaaatagttgttagcgtatctgatcacaggtgcacgt

SEQ ID NO: 4853 - DNA, 858 bp, Artificial Sequence
  P25118 (OPLEXA::G1792::(10A)12XHA)
atggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagagcggccgcggctgccgccgcagccgctgctagttacccatacgatgttcctgactatgcgggctatccctatgacgtcccggactatgcaggatcctatccatatgacgttccggattacgcttctagatacccatacgatgttcctgactatgcgggctatccctatgacgtcccggactatgcaggatcctatccatatgacgttccagattacgctactagttacccatacgatgttcctgactatgcgggctatccctatgacgtcccggactatgcaggatcctatccatatgacgttccagattacgcttctagatacccatacgatgttcctgactatgcgggctatccctatgacgtcccggactatgcaggatcctatccatatgacgttccagattacgctactagacaggcctcgtaccagatcctctag

SEQ ID NO: 4854 - DNA, 997 bp, Artificial Sequence
  P25119 (OPLEXA::G1792::(9A)TAP)
catggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagagcggccgctgccgctgcggcagcggccatggaaaagagaagatggaaaaagaatttcatagccgtctcagcagccaaccgctttaagaaaatctcatcctccggggcacttgattatgatattccaactactgctagcgagaatttgtattttcagggtgagctcaaaaccgcggctcttgcgcaacacgatgaagccgtggacaacaaattcaacaaagaacaacaaaacgcgttctatgagatcttacatttacctaacttaaacgaagaacaacgaaacgccttcatccaaagtttaaaagatgacccaagccaaagcgctaaccttttagcagaagctaaaaagctaaatgatgctcaggcgccgaaagtagacaacaaattcaacaaagaacaacaaaacgcgttctatgagatcttacatttacctaacttaaacgaagaacaacgaaacgccttcatccaaagtttaaaagatgacccaagccaaagcgctaaccttttagcagaagctaaaaagctaaatggtgctcaggcgccgaaagtagacgcgaattccgcggggaagtcaacctga

SEQ ID NO: 4855 - DNA, 1245 bp, Artificial Sequence
  P25147 (35S::G2999::GAL4)
gcttagggttttggagagagattactaagaaagttttaatgtttgtttaagagaaaagttatatattagggttttctttattcagaagcttcaagatcagaaaagatggaagttagagagaagaaagatgagaaaatggagatgacaagaagaaaatcatcagctctagatcatcatcgtcttcctccgtacacttactcccaaaccgccaacaaagagaaacccaccaccaaaagaaacgggtcggacccggatccggatccggatcttgatactaacccaatttctatatctcatgctccaagatcatacgctaggcctcaaactacttctccggggaaggcaaggtatagagaatgccaaaagaatcacgcggcgagctccggtggacacgttgtcgacggttgcggcgagtttatgtcttccggggaagaaggcacggtggagtctcttctttgtgcagcttgtgattgccaccggagcttccatagaaaagagatcgatggtttgtttgttgtcaatttcaatagctttggccattcacagagaccactcggaagccgccacgtgtctccgataatgatgagttttggtggtggtggtggttgtgcggcggagtcatcgacggaggatctaaacaagtttcatcaatcttttagtggttatggagtggatcagtttcatcattatcaacccaagaaacggtttaggacaaagtttaatgaagaacagaaggagaagatgatggagtttgctgagaagattggttggagaatgacaaaactagaagatgatgaagtgaatcggttttgtcgtgagattaaagttaaaagacaagtgtttaaagtttggatgcacaacaataaacaagcagcaaagaagaaggatttgtgcggccgccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtag

SEQ ID NO: 4856 - DNA, 945 bp, Artificial Sequence
  P25158 (35S::G3674)
atggatttcgacgaccatgacgagggtgacggcgacgaggagatgcctccgatgcctctgagctcgggctacgacgcgccgatgcagcccgggcttggaggtggcggtggcggggtgcccaagccgggaggtggagtcggcggcggcggtggtggtggtggtggtggtggaggaggaggggcgaggtatcgggagtgcctcaagaaccacgccgtcggcatcggcgggcacgccgtggacggctgcggcgagttcatggcttccggcgaggagggctccatcgacgcgctccgctgcgccgcctgcggctgccaccgtaacttccaccgcaaggagtcggagtcccccacgggcgtcgggccggccgagccttccgccgtgtcccccgccgccatctcggcctacggcgcctcgccgcaccaccagttctccccctactaccgcaccccggcagggtacctccaccaccagcagcaccagatggcggccgcggcggcggccgcggccgccgccgcagcgggcggctacccgcagcggcccctcgcgctgccgtccacctcccactcgggacgcgacgagggcgacgacatgtccgggatggtcggccccatggtgattggccccatggtcggcatgtccctcggctccgccggcccctccggctccggctccggcaagaagcggttccgcacaaagttcacgcaggagcagaaggacaagatgctcgccttcgcggagcggctcgggtggcgcatccagaagcacgacgaggccgccgtgcagcagttctgcgaggaggtctgcgtcaagcgccatgtcctcaaggtttggatgcacaacaacaagcacaccctgggcaagaaggcgccatagctaagctaagccaagcaagctcagctcagctcatctcctcccggtgctaggtacctgcactgcaactgcaac

SEQ ID NO: 4857 - DNA, 774 bp, Artificial Sequence; identical to SEQ ID NO: 2061
  P25159 (35S::G3676)

SEQ ID NO: 4858 - DNA, 1098 bp, Artificial Sequence; identical to SEQ ID NO: 2065
  P25163 (35S::G3681)

SEQ ID NO: 4859 - DNA, 1009 bp, Artificial Sequence; identical to SEQ ID NO: 2067
  P25165 (35S::G3683)

SEQ ID NO: 4860 - DNA, 821 bp, Artificial Sequence
  P25166 (35S::G3685)
ccggaccggaccggacagaggcatgtcctgatggaattcaggggccatgacgaacccgtcgacgagatgggagtcgcgtacggcaggacgccaccctcctcctcctcctcccccgccgcctccgcctccgcggggaacggcgccggcgcggcggaggtgaggtaccacgagtgcctgcgcaaccacgccgcggcgatgggcggccacgtcgtggacggatgcagggagttcatgccgatgccgggggacgccgccgacgccctcaagtgcgccgcctgcggctgccaccgcagcttccaccgcaaggacgacgggcagcagcagcagcagctgcgcctgctcatcccgtccccgcccacgccgcgcgtcccgctgctcatgccgccgccgcagccgcagccgcacccgcacccgcaacacccctacctgcacccgccgttcccgtaccaccacaccccaagcggcagcggcggcacgacgaccgagtcgtccagcgaggagcgggggcctccctcctcgtcggcggcggcggcgcaggggcggcggaagcggttccggaccaagttcacgccggagcagaaggagcagatgctggcgttcgcggagcgggtggggtggcggatgcagaagcaggacgaggcactcgtcgaacagttctgcgcgcaggtcggcgtgcggcgccaggtgttcaaggtgtggatgcacaacaacaagagcagcatcggcagcagcagcggcggcggcagtaggaggcagccgcaggagcaacagtcacaacagcagcagcagcagcagtagccatgggaggagacaagcatttg

SEQ ID NO: 4861 - DNA, 743 bp, Artificial Sequence; identical to SEQ ID NO: 2071
  P25167 (35S::G3686)

SEQ ID NO: 4862 - DNA, 1200 bp, Artificial Sequence
  P25173 (35S::GAL4::G2999)
atgcccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagggtaccatggaagttagagagaagaaagatgagaaaatggagatgacaagaagaaaatcatcagctctagatcatcatcgtcttcctccgtacacttactcccaaaccgccaacaaagagaaacccaccaccaaaagaaacgggtcggacccggatccggatccggatcttgatactaacccaatttctatatctcatgctccaagatcatacgctaggcctcaaactacttctccggggaaggcaaggtatagagaatgccaaaagaatcacgcggcgagctccggtggacacgttgtcgacggttgcggcgagtttatgtcttccggggaagaaggcacggtggagtctcttctttgtgcagcttgtgattgccaccggagcttccatagaaaagagatcgatggtttgtttgttgtcaatttcaatagctttggccattcacagagaccactcggaagccgccacgtgtctccgataatgatgagttttggtggtggtggtggttgtgcggcggagtcatcgacggaggatctaaacaagtttcatcaatcttttagtggttatggagtggatcagtttcatcattatcaacccaagaaacggtttaggacaaagtttaatgaagaacagaaggagaagatgatggagtttgctgagaagattggttggagaatgacaaaactagaagatgatgaagtgaatcggttttgtcgtgagattaaagttaaaagacaagtgtttaaagtttggatgcacaacaataaacaagcagcaaagaagaaggatttgtaagagatttctatatatatatatatactatttttacttctctttgttcaacattgctttaac

SEQ ID NO: 4863 - DNA, 435 bp, Artificial Sequence
  P25182 (35S::G47(AA1-27)::G1277(AA35-61)::G47(AA55-144))
atggattacagagaatccaccggtgaaagtcagtcaaagtacaaaggaatccgtcgtcggaaatggggcaaatgggtatcagagattcgagaacccaacaagcgttcaagactttggctcggctcttactctactcccgaagcggcggcgcgtgcatacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttga

SEQ ID NO: 4864 - DNA, 825 bp, Artificial Sequence
  P25186 (35S::GAL4::G47)
atgcccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagggtaccgtcgacatggattacagagaatccaccggtgaaagtcagtcaaagtacaaaggaatccgtcgtcggaaatggggcaaatgggtatcagagattagagttccgggaactcgtgaccgtctctggttaggttcattctcaacagcagaaggtgccgccgtagcacacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttgatttatctcgacggtcatgatcacgtttgatctt

SEQ ID NO: 4865 - DNA, 689 bp, Artificial Sequence; identical to SEQ ID NO: 2079
  P25204 (35S::G3719)

SEQ ID NO: 4866 - DNA, 666 bp, Artificial Sequence
  P25205 (35S::G3720)
atggcggcagtcggagcgcacccagtgctgtaccaccacccggcgccggcgggcgacgcctcctccatgtcctcctacttctcccacggaggcagctccaccacctccagctctgcgtccagcttcaccgccgcgctcgcgccgacgacgacggcgctcgccgagcatttcgacatctccgagttcctcttcgacgacgctgcgggcgctggggtcgccggcgcgccaggtgtgttcgccgatggcgcggcccgccccgtcgtcctgccggtgccggatgccgctggtggtggtgcaattatcggcgcagccgctgggggcgcggctgcggcgtcggaggtgccagagcggccgcggacgacgcggatcgcgttccggacgaggtcggagatcgagatcctggacgacggctacaagtggaggaagtacggcaagaagtccgtcaagaacagccccaacccaaggaactactaccggtgctcgacggaagggtgcaacgtgaagaagcgggtggagcgggacaaggacgaccccagctacgtggtgacgacgtacgaggggatgcacaaccacgtcagccccagtacggtgtactacgccagccaggacgccgcctccggccgcttcttcgtcgccggcacgcagccaccgggctccctcaactga

SEQ ID NO: 4867 - DNA, 680 bp, Artificial Sequence; identical to SEQ ID NO: 2085
  P25207 (35S::G3722)

SEQ ID NO: 4868 - DNA, 625 bp, Artificial Sequence; identical to SEQ ID NO: 2087
  P25208 (35S::G3723)

SEQ ID NO: 4869 - DNA, 831 bp, Artificial Sequence; identical to SEQ ID NO: 2091
  P25210 (35S::G3725)

SEQ ID NO: 4870 - DNA, 729 bp, Artificial Sequence; identical to SEQ ID NO: 2093
  P25211 (35S::G3726)

SEQ ID NO: 4871 - DNA, 618 bp, Artificial Sequence
  P25213 (35S::G3728)
atggcgacttcgctgggactgaaccctgaagatctcttcacttcgtactcgtcttcctactactcctcgccgccgttcatgtccgactacgcggcgagcttcacgccggcggccggggactccacggccttctcctcggagctcgacgaccttcaccacttcgactactcaccggcgccgatcgtcactgctgccggagccggggctgggggcggcgatcgcaacgagaagatgatgtggtgtgagggtggtggtgacgagagaagactcagaagcaacggaaggatcgggttcagaacgaggtcagaggtggagatcttggacgacggattcaagtggaggaagtacgggaagaaggccgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagccccggagccgctgctatcatcgtcccgtacggcagcggcggcggcaatagcggcttctacagcccgccgcacagcggctccccgtcggccacctcctactcgggctccctagccttctga

SEQ ID NO: 4872 - DNA, 744 bp, Artificial Sequence
  P25214 (35S::G3729)
gatgtcgtcgctgtacccgtctctcctctcgctgagcgagagccccgccgagtaccggcaggtcggcggtggccgctacgcgggggaggacgtcgtcgacgacgacgacgacatggctgccgtcgccgacgctgtgtccagctacctctccttcgacatggacgacgtcgagtattacacgccggaggtgggcttccactcaaagcagcacaacccgccgccagttgctgcggcgccactggaagccggaggaggcagggagcaaagccggcgggaagccgccgtcaatcttggcaagatggacaggggaccggcgccggtgagcggcggcgcggcgactggcggcgtgccgaggagcaagaacggcagcaagatcgcgttcaagacgaggtcggaggtggacgtgctggacgacggctaccggtggaggaagtacggcaagaagatggtcaagaacagccccaacccaaggaactactaccggtgctcgagcgaggggtgccgcgtgaagaagcgggtggagcgcgcccgggacgacgcgcgcttcgtcgtcaccacctacgacggcgtccacaaccacccggcgccgctgcacctcaggccgcagctgccgccgcccggcggctactcgatcgccggggcaccggccgtggtggcgccgcacggccgcctcgggctggaggaggccgaggtgatcgctctcttcaggggcaccaccgccacctcgctgctgcttccttgacc

SEQ ID NO: 4873 - DNA, 731 bp, Artificial Sequence; identical to SEQ ID NO: 2101
  P25215 (35S::G3730)

SEQ ID NO: 4874 - DNA, 628 bp, Artificial Sequence; identical to SEQ ID NO: 2133
  P25218 (35S::G3803)

SEQ ID NO: 4875 - DNA, 621 bp, Artificial Sequence
  P25219 (35S::G3804)
caatggcgacttcgctgggactgaaccctgaagatctcttcacttcgtactcgtcttcctactactcctcgccgccgttcatgtccgactacgcggcgagcttcacgccggcggccggggactccacggccttctcctcggagctcgacgaccttcaccacttcgactactcaccggcgccgatcgtcactgctgccggagccggggctgggggcggcgatcgcaacgagaagatgatgtggtgtgagggtggtggtgacgagagaagactcagaagcaacggaaggatcgggttcagaacgaggtcagaggtggagatcttggacgacggattcaagtggaggaagtacgggaagaaggccgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagccccggagccgctgctatcatcgtcccgtacggcagcggcggcggcaatagcggcttctacagcccgccgcacagcggctccccgtcggccacctcctactcgggctccctagtcttctgac

SEQ ID NO: 4876 - DNA, 1164 bp, Artificial Sequence; identical to SEQ ID NO: 2111
  P25230 (35S::G3746)

SEQ ID NO: 4877 - DNA, 885 bp, Artificial Sequence
  P25233 (35S::G3750)
atggccgggcagcagccgcagcagcagggcccaccggaggacgactttttcgaccagttcttctccctgaccagctccttccctggcgccgcgccgggcggccgcgccgccggtgaccagcccttctccctcgcgctcagcctcgacgccgccgcggcggccgaggcgtccgggagcgggaagaggctcggggtcggcgatgacgccgagggtggcggcagcaaggcggatcgggagaccgtgcagctcaccggactcttcccgccggtgttcggcggcggcggcgtgcagccgccgaacctccgccccaccccgcctacccaggtgttccacccgcagcagtcgaagcagggcggagcagccgtcgggccgcagccgccggcgccgaggccgaaggtgcgagcgcggcgtgggcaggcgaccgacccccacagcatcgcggagaggctaagaagagagagaatagcagaaaggatgagggccctacaggaattggtccccaatacaaacaagacagatagggcagctatgctagatgagatccttgattatgtgaaattcctgaggctgcaagtaaaggttttaagcatgagcaggctgggtggcgcgggtgctgttgcacagctggttgctgatattccactttcagttaagggggaagcaagcgatagtgggggcaaccaacagatttgggaaaagtggtcaacggatggcacagaaagacaggtagcgaagctgatggaagaagacatcggggcagcgatgcaatttctccaatccaaagcactctgcatgatgccaatctcgctcgccatggcaatctatgacacacaacaaacacaggatggacaaccagtgaagcacgaacccaacactccttcctag

SEQ ID NO: 4878 - DNA, 712 bp, Artificial Sequence
  P25241 (35S::G3765)
atgaaaggtgttggaaactatagtggggtcaatggcaatgatggtgaacttagtctatctatgaacagaatgaagaatcacattagcttctcatcaataagtccttcttcttccttgggaatgctatcaccaacctccaaaatgggcacggagggtattagggtaactagacctgaggatgggagacagggaagttgcaatggtgatgctcgatattatggtcctggattcccttatgcttcttggaatgagccctcacaccccaaaagacagcgaagtagtaatgatgagttactttttgattctcagaatggagagccaggaaatcaagttcaaaggctttcgcatcatttgagtttgccaagaacgtcgtcggagatgtttgctatggataatttgcttcagttctcagattctgttccttgtaaaatcagagcaaagagaggctttgctactcatcctcgaagcattgccgaaagggtgagaagaacaaggatcagtgaacgaataagaaaattgcaagagcttgttccaaccatggacaagcaaactagcacagcagagatgttggacttggctttagactacataaaagatcttcagaaacaattcaagactctgagcgataaacgggctaaatgcaaatgtataaacatgcagaagtcagaagcagatcgagttgcttgagtttcttttgtacagggctgccagg

SEQ ID NO: 4879 - DNA, 380 bp, Artificial Sequence
  P25242 (35S::G3766)
taatatgttatcacatcacttgagtttaccaaaaacttcagcagagatgattactatggagaagttgcttcagttccctgattctgttccttgtaaaatcagagcaaagcgaggctgtgctactcatcctcgaagcattgctgaaagggtgagaagaactcggatcagtgaaagaatgaggaaattacaagagcttgtcccacacatggataagcaaaccaacacagcagacatgttggacttggctgttgaatacattaaagatcttcagaaacaattcaagactctaagtgaaaaaagggcaaactgcaagtgtataagcatgccaaaggcagatacaaatcaaattgcttgatcacctttctttatgagcaatgcat

SEQ ID NO: 4880 - DNA, 666 bp, Artificial Sequence
  P25243 (35S::G3767)
atggggactttgggggctgttaataacagtatcgaagatgcaaaattttctagttcgagaaggttgaagaatcaaccgaactattcttcgtcggggagaatgtcgtccattgctgaaattggggacaaagggaatcgagaaagtagtccagacaatgaagcttttgctgatggtaacgattttatcaccggtttccaagttggtcattgggatgatgctgcaatcatgtctgacaacgttggtggtctcaaaagatttagagaaaacgattcaaaaccattttctggcttaaatgcggctgagactcagaatgaaacaggacagactcatgctcctttggcccatcagttgagtttgccaaatacttcagctgaaatagctgccattgagaagtttctgcagttttcagattctgttccgtgcaaaatccgtgccaaacggggctgtgccactcacccaagaagcattgcagagagggttagaagaactaaaattagtgagcgtatgaggaaacttcaagatcttgtcccaaacatggacaagcaaactaacacagctgatatgttggacttggctgtggattacatcaaagaccttcaaaagcaagttcagacgctttcagattgtcatgcaaagtgtacgtgttcacacgagaagcaacaataa

SEQ ID NO: 4881 - DNA, 798 bp, Artificial Sequence
  P25244 (35S::G3768)
atggagcaaggatcgttttcaatgggactcaggcatagtggaaataattctaaccttaccaggcatagtagctctcccgcaggactattttcccaaattaacattgaaaatgtgtatgctggtgtgagaggcatggggagtttgggagctgttaacaacagtatcgaagatgcgaaattttctagttcgaggaggttgaagaatcaaccgaactattcttcgtcggggagaatgtcgtccattgctgaaattggggacaaagggtatagagaaagtagtccagacagtgaagcttttgctgatggtaacgattttatggccggtttccaagttggtcattgggatgatactgcaatgatgtctgacaacgttggtggtctcaaaagatttagtgaagaagattcaaaaccattttctggcttaaatgcggttgagactcagaatgaaacgggacagactcatgctcctttggcccatcagttgagtttgccaaatacttcagctgaaatggctgccattgagaagtttctgcagttttcagattctgttccgtgcaaaatccgtgccaaacggggctgtgccactcacccaagaagcattgcagagagggttagaagaactaaaattagtgagcgtatgaggaaacttcaggatcttgtcccaaacatggacaagcaaactaacacagctgatatgttggacttggctgtggattacatcaaagaccttcaaaagcaagttcagacactttcagattgtcatgcaaagtgtacgtgttcacacgagaagcaacaataa

SEQ ID NO: 4882 - DNA, 948 bp, Artificial Sequence; identical to SEQ ID NO: 2127
  P25245 (35S::G3769)

SEQ ID NO: 4883 - DNA, 474 bp, Artificial Sequence; identical to SEQ ID NO: 2129
  P25246 (35S::G3771)

SEQ ID NO: 4884 - DNA, 1554 bp, Artificial Sequence
  P25263 (35S::G1073::GFP)
atggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttgcggccgcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctctag

SEQ ID NO: 4885 - DNA, 1161 bp, Artificial Sequence
  P25271 (35S::G1792::GFP)
atggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagatgcggccgcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctctag

SEQ ID NO: 4886 - DNA, 1167 bp, Artificial Sequence
  P25281 (35S::G481::GFP)
atggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtgcggccgcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctctag

SEQ ID NO: 4887 - DNA, 2241 bp, Artificial Sequence
  P25287 (PRRBSC3::G481::GFP)
aaatggagtaatatggataatcaacgcaactatatagagaaaaaataatagcgctaccatatacgaaaaatagtaaaaaattataataatgattcagaataaattattaataactaaaaagcgtaaagaaataaattagagaataagtgatacaaaattggatgttaatggatacttcttataattgcttaaaaggaatacaagatgggaaataatgtgttattattattgatgtataaagaatttgtacaatttttgtatcaataaagttccaaaaataatctttaaaaaataaaagtacccttttatgaactttttatcaaataaatgaaatccaatattagcaaaacattgatattattactaaatatttgttaaattaaaaaatatgtcattttattttttaacagatattttttaaagtaaatgttataaattacgaaaaagggattaatgagtatcaaaacagcctaaatgggaggagacaataacagaaatttgctgtagtaaggtggcttaagtcatcatttaatttgatattataaaaattctaattagtttatagtctttcttttcctcttttgtttgtcttgtatgctaaaaaaggtatattatatctataaattatgtagcataatgaccacatctggcatcatctttacacaattcacctaaatatctcaagcgaagttttgccaaaactgaagaaaagatttgaacaacctatcaagtaacaaaaatcccaaacaatatagtcatctatattaaatcttttcaattgaagaaattgtcaaagacacatacctctatgagttttttcatcaatttttttttcttttttaaactgtatttttaaaaaaatattgaataaaacatgtcctattcattagtttgggaactttaagataaggagtgtgtaatttcagaggctattaattttgaaatgtcaagagccacataatccaatggttatggttgctcttagatgaggttattgctttaggtgaaaccttatcatcattatatatacaaggggatactagagaccaattattgtcaacaagatctggtaccatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtgcggccgcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctctag

SEQ ID NO: 4888 - DNA, 969 bp, Artificial Sequence
  P25290 (35S::G682::GFP)
atggataaccatcgcaggactaagcaacccaagaccaactccatcgttacttcttcttctgaagaagtgagtagtcttgagtgggaagttgtgaacatgagtcaagaagaagaagatttggtctctcgaatgcataagcttgtcggtgacaggtgggaactgatagctgggaggatcccaggaagaaccgctggagaaattgagaggttttgggtcatgaaaaattgcggccgcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctctag

SEQ ID NO: 4889 - DNA, 1062 bp, Artificial Sequence
  P25296 (PRG306::G1816::GFP)
atggataacactgaccgtcgtcgccgtcgtaagcaacacaaaatcgccctccatgactctgaagaagtgagcagtatcgaatgggagtttatcaacatgactgaacaagaagaagatctcatctttcgaatgtacagacttgtcggtgataggtgggatttgatagcaggaagagttcctggaagacaaccagaggagatagagagatattggataatgagaaacagtgaaggctttgctgataaacgacgccagcttcactcatcttcccacaaacataccaagcctcaccgtcctcgcttttctatctatccttcctgcggccgcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctctag

SEQ ID NO: 4890 - DNA, 1776 bp, Artificial Sequence
  P25301 (35S::G867::GFP)
atggaatcgagtagcgttgatgagagtactacaagtacaggttccatctgtgaaaccccggcgataactccggcgaaaaagtcgtcggtaggtaacttatacaggatgggaagcggatcaagcgttgtgttagattcagagaacggcgtagaagctgaatctaggaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattctcattcgaaatctgagatcgttgatatgttgaggaaacatacttataacgaagagttagagcagagtaaacggcgtcgtaatggtaacggaaacatgactaggacgttgttaacgtcggggttgagtaatgatggtgtttctacgacggggtttagatcggcggaggcactgtttgagaaagcggtaacgccaagcgacgttgggaagctaaaccgtttggttataccgaaacatcacgcagagaaacattttccgttaccgtcaagtaacgtttccgtgaaaggagtgttgttgaactttgaggacgttaacgggaaagtgtggaggttccgttactcgtattggaacagtagtcagagttatgttttgactaaaggttggagcaggttcgttaaggagaagaatctacgtgctggtgacgtggttagtttcagtagatctaacggtcaggatcaacagttgtacattgggtggaagtcgagatccgggtcagatttagatgcgggtcgggttttgagattgttcggagttaacatttcaccggagagttcaagaaacgacgtcgtaggaaacaaaagagtgaacgatactgagatgttatcgttggtgtgtagcaagaagcaacgcatctttcacgcctcgtgcggccgcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctctag

SEQ ID NO: 4891 - DNA, 1368 bp, Artificial Sequence; identical to SEQ ID NO: 2137
  P25313 (35S::G3810)

SEQ ID NO: 4892 - DNA, 1007 bp, Artificial Sequence
  P25360 (35S::G3760)
atgcagcccactacgcgggaaatgcaggccatggccgccgccggccagcagatctccctcgacgacctccgcgcggcagcaggcggcgtgcacgacgacttcctggaccagatgctcggaggcctgccgccgtcggcatggccggagctgtcgtccgcggcgggagggaaggcgccggatggcggcgcgcaggcggagcagatgcagcaccagccgcagcacttgggtgggggtgggggcctgtacgacgactccgccttgctggcgtcgcggctccggcagcaccaaatcagcggcggcggcggcggggaggccgtgaagcagatggtgctgcagcagctggccgatctgaggcaggaacaccatgtgttgctgcagggcatgggccgctcgacctcgacgggcggcagcagagacggcggcctgctcctcccgctctctctcggcagtggcggatcgggcggcgacgtgcaggcgctactcaaagctgtagccgactccgccggaggagaagccgcaggcgtcttcggcggttccttcgccggatcgctccaccaccaccagcagcagcagcagcattttcaatcacatccgcagcagcaaacggcgccgttgccggggcagggcttcggtggaggcgcgggcgcgtccggcggcgtgtcgcagccgcaggccggcgctgcgtgcggaggcgccgccgcgccgcccaggcagcgggtacgggctcggcgcggccaggccaccgacccccacagcatcgcggagcggctccggagagagaggatcgcggagaggatgaaggcgcttcaggagctggtgcccaacgccaacaagacggacaaggcgtcgatgctggacgagatcgtcgactacgtcaagttccttcagctccaagtcaaggtgctgagcatgagccggctaggtggtgccgctgccgtcgcgccgctggtggccgacatgtcctcggagggtcgaggcggcgtggcggtcgcggccgggagcgatga

SEQ ID NO: 4893 - DNA, 597 bp, Artificial Sequence
  P25368 (35S::G3721)
caatggcggcttccgtaggactgaaccctgaagctttcttcttcagcaactcctactcctactcctcatcccctttcatggccagctacacgccggagttctcggccgccgctatcgacgccaacttattctccggcgagctcgatttcgactgctctctcccagctccggcccaggagtacccggaaaatgaaaacactatgatgaggtacgagagcgaggagaagatgagggcgagggtgaacgggaggatcgggttcaggacgaggtcggaggtggagattcttgatgatggcttcaagtggaggaagtacggcaagaaagctgtcaagaacagcccaaatccaagaaactactaccggtgctcgacggaggggtgcaacgtgaagaagcgagtggagagagaccgggaggaccaccgctacgtcatcaccacctacgacggcgtccacaaccacgcgagccccgccgccgccgccgcggcgctgcagtacgccgccgccgccggcgactactacagcccgccgctcagcagcgccggctcgccgccggccgcctattcggcaggcggctcgctgctcttctgagggctgatga

SEQ ID NO: 4894 - DNA, 455 bp, Artificial Sequence
  P25370 (35S::G3744)
atgagctccgggtgggaggagtcgtcgctcatgtcggacacgaacatctccggcgtgaagcgccagcgcgactcgtcggagccgtcccagaacggcggcggcggcggcggcctggcgcaccagttcagcctgccgaagacctcgtcggagatggcggccatcgagaagttcctccagttccaggacgcggtgccctgcaagatccgcgccaagcgcggctgcgccacgcacccgcgcagcatcgccgagcgggtgaggaggacaaggatcagcgagcgaatcaggaagctgcaagaactcgtgccaaacatggacaagcaaaccaacactgctgacatgctggatttggctgttgactacatcaaggatcttcagaagcaggtcaagggattaaacgacagccgagctaactgcacctgctcagcgaagcatcagcagtactctggctagaaagc

SEQ ID NO: 4895 - DNA, 662 bp, Artificial Sequence; identical to SEQ ID NO: 2089
  P25384 (35S::G3724)

SEQ ID NO: 4896 - DNA, 663 bp, Artificial Sequence; identical to SEQ ID NO: 2095
  P25385 (35S::G3727)

SEQ ID NO: 4897 - DNA, 1286 bp, Artificial Sequence; identical to SEQ ID NO: 2063
  P25405 (35S::G3680)

SEQ ID NO: 4898 - DNA, 789 bp, Artificial Sequence
  P25407 (35S::G3690)
gcggcgcggatgggcgcgcacgtgctcgacggctgcggcgagttcatgtcgtcccctggcgacggcgccgcggcgctggcctgcgccgcgtgcggctgccaccgtagcttccaccgccgcgagccggcggtcgtcgcgccggcctcgctctcgctctgccccgcctccgcctccgcctccgccgccgccggcctggtgtccctatccccctccgcgacgcccaccggcgccaactcctcccggctcatgccgctcctcctcgccccgccgcacatgcagaagcgcccgcccgtcctccccgtgtccccggcgtctgcgcccgccgcgctggccgagtcgtcaagcgaggagctgcgcccgccgccgctcccctcttcccacccccacgcgcacgcggccgccgtggtggcggcgtcggcctccgcgccgccggggccgagcaagaagcgcttccggaccaagttcacggcggagcagaaggagcggatgcgtgaattcgcgcaccgcgtcgggtggcgcatccacaagcccgacgccgccgccgtcgacgcgttctgcgcccaggtcggcgtctcccgccgcgtcctcaaggtgtggatgcacaacaacaaacacctcgccaagacgcccccgtcgccgacatcgcagccgccgccgccgccgctccaccacgatccttctcctcctccccctcctcaccaccaccaccaccaccatcaccaccaccacccaccacaacaccatcagcagcagcagcagcagcatgatgcatgagagagtgagcgagta

SEQ ID NO: 4899 - DNA, 1356 bp, Artificial Sequence
  P25424 (35S::G3811)
atgatgtctctgtcagtttcacctagcttaggatctccctaccaaatgaaatgcgagcaaaggggtttggtattaatccatttgttgctcgctggtgctaattttgtagccaccggtgatttacaaaatgcaaacctcacacttgagcagatttcccagcatgcctctcttgatggggatactatgcagcgaattgcttcttatttttctgaagcactcgctgatcggatacttaaaacatggcctggcatccacagggccctcaattccagcagaataactatggtttctgatgaaattcttgttcaaaagctcttctttgagcttttacccttcctcaagttctcatatatcctcactaatcaggctattgttgaagccatggaaggggagaaaatggtgcatatagttgatctctatggggccggaccggcacagtggatttctctcctccaagttttgagtgcacgtcctgaaggtcctccccatttgagaatcaccggggtccatcacaagaaagaggttctggatcagatggctcataaactcactgaagaggcggaaaagttggatatcccattccaattcaaccctgtgctaagcaagttggaaaatcttgatttcgacaaacttcgcgttaaaactggggaggcactggcaataagttctattctgcagttgcactcccttttggccttggatgaagatgcctcgcggagaaaatcgcctcttttgtcaaaaaactcaaatgcaattcacctgcagaaaggcctcctcatgaaccataacacactgggagatttgcttgacggctatagcccgagtcctgattcggcctcatcctcaccagcagcgtcttcatctgctttgatgaattcggagagctttcttaatgccttgtgggggttatccccaaaagtcatggttgtaactgaacaagactttaaccacaactgtttgaccatgatggagagactggcagaagctctattttcttatgctgcatattttgattgcttggagtccacggtctcaagagcatccatggacagattaaaacttgagaagatgctttttggcgaggagataaagaacatcatagcttgtgaaggatgtgaaagaaaagaaaggcacgaaaagatggataggtggatccagagacttgacttatctggatttgcaaacgtgcctataagctattatgggatgctgcagggaaggaggttcttgcagacctatggttgtgaggggtacaagatgagggaggaatgtggtcgggtgatgatatgctggcaggagcgatccttgttttccataacagcttggagaccaaggaagtaagataaagaagaaaat

SEQ ID NO: 4900 - DNA, 583 bp, Artificial Sequence
  P25426 (35S::G3755)
actgagcttctcgtcacggcaggggtcattgatgtcccagatctcagagatggacagcgaggaggtcggagggagcagcccagaggcttccggcggcggcggcagggggtacatccctgggtacccaatgggctctgggtgggaggactcgtcggctctcttgtcagacaatttgtctggcgtcaaacgcccccgggactcgtcggagcctggccagagcggccttacgcaccagttcagcgtgcccaagacgtcgtccgagatggcaactattgagaaattcctccagttccaggacgccgtgccttgtaagatccgtgccaagcgggggtgcgccactcatccacgcagcatcgctgagagggtgaggagaacaaagatcagtgagcgaatccgaaagctgcaagaactcgttccaaatatggacaagcaaaccaacacatctgacatgctggatttggctgtcgactacatcaaggatctccagaagcaggttaaggtactaaaggagagccaagataactgcacctgctcagcaagcaagaaccagcagcactcctgctgaaaccgtaatgctcactgt

SEQ ID NO: 4901 - DNA, 585 bp, Artificial Sequence
  P25435 (35S::G1274(AA1-109)::G179(AA65-121)::G1274(AA167-194))
atgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggatacaggtggaggaagtacggccaaaaagcagtcaagaacaatccattccccaggagctattataagtgcacagaagaaggatgcagagtgaagaagcaagtgcagaggcaatggggagacgaaggagtggtggtgacgacataccaaggtgttcatacacatgagagtctctctaatgtctattacaatgaaatggttttatcttatgatcatgataactggaaccaacactctcttcttcgatcttaa

SEQ ID NO: 4902 - DNA, 348 bp, Artificial Sequence
  P25437 (35S::G1792(AA1-115))
atggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagataa

SEQ ID NO: 4903 - DNA, 691 bp, Artificial Sequence
  P25438 (35S::G1792(AA1-115)::GAL4)
atggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagcccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtag

SEQ ID NO: 4904 - DNA, 444 bp, Artificial Sequence
  P25439 (35S::G179(AA1-64)::G1274(AA110-166)::G179(AA122-147))
atggaggataggaggtgtgatgtgttgtttccatgttcatcatcggttgatcctcgcttgacagagtttcatggggtcgacaactctgctcagccgacaacatcatccgaagagaagccaaggagtaagaagaagaagaaagagagagaagcgaggtacgcgttccagacaagaagccaggttgatatactggatgatggttttaaatggaggaagtatggcaagaaatctgtcaaaaacaacattaacaagaggaattactacaaatgctcaagtgaaggttgctcggtgaagaagagggtagagagagatggtgacgatgcagcttatgtaattacaacatatgaaggagtccataaccatgccgttgataaaccctctgataatttccaccacatcttgacacaaatgcacatcttccctcccttttgcttgaaggaatga

SEQ ID NO: 4905 - DNA, 1124 bp, Artificial Sequence
  P25440 (35S::G45(AA1-321)::G1792(AA116-139))
atggtacgtgtgtgtgtgtatacacagaaaacccctgattttatgtggaacctaaaaccctccatgaaatgcggtcagtaccttagaacacaagtttcaccaactgtacttcccaattatcctgccgcagatttcccattcaacgtacacacaaaacccccaaagcaacaatctctttaaaatgccctaaatctcaccaacacatactcctctctgattcaacaatggcttttggcaatatccaagaactagacggcgagatcctaaagaacgtttgggcgaattacatcggaacaccacaaaccgatacaagatcaattcaagttccagaagtttctagaacttgggaagcgttgcctacccttgatgacataccagaaggttctagagaaatgcttcaaagcctagatatgtcgacggaggaccaggaatggacagagattctcgatgctattgcttctttcccaaacaaaaccaatcatgatccattaaccaaccctaccattgattcatgttctttgtcttctcgggtttcttgcaaaacaagaaaatacaggggagtacggaagcgtccgtgggggaaatttgcagccgaaatcagggattcgacgagaaacggtgttagggtttggctcggaacgttccaaactgcagaggaagcagctatggcttacgataaagccgcggttagaattagaggtactcaaaaagctcacacaaattttcagctcgaaacagttataaaagctatggaaatggattgcaacccaaactactaccggatgaacaactcaaatacgtccgatccattaagaagcagccgcaaaatcggattgagaacaggaaaagaggcggttaaggcttatgatgaagtcgttgatgggatggttgaaaaccattgtgcccttagctattgttcaactaaggagcactcggagactcgtggtttgcgtgggagtgaagaaacttggttcgatttaagaaagagacgaaggagtaatgaagattctatgtgtcaagaagttgaaatgcagaagacggttactggagaagttttcgagtttgagtatttggacgataaggttcttgaagaacttcttgattcagaagaaaggaagagataa

SEQ ID NO: 4906 - DNA, 402 bp, Artificial Sequence
  P25445 (35S::G1792(AA1-80)::G30(AA81-133))
atggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtataacatgggaaccggatcctcatccactgcggctaattcttcttcctcgtcgcagcaagtttttgagtttgagtacttggacgatagcgttttggatgaacttcttgaatatggagagaactataacaagactcataatatcaacatgggcaagaggcaataa

SEQ ID NO: 4907 - DNA, 420 bp, Artificial Sequence
  P25446 (35S::G30(AA1-80)::G1792(AA81-140))
atggatcaaggaggtcgtagcagtggtagtggaggaggaggagccgagcaagggaagtaccgtggagtaaggagacgaccttggggtaaatacgccgcggaaataagagattcgaggaagcacggagagcgtgtgtggctagggacattcgacactgcggaagacgcggctcgagcctatgaccgagccgcctattcaatgagaggcaaagctgccattctcaacttccctcacgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagataa

SEQ ID NO: 4908 - DNA, 411 bp, Artificial Sequence
  P25447 (35S::G1792(AA1-80)::G1795(AA76-131))
atggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtataacatggggagtggtgtctcttcttccaccgccatggctggatcttcctccgcctccgcctccgcttcttcttcttctaggcaagtttttgaatttgagtacttggatgatagtgttttggaggagctccttgaggaaggagagaaacctaacaagggcaagaagaaatga

SEQ ID NO: 4909 - DNA, 405 bp, Artificial Sequence
  P25448 (35S::G1795(AA1-75)::G1792(AA81-140))
atggatcaaggaggtcgaggtgtcggtgccgagcatggaaagtaccggggagttcggagacgaccttggggaaaatatgcagcagagatacgagattcgaggaagcacggtgaacgtgtgtggcttggaacgttcgatacggcagaggaagcggctagagcctatgaccaagctgcttactccatgagaggccaagcagcaatccttaacttccctcatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagataa

SEQ ID NO: 4910 - DNA, 957 bp, Artificial Sequence; identical to SEQ ID NO: 2167
  P25571 (35S::G3848)

SEQ ID NO: 4911 - DNA, 988 bp, Artificial Sequence
  P25572 (35S::G3856)
ggaagttcatttcatttggagaggacacgctgacaagctgactctagcagatctggtaccgtcgacatgctgcttaacccggcgtgcgaggcggcagcgccgatggacagcatccggcatcacctcctggacgagccggcggcggcggcgaccgcgagcgcggctccgcggccggtgtactgccgcagcacgagcttcggcagcctagtggcggaccaatggagcgagtcgctcccgttccgccccgacgacgccgacgacatggtcgtcttcggcgcgctccgcgacgccttttcccagggctggctccccgacggctccttcgccgccgtgaagcccgagcccctggcgttcccggactccccctacgagcgcggatcctatccctgccttggtggcttccttctcgcggaggggcctgagacgccgaccgaggcggcgacgacgcccgggagcgaggaggaggccgcggcggcggtgtccagggggaagcactaccgcggggtgaggcagcggccgtggggcaagttcgcggcggagatccgggacccggccaagaacggcgcgcgcgtgtggctgggcacgtacgacagcgccgaggacgccgccgtggcctacgaccgcgccgcgtaccgcatgcgcggctcccgcgcgctcctcaacttcccgctccgcatcggctccgagatcgccgcggcggccgccgccgtcgcggccactgcccctgccgcgggagacaagcgggcgtccccagagccgaccgcgagctccgactcctccccttcggcctcctctgcgacaccgaagcggaggaagagaggcgaggccgctgccgcgaccatggccatggcccttgtgccgcccccgccggcggcgcaggcgcccgtccagctgaccctcccggcccgtccgtggttcgccgccggccccgtccagcagctagtgagctaatctagacaggcctcgtaccggatcctctagctagagc

SEQ ID NO: 4912 - DNA, 705 bp, Artificial Sequence; identical to SEQ ID NO: 2157
  P25573 (35S::G3841)

SEQ ID NO: 4913 - DNA, 557 bp, Artificial Sequence; identical to SEQ ID NO: 2189
  P25657 (35S::G3876)

SEQ ID NO: 4914 - DNA, 936 bp, Artificial Sequence
  P25658 (35S::G1274::GAL4)
atgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggcaagaaatctgtcaaaaacaacattaacaagaggaattactacaaatgctcaagtgaaggttgctcggtgaagaagagggtagagagagatggtgacgatgcagcttatgtaattacaacatatgaaggagtccataaccatgagagtctctctaatgtctattacaatgaaatggttttatcttatgatcatgataactggaaccaacactctcttcttcgatcttgcggccgccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtag

SEQ ID NO: 4915 - DNA, 936 bp, Artificial Sequence
  P25659 (35S::GAL4::G1274)
atgcccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagggtaccatgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggcaagaaatctgtcaaaaacaacattaacaagaggaattactacaaatgctcaagtgaaggttgctcggtgaagaagagggtagagagagatggtgacgatgcagcttatgtaattacaacatatgaaggagtccataaccatgagagtctctctaatgtctattacaatgaaatggttttatcttatgatcatgataactggaaccaacactctcttcttcgatcttaa

SEQ ID NO: 4916 - DNA, 1499 bp, Artificial Sequence
  P25660 (35S::G3086::GAL4)
atggaatcagaattccagcaacatcacttccttctccacgatcatcaacaccagagaccaagaaactcaggattgattcgttaccaatcagcaccaagttcgtacttttcgagtttcggtgaatcaatcgaagagtttttagatcgacccacaagtcctgaaactgagcgaatcttatctggctttttacaaaccaccgacacaagcgacaacgttgatagtttccttcaccatacttttaacagtgatggaactgagaagaaacctccggaagttaaaacagaggacgaagatgctgaaattccggtgactgcgacggcgacggcgatggaggttgttgtttccggtgatggtgaaatctcagtgaatcctgaagtatcgattgggtatgtggcttcggtttcgaggaataagagaccaagagagaaagatgatcggactccggtgaataatctagctcgtcataatagttcaccggccggattattttcatccattgatgttgaaacagcttatgcagctgtaatgaaaagtatgggaggttttggaggaagtaatgtgatgagtacaagcaatactgaagcttcgtctcttactcctagaagcaagttacttcctcctacttctagagcgatgagtccgatctctgaggttgatgttaaacccggtttctcgtctagattgcctcctcggacgctttccggtgggtttaatcgttcttttgggaatgaagggtctgcttcttccaagcttacagctcttgctaggacccaatctggaggtctagatcaatacaaaaccaaggatgaggattcagcaagtagacgtcctcctttggcacatcacatgagtttgcccaagtctttatcagatattgaacagttactgtcagattctatcccatgtaagatcagagccaagcggggttgtgcaactcatcctcgaagcatagccgagagggtgagaagaaccaagatcagtgaaagaatgaggaagctgcaagaccttgttccaaacatggacacgcaaacaaacacagcagacatgttggatcttgcggttcaatacatcaaggacctgcaagaacaagtgaaggcgctcgaagagagtcgggcaagatgtagatgctctagtgcgtgcggccgccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtagtaagctag

SEQ ID NO: 4917 - DNA, 917 bp, Artificial Sequence
  P25661 (35S::G3742)
atggcctcgcatcagcagcagctcatgtaccagtcgcatcagcagcagcagcagatggcttccgccatggagggactctaccgcaccgtcagctccggcggcacggagtccaccgccgccgccgccggcaacagcctcctccggcagagcagctcccccgccggcttcctcaaccatcttaccatggacaacggatacgggaatatgctaagagcgggcatgggcggcggcggcggtggcggcgacccgcggctcaaggggcagctcagcttctcgtcgcggcaggggtcggtgatgtcccagatctcggagatgggcagcgaggacgaggagctcgccggcggcggcggcagcccggaggctggcagcaacggcggtggcgccgcacgcggcggctacggcggcgggtacgcgatggggtcctccgcctgggaggagccctcgccgccggcgacgtcgctcctcccggacagcagcctcccgtccaagcgcccccgcgacgacctgccgcggcagctcagcctcccggcggcgtccaagaacagcagcaagcccccctcctccgcctccgccgccgcgtcgccggagatggccgccatcgagaagttcctccagttccaggacgccgtcccctgcaagatccgcgccaagcgcggctgcgccacccacccccgcagcatcgccgagcgggtgaggaggacgcggatcagcgagcggatacggaagctgcaggagctcgtccccaacatggaaaagcaaaccaacactgctgacatgttggatcttgccgtggactacatcaaggagctccagaagcaggtcaaggtgttaaacgacagccgttccagctgcacctgctcggcgagcaagcagaagcacttcgccggctaaatcaatcaagtcaatcaatcgccatg

SEQ ID NO: 4918 - DNA, 1491 bp, Artificial Sequence
  P25662 (35S::GAL4::G3086)
atgcccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagggtaccatggaatcagaattccagcaacatcacttccttctccacgatcatcaacaccagagaccaagaaactcaggattgattcgttaccaatcagcaccaagttcgtacttttcgagtttcggtgaatcaatcgaagagtttttagatcgacccacaagtcctgaaactgagcgaatcttatctggctttttacaaaccaccgacacaagcgacaacgttgatagtttccttcaccatacttttaacagtgatggaactgagaagaaacctccggaagttaaaacagaggacgaagatgctgaaattccggtgactgcgacggcgacggcgatggaggttgttgtttccggtgatggtgaaatctcagtgaatcctgaagtatcgattgggtatgtggcttcggtttcgaggaataagagaccaagagagaaagatgatcggactccggtgaataatctagctcgtcataatagttcaccggccggattattttcatccattgatgttgaaacagcttatgcagctgtaatgaaaagtatgggaggttttggaggaagtaatgtgatgagtacaagcaatactgaagcttcgtctcttactcctagaagcaagttacttcctcctacttctagagcgatgagtccgatctctgaggttgatgttaaacccggtttctcgtctagattgcctcctcggacgctttccggtgggtttaatcgttcttttgggaatgaagggtctgcttcttccaagcttacagctcttgctaggacccaatctggaggtctagatcaatacaaaaccaaggatgaggattcagcaagtagacgtcctcctttggcacatcacatgagtttgcccaagtctttatcagatattgaacagttactgtcagattctatcccatgtaagatcagagccaagcggggttgtgcaactcatcctcgaagcatagccgagagggtgagaagaaccaagatcagtgaaagaatgaggaagctgcaagaccttgttccaaacatggacacgcaaacaaacacagcagacatgttggatcttgcggttcaatacatcaaggacctgcaagaacaagtgaaggcgctcgaagagagtcgggcaagatgtagatgctctagtgcgtga

SEQ ID NO: 4919 - DNA, 1048 bp, Artificial Sequence
  P25703 (35S::G1073L)
ttttgtctttgtctctcactagctataaccaaaaaaaaatccaaaaacccaaaccacagtttcttgtttttgttatcaatgtctagttatatgcaccctcttctagggcaagaactgcatctacagagacctgaagattccagaaccccacctgatcaaaataacatggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttagagttttagcgttttggtgacaccttttgttgcgtttgcgtgtttgacctcaaactactaggctacctata

SEQ ID NO: 4920 - DNA, 505 bp, Artificial Sequence
  P25732 (35S::G47(V31E))
cttcttcttcacatcgatcatcatacaacaacaaaaaatggattacagagaatccaccggtgaaagtcagtcaaagtacaaaggaatccgtcgtcggaaatggggcaaatgggtatcagagattagagagccgggaactcgtgaccgtctctggttaggttcattctcaacagcagaaggtgccgccgtagcacacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttgatttatctcgacggtcatgatcacgtttgatctt

SEQ ID NO: 4921 - DNA, 505 bp, Artificial Sequence
  P25735 (35S::G47(V55T))
cttcttcttcacatcgatcatcatacaacaacaaaaaatggattacagagaatccaccggtgaaagtcagtcaaagtacaaaggaatccgtcgtcggaaatggggcaaatgggtatcagagattagagttccgggaactcgtgaccgtctctggttaggttcattctcaacagcagaaggtgccgccgtagcacacgacacagctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttgatttatctcgacggtcatgatcacgtttgatctt

SEQ ID NO: 4922 - DNA, 954 bp, Artificial Sequence
  P25736 (35S::G2999(CHR123-125GLL))
gcttagggttttggagagagattactaagaaagttttaatgtttgtttaagagaaaagttatatattagggttttctttattcagaagcttcaagatcagaaaagatggaagttagagagaagaaagatgagaaaatggagatgacaagaagaaaatcatcagctctagatcatcatcgtcttcctccgtacacttactcccaaaccgccaacaaagagaaacccaccaccaaaagaaacgggtcggacccggatccggatccggatcttgatactaacccaatttctatatctcatgctccaagatcatacgctaggcctcaaactacttctccggggaaggcaaggtatagagaatgccaaaagaatcacgcggcgagctccggtggacacgttgtcgacggttgcggcgagtttatgtcttccggggaagaaggcacggtggagtctcttctttgtgcagcttgtgatggcctcctgagcttccatagaaaagagatcgatggtttgtttgttgtcaatttcaatagctttggccattcacagagaccactcggaagccgccacgtgtctccgataatgatgagttttggtggtggtggtggttgtgcggcggagtcatcgacggaggatctaaacaagtttcatcaatcttttagtggttatggagtggatcagtttcatcattatcaacccaagaaacggtttaggacaaagtttaatgaagaacagaaggagaagatgatggagtttgctgagaagattggttggagaatgacaaaactagaagatgatgaagtgaatcggttttgtcgtgagattaaagttaaaagacaagtgtttaaagtttggatgcacaacaataaacaagcagcaaagaagaaggatttgtaagagatttctatatatatatatatactatttttacttctctttgttcaacattgctttaac

SEQ ID NO: 4923 - DNA, 679 bp, Artificial Sequence
  P25738 (35S::G1792(E119V))
gtcgagaatccatagatctcttattaaataacagtgctgaccaagctcttacaaagcaaaccaatctagaacaccaaagttaatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgtgtttgagtatttggacgataaggttcttgaagaacttcttgattcagaagaaaggaagagataatcacgattagttttgttttgatattttatgtggcactgttgtggctacctacgtgcattatgtgcatgtataggtcgcttgattagtactttataacatgcatgccacgaccataaattgtaagagaagacgtactttgcgttttcatgaaatatgaatgttagatggtttgagtac

SEQ ID NO: 4924 - DNA, 679 bp, Artificial Sequence
  P25739 (35S::G1792(D124G))
gtcgagaatccatagatctcttattaaataacagtgctgaccaagctcttacaaagcaaaccaatctagaacaccaaagttaatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttgggcgataaggttcttgaagaacttcttgattcagaagaaaggaagagataatcacgattagttttgttttgatattttatgtggcactgttgtggctacctacgtgcattatgtgcatgtataggtcgcttgattagtactttataacatgcatgccacgaccataaattgtaagagaagacgtactttgcgttttcatgaaatatgaatgttagatggtttgagtac

SEQ ID NO: 4925 - DNA, 679 bp, Artificial Sequence
  P25740 (35S::G1792(L128G))
gtcgagaatccatagatctcttattaaataacagtgctgaccaagctcttacaaagcaaaccaatctagaacaccaaagttaatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttggggaagaacttcttgattcagaagaaaggaagagataatcacgattagttttgttttgatattttatgtggcactgttgtggctacctacgtgcattatgtgcatgtataggtcgcttgattagtactttataacatgcatgccacgaccataaattgtaagagaagacgtactttgcgttttcatgaaatatgaatgttagatggtttgagtac

SEQ ID NO: 4926 - DNA, 679 bp, Artificial Sequence
  P25741 (35S::G1792(L132G))
gtcgagaatccatagatctcttattaaataacagtgctgaccaagctcttacaaagcaaaccaatctagaacaccaaagttaatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttggggattcagaagaaaggaagagataatcacgattagttttgttttgatattttatgtggcactgttgtggctacctacgtgcattatgtgcatgtataggtcgcttgattagtactttataacatgcatgccacgaccataaattgtaagagaagacgtactttgcgttttcatgaaatatgaatgttagatggtttgagtac

SEQ ID NO: 4927 - DNA, 585 bp, Artificial Sequence
  P25742 (35S::G1274(K120Q))
atgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggccagaaatctgtcaaaaacaacattaacaagaggaattactacaaatgctcaagtgaaggttgctcggtgaagaagagggtagagagagatggtgacgatgcagcttatgtaattacaacatatgaaggagtccataaccatgagagtctctctaatgtctattacaatgaaatggttttatcttatgatcatgataactggaaccaacactctcttcttcgatcttaa

SEQ ID NO: 4928 - DNA, 585 bp, Artificial Sequence
  P25743 (35S::G1274(N131S))
atgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggcaagaaatctgtcaaaaacaacattaacaagaggagttactacaaatgctcaagtgaaggttgctcggtgaagaagagggtagagagagatggtgacgatgcagcttatgtaattacaacatatgaaggagtccataaccatgagagtctctctaatgtctattacaatgaaatggttttatcttatgatcatgataactggaaccaacactctcttcttcgatcttaa

SEQ ID NO: 4929 - DNA, 585 bp, Artificial Sequence
  P25744 (35S::G1274(S136T))
atgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggcaagaaatctgtcaaaaacaacattaacaagaggaattactacaaatgcacaagtgaaggttgctcggtgaagaagagggtagagagagatggtgacgatgcagcttatgtaattacaacatatgaaggagtccataaccatgagagtctctctaatgtctattacaatgaaatggttttatcttatgatcatgataactggaaccaacactctcttcttcgatcttaa

SEQ ID NO: 4930 - DNA, 585 bp, Artificial Sequence
  P25745 (35S::G1274(D149S))
atgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggcaagaaatctgtcaaaaacaacattaacaagaggaattactacaaatgctcaagtgaaggttgctcggtgaagaagagggtagagagaagtggtgacgatgcagcttatgtaattacaacatatgaaggagtccataaccatgagagtctctctaatgtctattacaatgaaatggttttatcttatgatcatgataactggaaccaacactctcttcttcgatcttaa

SEQ ID NO: 4931 - DNA, 585 bp, Artificial Sequence
  P25746 (35S::G1274(Y155V))
atgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggcaagaaatctgtcaaaaacaacattaacaagaggaattactacaaatgctcaagtgaaggttgctcggtgaagaagagggtagagagagatggtgacgatgcagctgtagtaattacaacatatgaaggagtccataaccatgagagtctctctaatgtctattacaatgaaatggttttatcttatgatcatgataactggaaccaacactctcttcttcgatcttaa

SEQ ID NO: 4932 - DNA, 507 bp, Artificial Sequence
  P25777 (35S::G3873)
ggcgacccatgtccgatgctccggcgagtccatgcggcggcggcggcggaggcagccacgagagcggcgagcacagtccccgctccaatttccgcgagcaggaccgcttcctccccatcgccaacatcagccgcatcatgaagaaagcgcttcctcccaacgggaaaatcgccaaggacgccaaggaaaccgtgcaggaatgcgtctccgagttcatcagcttcgtcaccagcgaagcgagcgataagtgtcagagagagaagaggaagaccatcaacggcgacgatttgctttgggctatgaccactttaggtttcgaggagtatattgatccgctcaaggtttacctcgccgcttacagagagattgagggtgattcaaagggttcggccaagggtggagatgcatctgctaagagagatgtttatcagagtcctaatggccaggttgctcatcaaggttctttctcacaaggtgttaattatacgaattcttagccccaggctc

SEQ ID NO: 4933 - DNA, 526 bp, Artificial Sequence
  P25778 (35S::G3874)
catggccgacggtccggctagcccaggcggcggcagccacgagagcggcgaccacagccctcgctctaacgtgcgcgagcaggacaggtacctccctatcgctaacataagccgcatcatgaagaaggcacttcctgccaacggtaaaatcgcaaaggacgccaaagagaccgttcaggaatgcgtctccgagttcatcagcttcatcaccagcgaggcctctgataagtgtcagagagaaaagagaaagactattaacggcgatgatttgctctgggcgatggccactctcggtttcgaggattatatggatcctcttaaaatttacctcactagataccgagagatggagggtgatacgaagggctctgccaagggtggagactcatctgctaagagagatgttcagccaagtcctaatgctcagcttgctcatcaaggttctttctcacaaaatgttacttacccgaattctcagggtcgacatatgatggttccaatgcaaggcccggagtagtatcaagtt

SEQ ID NO: 4934 - DNA, 862 bp, Artificial Sequence
  P25889 (35S::G481(S66G))
ccacgcgtccgagcgtttcgtagaaaaattcgatttctctaaagccctaaaactaaaacgactatccccaattccaagttctagggtttccatcttccccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactggggaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaatacaaaatccttaaattaaaaaaaaaaaaaaaaaaaaaa

SEQ ID NO: 4935 - DNA, 426 bp, Artificial Sequence
  P25891 (35S::G481(AA1-19)::G485(AA20-110)::G481(AA111-141))
atggcggatacgccttcgagcccagctggagatggcggagaaagcggcggttccgttcgtgagcaagataggtttctaccgatcgctaacgttagcaggatcatgaagaaagcacttcctgcgaacgcaaaaatctctaaggatgctaaagaaacggttcaagagtgtgtatcggaattcataagtttcatcaccggtgaggcttctgacaagtgtcagagagagaagaggaagacaatcaacggtgacgatcttctttgggcgatgactacgctagggtttgaggactacgtggagcctctcaaggtttatctgcaaaagtatagggagttggagggtgataataagggatcaggaaagagtggagatggatcaaatagagatgctggtggcggtgtttctggtgaagaaatgccgagctggtaa

SEQ ID NO: 4936 - DNA, 486 bp, Artificial Sequence
  P25892 (35S::G485(1-19)::G481(20-110)::G485(111-161))
atggcggattcggacaacgattcaggaggacacaaagacggtggaaatgcttcgacaagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggaggtggaaggagagaagactactacggcagggagacaaggcgataaggaaggtggaggaggaggcggtggagctggaagtggaagtggaggagctccgatgtacggtggtggcatggtgactacgatgggacatcaattttcccatcatttttcttaa

SEQ ID NO: 4937 - DNA, 339 bp, Artificial Sequence
  P25893 (35S::G481SV)
atggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggaggtatggtga

SEQ ID NO: 4938 - DNA, 1158 bp, Artificial Sequence
  P25896 (PRRBSC3::GFP::G481)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggaggcggccgcatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaa

SEQ ID NO: 4939 - DNA, 1362 bp, Artificial Sequence
  P26037 (35S::G1821::(9A)CFP)
atggcagagggcagtatgcgtcctccagaattcaaccagcctaacaaaaccagtaatggtggtgaggaggagtgcacggtgagggagcaagacaggttcatgcctattgccaacgtgatacggatcatgcggaggatcttacctgctcacgccaagatctcagatgactccaaggagacgatccaagagtgtgtttcggagtacatcagcttcataacaggggaggctaatgagcggtgccagcgggaacagcgcaagaccatcactgctgaggacgtcttgtgggcaatgagcaagctcggttttgatgactacatcgaacccctcacgttgtacctccaccgctacagagagttggaaggtgaaagaggggttagctgcagtgctgggtccgttagtatgaccaacggcttggtggtcaagaggcctaatgggaccatgaccgagtatggagcctacgggcctgtgccagggattcacatggcgcagtaccattatcgtcatcagaacgggtttgttttcagtggtaacgaacctaattctaagatgagtggttcatcttcaggagcaagtggcgccagagttgaagtatttccgactcaacaacataagtacgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 4940 - DNA, 1236 bp, Artificial Sequence
  P26039 (35S::G2631::(9A)CFP)
atggatccgatggatatagttggaaaatcaaaggaagatgcttcgcttccgaaagctaccatgacgaaaattataaaggagatgttacccgcagatgttcgtgttgctagagatgctcaagatctattgattgagtgttgtgtagagttcataaatcttatatcgtcggagtcgaatgaagtgtgtaacaaagaggataaacgaacaatagcccctgagcacgtactcaaagctttacaggttcttggctttggggaatacgtagaagaagtttatgccgcgtatgagcaacataaatatgaaaccatgcaggattcgcagagaagtgtgaagatgaatagcggagcagagatgacggaagaagaggcggcagcggaacaacagaggatgtttgcagaagctcgagcaagaatgaatggaggtgttacagttcctcaaccagagcaactagaagaaccccaacaacaacaacaaacaagtctacaaagcgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 4941 - DNA, 1170 bp, Artificial Sequence
  P26040 (35S::G481::(9A)CFP)
atggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctgggcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 4942 - DNA, 1317 bp, Artificial Sequence
  P26041 (35S::G482::(9A)CFP)
atgggggattccgacagggattccggtggagggcaaaacgggaacaaccagaacggacagtcctccttgtctccaagagagcaagacaggttcttgccgatcgctaacgtcagccggatcatgaagaaggccttgcccgccaacgccaagatctctaaagatgccaaagagacgatgcaggagtgtgtctccgagttcatcagcttcgtcaccggagaagcatctgataagtgtcagaaggagaagaggaagacgatcaacggagacgatttgctctgggctatgactactctaggttttgaggattatgttgagccattgaaagtttacttgcagaggtttagggagatcgaaggggagaggactggactagggaggccacagactggtggtgaggtcggagagcatcagagagatgctgtcggagatggcggtgggttctacggtggtggtggtgggatgcagtatcaccaacatcatcagtttcttcaccagcagaaccatatgtatggagccacaggtggcggtagcgacagtggaggtggagctgcctccggtaggacaaggactgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 4943 - DNA, 1342 bp, Artificial Sequence
  P26043 (35S::G1781::(9A)CFP)
atgactgaggagagcccagaagaagatcatgggtctcctggagtagctgaaacaaatccaggaagcccttcttcaaagaccaacaacaacaacaacaacaacaaagaacaagaccggtttcttcccattgcgaatgtcggaaggatcatgaaaaaagttcttcccggtaacggtaagatctcaaaagacgctaaagaaaccgttcaagaatgtgtctcggagttcattagtttcgtcactggtgaagcttctgacaagtgtcaaagagaaaagaggaagaccatcaatggagatgatatcatttgggctatcacaactctcggtttcgaagactacgtggctccattaaaggtctacctctgcaaatatagagacaccgaaggagagaaagttaacagcccaaaacaacaacaacaaagacaacaacaacagcagattcaacaacagaatcatcataattatcagtttcaagaacaagaccaaaacaataacaacatgtcatgtactagttacatctctcatcatcatccttctccattcctaccagtggatcatcaaccttttcccaatattgctttctctcctaaatcattgcgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 4944 - DNA, 1230 bp, Artificial Sequence
  P26044 (35S::G485::(9A)CFP)
atggcggattcggacaacgattcaggaggacacaaagacggtggaaatgcttcgacacgtgagcaagataggtttctaccgatcgctaacgttagcaggatcatgaagaaagcacttcctgcgaacgcaaaaatctctaaggatgctaaagaaacggttcaagagtgtgtatcggaattcataagtttcatcaccggtgaggcttctgacaagtgtcagagagagaagaggaagacaatcaacggtgacgatcttctttgggcgatgactacgctagggtttgaggactacgtggagcctctcaaggtttatctgcaaaagtatagggaggtggaaggagagaagactactacggcagggagacaaggcgataaggaaggtggaggaggaggcggtggagctggaagtggaagtggaggagctccgatgtacggtggtggcatggtgactacgatgggacatcaattttcccatcatttttctgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 4945 - DNA, 1308 bp, Artificial Sequence
  P26052 (35S::G1836::(9A)YFP)
atggagaacaacaacggcaacaaccagctgccaccgaaaggtaacgagcaactgaagagtttctggtcaaaagagatggaaggtaacttagatttcaaaaatcacgaccttcctataactcgtatcaagaagattatgaagtatgatccggatgtgactatgatagctagtgaggctccaatcctcctctcgaaagcatgtgagatgtttatcatggatctcacgatgcgttcgtggctccatgctcaggaaagcaaacgagtcacgctacagaaatctaatgtcgatgccgcagtggctcaaactgttatctttgatttcttgcttgatgatgacattgaggtaaagagagagtctgttgccgccgctgctgatcctgtggccatgccacctattgacgatggagagctgcctccaggaatggtaattggaactcctgtttgttgtagtcttggaatccaccaaccacaaccacaaatgcaggcatggcctggagcttggacctcggtgtctggtgaggaggaagaagcgcgtgggaaaaaaggaggtgacgacggaaacgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4946 - DNA, 1569 bp, Artificial Sequence
  P26053 (35S::G2632::(9A)YFP)
atgggaattgaagacatgcattcaaaatctgacagtggtgggaacaaggttgattcagaggttcatggtacagtatcgtcgtcgataaatagtttaaacccttggcatcgtgctgctgctgcttgcaatgcaaattctagtgtggaagctggagataaatcttctaagtcaatagcattagcattggaatcaaacggttccaaatcaccatccaatagagataatactgttaacaaggaatcacaagtcacaacgtctccacaatcagctggagattatagtgataaaaaccaagaatctctgcatcatggcatcacacaacctcctcctcaccctcaacttgttggccacacagttggatgggcatcctcaaatccataccaggatccatattatgcaggagtgatgggagcctatggacatcatcccctggggtttgttccatatggtgggatgcctcattcaagaatgccactgccgcctgagatggcacaagaaccagttttcgtgaatgctaaacagtaccaggcgattctgaggcgaaggcaggcacgcgccaaggcagagctagagaagaagctaataaaatccagaaagccttatctacatgaatctcggcatcaacatgctatgaggaggccaaggggtactggaggacggtttgcaaagaaaaccaacaccgaagcttcaaagcgtaaagctgaagaaaagagcaatggtcatgttactcagtccccgtcatcatctaattctgatcaaggtgaagcttggaatggtgactatagaacacctcagggagatgagatgcagagctcagcttatgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4947 - DNA, 1449 bp, Artificial Sequence
  P26057 (35S::G715::(9A)YFP)
atggataccaacaaccagcaaccacctccctccgccgccggaatccctcctccaccacctggaaccaccatctccgccgcaggaggaggagcttcttaccaccaccttctccaacaacaacaacaacagctccaactattctggacctaccaacgccaagagatcgaacaagttaacgatttcaaaaaccatcagcttccactagctaggataaaaaagatcatgaaagccgatgaagatgttcgtatgatctccgcagaagcaccgattctcttcgcgaaagcttgtgagcttttcattctcgagctcacgatcagatcttggcttcacgctgaggagaataaacgtcgtacgcttcagaaaaacgatatcgctgctgcgattactaggactgatatcttcgatttccttgttgatattgttcctagagatgagattaaggacgaagccgcagtcctcggtggtggaatggtggtggctcctaccgcgagcggcgtgccttactattatccgccgatgggacaaccagctggtcctggagggatgatgattgggagaccagctatggatccgaatggtgtttatgtccagcctccgtctcaggcgtggcagagtgtttggcagacttcgacggggacgggagatgatgtctcttatggtagtggtggaagttccggtcaagggaatctcgacggccaaggtgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4948 - DNA, 1332 bp, Artificial Sequence
  P26059 (35S::G490::(9A)YFP)
atgaggaggccaaagtcatctcacgtcaggatggaacctgttgcgcctcgttcacataacacgatgccaatgcttgatcaatttcgatctaatcatcctgaaacaagcaagatcgagggggtctcttcgttggacacagctctgaaggtgttttggaataatcaaagggagcagctaggaaactttgcaggccaaactcatttgccgctatctagggtcagaaagattttgaaatctgatcctgaagtcaagaagataagctgtgatgttcctgctttgttttcgaaagcctgtgaatacttcattctagaggtaacattacgagcttggatgcatactcaatcatgcactcgtgagaccatccggcgttgtgatatcttccaggccgtaaagaactcaggaacttatgatttcctgattgatcgtgtcccttttggaccgcactgtgtcacccatcagggtgtgcaacctcctgctgaaatgattttgccggatatgaatgttccaatcgatatggaccagattgaggaggagaatatgatggaagagcgctctgtcgggtttgacctcaactgtgatctccaggcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4949 - DNA, 1407 bp, Artificial Sequence
  P26060 (35S::G489::(9A)YFP)
atgaactatggcacaaacccataccaaaccaacccgatgagcaccactgctgctactgtagcaggaggtgcggcacaaccaggccagctggcgttccaccagatccatcagcagcagcagcagcaacagctggcacagcagcttcaagcattttgggagaaccaattcaaagagattgagaagactaccgatttcaagaaccacagccttccccttgcgagaatcaagaaaatcatgaaagcggatgaagatgtccgtatgatctcggctgaggcgcctgtcgtgtttgcaagggcctgtgagatgttcatcctggagctgacactcaggtcgtggaaccacactgaggagaataagaggcggacgttgcagaagaacgatattgctgctgctgtgactagaaccgatatttttgatttccttgtggatattgttccccgggaggatctccgagatgaagtcttgggaagtattccgaggggcactgtcccggaagctgctgctgctggttacccgtatggatacttgcctgcaggaactgctccaataggaaatccgggaatggttatgggtaatcccggtggtgcgtatccacctaatccttatatgggtcaaccaatgtggcaacaacaggcacctgaccaacctgaccaggaaaatgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4950 - DNA, 1398 bp, Artificial Sequence
  P26061 (35S::G714::(9A)YFP)
atggatcaacaaggacaatcatcagctatgaactatggttcaaacccatatcaaaccaacgccatgaccactacaccaaccggttcagaccatccagcttaccatcagatccaccagcaacaacaacaacagctcactcaacagcttcaatctttctgggagactcaattcaaagagattgagaaaaccactgatttcaagaaccatagccttccattggcaagaatcaagaaaatcatgaaagctgatgaagatgtgcgtatgatctcggccgaggcgcctgttgtgttcgccagggcctgcgagatgtttattctggagcttacgttaaggtcttggaaccatactgaggagaacaagagaaggacgttgcagaagaatgatatcgcggctgcggtgactagaactgatatttttgattttcttgtggatattgttcctcgggaggatcttcgtgatgaagtcttgggtggtgttggtgctgaagctgctacagctgcgggttatccgtatggatacttgcctcctggaacagctccaattgggaacccgggaatggttatgggtaacccgggcgcgtatccgccgaacccgtatatgggtcagccaatgtggcaacaaccaggacctgagcagcaggatcctgacaatgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4951 - DNA, 1353 bp, Artificial Sequence
  P26064 (35S::G1820::(9A)YFP)
atggctgagaacaacaacaacaacggcgacaacatgaacaacgacaaccaccagcaaccaccgtcgtactcgcagctgccgccgatggcatcatccaaccctcagttacgtaattactggattgagcagatggaaaccgtctcggatttcaaaaaccgtcagcttccattggctcgaattaagaagatcatgaaggctgatccagatgtgcacatggtctccgcagaggctccgatcatcttcgcaaaggcttgcgaaatgttcatcgttgatctcacgatgcggtcgtggctcaaagccgaggagaacaaacgccacacgcttcagaaatcggatatctccaacgcagtggctagctctttcacctacgatttccttcttgatgttgtccctaaggacgagtctatcgccaccgctgatcctggctttgtggctatgccacatcctgacggtggaggagtaccgcaatattattatccaccgggagtggtgatgggaactcctatggttggtagtggaatgtacgcgccatcgcaggcgtggccagcagcggctggtgacggggaggatgatgctgaggataatggaggaaacggcggcggaaatgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4952 - DNA, 1383 bp, Artificial Sequence
  P26065 (35S::G1819::(9A)YFP)
atggaagagaacaacggcaacaacaaccactacctgccgcaaccatcgtcttcccaactgccgccgccaccattgtattatcaatcaatgccgttgccgtcatattcactgccgctgccgtactcaccgcagatgcggaattattggattgcgcagatgggaaacgcaactgatgttaagcatcatgcgtttccactaaccaggataaagaaaatcatgaagtccaacccggaagtgaacatggtcactgcagaggctccggtccttatatcgaaggcctgtgagatgctcattcttgatctcacaatgcgatcgtggcttcataccgtggagggcggtcgccaaactctcaagagatccgatacgctcacgagatccgatatctccgccgcaacgactcgtagtttcaaatttaccttccttggcgacgttgtcccaagagacccttccgtcgttaccgatgatcccgtgctacatccggacggtgaagtacttcctccgggaacggtgataggatatccggtgtttgattgtaatggtgtgtacgcgtcaccgccacagatgcaggagtggccggcggtgcctggtgacggagaggaggcagctggggaaattggaggaagcagcggcggtaatgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4953 - DNA, 1266 bp, Artificial Sequence
  P26108 (35S::G1364::(9A)CFP)
atggcggagtcgcaggccaagagtcccggaggctgtggaagccatgagagtggtggagatcaaagtcccaggtcgttacatgttcgtgagcaagataggtttcttccgattgctaacataagccgtatcatgaaaagaggtcttcctgctaatgggaaaatcgctaaagatgctaaggagattgtgcaggaatgtgtctctgaattcatcagtttcgtcaccagcgaagcgagtgataaatgtcaaagagagaaaaggaagactattaatggagatgatttgctttgggcaatggctactttaggatttgaagactacatggaacctctcaaggtttacctgatgagatatagagagatggagggtgacacaaagggatcagcaaaaggtggggatccaaatgcaaagaaagatgggcaatcaagccaaaatggccagttctcgcagcttgctcaccaaggtccttatgggaactctcaagctcagcagcatatgatggttccaatgccgggaacagacgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 4954 - DNA, 1671 bp, Artificial Sequence
  P26121 (35S::G1363::(9A)YFP)
atgcaagagttccatagtagcaaagattcattgccttgtcctgcaacttcttgggataactctgtcttcaccaactcaaatgtccaaggatcatcatccttgaccgataacaacactttaagcttgacaatggagatgaaacaaactggttttcaaatgcagcactatgattcctcctctactcaatccactggaggagaatcatatagtgaagttgctagcttaagtgaacctactaatcgttatggccacaacattgttgtcactcatctctcaggttacaaagaaaacccggaaaatcctattggaagtcattcgatatcaaaggtgtctcaagattcagtggttcttcctattgaggcggcttcttggcctttacacggcaatgtaacgccacatttcaatggtttcttgtcttttccttatgcatcacaacacacggtgcagcatcctcaaatcagagggttggttccgtctagaatgcctttgcctcacaacattccagagaacgaaccaattttcgtcaatgcaaaacagtaccaagccattctccgccgcagagagcgccgtgcaaagcttgaagctcagaacaagctcatcaaagtccgcaaaccatatcttcacgagtcgcggcacctccatgcactaaagagagttagaggctctggtggacgtttcctcaacacaaagaagcatcaagaatcaaattcctcactatctcctccattcttgattccacctcatgtcttcaagaactctccaggaaagttccggcaaatggacatttcaaggggtggggttgtgtctagtgtctcgacaacatcttgctcggacataaccgggaacaacaacgacatgttccagcaaaacccacaattcaggttctcaggttatccatcaaaccaccatgtctcagtcctcatggcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4955 - DNA, 1497 bp, Artificial Sequence
  P26130 (35S::G1646::(9A)YFP)
atggacaataacaacaacaacaacaaccagcaaccaccaccaacctccgtctatccacctggctccgccgtcacaaccgtaatccctcctccaccatctggatctgcatcaatagtcaccggaggaggagcgacataccaccacctcctccagcaacaacagcaacagcttcaaatgttctggacataccagagacaagagatcgaacaggtaaacgatttcaaaaaccatcagctccctctagctcgtatcaaaaaaatcatgaaagctgatgaagatgtgcgtatgatctccgccgaagcaccgattctcttcgcgaaagcttgtgagcttttcattctcgaacttacgattagatcttggcttcacgctgaagagaacaaacgtcgtacgcttcagaaaaacgatatcgctgctgcgattactagaaccgatatcttcgatttccttgttgatattgttcctagggaagagatcaaggaagaggaagatgcagcatcggctcttggtggaggaggtatggttgctcccgccgcgagcggtgttccttattattatccaccgatgggacaaccggcggttcctggagggatgatgattggaagaccggcgatggatcctagcggtgtttatgctcagcctccttctcaggcatggcaaagcgtttggcagaattcagctggtggtggtgatgatgtgtcttatggaagtggaggaagtagcggccatggtaatctcgatagccaaggggcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4956 - DNA, 1305 bp, Artificial Sequence
  P26159 (35S::G1818::(9A)YFP)
atggagaacaacaacaacaaccaccaacagccaccgaaagataacgagcaactaaagagtttctggtcaaaggggatggaaggtgacttgaatgtcaagaatcacgagttccccatctctcgtatcaagaggataatgaagtttgatccggatgtgagtatgatcgctgctgaggctccaaatctcttatctaaggcttgtgaaatgtttgtcatggacctcacgatgcgttcatggctccatgctcaagagagcaaccgactcacgatacggaaatctgatgttgatgccgtagtgtctcaaaccgtcatctttgatttcttgcgtgatgatgtccctaaggacgagggagagcccgttgtcgccgctgctgatcctgtggacgatgttgctgatcatgtggctgtgccagatcttaacaatgaagaactgccgccgggaacggtgataggaactccggtttgttacggtttaggaatacacgcgccacacccgcagatgcctggagcttggaccgaggaggatgcgactggggcaaatggaggaaacggtgggaatgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4957 - DNA, 1632 bp, Artificial Sequence
  P26197 (35S::G927::(9A)YFP)
atggctatgcaaactgtgagagaaggtctcttctctgctccacagacttcttggtggactgcttttggatctcagccgttggctccggagagtctcgccggcgattctgactcattcgccggagttaaggtcggatctgtcggagagacaagacaacgtgtggataaacagagcaactctgcaacgcacttagctttctcacttggtgatgtaaagagtccaagacttgtgccaaagcctcatggagctactttctcaatgcaatcaccttgcttggaacttggattttctcagccaccgatctatacaaagtatccctatggagaacaacaatactatggagttgtttcagcctatggatctcagagcagggtaatgcttcctctaaacatggaaacggaagatagtaccatctatgtgaactcaaagcaataccatggaatcataaggagacgccaatcccgcgcaaaggctgctgctgttcttgatcagaagaaattgagtagtagatgccgcaagccatatatgcatcattcgcgccatctccatgcattgcggcgtcctagaggatccggtgggagattcttgaacactaaaagtcagaacttggaaaatagcggaaccaatgcaaagaaaggtgatggaagtatgcagattcagtctcagcctaagcctcagcaaagtaactctcagaattctgaagttgttcatccggaaaacgggaccatgaacttatcgaacggattaaatgtgtcgggatcagaagttactagcatgaactacttcctaagttctcccgttcattctcttggtggcatggtaatgcctagcaagtggatagcagcagcagcagcaatggataatggctgctgcaatttcaaaaccgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4958 - DNA, 816 bp, Artificial Sequence
  P26217 (35S::G926::(9A)YFP)
atgcaatcaaaaccgggaagagaaaacgaagaggaagtcaataatcaccatgctgttcagcagccgatgatgtatgcagagccctggtggaaaaacaactcctttggtgttgtacctcaagcgagaccttctggaattccatcaaattcctcttctttggattgccccaatggttccgagtcaaacgatgttcattcagcatctgaagacggtgcgttgaatggtgaaaacgatggcacttggaaggattcacaagctgcaacttcctctcgttcagtagataatcacggaatggaaggaaatgacccagcgctctctatccgtaacatgcatgatcagccacttgtacaaccaccagagcttgttggacactatatcgcttgtgtcccaaacccatatcaggatccatattatgggggattgatgggagcatatggtcatcagcaattgggttttcgtccatatcttggaatgcctcgtgaaagaacagctctgccacttgacatggcacaagagcccgtttatgtgaatgcaaagcagtacgagggaattctaaggcgaagaaaagcacgtgccaaggcagagctagagaggaaagtcatccgggacagaaagccatatcttcacgagtcaagacacaagcatgcaatgagaagggcacgagcgagtggaggccggtttgcgaagaaaagtgaggtagaagcgggagaggatgcaggagggagagacagagaaaggggttcagcaaccaactcatcaggctctgaacaagttgagacagactctaatgagaccctgaattcttctggtgcacca

SEQ ID NO: 4959 - DNA, 1341 bp, Artificial Sequence
  P26219 (35S::G929::(9A)YFP)
atgacttcttcagtacatgagctctctgataacaatgaaagtcatgcgaagaaagaacgtccagattcccaaacccgaccacaggttccttcaggacgaagttcggaatctattgatacaaactctgtctactcagagcccatggcacatggattatacccgtatccagatccttactacagaagcgtctttgcacagcaagcgtatcttccacatccctatcctggggtccaattgcagttaatgggaatgcagcagccaggagttccattgcaatgtgatgcagtcgaggaacctgtttttgttaacgcaaagcaataccatggtatactcaggcgcaggcaatcccgggcaaaacttgaggcacgaaatagagccatcaaagcaaaaaagccatacatgcatgaatctcggcatttacatgcgataagacggccaagaggatgtggtggccggtttctcaatgccaagaaggaaaatggagaccacaaggaggaggaggaggcaacctctgatgagaacacttcagaagcaagttccagcctcaggtccgagaaattagctatggctacttctggtcctaatggtagatctgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4960 - DNA, 1767 bp, Artificial Sequence
  P26223 (35S::G928::(9A)YFP)
atgatgcatcagatgttgaataagaaagattcagctactcattccactttgccataccttaatactagcatctcttggggagtggttccaactgattccgttgctaatcgtcgcggttctgctgaatcactaagcttgaaggttgattcaagacctgggcatatacaaactacaaagcaaatcagttttcaggaccaagattcatcttcaacacagtccactggtcaatcttatactgaagttgctagtagtggtgatgataatccttccagacaaatctccttttcggctaaatcaggatctgaaataactcaacggaaggggtttgcaagtaatcctaaacaaggctcgatgactggatttccgaatattcactttgctcctgcacaggctaatttctcatttcactatgctgatccacattatggtggtttattagctgcaacttacctaccacaggcaccaacatgcaatcctcaaatggtgagtatgattcctggtcgtgttcctttaccagcagagctcacagaaactgatccagtctttgtcaatgcgaagcaataccacgcaattatgaggaggagacagcaacgtgctaagcttgaggctcaaaacaaactaatcagagcccgtaagccctatcttcatgagtctcgacatgttcatgctcttaaaaggccaagaggatctggtggaagattcctaaacaccaaaaaacttcttcaagaatccgaacaggctgctgctagagaacaagaacaggacaagttaggccaacaggtaaacagaaagaccaacatgtctagattcgaagctcatatgctgcagaacaacaaagaccgcagctcaaccacttctggctcagacatcacctctgtttccgacggtgctgatatctttggacacactgaattccagttttcaggtttcccaactccgataaaccgagccatgcttgttcatggtcagtctaatgacatgcatggaggtggagacatgcaccatttctctgtccatatcgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4961 - DNA, 1731 bp, Artificial Sequence
  P26230 (35S::G931::(9A)YFP)
atggataagaaagtttcatttactagctctgtggcacattcaactccaccataccttagtacttccatctcatggggacttccaaccaaatccaatggtgtgactgaatcactgagtttgaaggtggtagatgcaagaccagaacgtcttataaacacaaagaatatcagtttccaggaccaggattcatcttcaactctgtcctctgctcaatcttctaacgatgttacaagtagtggagatgataacccctcaagacaaatctcatttttagcacattcagatgtttgtaaaggatttgaagaaactcaaaggaagcgatttgcaattaaatcaggctcctccacggcaggaatcgctgatattcactcttctccttccaaggctaacttctcatttcactatgccgatccacattttggtggtttaatgcctgcggcttacctaccacaggcaacaatatggaatccccaaatgactcgagttccgctaccattcgatctcatagagaatgagcctgtctttgtcaatgcaaagcaattccatgcaattatgaggaggaggcaacagcgtgctaagctagaggcgcaaaacaaactaatcaaagcccgtaagccgtatcttcatgaatctcgacatgttcacgctcttaaacgacctagaggatctggtggaagattcctaaacaccaaaaagcttcaagaatctacagatccaaaacaagacatgccaatccaacagcaacacgcaacgggaaacatgtcaagatttgtgctttatcagttgcagaacagcaatgactgtgattgttcaaccacttctcgctctgacatcacatctgcttctgacagcgttaatctctttggacactctgaatttctgatatcagattgcccatctcagacaaacccaacaatgtatgttcatggtcaatcaaatgacatgcatggaggtaggaacacacaccatttctctgtccatatcgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4962 - DNA, 1554 bp, Artificial Sequence
  P26238 (35S::G1334::(9A)YFP)
atgcaaactgaggagcttttgtcgccaccacagactccttggtggaatgcttttggatctcagccgttgactacagagagcctttccggcgaagcttctgattcattcaccggagttaaggcagttactacggaggcagaacaaggtgtggtggataaacaaacttctacaactctcttcactttctcacctggtggtgaaaagagttcaagagatgtgccaaagcctcatgttgctttcgcgatgcaatcagcttgcttcgagtttggatttgctcagccaatgatgtacacaaagcatcctcatgttgaacaatactatggagttgtttcagcatacggatctcagaggtcttcgggccgagtaatgattccactgaagatggagacagaagaagatggtaccatctatgtgaactcaaagcagtaccatggaattatcaggcgacgccagtcccgagcaaaggctgaaaaactgagtagatgccgtaagccatatatgcatcactcacgccatctccatgctatgcgccgtcctagaggatctggcgggcgtttcttgaacaccaagacagctgatgcggctaagcagtctaagccgagtaattctcagagttctgaagtctttcatccggaaaatgagaccataaactcatcgagggaagcaaatgagtcaaatctctcggattctgcagttacaagtatggattactttctaagttcgtcggcttattctcctggtggcatggtcatgcctatcaagtggaatgcagcagcaatggatattggctgctgcaaacttaatatagcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4963 - DNA, 882 bp, Artificial Sequence
  P26259 (OPLEXA::12XHA(10A)::G1792)
atgagttacccatacgatgttcctgactatgcgggctatccctatgacgtcccggactatgcaggatcctatccatatgacgttccagattacgcttctagatacccatacgatgttcctgactatgcgggctatccctatgacgtcccggactatgcaggatcctatccatatgacgttccagattacgctactagttacccatacgatgttcctgactatgcgggctatccctatgacgtcccggactatgcaggatcctatccatatgacgttccagattacgcttctagatacccatacgatgttcctgactatgcgggctatccctatgacgtcccggactatgcaggatcctatccatatgacgttccagattacgctactagacaggcctcgtaccggatcctctacctagagaattccgccgctgccgctgcggcagcggctgcagcgggtaccatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagataa

SEQ ID NO: 4964 - DNA, 1217 bp, Artificial Sequence
  P26263 (OPLEXA::12XHA::G481)
atgagttacccatacgatgttcctgactatgcgggctatccctatgacgtcccggactatgcaggatcctatccatatgacgttccagattacgcttctagatacccatacgatgttcctgactatgcgggctatccctatgacgtcccggactatgcaggatcctatccatatgacgttccagattacgctactagttacccatacgatgttcctgactatgcgggctatccctatgacgtcccggactatgcaggatcctatccatatgacgttccagattacgcttctagatacccatacgatgttcctgactatgcgggctatccctatgacgtcccggactatgcaggatcctatccatatgacgttccagattacgctactagacaggcctcgtaccggatcctctacctagagaattccgccgctgccgctgcggcagcggctgcagcgggtaccgtcgacgcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaatacaaaatccttaaattaaaaaaaaaaaaaaaaaaaaaaaa

SEQ ID NO: 4965 - DNA, 1164 bp, Artificial Sequence
  P26277 (35S::G486::(9A)CFP)
atgacagacgaagatagattgttgccaatagccaatgtagggagacttatgaagcaaatcctaccatcaaatgcaaagatctcaaaagaagcaaaacaaacagttcaagaatgtgcaacagagttcataagctttgttacatgcgaagcatcagagaagtgccacagggagaatcggaagacggtgaatggagacgacatctggtgggctctcagcactctcggcctcgataactatgctgacgccgtgggtaggcatcttcacaagtaccgcgaagccgagagagaaagaactgagcacaacaaaggtagcaatgatagtgggaatgagaaagaaaccaacactagaagtgatgtacagaaccaatcgacaaaatttattagagttgttgagaagggaagcagctcctcggcccgtgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 4966 - DNA, 1281 bp, Artificial Sequence; identical to SEQ ID NO: 15
  P26372 (35S::G867(SULF))

SEQ ID NO: 4967 - DNA, 972 bp, Artificial Sequence
  P26378 (35S::G28(SULF))
ccacgcgtccggaaatctcaacaagaaccaaaccaaacaacaaaaaaacattcttaataattatctttctgttatgtcgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagatccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataattttgatttttctttgttggatgattatatgattcttcaaaaaagaagaacgttaataaaaaaattcgtttattattaaaaaaaaaaaaaaa

SEQ ID NO: 4968 - DNA, 1751 bp, Artificial Sequence
  P26383 (35S::G1919(SULF))
tctctagctctttactaatttatcgatttgtctttctgatttttgttttgtcattttcaagaaaacaatggagtacgatggacggagaccctactctgttctaacgagaaatgaaattaccgtaaagatgaagaaacagatcaatgaaatctctgacatcttcttcatatcaaactccgatgcgaccgtacttcttatgtatctccgatgggactcgcttcgtgtttcagagcgtttaggtgaaaacaaggagaaattattgatggattcaggtttgaaatcagtcatgatcgatcccagtccagattcatctagcgagattagcttggagactgatgtttatgagtttgatggtgataatgatttaatctccatgcccttttgttctcacaagttcgactcaaaatattggagagagtatcttgagaagaatttctactatgtggagaaaatccaaaccacaatctcttgtcctgatcaagattgtcgatctgcggttggaccagacacgattgagaaactaacagtacgtgatcaagagatgtacgagaggtacatttggagatcttacattgaaggaaacaaggtattgatgatcaaacagtgtcctgcacggaattgcgattatgttattgagtttcatcaagagaatgatgatgatgatgagtatagtttaaacgtggtgtgtatctgtggtcatatcttctgttggagatgcagacttgagtcacacagaccagtgagttgtaacaaggcctctgattggttgtgtagtgccacaatgaaaatatcagatgaatcatttagcctttatccgaccaaaaccaagacagtgacttgccctcattgcctctgttctctggagtctgatacaaaaatgccccagttcttgacttgtgtctgcaggtttcaccctaattttgacaattacatagaattggatttctctgtttaagtcttgatccttactcttttgtgttatcttgctttaggcttcgtttctgttcgaggtgtttgcggtcagaggaagcccacaaaattgaagcagtagactctggattctgtattaaaacagaagtggggattttatgtgaggatcgctggaacgtgtgtcagaagttactggagcaagccaaatccgatctagaagctttcgaggaaaccaacatcaagaaaccgagtgacttattaagggagcaagacattatgattataagagaagggttgatgttgattgttcaatgcagacgagtccttaaatggtgttgtgtgtatgactatttccacacagagtatgagaactcgaaggagtatctacgatacctccaaggaaatgcaatcgccacgctccagagttactcaaacactttacaagagcaaaaagatatcgtcctcgctgcagctacttatgaagagtgtactttcttcagacatacgatacctactgcgacaagcaacattggtaactacttttatgattttatgaaaactttacaagatggtttggtcgatgtaaaggtgaagtcatacaacggcgggactggtcctttctggtactgtgatcgctgcacgtatgcaaacacttgggaggataatgagtgtgagatgtgctatgatgatagtgcctctcttgtgggagagataagtgatttgtttcttaacaaagtttcttaaaaacacgagggaggcatgaaactttcaacttgtatattttacaattgttttgctctgcaatataataatcgagacgc

SEQ ID NO: 4969 - DNA, 930 bp, Artificial Sequence
  P26385 (35S::G1266(SULF))
ccacgcgtccggaaacagagtattttttctacatggatccatttttaattcagtccccattctccggcttctcaccggaatattctatcggatcttctccagattctttctcatcctcttcttctaacaattactctcttcccttcaacgagaacgactcagaggaaatgtttctctacggtctaatcgagcagtccacgcaacaaacctatattgactcggatagtcaagaccttccgatcaaatccgtaagctcaagaaagtcagagaagtcttacagaggcgtaagacgacggccatgggggaaattcgcggcggagataagagattcgactagaaacggtattagggtttggctcgggacgttcgaaagcgcggaagaggcggctttagcctacgatcaagctgctttctcgatgagagggtcctcggcgattctcaatttttcggcggagagagttcaagagtcgctttcggagattaaatatacctacgaggatggttgttctccggttgtggcgttgaagaggaaacactcgatgagacggagaatgaccaataagaagacgaaagatagtgactttgatcaccgctccgtgaagttagataatgtagttgtctttgaggatttgggagaacagttccttgaggagcttttggggtcttctgaaaatagtgggacttggtgaaagattaggatttgtattagggaccttaagtttgaagtggttgattaattttaaccctaatatgttttttgtttgcttaaatatttgattctattgagaaacatcgaaaacagtttgtatgtatttttgtgatacttgactttatcaatttcaagttagtgtaaaagtctttgtctcttactattcaactagtaagaaaactctcatttttcttatttatcgtaaaaaaaaaaaaaaaaaa

SEQ ID NO: 4970 - DNA, 507 bp, Artificial Sequence
  P26388 (35S::G47(SULF))
cttcttcttcacatcgatcatcatacaacaacaaaaaatggattacagagaatccaccggtgaaagtcagtcaaagtacaaaggaatccgtcgtcggaaatggggcaaatgggtatcagagattagagttccgggaactcgtgaccgtctctggttaggttcattctcaacagcagaaggtgccgccgtagcacacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttgatttatctcgacggtcatgatcacgtttgatcttgc

SEQ ID NO: 4971 - DNA, 140 bp, Artificial Sequence
  P26396 (PR2XW1BOX::M35S::G1795(-UTR))
cacacttaatttgaccgagtaacattcgcctctagtcacacttaatttgaccgagtaacattcgcctctagagcggcccgcaagacccttcctctatataaggaagttcatttcatttggagaggacacgctgcggccgc

SEQ ID NO: 4972 - DNA, 130 bp, Artificial Sequence
  P26398 (PR2XNBOX::M35S::G1795(-UTR))
ttctagccaccagatttgaccaaactctagtttctagccaccagatttgaccaaactctagagcggcccgcaagacccttcctctatataaggaagttcatttcatttggagaggacacgctgcggccgc

SEQ ID NO: 4973 - DNA, 128 bp, Artificial Sequence
  P26402 (PR2XJEREBOX::M35S::G1795(-UTR))
agaccgccaaagaggacccagaattctagtagaccgccaaagaggacccagaattctagagcggcccgcaagacccttcctctatataaggaagttcatttcatttggagaggacacgctgcggccgc

SEQ ID NO: 4974 - DNA, 127 bp, Artificial Sequence
  P26404 (PR2XSBOX::M35S::G1795(-UTR))
cagccaccaaagaggacccagaattctagtcagccaccaaagaggacccagaattctagagcggcccgcaagacccttcctctatataaggaagttcatttcatttggagaggacacgctgcggccc

SEQ ID NO: 4975 - DNA, 208 bp, Artificial Sequence
  P26406 (PR4XW2BOX::M35S::G1795(-UTR))
ttattcagccatcaaagttgaccaataattctagtttattcagccatcaaagttgaccaataattctagtttattcagccatcaaagttgaccaataattctagtttattcagccatcaaagttgaccaataattctagagcggcccgcaagacccttcctctatataaggaagttcatttcatttggagaggacacgctgcggccgc

SEQ ID NO: 4976 - DNA, 192 bp, Artificial Sequence
  P26407 (PR4XNBOX::M35S::G1795(-UTR))
ttctagccaccagatttgaccaaactctagtttctagccaccagatttgaccaaactctagtttctagccaccagatttgaccaaactctagtttctagccaccagatttgaccaaactctagagcggcccgcaagacccttcctctatataaggaagttcatttcatttggagaggacacgctgcggccgc

SEQ ID NO: 4977 - DNA, 188 bp, Artificial Sequence
  P26408 (PR4XWAMYBOX::M35S::G1795(-UTR))
ggattgacttgaccgtcatcggcttctagtggattgacttgaccgtcatcggcttctagtggattgacttgaccgtcatcggcttctagtggattgacttgaccgtcatcggcttctagagcggcccgcaagacccttcctctatataaggaagttcatttcatttggagaggacacgctgcggccgc

SEQ ID NO: 4978 - DNA, 216 bp, Artificial Sequence
  P26409 (PR4XDBOX::M35S::G1795(-UTR))
tacaattcaaacattgttcaaacaaggaacctctagttacaattcaaacattgttcaaacaaggaacctctagttacaattcaaacattgttcaaacaaggaacctctagttacaattcaaacattgttcaaacaaggaacctctagagcggcccgcaagacccttcctctatataaggaagttcatttcatttggagaggacacgctgcggccgc

SEQ ID NO: 4979 - DNA, 212 bp, Artificial Sequence
  P26410 (PR4XUBOX::M35S::G1795(-UTR))
agttgaaattcaataagttgaaattcaatatctagtagttgaaattcaataagttgaaattcaatatctagtagttgaaattcaataagttgaaattcaatatctagtagttgaaattcaataagttgaaattcaatatctagagcggcccgcaagacccttcctctatataaggaagttcatttcatttggagaggacacgctgcggccgc

SEQ ID NO: 4980 - DNA, 188 bp, Artificial Sequence
  P26411 (PR4XJEREBOX::M35S::G1795(-UTR))
agaccgccaaagaggacccagaattctagtagaccgccaaagaggacccagaattctagtagaccgccaaagaggacccagaattctagtagaccgccaaagaggacccacaattctagagcggcccgcaagacccttcctctatataaggaagttcatttcatttggagaggacacgctgcggccgc

SEQ ID NO: 4981 - DNA, 187 bp, Artificial Sequence
  P26412 (PR4XSBOX::M35S::G1795(-UTR))
cagccaccaaagaggacccagaattctagtcagccaccaaagaggacccagaattctagtcagccaccaaagaggacccagaattctagtcagccaccaaagaggacccagaattctagagcggcccgcaagacccttcctctatataaggaagttcatttcatttggagaggacacgctgcggccc

SEQ ID NO: 4982 - DNA, 652 bp, Artificial Sequence
  P26442 (PRAT2G43620::G1795(-UTR))
accagggttggtaagactaaaccgctttttattgatatgctggtttaattttgacgcatgactatttggaaattgcaataattgagttggatttttctaattttggttgattttgatttataaatagaaacattttggcttcactagtcatttttctcacaattccatacaatttttgttaaaaatcaaagtaagactttaaaagaacgttctaaatgctatattagttgaccaaaaaaaatgctatattagctaacaatatcgtttgagctaattaacaaaaacttggaactattcaatagaaaaatctcaaacgtttgaactaatctaaacttgattatctcaatcaagtttttatgagaatgattttcatccaagtaacttggctctttaaaattttgattacatattcgtttttgatctgatctatgaccgacatggaatttctcataacgacaagagaaaaaactgtgtcattgacttttgttaagtggtacaaagtggcattgactttgactcagaaaaagccaatcaataatcgtgaaagatgtctaacactgatcaatatttcaatttgaatagaccaaatttacactataaatacatcaacacaccttcttcatttcttcacacaacaccctccatacacaaa

SEQ ID NO: 4983 - DNA, 1200 bp, Artificial Sequence
  P26443 (PRAT3G02840::G1795(-UTR))
ctacgatgattgaaccaactggcttatgttttacctatctgcgttaaatttcgtggtaaactgaaccgggatgtaatgaatccggttttggtttgattttttttaaatgaaaataactttctgtggatcttttaatcgaaaataatattgaacgttacataattgggtgaaaattcgtatttatcagatatttggttttgatcgaatcttcgtgtggtttatcttagatactcgaacttttaaagcagtgtatgaatctacgcgtaaaatatttaatgtattgaagtaatattggaaaaacaatgacgcggggaaaagtaaacaaacacggacccgacgacggataagcgaccaagcccgagtcgcatcgtcttggtcttaagtctttccctactcgttttatcattttcttaaactaaaaactaatttaatcactcttaattatttacttttttcttttaattcaactatgactaattcttattcacagaatgagtctcacatgcctactcgtcgtactcgactccagtccaaatgttcccatacttgtaatctatactacatatattatacgtcatcgtcatgtatatacaagactcaatatataacgtccaaattaatcaaagatttaacatgatcgggaaccaatatctaatcatcgattagatatatttaagtctagtaactaattagtatattttctacaaattgtttaattaaacatatagtatacagttggtaaaggggaaacacgcgtaatctatatgtatatattaataatatatagttcttggtatgatcttcttagttatttatttactaagctttctagactttaacaatatttgaatgaaaaaaaaatttaattaaccgtcgaaaaaaaagtcataaatctggacgcagaatactaatccacagatttcaacggtcaacattccaattcagttcacaaacctaaatcaaacgttccatttcataccttttttctctttcaagcttatacaacctttgaccatgtctcactttattaataagtacaaaaccaccttacattacatgcatatatataaataaaacacgttaaggaacatatatttatacaaatcccataaaccccatttcattcttcatcgaatagtcgaaaaatatttgaactttcttaggaaaccaaaccaacaaaacaaaaaggaaaacgagata

SEQ ID NO: 4984 - DNA, 1174 bp, Artificial Sequence
  P26445 (PRAT3G18250::G1795(-UTR))
atctgaaacatactatacccaaaaatcgatgctcacacctagctagttcaaactgcgtacgtcaaaatatgtggtatggacgtaaagtattttataagttttgttagaaagttagatacttataaaataaaaaaattgatatttttttggtaaaaaatggaagtttggtattttttggcagttgtatacataaataaaaatatatattacggagttatatattcttgtttggtcaaatgtttcggaagcttttagattacgaaattacataatccatgatgaattaaatttggttagtggtagaagaataagacgccaaaagaaaaaagggaagaacattgggttacgtcgaaagtcctttgataagaatttgattttgcatagtcaaatttggaccaacaacaaaaatggagtccacgtgaaatagaagagagagacttaatagcttctcatgcataaagttatgaacaatcaatgataaccaatgataaataactaaacagtacaaaatctctgtatttttattggatttaacaaaggccatgaacaatcacttcaatatttataatttttttaaaaagacgaggcaattcaagctgatttatacattatgattaatgataattatattatggcatttgacttttctcacgctaatgtaaatggtcaaaaatccttatcttcaactaaacttcctcgacaaaaccttaactagaactatgtatgtaatttatcaaatattgaactttaaatttctttaaaagcataatataatcttgacctataaaattagcctagcctttcgaattacaagttttatatttttaaagaaacataatcttcaactagaaattattataaaccgggtcctatcttcatctaatatacgtgattccatcaaaattccgcagtcaaatgtgtttagttgagaggaggagaatagtagactaaaatggatgactttctggtaagtcttgtattgcagtcttttctatattttaacaaataagtcttcttttcttaaaaagaaaaatttaattacaaagaaatcttactactgaacgaataatttatcaaaagtcagtggccttacgtacgaatttatcggctataagtaggaaagcttttcacgttaaacaacttaatctcatccacattaactagagaaagagag

SEQ ID NO: 4985 - DNA, 1268 bp, Artificial Sequence
  P26446 (PRAT3G26830::G1795(-UTR))
ttatatgcaaagtacatgtcaaaacgttatcttatttacatccatttactaatcaaatatctattttaccacaaaaggtgtgttttataccctatcatgttttactcttgagatatgttctttgacaccacccacaaaatatctctacgaaatacgaagccactatatgtctctttaatttcactttttatagtttttttcaccgctaaaattgttgactaaaaaatatattgcataaaaataattgataatatatttataagaaaaactatgataagaaaaaatataatcggttgaaatgagtcatgactaacaataattaaaggttaggaaattaaaagaaaataaattctgaaataactaaaaaaaaaaaaatagaagatgatgatatatggatccctatactaatattttggaagtacattgaaaaactaactttcaaagacccaattaattaagctcattaaggataaacatgttaaatactaacttatggacattaattaaattaaaaattataaaacgaaaataaattgatgacaaaaaaaaaactatgaattttcttattaggatttgtaatctactttcttgaaaaaaattgaagtttactgacggcttcctttttttggaaactccaaaataacaaaacatatgaagaagttttggaatagcctttgactcaacaactttaacaatagaaagaaaacatgtttaattaatgttcatgcacttcgtctcggctgccccttgtggcctgtggggttgccgggttggcttagcttgagacgacccaatactgaatttgttagctcggtcagtgaagtctacatgcatgatacaaaaagattgactagtgtttaagtttttttttttttttttttttttttttcataaatggtagtgtctcatattagaaatggtagtttgaaaagtattcagtttgtttgttcactttggattatttgattttggttttgttaattgaatcagttttgtttgaaaagtattcacttttgaaaagtgttcactttaaaaagttttgtttgaaaagtgttcactttgaaaagtattctttgagaagtgctcagttttggtttgtccacttacgattattattcacaagctacagcggatagtagtgactagtgacttatgactttgaataaagaatttccctctaaaggaatgaatacattataaatagattattaacctaagcttgatagagaagacagaacaaaaaaaaacacaagaacagggcaaggaaa

SEQ ID NO: 4986 - DNA, 1178 bp, Artificial Sequence
  P26447 (PRAT1G02360::G1795(-UTR))
atgtaaacactagtcactaatcgacagaatatgaataaatccacagtaataagaaattacaatgaatgtcagttttttagaaggattacaaatatttctgtttgaatgtcttttgtaacattatcttcttcgaaagatgagatttgtttcatagagattgtgatttttttttttttggtaaaaggttaaattttatactaattttctgattttttctgtacattgttgatacaacttattaaaaagaagaatttaaaaagtttcatagagattgtgattttttaaaaaagtttaatcatgtatttggaatggacctaaaacacataaaaacggaagacttagttgatatgatagtaaggaaccgaaatttagtttttatttttggatgagaaatcagaaaaagaaacgagtttattgtcaaaaaacatttttgtcaacttttgcacaacttaaagtgttgtaatttgtttcggctctgaaataggaacatataataaaatgtatatacaactttaccaattagttagccgccgaacgagaattttttgtgtagattccaccacattaataaaaaatacgaatgagtcttccatcaagataaaataatgagattttccatagcaagaatgagtcttcaagcattaaaaattgaaatcagtctttttcggtaatactgctacgtcgaccgaataagaatatcgtcatccactatcattttaatcgtaatacacactatctatatcattcaatgattatattgataagttgtttttattttgtatgatctcggtttcatattaagtaatgtcagctaaaaaaaatgtcattttagtgaaaagccgttatttgtttttttctctacaataaaaaataattgcttttgttgtttttttccccttcacgtattcgctttttgttgttgtcttgatatctaatctaattaaggtgtaaactatatgaaaaattataccaaaaactatagaaaaagtttcacttaacgtgaaagaagcatcgtttgatgaatgaaaacacatgagagcatgtataaacgaaccttcagaccaatgaaaaaaaagtccaccgttaaagtcaaaagtcaacgcgttgatcatttacacatctatataacaaactcatcttcttacaccaaaaccatcaagatcgatccctctctaaaa

SEQ ID NO: 4987 - DNA, 704 bp, Artificial Sequence
  P26448 (PRAT1G16420::G1795(-UTR))
atattgactattggaccttacatattccgattgtgtttgctatttactacggactaccgttttgtttttgtctcactttgataattggtgaatttttcatttttggatcagctaagtgcgacccaaacagaaattcaaaagtcaagagcataattttagtttcctaaaataggaattaatttatggatcttagattcacaaccgcatgtggaataattagtaaagaaaatgccagcctttttattattttttctttgtcaacaagctaatgccaactcttttaaaatgaatgaaacctactcatataattcctttttggccacccgtagactattccagacgattaacttaatgacactcatgtttttttccttaataatagaccatagtccattaacactttctttttattaagagtaacatgagagttatattaacatttgataataaaaacgacaatggaaatagccgccactcaaaaaagaaagaccaaggaaaaaattaaaaatgagacgtaaaaggccaataacagcaaaccacacaaagtttctcttaggagaagaggcaaaataacagtcaagcatgttggtccgtcttcagacctttcgtggtagtttaaatgctaagtctttcgtttataaataaagtgaaaaataaatgcaattcataaagaaaaaacaaaggtataattcattcattcgtca

SEQ ID NO: 4988 - DNA, 1199 bp, Artificial Sequence
  P26449 (PRAT3G63380::G1795(-UTR))
ttaatttgttgcatgctgagagctttgttattactagttaccgttatgagtgagcttaattagttgtaatcttcccttctacttattcctgaaccattgtttagtttcataagatgatggttagtctatttattctcgagcaagccattgtatttgttggttgggattttgttaagcttgctactgcttttggtgcaaacactcttgtttctttcttatccacatacagtaactcgtgatctaatgtatgtcactgagcatctctgtgtatgtatgtatatgatttgaggagtttctcgacattcacttcatcgcttgtatcggaattttatgccaaatctggtctcacctcacgtctagttttagtggaggtcaacttattttgtttgtttataaaaataaagtcaactgcttttatgtcttgctgtcgtcacatgaacaaagaaagagatgacagcgaaaatggaaagtgctatgaagtttcggtgatcaaactcataatgccttcgtcgtacacgctgctccattttattatttctaaacatagatttgtggaaaagtagacggattttgagtttgagtagtataaatttcacttgatagatattataccaaaccaagttggtgtggaagattcaatctaaatcctttttttcttctttcgctttactatattcgccatttcttttcatttgtccgtgcggactaagcaagttggtacacgcacgctattcctcctcattctacaatgacggcttgtccacaccattacatcatacggctgctttagaaattactaccaaaatctcagattaactctctcttttagggcacagtggttccaaaccgaaacacgagacaacagataagtcaaaacacaagtacaaaaggatgtgcggcccatgtcctttgatcgacatgacttcgtgtttacaacgtttctgagtggttccaccgcctgaaaatattaaactaggacaagttactttacacgagatatttaatattttaaagcagataaatagcaatcaaaaggcggccaatacggatttaaatagtaccacgaagcttagggtattagagagagagaaatcattctttgcgagtcttaagtgtcttacaagtaacaccacatttagttgagagagagcgagactcttttccttctaaaaactctctttctttcacacaaataaagc

SEQ ID NO: 4989 - DNA, 874 bp, Artificial Sequence
  P26450 (PRAT4G01010::G1795(-UTR))
aaacaagatttcatgagtcagacaagacaaaagccataaacaacacaaaagtcctgcaagattgctcacttgggcggttgggcctatatgaaaatttactatctcaaaatttaactaagagcccataaaaactgtaagatctttgctttaaatcacattgtcttcatagactttgtgattcatggtagatttgtgaagatctttggtcatctttttgtttacatttggcttattgagtgtagagtgtgaacaatctgctatgaagttggtaaaattctttggatccaaacctttaaatcgtagcatatttactatttcacactgctaggatctgtttatagctgatgcattactggaatctatgatgtttactgtgttggtctgatatataacaagttctgaattttaaaatcaaattcaatatcgaattgggcttttaattaaggttaggcccatcaaatgtttttgactctttaataattccctctcttttgtcttttattgtaaaatgcacacaatttcgaagaaactgccaatggagtctccattttccagcgccatgccaagcttgactctacgatgatagcttatttgactgcttcaaaaaaaaacttcagagaattaatttcgagaattttcccaatttcagatcatcggaaaattcttactataatctttcttatatcgcttctctcagttacttcaacgttctggtcagtttcggatataaatgttttaatttcttagtttccgtttcttcttcttcttcttttttttttttttctgttactgtaaacttggggataacgaattaaagcgatcaaatcgatgttcttatgattcaggatccgttatagcaaaaaaagcttgactc

SEQ ID NO: 4990 - DNA, 1208 bp, Artificial Sequence
  P26452 (PRAT4G18250::G1795(-UTR))
tcaatacaaacacaaaggacaatttggccgagtggtctaaggcgccagatttaggctctggtccgaaagggcgtgggttcaaatcccacagttgtcatttagatttattttttccagactttttataagatttagagactaaaaaactttttaaaataagtataacatagattgttgcctaaacgaatattgttacgtaactgtaaggtttaactttgattttggtccacaacagaagagcttaagccttttacccatgtttgatcagttttggatgctaagatatagagagtgtgcatagtcttcactcttcactcttcaaattgataatgttatgtttcagtagaacgatcaacgcaaatagtgaaagcctaatgagtggccaatcatcaaaattagagcgaataaaaaggaacaaaaaaaaagaagacaatgagtttaatactttttagcctcaacaagtttcaatcttattttttttgtaagtatctagctagttctataaaatttatttaacttagtgattagataaaagggaacaaaaaaaaaaatgactttggtgtttgctagcctctacctcaagtcctcaacccatcattttatttgtgaattaggtagataaaaatttaaaaacggacacctaaaaaatctaaattctaaatctgaaattttaaactcttttaatttttttctagtaaaatgttacgaaagtaaatcgtttgtcccataactgttaataaatggtaaaatcattcgataaaacagtcgttttttttctcttttttcatgaaaaaacttattcccattgccactaaatggaattatttagaaaaaaataaaatacctcttctttcttggcaagttcccggaaaaaaatatggattgggaaaaggatagtattgtagttacatttatttcctctatctgtttccttccttctatttattcttgattgactctcatcaccaacgaatatgtactagtaatttctactaacaagcgaggaagaagcaagagaaattataacgcgaaattcacttctttggaacgtatatttttttttctttcagcagccaatggcgaaaaggctgccattgattttcctccttacttcacattttttagtatcgggtaggattttcttttcttgattgataataacaatggttttttgttaattgtttcttatttctaagcttagcggccgc

SEQ ID NO: 4991 - DNA, 1194 bp, Artificial Sequence
  P26453 (PRAT4G21390::G1795(-UTR))
tgagtatcaatatatgctttagtgccacttgctagtgcaatccacttgaggtttggctgcatcgatattagatataaatacttaagcgtcatgcaaaaaaaagattactaaataattgtagggttattatgggattttaggcgagcaaacaacatttaaactttgaaggaatacaatttgaaatatcaagatacgtaaaatatgtcacgtgcaataaaataaagagaagacccatccaaatcaagtgtgcgatactttgaccatatgagtcaatgtggcggccaaaggcaacaagcatatctaatctaagtattatataactaagcaaatattccactaaactagtatacaaagccaactgctccactaattgcctgacatacttatttattttcaaatttggtaaccacacctatagcttatacattttcttcgatggccttatacaataggaatatactattaccttctcattgttcttattatcatcaaccatttgataaatcctcatcactcttaaacattgactatgaactaaggacgtcagaagtagtccatacaagatatgaatggttggatcgtcctaagtcattgtattaatatacgtttctaatcaatggaaactatataattgtaatataatttttactaaatcatgtaacttgaaaacctaactttctttcttaataaaaattgaaccgctaaagtatctaatccatcatgtgtcaactgacaccgtccaaaatcctcttagagatgtaagaaaaagtttcaaaacaattaggtcagccaccaatcacatatttctatgcaggttgtataatcttgaaaaagaacaaaaaaagtagatgacaaaaaagaattaaaagacaataataataataccttataaagatgataataattcaaacagtttgacctttttatttcaattctctggtccaactttccaacctgacgagacaaaaatatagaaacttctcaacagcaataaaacagcaacctttcctttttgtatcccttctcctttgtcacctctcctcttacttttttatcaataggaagtttccgccattgtgacagacacagttcctctgtttctcttctttcatctttaagcaaacctcaaaaaccaatcctttattacgaagatcctcacttgtgtcttcttctccaacactaaaccccaagaaa

SEQ ID NO: 4992 - DNA, 1193 bp, Artificial Sequence
  P26454 (PRAT4G35110::G1795(-UTR))
tctcactcgtatttgtataaccgtcccacgttgttgtccacttctggaagataagtgaggtgtgtgattgattgccgtttccaacctcttttcaattaaatgcttctctctatcttcaattggtaatattggctttggtcaattcatcatcatcatcatattattattataccaaagacaatgtcacatgaaccttataatatacacaactgttataccttataaacaaaaataaaaatcaacattttattcatttttctccgctcatcacatttctctccctcttccgattctcctggtatatctctctctctctttctctttatttctctgtttgttgattgattgcatttttgtgtgaattaaaagtttggttctttgatccacaaatagattcttgatctcgatcagaatcgtgggtttgcttttgttttaagaattaattcaatgatcgatgatgaaactgattgatactgttttattgtcatatgctctgtttctttgctctgttctaaggaaattttgtgacaaacgacaatcatggaaaacgaaatttcaacctattaaaaaaatattatccacaagggtgggccttggaagtttttgtctgttcaagaaaacaagccggtcaaaataatctaccttttaactctggtctaagtcaataactgagtgcttccaccgttgaaatttagtatctcactggaaaattgtacttggaaattgcatggtcggtccatgaaagtattaaggagaagaaacaaaccaaaagtcgtctttttgtatctctctatacctatacattttatgatttgattggttttgtggggatcaatttcactattactcgtaagaaatttctttatggatatgttttggtgaatctctctctgcttctcacaatctccctctttactttttttctttcatcatataaagggttggtgaaatatgaatggaatccaatttcgttgggaggttgttgtatattataagtttttagtgtctaatctttttgaactatttgttgaaattaaggtgtaaaggtttgaccacttacttacccttaatgtgatatgttcagtcctttgacaccacaaatttgaagttcttgtgttgttctttgagtttgtcttctttgagctgattagttatcttgattttgttgcagttgttccattcatcaaaaagct

SEQ ID NO: 4993 - DNA, 1199 bp, Artificial Sequence
  P26456 (PRAT5G12930::G1795(-UTR))
gattattcaaaagacaactcatgtgcccgcgcatgtgcttgacgttcgtttgccgtgtattagaactttaaaaactgattcatataaatcatcggtcgattgaaatatattaacatggattatgatgacaacaatcattatacaattaagttttatgaaatgatcatccacaaaacataacttttgtcggctatttttttgttgacgtgacaaactaaattagtaaactgtgttttgagtgcaaaaagatgagaaatttgtgggattgattgcatagaataacacttacaaaaatgtaggtagtatgcaggggagtcaacaacagacgacttttcataattcagaaaacgaagaaaaacaaaaagaaaggtcgatttcccaaggactagggcatagcacgtgtctatatcactggaggatatatcacttagaccgttagacgtcacgtgtaatcgtgtattaatgcttgcaaaatgtggttcaatcaaatacccaattaagggttatgagaactaatacaaaaatgtggttcccgtaaataatgcatgagcaagcacatgactgacatgagagatagaccagcgaataaaggttaagtattgacgcaccatgcaaagcgtaacggtgaactggagctctactggctgagataattcacaaggtgaaggtgagatatattttaggagagccagaaaggtagaacccaagacaaataaagagagagaccaagtgagttttggactaatgtttttcaaagaatgtgtctataactatttattaagttccaaaaaaagacaaataaaagtatgatttttctatataggactactcgattaatcttaacaaaaagacgaataagcagaaaacatatatgtttgttttttcaaaacaataaccttggaaatcaaaacaccagaaaaatgtggctgtgaagaaaagtacaagagagacagtaaaaagaaaatgaaccaaaaaggcaaaaaaatgaatacgtggcttcaatgtagacccagacgatgaacgtcgcatcaccttccttacgggggaaatctcacattttgaaattacagaaaactccaaagaacccaaaattgaatattgaatattgaaaattgaaaaaatctctctttgaagaattgaaatctctctttgaagacgaacgaacctcgttgattcctccattcctcttcggctcgtcc

SEQ ID NO: 4994 - DNA, 1198 bp, Artificial Sequence
  P26457 (PRAT5G18470::G1795(-UTR))
tcagaaatctttgatcccactgacaacgtgaaaacatttttactgtattggttggctaaatgagttttagttattacaccaagagatttgagttcaaacttcaaaatatactatttttgtttgagtttgttgttcaagtattacatagctgattacagaaaccaaagaaatataagatccaatgtacttggacttcttttctttttttgtcgtcaatttcattaaatccttaaaaggattacatggtgaaaggaaaacccacatatacacaaagttaaagcccaattaacccaaatattgattacgatgaaagaacaaaatgggctaaaaagagacacgtgtgtacacgtggaggcatggatgaaatataagatccaatgtacttggacttctaaaataacaaataatgtaacactagattttagaaaacaaaaaccatccaactcgatcattcatcaatattatatagagaaaacagtcataatgttagagagagacgtatgaatcgaaattcatattactgtatttcgattacctaaaaagtttcgaaaaagaattaaaagtttgtgtggaagattccaatacacgttgctatcggaagaagacttggaaaattattcctcaagtcgttaatgcttggaattagtgactaacaatcatcattattccattgaaagagccgcccacgacgcgtttccattttccacaccagtcaaagttgatgtctcaaattagtaactgatttacaattttaaattacaaaatacaaagcccgtacaagctaatgtaaacggaagtaaaaccaaatacattaacaacttttagtttagctgttcaaaggacagagatatgacctcaaccttaacccaatctttcgtctgtgtttgaaacttctgctcgtaaagagactctagtaaaacccttcggaagaaattttttaggtagtcgccatcatataatttaaagcttatgagacttgttatgttacaagcagagaccaaagactattcataatcacttatcagagtataaaatactctttttttgtcaatcgagtataaaatactctgatatcacttatacaaagttctacgaaactcattaaagatttgagagtgtacaagggacaaaaggtgctataaatatctcttaaaagagagctaaaagttaaggaaacacttaaccaagcaaacaacaa

SEQ ID NO: 4995 - DNA, 998 bp, Artificial Sequence
  P26458 (PRAT5G22530::G1795(-UTR))
atttcttacaaacctctaaacctttatgatgtttctagaggaccgggaaatatattgcatgcacccgtaaactacctttcaattttctacataagtcacttcaacacaacatttgatggccaaaatgtaaactgtgattagcttactccttaaagagtgaacaaaagttgcagaagtgactctatttgaaccttactctttatctgataatagagagacattaccaaagtataaaagagtttagtaatcctaacgtgtctttgctaggagttacaaaaaaaggagtcacctttgatggcttggataattaaagacttttagtagtcctttttggactaatgaaagactaaagaaacgacttttgacccaaaaaaaaaaaaaaaaaaagacttaagaaacgactcttggactacggcctaaaaatttagtacttttagtctccaccaactctttcttattatataaataattttgcctacacaattttagacaaaacttcctaaaggtataacataattgcctagaagatgacataatttttacacattttttgttgaatctgcataatgcgacacagtttaagaagaccgttaaagataacataacttcctaaacttatgcagtctacaagatgacataatttgcacattttgaaagcaaaaattggatttatggcattttagacaaaacttcctaaaggtaaaagttttacaaagtgagttgcgtggacttagtatacttttttagtttttttttttgccctctctttttggtaatttcctgcaagtgagtggtggaagaaaggaagctgcgtggagtcccaaaaattaaaattgcagaaaaacaggtcttataataatcagcttaatagctcaggtctctttttctcattctgaagattaaacatcttcaaggaacctaatctttgtctctggttttaccttcgacaaacaagcacacatattgtttgttaaaaaatcatctatcccccaagaaaa

SEQ ID NO: 4996 - DNA, 1201 bp, Artificial Sequence
  P26459 (PRAT5G24110::G1795(-UTR))
taacagacatcaccgaaaaagtcgccgaaaaaattgaccggaaccacatatgtaaaaatgagttccaacaagaggcagtacaaaagaataggcataaccgtaccgcataagtgttcaagcccaaggcaaagccatatctaaaaatattttcatacaaaaaggtgtatacctaaaattttcttttgaagtaagaacaaaaaaaaagttaaaatttattttcatatgttctcgaaaagtatatttattctaatatgaaatggcaaataattttgccccgctggaatttctatatagtttgcgtttattagagtttgcgtttgtatttagcattattattatttgcattgtcgttagcttttacatctgcatttagtgttatgtttctagcttttgctttggcatttctattttttttttgttagagtttgattttgaatctattttaagatttatatatgacgaatttatttattatatatattatgaaatttcatatgttatactatatttttctaatgtatattgtttagtctcataaactttttaaacgcctagattgtctaaacgtcgattatgggttatatattgattattgacactaggtgatcaattgtcactccttattgtctacagttatcttaaacacttttatagaaactctagaaatgctatcttgtattgaatttggttccataaatggatcgataattaaacttgatccaaaacaaaatgaatattccaacataatgaccatatttgtctcttggaatttctaaactcaatattagaattttatagcaaaattaaaatttacaatagaaaatcatatcctaataagaatgaatagttattaacaaattaatattacgaatgtaagttaaatgattgagaccctaatattaaaacaaaaccagatcatgtaattcaaaatccaataaatcaaaaataaaaaggatcgagaagcagagaactggtcagcatgttggactttccaaattcattgaccaaagactggtctcacttctcacaaaccacatcagctttcttcgttcttcagtcaaaaagtcaaactatctctctcacacatcctctttaaattctcctctttctcagtttccagaagccatgcaaaaataaacatagtaacaatactttaaactatttacaccactttaatcttattctccactctttgaacgta

SEQ ID NO: 4997 - DNA, 939 bp, Artificial Sequence
  P26460 (PRAT1G24140::G1795(-UTR))
tgtaattaaaatctgtaactaaaatgaattagtcagtcaaaaatatcataactacgaaataaatgtacactaaacactatcaaacgtcccttagtttagattttggttaataaagctatgcgtttacaggcttctaagttttaataatgttggtgcaaacgtggttgaactaattctgaaaacaatttttagcctaaatggatctaacatgaaaatctacatttttctgtttatatgtatcctaattctgtttagaaagggcttcaaacttttggcccaaaactttatatgcatgtatgatatatcaattaattttaccgatggagacttgcatgttatacccattacaggaaaaaattagatagcctaacaaacaagtcatggcgttactcgtgtaaggtggagattttacgttgattttttcaaccaataacaacaacctccggaaaaattatcacaaaaagaaaaaagaccaattcaaacattcaacgacccaaaaaaaacaaaaacactttcaaccaatttagttgattctgccgccttcaaccatttttgttgcatggttctttttccaactttgcatttaaccggtcctttaccaccggtcaatcacaatttctagtcatccaagactaaatcgggcctaatctattgcaccaagccaccaatcaactttaattatccataaaacgacactatctattggcagaagcttcattagtctttttcttcgtgagaccctttgaaacgaggacggaggaagtttcctttgaataatgcagcattttcaacatagaaaattctccaaacgcaacgcagaaatgacctctgctttctccaacgtcaaacttgtttagttttatctatgtcatctctctaattctcttgtaaatctcaataatacctcttcacttaatctttttaatatttctcttttgg

SEQ ID NO: 4998 - DNA, 1008 bp, Artificial Sequence
  P26461 (PRAT5G48540::G1795(-UTR))
ctctttaaattttatttctaatggcatacctatgtaattacttacaaaaaataagattatatttaaaatgtacttcccaaataatatagcaggaagttttcatttttaattatatatgtgccttttcatttaacaaattttccaacatgaaaagaagatatgttggtaaatggtaatctacaaacccaaataaaaaagaatataaaaaaaattttagttaaagataaatataaattctttatcaatactatttccataccaacttgtaaatcttcaaattattttgattagtatctatctacaccaagtaccggaacaagtttttgtgcaatacggaatcttcacctcaaaccaagcctaacataggcattcatcaaggctgaaattgtgcacaataacacgtacaaaaaatcatcgtaaaataaatacgaacatctctcgaaacagagaagtggtcaatggtggttatattttttctttttttgtggtggtgatattatgtaatatgattagtcattgaagaccttttgtagagagaagtggtcgatgttgcgccactttagcgttaacgttgacgtttggaaataagaagcaataaataaatcgacggtcaataattcctgctccatatatgttgacctacacgtgatgccattttggaatcttccaacgaaaattatttagttttaattcaattcaatatattatccattttgtctttctacaatacacaaatgaaaaaaacaaagtaaaattgaccaactaatatttatttactgatttgattggtcacaaactcacaagattttggccacaatatagacttctcggtcaacaaaaatttgtatttgatcataaataaataaacaattatttcccacttgttgttatgcgttttgaccgacttctaaaaaaatcaacgttctagaatagataacgttttggtataaaatcagtctcttcttctagtgactcaaaacaaactgtaaagtttattaagaaataata

SEQ ID NO: 4999 - DNA, 706 bp, Artificial Sequence
  P26462 (PRAT1G26420::G1795(-UTR))
atattcgtttttataagaaatgaaatgaatacagataatatattagtaggtgctacaatctccaaagtttgcaaaaatttgagtttcttctattcggtaagaaactctaatatcaaaaaatctaaatcgctagaaggagggatcgaacctccgaccttgtggttaacagccacacgctctaaccaactgagctattccagcttttgttaatatgtgttagttaacttttatatatcttaccataacaaaaaaaaaattcaacaaagattaatcgtgcaccgggggtcggggggatatttttaagataacattcaacaaagattaatcgtattcaactttattaaattctctatctgtattcaacttttttccactattgaaatttgcaatatatatactagatagaaactacaataatataatcccaaaacatgcatgtcaaatagcgaagtaattccatagtcaatccctgatcccagtcatgactcatgacaacgacttctctgtaatagcgttggaaatcatttccactagcttgttcaaaccaaacatctacatgttgactaaagaaatttcaaaataaacctgcaaaaaccaaattcaaagtaaacctatatgacaaaacagaagtcaattatatattaatttctctctattctataaactaaaatcctaatagagacgtaagacaaaattaaataaaaat

SEQ ID NO: 5000 - DNA, 1062 bp, Artificial Sequence
  P26463 (PRAT1G26380::G1795(-UTR))
aatctgaaatttaaattattatcataaagctacttctttattttagttacttgtagtcttaaaatacttagggacggtttatattaagtcacataaaaatcatgaatcattctattatatactaaaagtataaaccagaatttatcagtagtatcatagttcatcaagaatatcacatttcatatcaaactttcagtatatatacgaatgtctgataaataagttagaaaaaaaaactaaaataattgtgaagcataacaattcacaaatcaaaattaacttgaaaaacatctaattaaaacaaaacaaaaaaaaaagatagttacatgcgtaaataggtttaagtctacataaattaatataacagtagacgcagacacaatttaatggtggtctgatttaacgatgacggataggatcgacatttctactataagaaaagtcaatcgcacttttaaattaaaagataagttatgtatcaaaatttctcggccatcttaaaataatgggaaaataataatatagtcattagtattttacaacaacgtagccttataaaatttgaattcaacgaggggggacaaagaaaacaaaggattcaaagagaagagagaggaaaattcagtgcattctacaaatacatttggcataaaattcaacaatacttaatcgcaattatttcaattagtagatagctaggtttggtcaaaatatgaatgaagtcttaccttaggtttccatttataaaatctcgtggtcacttaaaaaatctctgtattcaactacctaaaatgatcatttgaaataaagaagttcagttgatgcgactcaccccctgatctaaattatgaaagtcatttcccctgtactatacgtattacgtacgttgtaatttcataactttgttcaaaataaacagctacttgacgaaaagtcaaaccaaattcaaaagtacaccgatatggaaaaaatggtcaagattgtcaagttgaaattattgtctccatatatattggtattctataaattacaaagtagaggcataatgaaccaaacagcaaa

SEQ ID NO: 5001 - DNA, 1185 bp, Artificial Sequence
  P26465 (PRAT1G28190::G1795(-UTR))
ttcaaaaccaaaataaagtaatgaagaagcgagtcaaagtaaggcaacataattacgtacactatttgatgagtcaaacctacatctttctatgaccaaatttgagaggtggctacttctcttaggctttgcaacttgaaaaatatgttccgcatctaatctaataataggatgttgtcatgttcatatgtttcgttgaaaaatattaattctaattaaaactcgtgttaacatcaggattggatttttatgttcatagtgataattaaatatctccaagattagtgtaacaacaacaaaaaaaagaataatacttatatcataatctcaggatgatcatgattgctcaactaagtagggattgggtcaatcactggttaaaagagaagaaaaaggtgtaatgattattctagagttttcattaaagttgaaataccttaaaaccaagattgaaatgtctaaaaagaacactcgatacttccttttaattccaccggtctaagtcttctttcattttatatatttgtataacctaatgccgtcacgcacgttaaacatagtcaaattctttattcatatattattattttaatcgcttcttaatcacagttaacatacttggaccaaacctagtccatatatccaacttttaaagcatggatgtccgataacatagttgaaacatatacatataaggtgtgcataaaaatataaataatatgtatgcatgaaaaaaaagaaaaatacaaaacattactaaacgaatggaataaaaaaaatctgtatattaatagatgagtatacttattagtaaaaatttattttaaagtaaattgaaattagccaaaaagataaagtgaaaaagatgtaaaaaattgaatttttcttgaaagccaaaaattatttgtttgggcccctatttgtttaccaaataaaatgaaatgaaggagaactcatatatttgaatatgaaaattgaaaacaaacacatttttaaagggagataaattcttttgtatgtaaaatactctcagtgtatatatatacaaaccaaaacttcatttcatttgttcacactgaaactccaaaactctatctctctctctcctccacacaccaatttcttcatgaccttcttcttctagcagagaagattaaagaaacccccaaatccagcttatactaa

SEQ ID NO: 5002 - DNA, 1200 bp, Artificial Sequence
  P26466 (PRAT1G30700::G1795(-UTR))
caatatgaaagtcaaaccagccgctcaaatgtatccttcatgagttcatgttatatttcagtcaatacttttcatatttaaacacttattataattacgtaatatttttttgcccaaaaaaaaaaattacgtaatattcaacatctctaccttgtagagttccaaaacattgtcacaaaatatctataaagaatttattttaactaattaggtcgttaattgtccaagggtttttcatagttgatatagttctgttcaaatatagccatccttaatcgattcatgggatcgtaaattactacttcgagtgttgtaaaaaaaaatgaaacttctacattacaaactcgaatttaatgcatctggagtgatactataaaagtagggatgctctcaggtcgcatttgagagacacagaaatgattttaatggaattaatatattttcagtttttcacaaaaaaaaattgtgtttataacaactgcagattcaatgctgattttatgagtctcacctatagaatttatatttctatattcatagaggcagtataggtgttgacccaacatcgaaagaacacttcgtaaaaaattctttggaacaaggctgaaaatttactcccaaatttagctatccgatgaagataaatcatttaccgtttattaaagaattatcgagattttagtccaaaccaaaagagattatgagcctaagattttgaatttgtattggtaaaagaaattgaacgaaaatttcagaaaaaaatattaataaattgaacgatagagttcacttactacatagtcaactagtgcctagctataatagtttcaaaagacaaaaagaaacaaaatcggttaactacttccgtgacataattctcattttgatttttgaatccagtctaatttgaaaagtatattcaaaatctttaaatccattaatgataacttttataatacgttgacacacgcaattgtatatacaatattcttgaattttaaatgtaaattctagaatatattgcgatcaccacactaatcaaaatctttgggacaacttgaacccacatttgacttttcttggtcaaatattttggcatcatgcatgatcttctctataaaaaccaaaaggcctcaacgacattcataaactcagtcattatatttatttttgttgtatttcaacgttcaatctctgaaa

SEQ ID NO: 5003 - DNA, 1199 bp, Artificial Sequence
  P26467 (PRAT1G35230::G1795(-UTR))
cttctaagaatagttgcaagcctttaaatactccgacaaatctggcattagccgaaagatattccaaactcaaaatcggatcagatagtgtggtggtctaattttacctggatcgggagatgtccactctgtaccaccttgatgcatttttactgatactgatcagatcaaccgatataatatatatataaaaaaagaaagttcgtccaaaaggaatcattattttcttaaccaatagaatataggaaataataggataaatctatattagtggacaggtaatagaatgctttcattcacattgaaatcatattgtaataagcacacttttcttatcaaaaaaaaaaggcaaaaagaaatggccacgcaataaaatcattagggtaagttgaattttggtccataatattataaattaatttaatctcgaaagcttaatcttatgatctcatgtgatctttattgaatttacttacttccatagagttttgtattttgtctaaggaaagaaaaaaaaagtctgccagctttggaacgccgcccattcctctagactttcttggaaacaacgcgttgttcttgttggggtcgacgaagactcactaaatccatccgacgactcagattttatcttggcttcttttgatgtgtacacatatccaccctgatttgattcccaaagccaaaagcctgaacaatgtagtgtagaagaagtgacgggaaaaaacggtaatgaatccacaatggatatttacagaaagaaataaaattatatagattatagagaagcaaaattatgcaaataatctttatttaatactattaaaagagtagctgttggaaactataacaggtaatttaaaatattttacaagttcaacatataataattttgaaattcagtccaacataactatcagtatggaaataagccaaacaaattactcaaaataagaaatatgttttcacattattatttaaacatttttagtcatttgtttggcttatttccaaaacgatatttatgttggacttgttttcaaaagtattatgttgaacttgtaaaaaaaatttatatagctgttgaaatttccaagaaaataaggttttacacctaaacccttccactatatatataaaccccacttttgtctctatatctttactaatttcttaaaccctctcaacaatacgtaaca

SEQ ID NO: 5004 - DNA, 696 bp, Artificial Sequence
  P26468 (PRAT1G56060::G1795(-UTR))
tttaattgtcagtcatgcattaggttcacttacatggtaacggattatttgtggtgttgttgatttagtaaattggaatgttgaagaatgcagccaggtcccttgaatagtgggagctccttaaaaaatattccaagtcgatagtgtttagaagatgcgttcggtggctatttcctaaggaaacccacattgctcatttatcacttagtttaattatctcatctataaataaaacgtccagtttggacaccaaatcacgaatcacttattaatctttggtgatcttgtgtattagttttaagaggatgtcatttagagagttaataagctgattcgtgatttaacaccattggcccaaatacatgattgattatgggtcgtacaaggcaacaataaggttggttacttatcaaaacaccggtgagaacacgtccattgactcgttatgaagtgttttgacctggaaccttcagagacgaccagaatcaaggacgcctcctacttttatttgaaacgcgttgtgtcgtgttcggtctggctagaaaccggaagtttctacgaacacacctcctaacaaattcaatatcttaaaccggaagataacgtcagaaaatgtataaatatacactttgaattgaagcaattcacaaaaatcattcatcatctctcttaactcatcattacacagacatagca

SEQ ID NO: 5005 - DNA, 1165 bp, Artificial Sequence
  P26469 (PRAT1G57630::G1795(-UTR))
tcgagagtcgcatggtacagtataatgtcgctggggatttgcattgtggtctctggtttacagattttgtacttgaagcaatactttgaaaagaagaagcttatttagatcatggatagtttcttgttgaagattactagaaccaacagtttgctctgctttctttctcttgatcttctctttggaactgttagtgtaaaattttgttcactcatttaacttgtaatttgtctcctattattacatataacatataactagactctaattataggaattgcaactaaatttctcttgataaaaataataatgaatttctttggcatgtgtttttttatattatctgaactgaaccaaattgcagaattgtgacttgagaaaaacagaggactctgttgatatgaagtctcatagtataaacagaggactctatgtgaaacagagttacgaaaaattctaaagtaatgaaaaaaacacattgtggttttatctggattagaaaagccttcatatattttatctgacaacattaagaagcttaggagatttcttgggatgcaagcattttgtaacctgttttttgctacataacatgacattgtgttccagctaggtcaaaagagtattacagcattattcacataacacacagagcacaaagttaaatctttgtagagtttctataagacgacaagaacatatgtccacaatacgaaacataggctgatgcatgtggcgggggcaactgtggtggagaggttggtcataaatttggggcgtacacggaaactcagacttttcctcaatacaaaacatagtctgatgcattacgtcgtcggtgcatgattgtcaaggtagacgccgcaaataagcttctcggaaaaactctatacatgtgaacgtagactagtctatggaatccttttttgctatgactaagtccaaacattgaacttattgcttggaaactgcatatatttgaatttagattttgatggagactttcgttttcttcgctgaaattgcttgtgcgtttcattgctatttccttcttagaactagagaaccacaaccattttctgagttattacttcctacatagctctataacctctattattactttattagatctctgatcttaaatcgtctctctgtcgtagta

SEQ ID NO: 5006 - DNA, 1194 bp, Artificial Sequence
  P26470 (PRAT1G61560::G1795(-UTR))
aagaacacatttgaaccaatcatcgaaatatatggtggaaatatatttctaccaaagatttgttttttaaccaaataattgaacacaacgctaactgaatattttataaaactgatacagatttattaaaaattttgctaataaacattataaaattgcttttaccaattataggatgtattgtatctcttggactttaatatcgttgacgatcttgacaaataaaaagctggcgtttcattaaattggtatttacaatgagaaaaatgtgtgggatccaaaactggatataggattcgctttactgtatctggatccgaaactctaaaatatgatgtttcttatgatctggattttttcaaactataaatgatttctgaatttccgtgtatgtcaaccaatatttaaaaacagattatatttcttaaatatttttcagattttttgaaaaatattctgtaaattacaaatgcaaataaattatttaagaccgttaaggatcaaatatgtttttagtttattcaaatctctcgttctctcatatcgctattttgtacttagtttagataaaagtattaagtttggcttcttagaatttgatgtttctttttttcgtttttgctatcgacttttgttttttttttttttactattttgttgttatttatctattccttagattttggttttgtttctgatacttatattttctgtaatttatgtcgcaacttcaaaaataatataaatactttacattgatattaaaaaaaaaaaattgagctctaatgacctttggagctcatgctcatctatggaaaaaaaaatccatgcaggaagaaccaagaggaaacggtatacaaaataatattaaataaataattatttgtcaataaaataaataaaaactcaccaaagtacataacagttcacacagcatgtttttagaaaagatcatatactattggtttcaaagtctttgactttgaatgtttgaacttttcaaggttcgcctactcgccggtcgtctcctttaaccttcgtctctgtgtttatataagaacatatacgtatttgatgattacaaaaagacaattctttatccttctttagatttctgtggaaagttcactatttattaggagagacaatttcaaaaaggaaagctttttgcttggaactgttctgtgagttcta

SEQ ID NO: 5007 - DNA, 1125 bp, Artificial Sequence
  P26471 (PRAT1G67810::G1795(-UTR))
ttggtcagtacactcaagtgtagccgtaagctatgacgacgaaatgaaaacaactttaaattatttcccaagcctctttccgacagtatggggctctaaaagtatatcactaattcagtagtcgaatcgaatatgcctttgttctttcccttttaaatccataatttatttctaaaataataaaaaggagattgtcactggagaagccgcctcaaatgatgtccatatcgcatcataacatttaacgtcacacgataaaacaaaacatttcgtattttgttttgcaatctatttagtaattgcattattagtagtggcctatctcttttgaagttgaaagtctctagttgacttggtcgtatttgtatcattgtcacatataagtgaaaattaagatggacatttccgatattattagctaaattaaatcattctaattttttttaccagatattcaaaattccaactcatttagagtttcacgttggcatccaagtacttggattagctttcgactaaacaagaaattttacgtttttgcatagattataaaattagtttgaaaatttggttcaaaaatttcctgattaaaagaatataacgaagcattttataatgatgacaatgattcataatttttgtaagtgcttcagttgctacctaactcaaagtcgcaacttatattctaacagtttcatcattttaattttctaaaaaaaaaaaaaaatcaaagaccaaaaaattctaaattaaacctataatagtttcctttaaccaaaaaaaaaaaacctatactagtttcaaggctcgtagaggaagttagattacttaccatttaaaaatctacaatttaaatatataatttttttaaagtattttataaaataacattacaagatagatctttttttttttggtaaaaaataagatagattatatatagatagatcaataaacataaaaatagttttggcgcgttatagaaaggctctatgcatctaatcactatcctctctccgtcgcgtagttcaaggagttctcctttgattatccttaaatatctctcttctctcgttttcttctacctcctcctcccatttcttttcattgcccttgttacggaac

SEQ ID NO: 5008 - DNA, 664 bp, Artificial Sequence
  P26472 (PRAT1G24145::G1795(-UTR))
gggggtactgtttgctaattttggaatatttttgctaatttcatgattttttttgttaattatgggacttaataataatttaaaaaaacatagaaaacgtaaaaatttgagacccaatataaatgtttcaacattatgcgtaaaaggacaggccttcctaaaattagaacattttatatgatatcctcttaagtcttaagtactatcgaagccggagatttctaagttttacttttactaattaagctattgacacttgataaatgccatatttttgcattccctaaaacctcaaaactctctaaacacgtttttgtggacatattaaaatagtgtattttgtagtctcttccaggtttcttccttcttgtcaacgtcgcacaagtccgtttacggatatgggtgaataattgaatattatccatgtttccttattagcagtcgctattgtgggtttctttttggtagtctaatttattatttacttctttaaaatggggaaacagatacaaagttgcattacatatataacgcaatacaattagatcccatttgaccgagtaaacgctaagatccacacaaactcaatcgtcaactcctctctcttctctattctatatagttgcgtgaaatgtaatgaaagtgatcatcattcacttctaag

SEQ ID NO: 5009 - DNA, 1193 bp, Artificial Sequence
  P26474 (PRAT4G35180::G1795(-UTR))
atgttttagctggtcatcatcaactcgatttaagaaaactgaattcataaatttttagttgactacttgactggtgttcgttgactagttcacttatttaagtttttcttattaccagacctagaaagaaaaaaatgaaaaaaaaatcaccaaatgtccaaatgagatagcaatgtagtactagttaatagattgtttcttaagtcttatagatttgtatcaaagggcttcttgactgatacaagtttcttcctttaattcggtttataatagtattgatctaaaaccaaactacaaatacttacttaccactaaacttacttttcaaactttggcttgaagctaaacttgaagctaattctcacttaccactagacttgaagctacttttgaaactttggtctcacataactagagttgtaaaattagatgactagatgcctactctatatactttttaattatttttgctcataacaaaagtcgagtcaaaaacaactcgcacgtttatcatctttaattaactacttgattaatacttattaatcgtgtatacaaagagacgatgaaggaagatcagctcaaagttgacccttgcgttgaccaaaacatccgaagagcaaacaaagtccaattgaacaatgaacacaatctaacacaaactagtttggtttactttttagcctggcttgagttttaagctaccgaacaaaattagaagacttcgatttataccgatgggtctcgctttcgagagtatttgaaagtgacataaccgattacgtcatctttctcgtgtcattaatgcttacgtcatagctaataatttctaccgttcagaatatattttcttatatggtaattagagatatgaattgtttagtgttaaagtattgagattctcttgagcacttaaacagaaaaaaacaattccctaagaaaaataccttccttttttttgttttggaaaaagagattcaaagtcaatatacacagccaccgaacaaattactctatataaatccaatgaaagcagagtaaacatttatatagccatacaatttgtggctcgacgtaaataacgcgattggagtcgttagaggaaaataaagtttattttgtatacaatgtctatagcattgggaaacttatttgatttggaatcacaagaaagtggtggttctcctttattt

SEQ ID NO: 5010 - DNA, 1171 bp, Artificial Sequence
  P26476 (PRAT5G64905::G1795(-UTR))
caaaaaccttaaacgcagtgataatcatcctatcacaattcacaacgtgcattatgaatggtaatattatatacaaagttgacgagtgctctctatgagtaacgcatgatcgctctatgatttaataaaatatactccacgaggagcagaagcaacaccaacttcgaatataaaacacatttaacaatcttcactgtgactttagacatcatgatttttttggtgttctttttttaaaaaactcataatctggtgataagtctcgtagttacctcatcgtagaaccacaatttagtatttacacaagaaggtatggtctgattaaagtttgggggtctttgtaattaggcctacaataatcattcacaaatttgaaatattacaatttatgagggaccacaacacctaaaaaggcataaatgcattatgcccagtggcgacgaaaaaagtgcattaaaccaaaggaatatatgtttgatttttattttaatgtgggaatgggatatgcaatattacaattatgatattatctgaaattttatatctttacaaaatttgattttcaaacttaaattctatagtatgatctacatgaacactttatattcttatgcaagaaaaacaagtcctttgtccaatcattgacctcttaattgaatttgaaatatttaacaaagtacccaatagataattcttttgttcttgttaaattagattttcaaaatactaagctttagcattaatttgaataatcaaagatcttcctttgaattacctattcaacatttgtttaataacttaattcaaacaaaaaccaaagaagagcgtgaattgactttgaccaaaaccaaattctctcaagagttgctgccatattttgaccgcgcgccacgtagattagagtcaaaattgttattttattcacttcaacataaaaccaaataagcattatcggttttcaacataccggcaccaacttttccaaagtctgtatgtacctaacaaaaccggtttatcatagaaacggtcaacacaccaaaaatagttgaccaacaactacccaagtgatatccctttaaaaggagtcgcatatgtgttaccaagttccatcatcaacctaataacacacaacactaaatctctttaccaaaaaaagattaagaagtcaacg

SEQ ID NO: 5011 - DNA, 875 bp, Artificial Sequence
  P26477 (PRAT2G29460::G1795(-UTR))
tctcataacatatttttgttctgtaatttagatgataaattgataaccaatttgtattattacgaagaaaaagaaaacagtttgaactattcattaaaaaaagttattgtttaaaaggtattttattagattaaaatattaaattaattgtaattcacttttggaccacgcatttagcatcacacgtataactttaacaaatcaggtaaaaccaaatttctttaattaggtaaagaaacagaagactgaaagaaaaactagtttggaaacaaaaaatggtatttgcaggaattgtaaggaatttgggatactagaaatgtatggatctaagttagaaaaaatcaacaaaaatttgttgaatattatttataaagttggtatgtttgaggaaattgaaaaagataaaatatatttgaatatatggagagatgatataatgtgttcacggttcattggatatttagcagtgaatgaatcaagagaaagcaaaatagttattttcttctttcccgtcgttttagtatacttttcaagcacgagaacggaatcacaaaaactagtcaaaaaaggcgttaaatcctatagaacaaaaacatataagctatggtttcgaacgggaaccaaaccataatatgcgatgcacttctaatagcaatcaaaaatttgttaatatgtacatatatatttttgttttattaaaaccgtatcatactttatctgcagttaaaccgcacatctttattcggagcctatatatctacactgcctatatatcaaccgaccaaacattcacgaaaacaaaccacataaactagtcaaagaagaatagatgagttacattataaaaaagttcaagtgagagaaagagaggtcca

SEQ ID NO: 5012 - DNA, 1166 bp, Artificial Sequence
  P26479 (PRAT2G32210::G1795(-UTR))
aggacaatttgttattgtggctcaacgtaaccgggaccgcacgtttgataagttattgtttttttttttgttaaatgcagtcttgcgaccatgttggcctgttgcgtcctcgacgcatgcattttctgagttcggaggaagcagtcgattgtttattaaatttgacacttcatgcaaatatttttcattgtattttgcaagtagtttttgggattcgattagcttataacatttggacctcctatttgttgatttaattatttattactactttttttattttattacaacttagtttgtaatagtaaaatttattctactttgtgcccaaaactgtcaattgttgttcatttaaatttctggaattagatttagatacgctaaattaaatcacattttgcgtttatattcccacctaatttgaaaccagcaattattcttcttcataagaaaactttcatgtgctctctcgaaaataaagttttactctaataacaacacgcactttggacgagataaagcgattcaagtaaaattattatggttcaaactattatctaagatccgtttgtgtaaaacataacttctaataacatatatattctgatctacttttgttagtttttattagttaatataagcgttaattattgttctctcttttgcttaacatgtaaatattcccatggagaaagaagtacactttttgctttgagaaagaataaaaaaactctttattattactaaatcaagaaaaatataaaaccatgctgcatttatcatcattttacatattctatatataaggttctctaattcgtatacttttgtaaatagagaacaacgaattaaaagaccaaatcgatagcatcttacctttttgttgatatttattaagagaaaaaatcaacacattgttattcttcaagagaataaatttctggagacttagcagttaatgcaatctgacctcacgcgttttttttttttgacctcacgcggttttactaaaccgaccttcgtttacttcccttacctctctatatatatatctctatcttcatttgcatatttcaattcatttcataatcatacacctctctacatttgttactactttcttctaacttgttttcaaagagaaatcacaatctatctgttccaag

SEQ ID NO: 5013 - DNA, 1194 bp, Artificial Sequence
  P26481 (PRAT2G35980::G1795(-UTR))
agcagaatagtggggttttcacgttgactatatgcgttgatggacgcgtgaggtggaaggtcgggactcttactatagggaattatcatctccatgttcgttgtcaggcgttcataaaccaggctgataaagcagccggagttcatgtcggcgaaaacaccgttaagtacacgttgatcaataagtgcagtgtcaatttttaggaggtaaaaggacacaactttgacgccgtcaatgtttgcttttactctttcttcttcttttcatttttcttctactcggataatgtttttgcttctatatcgtttaattttctacctttttctgctgatcatataacatacataaaatcaaaaaatttaatatgataaattcatgttaaaagaacttgccaaataaaaaccgatacagaattttcttgtaaacattcttcaatcttttttatttatttttttaactttaaatttccacttaaattaaaataaagaggattacaaggttaaaaaccccaacatggccgcaggcctaaaaaagaaagataaattcttcaaatttatatttacgtaaaccttcaaatttaataaattttaaaaaaccagacataattatgttgagagcatcagcaacggtaatttctcaacttccgtttctcaatatatgtgtaaacataaataaaagtgtgaacacaaatattattaatatttaattgaaaagtattttaattaaaccaatgattgaatgacaactgtgagaaacgttgtcgataagtttctcttggtttctctaaagagaaactttcccttacctctctcctcctttggacatttcttttcttattttattggtgagagattttatgagaaactcccgttggagttggtctgacacaggcggccctaggttctagaacggtataacgagaaaccaacgtacgacgagagaccaaaaagtaatattaacatatacgatcttacaaaaagtactcattattggaagtttggggcaacatcacaagcctacaattgcataatattctttggtcaattattcaatcaaatcaccgcgtaacgtgaccttaccttaatctaataagttgaccaacgcataaatgaaagtgtatataaagatgacttacataaacctcttagccatatatccattcattccaatataattctccacaaaattactatc

SEQ ID NO: 5014 - DNA, 1650 bp, Artificial Sequence
  P26496 (35S::G481(GENOMIC))
atggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgagtatgcattcccaatttttcttctttcaatcgaatttgttggaaaatattttgctctttggtgaaaaaaattgatcatttgttggaactttgggtttgtgagagatagttttcttaaactagctatggattgagtttagctcagagagttttttgaagtttatagagcaaagattatgtttttttttttgtcacaatgttaatcaaccattgtttggtatgggtttaccttaacctagttcctttcctatagaccattttgcagattatttcacatgcttctactgtgttatatcttaactctgtcaaataaattgttagatttttttcttcatttaaccatcttagggtataaaagccgtatcttgatcatgtttcaaagattcttttatctttaggatctgtttgtttttgttcctttttgttcatttaaggcaaaagatatgtttttcatcatgaaggaattgcttgtgttgaatgcgttttaggtctctgattgatgagttttatgtttcttataacatcagatgcccccgttctttgttaggaagaaataagttatcatgtatgaaactatgatttatctattggttcaagataagcttgtctgatgttgcgcttaagtctcttttgctggtcttatgttgattcgttgactgtaatggccaattgactggtatctgtttctgctaatcagggccagtgataagtgtcaaaaagagaaaaggaaaactgtgaatggtgatgatttgttgtgggcaatggcaacattaggatttgaggattacctggaacctctaaagatatacctagcgaggtacagggaggtatgttgctttgactccctaatcatgtgttctgaaatccttaatatcctagtcaagagattagtagctgtgagtaacatcgaagcttgccatgatagcagttttacaatcccttcaatacgtcttgtgtagaatttttgaagcaagaaagataaatctagaccaacagtcaggatgcatattagtaaattttgaaagacatttattactctctcttttgtgcttttgttgttaacatacataataaaatcaaaatgtttcttattaagttgagactaattcggttcttttcattccctgggattggttgctgacacaccacctgctgatgcagttggaggtaaataaaccacatacttatttctactttatattccattccagtgttgcccattggcttcttacgttttgttgtgaaattatgatagggtgataataagggatcaggaaagagtggagatggatcaaatagagatgctggtggcggtgtttctggtgaagaaatgccggtatgattttgacaagtatagatgataccaatgctatacagcctatattgtacttagctctgacttcatcattttgattcaatcacagagctggtaaaagaagttgcaagtagtg

SEQ ID NO: 5015 - DNA, 1627 bp, Artificial Sequence
  P26497 (35S::G28::GFP)
gtcgacccacgcgtccggaaatctcaacaagaaccaaaccaaacaacaaaaaaacattcttaataattatctttctgttatgtcgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagatccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttatgcggccgcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctctag

SEQ ID NO: 5016 - DNA, 1097 bp, Artificial Sequence
  P26498 (35S::G1792(-UTR))
ctgcaggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgacaagctgactctagcagatctggtaccgtcgacggtgagctccgcggccgcatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagataa

SEQ ID NO: 5017 - DNA, 795 bp, Artificial Sequence
  P26499 (35S::G3396::GAL4)
aaaaactaagcgatgtcggaggggttcgacgggacggagaacggcggcggcggcggcggaggcggagtagggaaggagcaggaccggttcctgccgatcgccaacatcggccgcatcatgcgccgggccgtgccggagaacggcaagatcgccaaggactccaaggagtccgtccaggagtgcgtctccgagttcatcagcttcatcaccagcgaagcaagcgacaagtgcctcaaggagaagcgcaagaccatcaatggggacgacctgatctggtcaatgggcacgctcggattcgaggactatgtcgagcctctcaagctctacctcaggctctaccgggagacggagggtgacacaaagggttcaagagcttctgaactgccagtaaagaaagatgttgtacttaatggagatcctggatcatcgtttgaaggcatgtgcggccgccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtag

SEQ ID NO: 5018 - DNA, 892 bp, Artificial Sequence
  P26500 (35S::G3470::GAL4)
tcaccgggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaatgctcagcttgttcatcagggttcgctgaactatattggtttgcaggtgcaaccacaacatctggttatgccttcaatgcaaggccatgaatgcggccgccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtag

SEQ ID NO: 5019 - DNA, 1484 bp, Artificial Sequence
  P26537 (35S::G28(-UTR))
ctgcaggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgacaagctgactctagcagatctggtaccgtcgacggtgagctccgcggccgcatgtcgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagatccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataa

SEQ ID NO: 5020 - DNA, 578 bp, Artificial Sequence
  P26548 (35S::G3866)
tataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaa

SEQ ID NO: 5021 - DNA, 705 bp, Artificial Sequence
  P26576 (35S::G3841)
atggatcaacagttaccaccgacgaacttcccggtagattttccggtgtatcgccggaattcaagcttcagtcgtctaattccctgtttaactgaaaaatggggagatttaccactaaaagtcgatgattccgaagatatggtaatttacggtctattaaaagacgctctaagcgtcggatggtcgccgtttaatttcaccgccggcgaagtaaaatcggagccgagagaagaaattgaatcgtcgcttgaattttcaccttctccggcggagaccacggcagctccggcggctgaaacaccgaaaggaagacattatagaggcgttagacagcgtccgtgggggaaatttgcggcggagattagagatccggcgaagaacggagctagggtttggcttggaacgtacgaaacagctgaagaagctgcaattgcttatgataaagctgcttatagaatgagaggatcaaaagcacatttgaatttcccgcaccggatcggtttgaatgaaccggaaccggttcgagttacggcgaaaaggcgagcatcgccggaaccggcaagctcgtcgggaaacggttccatgaaacggagaagaaaagccgttcagaaatgtgatggagaaatggcgagtagatcaagtgtcatgcaagttgaatgtcaaattgaacaattgacaggtgtccatcaactattggtcatttaa

SEQ ID NO: 5022 - DNA, 1188 bp, Artificial Sequence
  P26579 (PRAT2G18690::G1795(-UTR))
gtttgaaaaccggtttatgtaactatcaagaaataatcaaaacaaaaaatccaaaaataaacttcaatgtgaattttgatttgggctatatatttcaaatttcagtctaaaatttattggcaacaatattattaaaaaaaaaaacctacattgttattacaatggggaaacttatttattaagcggtataaaaggttttatacataagtaacgaaaaagtagtaagtaaacgaccatgagttggtaattaatttgcaaaaatgatggatgatacgtaaaagtttaattatattatgttaaaaattttacttaccttaaaaacaaaagagatcagatttaaagaaaagagaggttagattaaaggaggaagttctacaagaaggagaactatggatatgttttggtcatggaagaaatagtttgctagatttgtaagtgctctgtttttctttttttcaatcatatttggattagaagttataatcatttagcaatttgcaacgtcctcaaagaatgtttgaagctctaattcttctatgttcggttaaatataaatatataatgacggtttggtatagcatatagtttgaccctactgtttatgactcattcatgatgacttgttcgcttgaggaaacaaattttttttttagatagatgtttcattatcttacacggtttcttgacattttcaacacgaatagaggaagtgaatgttgatcacgtacatttgatgaagaagtcaacttgcaatgttaaacatgttcctcttattttctttatataacatcttcatttatgacgcggtcaggaagtcatcatttttagacttttcatcgatgcattatgcttcgggttctttgttcttggatttgtctaagtcttggtttcttcctttgattttggatataatatgtagtaataataatatattgagggttccgtgtacttggactcaatcaaatggatgacaagaatctccgtaagcgaagctaccccgaaatacaagccaaagacttctttttccatagaaaaatagctggtcataatctaaaggtatagtagtttttgaatgtttggttagtagtatataagccctagacagataggtttgatcttataaaccctcgccaccattaccaaaaaccaataagccaagagcttttctcatttttcttcttgaaaccc

SEQ ID NO: 5023 - DNA, 689 bp, Artificial Sequence
  P26580 (PRAT3G22060::G1795(-UTR))
gatgtagaagacaatctcttgacaactttcctattttgtttggttttgttttcttaattttgttttatttttggttacaagtcaaaacttttttggtttgaaataatataatgtataaatcccttttaaattagtgaaaaccctcaaacaagaaaaagaacaaaaaaaaaaattgatttaatatatttgagcagttaaagggagaaaattatcatttagataaaatacatttaaaaaaaaagaatttatgtccacaccgtacatatcttagtttcactcagtcaaacctttgaatgttgactttttcattcaccgcaataccaagttcccctcaactcatggccctctactttacatttctaatttcatctagaagcttgaaatgaaagttggatcaaatgggacaaaaaattgttgttttgacataattgcttcatcttagccaatcagctaaattgacttcttttttgttcaaaggaactctcgtgattggaaaatgaccaaatcccaattgtacaaaaatgaaaacttcaacccattctaatatttattaaataaataaataacttgtctcaccacccaaagaccaaaatcatctagccactctataaaacatccttacctcaacacttcttctatcaaaaaaaaaaaagacaccctccacaaaatatcaattttcttccaaaaca

SEQ ID NO: 5024 - DNA, 1178 bp, Artificial Sequence
  P26582 (PRAT2G18660::G1795(-UTR))
tgtaaatttaaacttggacgatgatataacaacacaaatgacatatgcttaaaagttaaaatctcattttttatattttgaatctttgattgatgaattatagcgacaagccgacaaaggcaacttcctcggtaagggcaatcgttatcttaagtttaatttgatcaaatctctttctcagcgatagaaagtttaattggtatatagagatttgggcctttacataaaatgatatttgaaggcccactaagcccaattattttccagaatgttgaattcataaacgcagatttacttgacatgataacaaagagaaatttgtcttgattcaaaaaaataaaataaagaagagacatttgtctttctcttgtaaaagaggtcaataaagcaaatttgtttttcatacttcatcatttgactaattttattggtgttatgtaacaaaccgaatattggagatatcttagggagcaagtacgtgaagtccgaagaatattctagatttcactattaccttttgttcaagttatttttttatatgtttagaaaagttgaagaacaatctgactcggataccatgatagatttgggcttttaatatgagatttcaactaaaaatcaattggtaataggtggagtgaccctaacactttatatactatttgataatttttaatttttaatgtgggactttcttcattaacacattttgttttagtagatggtcctaacgttagaacctaacactcatcagaaggtttaaaagacggttatacttttcccgatggttttggatttgggtaaggttgagaattttctcaaggtaggattcgaagtgatgttgagaataccctccttagtttcttcgaaatttccttcgcagctttgtgaaaataatatccacaaagaaaaaaaaaatgaactttaaatttcaaaccctcgtggaattttccttcacacatcatcatatattcatattcattcaattcaccaagaaaatttaggtggagtaaggaataacaaattgtcctgtatgaaatcaatacaataagtaatggaagacttgacgtagaccaaagacttttccttttacttacagtctttgagtccaattatatataaatactcgcttccctttgcttcgttatttcacaaacaagttaaagaaaatgataaaa

SEQ ID NO: 5025 - DNA, 934 bp, Artificial Sequence
  P26587 (35S::G3866::GAL4)
tataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactgcggccgccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtagtaagc

SEQ ID NO: 5026 - DNA, 277 bp, Artificial Sequence
  P26589 (35S::G3930)
cagtacatactaatggataacacaaaccgtcttcgccgccttcactgtcataaacaacccaagttcactcatagctctcaagaagtgagtagtatgaaatgggagtttatcaatatgaccgaacaagaagaagatctcatctttagaatgtacagacttgttggcgacaggtgggatttaatagcaagaagagtggtgggacgtgaggcaaaggagatagagagatactggattatgagaaattgtgactatttctcccacaaatgacgcaaaagtc

SEQ ID NO: 5027 - DNA, 768 bp, Artificial Sequence
  P26590 (35S::G3889)
aatccatggacaaccagccgctgccctactccacaggccagccccctgcccccggaggagccccggtggcgggcatgcctggcgcggccggcctcccacccgtgccgcaccaccacctgctccagcagcagcaggcccagctgcaggcgttctgggcgtaccagcgccaggaggcggagcgcgcgtccgcgtcggacttcaagaaccaccagctgcctctggcccggatcaagaagatcatgaaggccgacgaggacgtgcgcatgatctccgccgaggcgcccgtgctgttcgccaaggcctgcgagctcttcatcctcgagctcactatccgctcctggctccacgccgaggagaacaagcgccgcaccctgcagcgcaacgacgtcgccgcggccatcgcgcgcaccgacgtcttcgatttcctcgtcgacatcgtgccccgcgaggaggccaaggaggagcccggcagcgccctcggcttcgcggcgcctgggaccggcgtcgtcggggctggcgccccgggcggggcgccagccgccgggatgccctactactatccgccgatggggcagccggcgccgatgatgccggcctggcatgttccggcctgggacccggcctggcagcaaggggcagcggatgtcgatcagagcggcagcttcagcgaggaaggacaagggtttggagcaggccatggcggcgccgctagcttccctcctgcgcctccgacctccgagtgatcgatcggcgcgtctcttggtcctg

SEQ ID NO: 5028 - DNA, 627 bp, Artificial Sequence
  P26591 (35S::G3911)
acaaccctagctgcccccgaatccatggatcctaacaaatccagcaccccgccgccgcctccagtcatgggtgcccccgttgcctaccctccgcctgcgtaccctcccggtgtggccgccggcgccggcgcctacccgccgcagctctacgcaccgccggctgctgccgcggcccagcaggcggcggccgcgcagcagcagcagctgcagatattctgggcggagcagtaccgcgagatcgaggccactaccgacttcaagaatcacaacctcccgctcgcccgcatcaagaagatcatgaaagccgacgaggacgtccgcatgatcgccgccgaggctcccgtggtgttcgcccgggcctgcgagatgttcatcctcgagctcacccatcgcggctgggcgcacgccgaagagaacaagcgccgcacgctccagaaatccgacattgccgctgccatcgcccgcaccgaggtattcgacttccttgtggacatcgttccgcgcgacgacggtaaagacgctgatgcggcggccgccgcagctgccgcggctgccgggatcccgcgccccgccgccggagtaccagccaccgaccctctcgcctactactacgtgcctcagcagtaa

SEQ ID NO: 5029 - DNA, 1091 bp, Artificial Sequence; identical to SEQ ID NO: 2325
  P26593 (35S::G4264)

SEQ ID NO: 5030 - DNA, 778 bp, Artificial Sequence; identical to SEQ ID NO: 2025
  P26595 (35S::G3552)

SEQ ID NO: 5031 - DNA, 638 bp, Artificial Sequence
  P26596 (35S::G3909 )
tgaccgccgtaacaccctaggcaatggagcccaaatccaccacccctcccccgccccccgtgatgggcgcgcccatcgcgtatcctcccccgcccggcgccgcgtaccccgccgggccgtacgtgcacgcgccggcggccgcgctctaccctcctcctcccctgccgccggcgcccccctcctcgcagcagggcgccgcggcggcgcaccagcagcagctattctgggcggagcaataccgcgagatcgaggccaccaccgacttcaagaaccacaacctgccgctcgcccgcatcaagaagatcatgaaggccgacgaggacgtgcgcatgatcgccgccgaggcgcccgtcgtcttctcccgcgcctgcgagatgttcatcctcgagctcacccaccgcggctgggcacacgccgaggagaacaagcgccgcacgctgcagaagtccgacatcgccgccgccgtcgcgcgcaccgaggtcttcgacttcctcgtcgacatcgtgccgcgggacgaggccaaggacgccgactccgccgccatgggagcagccgggatcccgcaccccgccgccggcctgcccgccgccgatcccatgggctactactacgtccagccgccgcagtaacgaatttgc

SEQ ID NO: 5032 - DNA, 756 bp, Artificial Sequence; identical to SEQ ID NO: 2227
  P26597 (35S::G3925)

SEQ ID NO: 5033 - DNA, 762 bp, Artificial Sequence; identical to SEQ ID NO: 2005
  P26598 (35S::G3543)

SEQ ID NO: 5034 - DNA, 760 bp, Artificial Sequence
  P26599 (35S::G3544)
agaggacatggagccatcatcacaacctcagccggcaattggtgttgttgctggtggatcacaagtgtaccctgcataccggcctgcagcaacagtgcctacagctcctgctgtcattcctgccggttcacagccagcaccgtcgttccctgccaaccctgatcaactgagtgctcagcaccagctcgtctatcagcaagcccagcaatttcaccagcagcttcagcagcagcaacagcgtcaactccagcagttttgggctgaacgtctggtcgatattgaacaaactactgacttcaagaaccacagcttgccacttgctaggataaagaagatcatgaaggcagatgaggacgttcgcatgatctccgcagaggctcctgtgatctttgcgaaagcatgtgagatattcatactggagctgaccctgagatcatggatgcacacggaggagaacaagcgccgtaccttgcagaagaatgacatagcagctgccatcaccaggacggatatgtacgatttcttggtagatatagttcccagggatgacttgaaggaggagggagttgggctccctagggctggattgccgcccttgggtgtccctgctgactcatatccgtatggctactatgtgccacagcagcaggtcccaggtgcaggaatagcgtatggtggtcagcaaggtcatccggggtatctgtggcaggatcctcaggaacagcaggaagagcctcctgcagagcagcaaagtgattaa

SEQ ID NO: 5035 - DNA, 1000 bp, Artificial Sequence; identical to SEQ ID NO: 2229
  P26600 (35S::G3926)

SEQ ID NO: 5036 - DNA, 824 bp, Artificial Sequence
  P26602 (35S::G3924)
gcattccgaggtgagcgagcatggagtcgaggccggggggaaccaacctcgtggagccgagggggcagggcgcgctgccgtccggcataccgatccagcagccgtggtggacgacctccgccggggtcggggcggtgtcgcccgccgtcgtggcgccggggagcggtgcggggatcagcctgtcgggcagggatggcggcggcgacgacgcggcagaggagagcagcgatgactcacgaagatcaggggagaccaaagatggaagcactgatcaagaaaagcatcatgcaacatcgcagatgactgctttggcatcagactatttaacaccattttcacagctggaactaaaccaaccaattgcttcggcagcataccagtaccctgactcttactatatgggcatggttggtccctatggacctcaagctatgtccgcacagactcatttccagctacctggattaactcactctcgtatgccgttgcctcttgaaatatctgaggagcctgtttatgtaaatgctaagcaatatcatggaattttaagacggaggcagtcacgtgcgaaggctgaacttgagaaaaaagttgttaaatcaagaaagccctatcttcatgagtctcgtcatcaacatgctatgcgaagggcaagaggaacgggtggacgcttcctgaacacaaagaaaaatgaagatggtgctcccagtgagaaagccgaaccaaacaaaggagagcagaactccgggtatcgccggatccctcctgacttacagctcctacagaaggaaacatgaagtagcggctcgaaacctagaacagtg

SEQ ID NO: 5037 - DNA, 649 bp, Artificial Sequence
  P26603 (35S::G3546 )
gagaaaccctagcaatggagcccaaatccaccacccctcctccgcctcctccgccccccgtgctgggcgcccccgtcccttacccgccggcgggagcctaccccccacccgtcgggccctacgcccacgcgccgccgctctacgccccgcctccccccgccgccgccgccgcctccgccgccgccaccgccgcctcgcagcaggccgccgccgcgcagctccagaacttctgggcggagcagtaccgcgagatcgagcacaccaccgacttcaagaaccacaacctccccctcgcccgcatcaagaagatcatgaaggccgacgaggacgtccgcatgatcgccgccgaggcccccgtcgtgttcgccagggcgtgcgagatgttcatcctcgagctcacccaccgcggctgggcgcacgccgaggagaacaagcgccgcacgctccagaagtccgacatcgccgccgccatcgcccgcaccgaggtcttcgacttcctcgtcgacatcgtgccccgcgacgaggccaaggacgccgaggccgccgccgccgttgccgccgggatcccccaccccgccgccggtttgcccgccaccgaccccatggcctactactatgtccagccgcagtaacattttcctaccgtata

SEQ ID NO: 5038 - DNA, 798 bp, Artificial Sequence
  P26604 (35S::G3542 )
agctgacatggaaccatcctcacagcctcagcctgtgatgggtgttgccactggtgggtcacaagcatatcctcctcctgctgctgcatatccacctcaagccatggttcctggagctcctgctgttgttcctcctggctcacagccatcagcaccattccccactaatccagctcaactcagtgctcagcaccagctagtctaccaacaagcccagcaatttcatcagcagctgcagcaacagcaacagcagcaactccgtgagttctgggctaaccaaatggaagagattgagcaaacaaccgacttcaagaaccacagcttgccactcgcaaggataaagaagataatgaaggctgatgaggatgtccggatgatctcggcagaagcccccgttgtcttcgcaaaggcatgcgaggtattcatattagagttaacattgaggtcgtggatgcacacggaggagaacaagcgccggaccttgcagaagaatgacattgcagctgccatcaccaggactgatatctatgacttcttggtggacatagttcccagggatgaaatgaaagaagaagggcttgggcttccgagggttggcctaccgcctaatgtggggggcgcagcagacacatatccatattactacgtgccagcgcagcaggggcctggatcaggaatgatgtacggtggacagcaaggtcacccggtgacgtatgtgtggcagcagcctcaagagcaacaggaagaggcccctgaagagcagcactctctgccagaaagtagctaaagatgatacag

SEQ ID NO: 5039 - DNA, 847 bp, Artificial Sequence
  P26606 (35S::G3550)
agtaagtcatcatggataaatcagagcagactcaacagcagcagcagcaacaacagcatgtgatgggagttgccgcaggggctagccaaatggcctattcttctcactacccgactgcttccatggtggcttctggcacgcccgctgtaactgctccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccatagccttcctcttgctcggataaaaaagataatgaaagctgatgaagatgtccggatgatttcagcagaagctccggtcatatttgcaaaagcttgtgaaatgttcatattagagttgacgttgcgatcttggatccacacagaagagaacaagaggagaactctacaaaagaatgatatagcagctgctatttcgagaaacgatgtttttgatttcttggttgatattattccaagagatgagttgaaagaggaaggacttggaataaccaaggctactattccgttagtgggttctccagctgatatgccatattactatgtccctccacagcatcctgttgtaggaccacctgggatgatcatgggcaagcccattggcgctgagcaagcaacactatattctacacagcagcctcgacctcctgtggcgttcatgccatggcctcatacacaacccctgcaacagcagccaccccaacatcaacaaacagactcatgatgactatgcaattcaattag

SEQ ID NO: 5040 - DNA, 750 bp, Artificial Sequence; identical to SEQ ID NO: 2197
  P26607 (35S::G3886)

SEQ ID NO: 5041 - DNA, 956 bp, Artificial Sequence; identical to SEQ ID NO: 2221
  P26608 (35S::G3920)

SEQ ID NO: 5042 - DNA, 628 bp, Artificial Sequence
  P26609 (35S::G3875)
attagggttccggcgagcatggccgacggtccggcgagtccaggcggcggtagccacgagagcggcgagcacagccctcgctctaacgtgcgcgagcaggacaggtacctccccatcgctaacataagccgcatcatgaagaaggcactacctgcgaacggtaaaatcgccaaggacgccaaagagaccgttcaggaatgcgtatccgagttcatcagtttcatcaccagcgaggcctctgataagtgtcagagggaaaagagaaagactattaacggtgatgatttgctctgggccatggccactcttggttttgaggattatatcgatcctcttaaaatttacctcactagatacagagagatggagggtgatacgaagggttcagccaagggcggagactcatcttctaagaaagatgttcagccaagtcctaatgctcagcttgctcatcaaggttctttctcacaaggtgttagttacacaatttctcagtgaattctgggtgaatgaaacaaattcattgaagtatcttaagctacaagggtacctgatccttaaattggtcaacatatgatggttccaatgcaaggcccggagtaggtatcaagtttattaaccctcctgt

SEQ ID NO: 5043 - DNA, 786 bp, Artificial Sequence
  P26610 (35S::G3548 )
aacatcaggggatgggcgttgccacaggtgctagccaaatggcctattcttctcactacccgactgctcccatggtggcttctggcacgcctgctgtagctgttccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccacagtcttcctcttgctcggataaaaaagataatgaaagctgatgaagatgtccggatgatttctgcagaagctccagtcatatttgcaaaagcatgtgaaatgttcatattagagttgacgttgagatcttggatccacacagaagagaacaagaggagaactctacaaaagaatgatatagcagctgctatttcgagaaacgatgtttttgatttcttggttgatattatcccaagagatgagttgaaagaggaaggacttggaataaccaaggctactattccattggtgaattctccagctgatatgccatattactatgtccctccacagcatcctgttgtaggacctcctgggatgatcatgggcaagcccgttggtgctgagcaagcaacgctgtattctacacagcagcctcgacctcccatggcgttcatgccatggccccatacacaaccccagcaacagcagccaccccaacatcaacaaacagactcatgatgaccatgca

SEQ ID NO: 5044 - DNA, 799 bp, Artificial Sequence
  P26611 (35S::G3894)
gctcaaaatggatcaacatggaaatggacagcctccaggtattggagtcgttactagctcagctccaatatatggtgctccataccaagctaaccaaatggcagggccctctcctcctgcagtttcagctggtgcaattcaatctcctcaagcagctggtcttgctgcttcgtcagctcagatggcgcaacatcagctcgcttatcagcacattcatcagcagcagcaacaacagttgcagcaacaactccagactttctgggcaaatcaatatcaagaaatcgagcatgttactgatttcaagaatcatagcttgccattggcaaggatcaagaaaatcatgaaagcggatgaagatgttaggatgatatctgctgaagcaccagtcgtatttgctcgtgcctgtgagatgttcatacttgaattgacactgcgtgcatggaaccacactgaggagaacaaaaggaggacgctgcagaaaaatgatatcgctgcagccataacaaggactgacatatttgatttcttagttgacattgtcccaagagaggacttgaaagatgaggtgcttgcaacaattcctagaggaacgcttcctgttggaggcccaactgagggtctgccattctattatggcatgccaccacaatctgctcaaccgattggagctccagggatgtacatgggaaagcctgtcgatcaagctctgtatgcccagcagccccgcccatatatggcacagccaatttggccccagcagcagcaaccaccctcagattcttaagcagctcaaagctta

SEQ ID NO: 5045 - DNA, 458 bp, Artificial Sequence
  P26612 (35S::G3969)
ctctcgagaatatgaataccaacgagtccgaacatgttagcacaagcccagaggatactcaggagaacggtggaaacgctagctccagcggcagtttgcagcaaatttccacgctaagagagcaggacagatggctacccatcaacaatgtagcgcgactcatgaagaatactctcccaccgagtgctaaggtatcgaaagatgcgaaagagtgcatgcaggagtgtgtcagtgagctcatttcttttgtgactagcgaggccagcgatcgatgcgctgctgacaaaagaaagacgataaacggggaagacattctcatatcattgcacgccttaggattcgagaactatgcagaggtgttgaaaatctacttggctaaatacaggcaacaacaggcgctgaagaatcaactaatgtatgagcaggacgacgaagaggtgccttgagaagacaaaacc

SEQ ID NO: 5046 - DNA, 1207 bp, Artificial Sequence
  P26707 (PRAT5G62150::G1795(-UTR))
tggtatatgcacgacaggacaaccgatacaatgacagttggttccaaaaaaaaagtttaatcctaaatatatgaataatcgaatcgatcaataacacgttgacaaaaaacgaacaaataatcacactgatgaaccactttataatgaacagagaattttgtaatctgaaaattttgaaagtcaagaggttaatcaagtaattatagaaaggtagttgtaacgttggcttttgtggaactaataacttacgtgtctttaaacggcggctactttggaaggctacgtttcttaatttgaacctcattttctccattttccttcgtttatacgatatctttttcaaaaaagtgacccaataaccacacatataacatatttagtataactttgaatataaacgaatcaatgatatctgaattttattttgattttgatcttgatttttgttgttttttgtcgaggctattgccttgccactttggatgaaggaacccggctaaggtaagaccccctgcctaatattagcctccggcgaattttgcactcagaaattacattatgttatagttttggaattttagtttaaatttgtaaaagtattaaaacaattggtcaactattatattaattagctcaagagtgctttcaaaaacatatcttaaatttaataaagaaatattccaatatcttaaccagtactaaaagagaagatcagaaaatttcttataaaactttaatctaataaaatcatctacgactctaccattcaatatttttttgttattgttttatttacatatttcttttaatatttacatatctcttttcctttttgctaaaaaaaagttggcataaaaattactaaattttaagcgtaaaaaaataaaattaattattgtctattgccatttttggaggatggatatgatttggaggaatagttaaagaaagtgctaaaatctcctttagtgagtcacaaccgttgaccttcaccgcaaggcacaagagaccaagtctctaacccaacacaacacaaaacccataaactgaaaagactaacctaccctatcttgccatataaatccctctcgagcaacgcatgttaaataaacctaatttatacattcattctcaaagtcaaaaggagacagggagagagagagagagagagagaattcaaagcgttttttttttataaattaaaggc

SEQ ID NO: 5047 - DNA, 1216 bp, Artificial Sequence
  P26708 (PRAT5G24090::G1795(-UTR))
aaatggtccagttttggcccaaatatttaacaacatttgggttacgagtatttgccctttacaaatggatcaacaatctccctggatcaatatttagtggccggtttcatgaatcaacatattctttttttttttttgtctaaagaatcaacatattctaaatcaccaaaacactttggtcaacaattttcgacaatatatggaaattaggttggattatcatgcgacttttttctgattaattttatgtatttttaatttacgatgtaattcggactactaatttgtattatgataactttacattttccatactactcaagtccaagtaaaatactattgtatatatatctttggattttacataaattaatggggaggcctaataaaatatactcggagtatatcatttgactttgaaatttatcgagtcaaatcaatgattgtatttttggtaaaaacaattattatgaagactttgaaagtttttaatgattttaatttcaaaaattagtaaatgctggtctggttatccatccattggaagagaaaataagaccttttcaaagctagttgataaaaaaagttctcggtcctatccctcatcttataaagaaattattaatacgtttagggattcaattcacagaagatttaaaaacaaatggaaaataggatattaccataataattatggttcaacaacaatttcgatttctaatttgaataatggaaatttagatcaaaaatagttccgactcatagataaattgaaatgtgccaaatgtcacgtaaaccagcaagaggacaaagtcaacaccacaagagacgacgacgagcacagtgtgaggttatgatatataccctctgcgagactgcgactgctattactgatttgatcccaagttttttttttttttttgaaatttattttttctttatacacaattacatagtggtaagagattctagatggcttcttaatgtttgagatttatatctagtttaagtaggaaagctatattatttgaagaaagaaaaaaacaaccaatcaaagtcatgcaatgtgtgtgagagacattataacatacatagataagatataaaaattaaagcaaacaaaagtcatattttacttcttttataaaaaaagaagttaagcaataacaaacaaacacataaccacaaagaagacaaaacatctttaaccaaaaac

SEQ ID NO: 5048 - DNA, 736 bp, Artificial Sequence; identical to SEQ ID NO: 1937
  P26738 (35S::G3479)

SEQ ID NO: 5049 - DNA, 745 bp, Artificial Sequence; identical to SEQ ID NO: 1947
  P26744 (35S::G3484)

SEQ ID NO: 5050 - DNA, 752 bp, Artificial Sequence
  P26748 (35S::G4004)
atgaagcccaagacttgcgagctttgtcatcaactagcttctctctattgtccctccgattccgcatttctctgcttccactgcgacgccgccgtccacgccgccaacttcctcgtagctcgccacctccgccgcctcctctgctccaaatgcaaccgtttcgccgcaattcacatctccggtgctatatcccgccacctctcctccacctgcacctcttgctccctggagattccttccgccgactccgattctctcccttcctcttctacctgcgtctccagttccgagtcttgctctacgaatcagattaaggcggagaagaagaggaggaggaggaggaggagtttctcgagttcctccgtgaccgacgacgcatctccggcggcgaagaagcggcggagaaatggcggatcggtggcggaggtgtttgagaaatggagcagagagatagggttagggttaggggtgaacggaaatcgcgtggcgtcgaacgctctgagtgtgtgcctcggaaagtggaggtcgcttccgttcagggtggctgctgcgacgtcgttttggttggggctgagattttgtggggacagaggcctcgccacgtgtcagaatctggcgaggttggaggcaatatctggagtgccagcaaagctgattctgggcgcacatgccaacctcgcacgtgtcttcacgcaccgccgcgaattgcaggaaggatggggcgagtcctagctgatgatagctataccaat

SEQ ID NO: 5051 - DNA, 756 bp, Artificial Sequence; identical to SEQ ID NO: 2253
  P26749 (35S::G4005)

SEQ ID NO: 5052 - DNA, 687 bp, Artificial Sequence; identical to SEQ ID NO: 2245
  P26799 (35S::G3980)

SEQ ID NO: 5053 - DNA, 821 bp, Artificial Sequence; identical to SEQ ID NO: 691
  P26801 (35S::G926)

SEQ ID NO: 5054 - DNA, 734 bp, Artificial Sequence; identical to SEQ ID NO: 1201
  P26819 (35S::G1821)

SEQ ID NO: 5055 - DNA, 719 bp, Artificial Sequence; identical to SEQ ID NO: 2191
  P26821 (35S::G3883)

SEQ ID NO: 5056 - DNA, 912 bp, Artificial Sequence; identical to SEQ ID NO: 1613
  P26883 (35S::G2632(-UTR))

SEQ ID NO: 5057 - DNA, 217 bp, Artificial Sequence
  P26885 (35S::MIR169E)
tgatgatgatgatgagtcactaattaattgtatcatagagtcttgcatggaaaaatagaaaatgagattgagccaaggatgacttgccgattttctcaacgaatcttactgattatggtatccggcaagttgactttggctctgtttccttcccttcttttcgatgtcaaactctagatacctaaccacatatcatatatatcatcatcattcatca

SEQ ID NO: 5058 - DNA, 167 bp, Artificial Sequence
  Artificial sequence
  P26886 (35S::MIR169F)
gggtcttgcatgaaggaataacgaatggaattgagccaaggatgacttgccggtttaaacccaaccggtttatgaccattgatttggtctcattcacaatctgttgattcgtgtctggcaagttgaccttggctctgcttcgttctctattcttccatgttagattc

SEQ ID NO: 5059 - DNA, 379 bp, Artificial Sequence
  P26887 (35S::MIR169G)
tgcctataaataccttcatcacgagtatgacaagatcacaagacaagaaaagaaaggtagagaaaacatgataatgatgattacgatgatgagagtctctagttgtatcagagggtcttgcatggaagaatagagaatgaggttgagccaaggatgacttgccgggtttttttaccaatgaatctaattaactgattctggtgtccggcaagttgaccttggctctgtttccttctcttcttttggatgtcagactccaagatatctatcatcatgaatcgtgatcaaactttgtaatttcattgaaatgtgtttttcttgatgcgaattttttggcttacggtttttcgatttgaatgatcagatttttgtttttgca

SEQ ID NO: 5060 - DNA, 578 bp, Artificial Sequence
  P26888 (35S::G3866(I97L))
tataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaagcgagtgacaagtgccagagggagaagcggaagaccctcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaa

SEQ ID NO: 5061 - DNA, 578 bp, Artificial Sequence
  P26889 (35S::G3866(G110L))
tataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctgctgtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaa

SEQ ID NO: 5062 - DNA, 578 bp, Artificial Sequence
  P26890 (35S::G3866(P50L, A51L))
tataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcctgcttaacgggaagaccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaa

SEQ ID NO: 5063 - DNA, 426 bp, Artificial Sequence
  P26891 (35S::G481(-UTR))
atggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaa

SEQ ID NO: 5064 - DNA, 528 bp, Artificial Sequence
  P26921 (35S::G3434(G91L))
aagggttgcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttactattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctag

SEQ ID NO: 5065 - DNA, 528 bp, Artificial Sequence
  P26922 (35S::G3434(A36L, V37I))
aagggttgcggcggaggcgcccggtcgctggcgatggccgacgacggcgggagccacgagggcagcggcggcggcggaggcgtccgggagcaggaccggttcctgcccatcgccaacatcagccggatcatgaagaagctcatcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctag

SEQ ID NO: 5066 - DNA, 208 bp, Artificial Sequence; identical to SEQ ID NO: 4975
  P27030 (PR4XW2BOX::M35S::G1792(-UTR))

SEQ ID NO: 5067 - DNA, 188 bp, Artificial Sequence; identical to SEQ ID NO: 4980
  P27035 (PR4XJEREBOX::M35S::G1792(-UTR))

SEQ ID NO: 5068 - DNA, 187 bp, Artificial Sequence; identical to SEQ ID NO: 4981
  P27036 (PR4XSBOX::M35S::G1792(-UTR))

SEQ ID NO: 5069 - DNA, 987 bp, Artificial Sequence; identical to SEQ ID NO: 2267
  P27042 (35S::G4220)

SEQ ID NO: 5070 - DNA, 845 bp, Artificial Sequence; identical to SEQ ID NO: 2269
  P27043 (35S::G4221)

SEQ ID NO: 5071 - DNA, 983 bp, Artificial Sequence; identical to SEQ ID NO: 2271
  P27044 (35S::G4222)

SEQ ID NO: 5072 - DNA, 1209 bp, Artificial Sequence; identical to SEQ ID NO: 2273
  P27045 (35S::G4223)

SEQ ID NO: 5073 - DNA, 1008 bp, Artificial Sequence; identical to SEQ ID NO: 2293
  P27047 (35S::G4234)

SEQ ID NO: 5074 - DNA, 1105 bp, Artificial Sequence; identical to SEQ ID NO: 2283
  P27048 (35S::G4228)

SEQ ID NO: 5075 - DNA, 915 bp, Artificial Sequence
  P27049 (35S::G4229)
tactaaagaaccagtttctgagtaaaacatggcggcgtcgccttccccgtccggcagcggcggcggcaaggccggcgtggaccggatcaagggcccctggagccccgaggaggacgaggccctgcagcgcctcgtgcgccgccacggcgcgcgcaactggtccctcatcagccgctccgtcccgggccggtccggcaagtcgtgccgcctccggtggtgcaaccagctgtcgccgcgggtggagcaccgccccttcacgcccgacgaggacgacgccatcctccgcgcgcacgccaggttcggcaacaagtgggccaccatcgcgcgcctcctctccggacgcacggacaacgccatcaagaaccactggaactccacgctcaagcgcgagcgcgagcgcaagcgcgagtactacgccgatgcgcgccccggccccggcgaccagcgctcgctcaagcgcaccagcagcgacgggccccccggaagcccgtccgggtccgacctcagcgactccagccaccagagccttcccaccgtgatgccgtcagccgcttctaccgccgtcacctcccagcagcagctacaacacgtgtactaccgccccgtgccgcgcgcgggcggcgtggtcctgctcccggtggcgccgccttctccgcaggctcctccagcaacctccttgtcgttgtccctctccctgccagggctggaccagcagcccgaaccatccccgccgccgccgccaacacctcaagcacaagcaagctcgccgttgagcgcggagttcctgttgatgatgcaggagatgatccggatcgaggtccggaactacatgtccgggtcgggcttcgacgcacacgccgtgatgggcatggccgagatcgactagtttcagcggcaggggtccaagaccaagac

SEQ ID NO: 5076 - DNA, 328 bp, Artificial Sequence
  P27085 (PR4XW2BOX::4XSBOX::M35S::G1792(-UTR))
ttattcagccatcaaagttgaccaataattctagtttattcagccatcaaagttgaccaataattctagtttattcagccatcaaagttgaccaataattctagtttattcagccatcaaagttgaccaataattctagtcagccaccaaagaggacccagaattctagtcagccaccaaagaggacccagaattctagtcagccaccaaagaggacccagaattctagtcagccaccaaagaggacccagaattctagagcggcccgcaagacccttcctctatataaggaagttcatttcatttggagaggacacgctgcggccgc

SEQ ID NO: 5077 - DNA, 342 bp, Artificial Sequence
  P27086 (PR4XW2BOX::2XSBOX::2XDBOX::M35S::G1792(-UTR))
ttattcagccatcaaagttgaccaataattctagtttattcagccatcaaagttgaccaataattctagtttattcagccatcaaagttgaccaataattctagtttattcagccatcaaagttgaccaataattctagtcagccaccaaagaggacccagaattctagtcagccaccaaagaggacccagaattctagttacaattcaaacattgttcaaacaaggaacctctagttacaattcaaacattgttcaaacaaggaacctctagagcggcccgcaagacccttcctctatataaggaagttcatttcatttggagaggacacgctgcggccgc

SEQ ID NO: 5078 - DNA, 202 bp, Artificial Sequence
  P27087 (PR2XSBOX::2XDBOX::M35S::G1792(-UTR))
cagccaccaaagaggacccagaattctagtcagccaccaaagaggacccagaattctagttacaattcaaacattgttcaaacaaggaacctctagttacaattcaaacattgttcaaacaaggaacctctagagcggcccgcaagacccttcctctatataaggaagttcatttcatttggagaggacacgctgcggccgc

SEQ ID NO: 5079 - DNA, 1194 bp, Artificial Sequence; identical to SEQ ID NO: 4991
  P27199 (PRAT4G21390::G1792(-UTR))

SEQ ID NO: 5080 - DNA, 1165 bp, Artificial Sequence; identical to SEQ ID NO: 5005
  P27201 (PRAT1G57630::G1792(-UTR))

SEQ ID NO: 5081 - DNA, 578 bp, Artificial Sequence
  P27228 (35S::G3866(L102A))
tataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatgcgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaa

SEQ ID NO: 5082 - DNA, 1319 bp, Artificial Sequence
  P27229 (35S::G3866(L102A)::GFP)
tataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatgcgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactgcggccgcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctctag

SEQ ID NO: 5083 - DNA, 709 bp, Artificial Sequence; identical to SEQ ID NO: 2249
  P27404 (35S::G4000)

SEQ ID NO: 5084 - DNA, 741 bp, Artificial Sequence
  P27405 (35S::G4011)
gatgggtggcgaggcggagcggtgcgcgctctgtggcgcggcggcggcggtgcactgcgaggcggacgcggcgttcctgtgcgcggcgtgcgacgccaaggtgcacggggcgaacttcctcgcgtcgcggcaccaccggaggcgggtggcggccggggcggtggtggtggtggaggtggaggaggaggaggggtatgagtccggggcgtcggcggcgtcgagcacgtcgtgcgtgtcgacggccgactccgacgtggcggcgtcggcggcggcgaggcgggggaggaggaggaggccgagggcagcggcgcggccccgcgcggaggtggttctcgaggggtggggcaagcggatgggcctcgcggcgggggcggcgcggcggcgcgccgcggcggccgggcgcgcgctccgggcgtgcggcggggacgtcgccgccgcgcgcgtcccgctccgcgtcgccatggcggccgcgctgtggtgggaggtggcggcccaccgcgtctccggcgtctccggcgccggccatgccgacgcgctgcggcggctggaggcgtgcgcgcacgtgccggcgaggctgctcacggcggtggcgtcgtcgatggcccgcgcgcgcgcaaggcggcgcgccgccgcggacaacgaggagggctgggacgagtgctcgtgttctgaagcgcccaacgccttgggtggcccacatgtcagtgacacagctcgtcagaaatgatacttatgcagagg

SEQ ID NO: 5085 - DNA, 676 bp, Artificial Sequence
  P27406 (35S::G4012)
tgtaatggaggtcggcaacggcaagtgcggcggtggtggcgccgggtgcgagctgtgcgggggcgtggccgcggtgcactgcgccgctgactccgcgtttctttgcttggtatgtgacgacaaggtgcacggcgccaacttcctcgcgtccaggcaccgccgccgccggttgggggttgaggtggtggatgaggaggatgacgcccggtccacggcgtcgagctcgtgcgtgtcgacggcggactccgcgtcgtccacggcggcggcggcggcggcggtggagagcgaggacgtcaggaggagggggcggcgcgggcggcgtgccccgcgcgcggaggcggttctggaggggtgggcgaagcggatggggttgtcgtcgggcgcggcgcgcaggcgcgccgccgcggccggggcggcgctccgcgcggtgggccgtggcgtcgccgcctcccgcgtcccgatccgcgtcgcgatggccgccgcgctctggtcggaggtcgcctcctcctcctcccgtcgccgccgccgccccggcgccggacaggccgcgctgctccggcggctggaggccagcgcgcacgtgccggcgaggctgctcctgacggtggcgtcgtggatggcgcgcgcgtcgacgccgcccgccgccgaggagggctgggccgagtgctcctgatcc

SEQ ID NO: 5086 - DNA, 787 bp, Artificial Sequence
  P27428 (35S::G4299)
aatggaacttctgtcctctaaactctgtgagctttgcaatgatcaagctgctctgttttgtccatctgattcagcttttctctgttttcactgtgatgctaaagttcatcaggctaatttccttgttgctcgccaccttcgtcttactctttgctctcactgtaactcccttacgaaaaaacgtttttccccttgttcaccgccgcctcctgctctttgtccttcctgttcccggaattcgtctggtgattccgatctccgttctgtttcaacgacgtcgtcgtcgtcttcgtcgacttgtgtttccagcacgcagtccagtgctattactcaaaaaattaacataatctcttcaaatcgaaagcaatttccggacagcgactctaacggtgaagtcaattctggcagatgtaatttagtacgatccagaagtgtgaaattgcgagatccaagagcggcgacttgtgtgttcatgcattggtgcacaaagcttcaaatgaaccgcgaggaacgtgtggtgcaaacggcttgtagtgtgttgggtatttgttttagtcggtttaggggtctgcctctacgggttgccctggcggcctgtttttggtttggtttgaaaactaccgaagacaaatcaaagacgtcgcaatctttgaagaaattagaggagatctcgggtgtgccggcgaagataatattagcaacagaattaaagcttcgaaaaataatgaaaaccaaccacggccaacctcaagcaatggaagaaagctgggctgaatcctcgccctaa

SEQ ID NO: 5087 - DNA, 1009 bp, Artificial Sequence
  P5284 LEAF-SPECIFIC RBCS3 PROM. DRIVER CONSTRUCT
aaatggagtaatatggataatcaacgcaactatatagagaaaaaataatagcgctaccatatacgaaaaatagtaaaaaattataataatgattcagaataaattattaataactaaaaagcgtaaagaaataaattagagaataagtgatacaaaattggatgttaatggatacttcttataattgcttaaaaggaatacaagatgggaaataatgtgttattattattgatgtataaagaatttgtacaatttttgtatcaataaagttccaaaaataatctttaaaaaataaaagtacccttttatgaactttttatcaaataaatgaaatccaatattagcaaaacattgatattattactaaatatttgttaaattaaaaaatatgtcattttattttttaacagatattttttaaagtaaatgttataaattacgaaaaagggattaatgagtatcaaaacagcctaaatgggaggagacaataacagaaatttgctgtagtaaggtggcttaagtcatcatttaatttgatattataaaaattctaattagtttatagtctttcttttcctcttttgtttgtcttgtatgctaaaaaaggtatattatatctataaattatgtagcataatgaccacatctggcatcatctttacacaattcacctaaatatctcaagcgaagttttgccaaaactgaagaaaagatttgaacaacctatcaagtaacaaaaatcccaaacaatatagtcatctatattaaatcttttcaattgaagaaattgtcaaagacacatacctctatgagttttttcatcaatttttttttcttttttaaactgtatttttaaaaaaatattgaataaaacatgtcctattcattagtttgggaactttaagataaggagtgtgtaatttcagaggctattaattttgaaatgtcaagagccacataatccaatggttatggttgctcttagatgaggttattgctttaggtgaaa

SEQ ID NO: 5088 - DNA, 1183 bp, Artificial Sequence
  P5287 EPIDERMAL AND VASCULAR-SPECIFIC LTP1 PROM. DRIVER CONSTRUCT
gatatgaccaaaatgattaacttgcattacagttgggaagtatcaagtaaacaacattttgtttttgtttgatatcgggaatctcaaaaccaaagtccacactagtttttggactatataatgataaaagtcagatatctactaatactagttgatcagtatattcgaaaacatgactttccaaatgtaagttatttactttttttttgctattataattaagatcaataaaaatgtctaagttttaaatctttatcattatatccaaacaatcataatcttattgttaatctctcatcaacacacagtttttaaaataaattaattaccctttgcatgataccgaagagaaacgaattcgttcaaataattttataacaggaaataaaatagataaccgaaataaacgatagaatgatttcttagtactaactcttaacaacagttttatttaaatgacttttgtaaaaaaaacaaagttaacttatacacgtacacgtgtcgaaaatattattgacaatggatagcatgattcttattagagtcatgtaaaagataaacacatgcaaatatatatatgaataatatgttgttaagataaactagacgattagaatatatagcacatctatagtttgtaaaataactatttctcaactagacttaagtcttcgaaatacataaataaacaaaactataaaaattcagaaaaaaacatgagagtacgttagtaaaatgtatttttttggtaaaataatcacttttcatcaggtcttttgtaaagcagttttcatgttagataaacgagattttaattttttttaaaaaaagaagtaaactaactatgttcctatctacacacctataattttgaacaattacaaaacaacaatgaaatgcaaagaagacgtagggcactgtcacactacaatacgattaataaatgtattttggtcgaattaataactttccatacgataaagttgaattaacatgtcaaacaaaagagatgagtggtcctatacatagttaggaattaggaacctctaaattaaatgagtacaaccaccaactactccttccctctataatctatcgcattcacaccacataacatatacgtacctactctatataacactcactccccaaactctcttcatcatccatcactacacacatc

SEQ ID NO: 5089 - DNA, 1176 bp, Artificial Sequence
  P5288 EPIDERMAL-SPECIFIC CUT1 PROM. DRIVER CONSTRUCT
tgtgaattatattttactcttcgatatcggttgttgacgattaaccatgcaaaaaagaaacattaattgcgaatgtaaataacaaaacatgtaactcttgtagatatacatgtatcgacatttaaacccgaatatatatgtatacctataatttctctgattttcacgctacctgccacgtacatgggtgataggtccaaactcacaagtaaaagtttacgtacagtgaattcgtctttttgggtataaacgtacatttaatttacacgtaagaaaggattaccaattctttcatttatggtaccagacagagttaaggcaaacaagagaaacatatagagttttgatatgttttcttggataaatattaaattgatgcaatatttagggatggacacaaggtaatatatgccttttaaggtatatgtgctatatgaatcgtttcgcatgggtactaaaattatttgtccttactttatataaacaaattccaacaaaatcaagtttttgctaaaactagtttatttgcgggttatttaattacctatcatattacttgtaatatcattcgtatgttaacgggtaaaccaaaccaaaccggatattgaactattaaaaatcttgtaaatttgacacaaactaatgaatatctaaattatgttactgctatgataacgaccatttttgtttttgagaaccataatataaattacaggtacgtgacaagtactaagtatttatatccacctttagtcacagtaccaatattgcgcctaccgggcaacgtgaacgtgatcatcaaatcaaagtagttaccaaacgctttgatctcgataaaactaaaagctgacacgtcttgctgtttcttaatttatttctcttacaacgacaattttgagaaatatgaaatttttatatcgaaagggaacagtccttatcatttgctcccatcacttgcttttgtctagttacaactggaaatcgaagagaagtattacaaaaacatttttctcgtcatttataaaaaaatgacaaaaaattaaatagagagcaaagcaagagcgttgggtgacgttggtctcttcattaactcctctcatctaccccttcctctgttcgcctttatatccttcaccttccctctctcatcttcattaactcatcttcaaaaatacc

SEQ ID NO: 5090 - DNA, 2244 bp, Artificial Sequence
  P5290 VASCULAR-SPECIFIC SUC2 PROM. DRIVER CONSTRUCT
aactaggggtgcataatgatggaacaaagcacaaatcttttaacgcaaactaactacaaccttcttttggggtccccatccccgaccctaatgttttggaattaataaaactacaatcacttaccaaaaaataaaagttcaaggccactataatttctcatatgaacctacatttataaataaaatctggtttcatattaatttcacacaccaagttactttctattattaactgttataatggaccatgaaatcatttgcatatgaactgcaatgatacataatccactttgttttgtgggagacatttaccagatttcggtaaattggtattcccccttttatgtgattggtcattgatcattgttagtggccagacatttgaactcccgtttttttgtctataagaattcggaaacatatagtatcctttgaaaacggagaaacaaataacaatgtggacaaactagatataatttcaacacaagactatgggaatgattttacccactaattataatccgatcacaaggtttcaacgaactagttttccagatatcaaccaaatttactttggaattaaactaacttaaaactaattggttgttcgtaaatggtgctttttttttttgcggatgttagtaaagggttttatgtattttatattattagttatctgttttcagtgttatgttgtctcatccataaagtttatatgttttttctttgctctataacttatatatatatatgagtttacagttatatttatacatttcagatacttgatcggcattttttttggtaaaaaatatatgcatgaaaaactcaagtgtttcttttttaaggaatttttaaatggtgattatatgaatataatcatatgtatatccgtatatatatgtagccagatagttaattatttgggggatatttgaattattaatgttataatattctttcttttgactcgtctggttaaattaaagaacaaaaaaaacacatacttttactgttttaaaaggttaaattaacataatttattgattacaagtgtcaagtccatgacattgcatgtaggttcgagacttcagagataacggaagagatcgataattgtgatcgtaacatccagatatgtatgtttaattttcatttagatgtggatcagagaagataagtcaaactgtcttcataatttaagacaacctcttttaatattttcccaaaacatgttttatgtaactactttgcttatgtgattgcctgaggatactattattctctgtctttattctcttcacaccacatttaaatagtttaagagcatagaaattaattattttcaaaaaggtgattatatgcatgcaaaatagcacaccatttatgtttatattttcaaattatttaatacatttcaatatttcataagtgtgattttttttttttttgtcaatttcataagtgtgatttgtcatttgtattaaacaattgtatcgcgcagtacaaataaacagtgggagaggtgaaaatgcagttataaaactgtccaataatttactaacacatttaaatatctaaaaagagtgtttcaaaaaaaattcttttgaaataagaaaagtgatagatatttttacgctttcgtctgaaaataaaacaataatagtttattagaaaaatgttatcaccgaaaattattctagtgccactcgctcggatcgaaattcgaaagttatattctttctctttacctaatataaaaatcacaagaaaaatcaatccgaatatatctatcaacatagtatatgcccttacatattgtttctgacttttctctatccgaatttctcgcttcatggtttttttttaacatattctcatttaattttcattactattatataactaaaagatggaaataaaataaagtgtctttgagaatcgaacgtccatatcagtaagatagtttgtgtgaaggtaaaatctaaaagatttaagttccaaaaacagaaaataatatattacgctaaaaaagaagaaaataattaaatacaaaacagaaaaaaataatatacgacagacacgtgtcacgaagataccctacgctatagacacagctctgttttctcttttctatgcctcaaggctctcttaacttcactgtctcctcttcggataatcctatccttctcttcctataaatacctctccactcttcctcttcctccaccactacaaccacca

SEQ ID NO: 5091 - DNA, 1326 bp, Artificial Sequence
  P5297 FRUIT-SPECIFIC POLYGALACTURONASE (PG prom. HIGH EXPRESSION) PROM. DRIVER CONSTRUCT
accaatgcgctatatattaatcaacttgataatataaaaaaaatttcaattcgaaaagggcctaaaatattctcaaagtattcgaaatggtacaaaactaccatccgtccacctattgactccaaaataaaattattatccacctttgagtttaaaattgactacttatataacaattctaaatttaaactattttaatacttttaaaaatacatggcgttcaaatatttaatataatttaatttatgaatatcatttataaaccaaccaactaccaactcattaatcattaaatcccacccaaattctactatcaaaattgtcctaaacactactaaaacaagacgaaattgttcgagtccgaatcgaagcaccaatctaatttaggttgagccgcatatttaggaggacactttcaatagtatttttttcaagcatgaatttgaaatttaagattaatggtaaagaagtagtacatcccgaattaattcatgccttttttaaatataattatataaatatttatgatttgttttaaatattaaaacttgaatatattatttttttaaaaattatctattaagtaccatcacataattgagacgaaggaataattaagatgaacatagtgtttaattagtaatggatgggtagtaaatttatttataaattatatcaataagttaaattataacaaatatttgagcgccatgtattttaaaaaatattaaatagtttgaatttaaaaccgttagataaatggtcaattttgaacccaaaagtggatgagaagggtattttagagccaatagggggatgagaaggatattttgaagccaatatgtgatggatgaaggataattttgtatcatttctaatactttaaagatattttaggtcattttcccttctttagtttatagactatagtgttagttcatcgaatatcatctattatttccgtcttaaattattttttattttataaattttttaaaaataaattattttttccatttaactttgattgtaattaatttttaaaaattaccaacatataaataaaattaatatttaacaaagaattgtaacataatatttttttaattattcaaaataaatatttttaaacatcatataaaagaaatacgacaaaaaaattgagacgggagaagacaagccagacaaaaatgtccaagaaactctttcgtctaaatatctctcatccaaactaatataatacccattataattaaccatattgaccaactcaaaccccttaaaatctataaatagacaaacccttcccatacctcttatcataaa

SEQ ID NO: 5092 - DNA, 1242 bp, Artificial Sequence
  P5303 FRUIT-SPECIFIC PHYTOENE DESATURASE (PD prom. MODERATE EXPRESSION) PROM. DRIVER CONSTRUCT
acgtgtaatagctaccatacaagagaagtaactcgcactgtccatgtcttatgtggctcgactcagaaagcattcagggggattgataaccaccctccaaaccaactgaaccattgtgaataaccacccttcaaatcaaccgagtcctcgtgaaggacaaatatgtggttttatatacattaaattttgtttttacatgcttcctcttacttctttagttttcttgaccatatcttgcgtttttcccttctgtaattgacacttttcttcaaaccatccagcaatgtggaagcttgacgattttccttcagagtagaaattgaaaagaatcaactaaaaaggatagtccttcgatttgatttccggcttaaaaataaactaataagaatgagagagcgaataatagaatattttgaaattttaaagatattcaactatgttaaattgcgttataaatttcttaaattagtagcacctaatagtttagttctcaaaagtcaaaactactacataatgtgctcatttttcacattaaaatgcctacatgatgtaaaagtaaaactcgtagcattctacgtgttttactcaactcaaacatcctgttcattttaataaacgtacgatgagcttctctctccaattttcttttcttttttttttttaaaaaaatatttttttttatatcaatccaaatgggctccaatttatcataaattaggtagaaacttagatattaaagaaagaaaagggtttatctcgcaagtgtggctatggtgggacgtgtcaaattttggattgtagccaaacatgagatttgatttaaagggaattggccaaatcaccgaaagcaggcatcttcatcataaattagtttgtttatttatacagaattatacgcttttactagttatagcattcggtatctttttctgggtaactgccaaaccaccacaaatttcaagtttccatttaactcttcaacttcaacccaaccaaatttatttgcttaattgtgcagaaccactccctatatcttctaggtgctttcattcgttccgaggtaagaaaagatttttgtttctttgaatgctttatgccactcgtttaacttctgaggtttgtggatcttttaggcgactttttttttttttgtatgtaaaatttgtttcataaatgcttctcaacataaatcttgacaaagagaaggaattttaccaagtatttaggttcagaaatggataa

SEQ ID NO: 5093 - DNA, 922 bp, Artificial Sequence
  P5310 ROOT-SPECIFIC RSI1 PROM. DRIVER CONSTRUCT
caatcaactaaatggacttttcttgtgcattggtcccatttttacgccctaatattcgcttacttgcttttttgtattttatttattttagttttaattttatctacctccaaattgatagaaataattacacttatagtccttttgaaaaattataattatagcattcaagtaaataaaaatacgtatttttagtcactttgtaatgtataattttgagttgaaaatgtatcaaaagtaaatttatattcttaagatatggataaagtttacatatacattatccgtttcataccctatttatagtattacattgcataagttattgtagatcttgatcgaaagtatgtgatattaatactatttttagaattatgttattctcagttatggagtgatatttaaaatcaatatagtatatcgataatcagatagtttaattcttattttctccatccaatttatataatgatattataatcaattttacgaatgagatggatattttgaaatttttagtttaaaataaattttaaattttttgtgggtctataaattatctaattaagaggtaaaatagaaagtttgaaattaattattacttactaaatatataaatatgtcattttttcttaaactgatttagaagaaaagagtgtcatatacatggacagaacgaatataatttgataattaaatttgtaaagattcatagttaatagggatcaaaattgcacgtatccattactataaggtcatatttgcttcataaaaatcatcaggatcaaaaatcagaatttatattatatttgagggactaaaaatgctaatatcacaaattaaaattagtctataaatattcacactttactcttctaattccatcaaatatttccatttatcttctcttcttcttaaatat

SEQ ID NO: 5094 - DNA, 2365 bp, Artificial Sequence
  P5311 ROOT-SPECIFIC ARSK1 PROM. DRIVER CONSTRUCT
ggcgagtgatggtatatttattggttgggcttaaatatatttcagatgcaaaaccatattgaatcaataaattataaatacatagcttccctaaccacttaaaccaccagctacaaaaccaataaacccgatcaatcattatgttttcataggatttcctgaacatacattaaattatttttcattttcttggtgctcttttctgtcttattcacgttttaatggacataatcggtttcatattgtaaatctctttaacctaacgaacaatttaatgaccctagtaataggataagaaggtcgtgaaaaatgaacgagaaaaaacccaccaaaacactatataagaaagaccgaaaaagtaaaaagggtgagccataaaccaaaaaccttaccagatgttgtcaaagaacaaaaatcatcatccatgattaacctacgcttcactactaagacaaggcgattgtgtcccggttgaaaaggttgtaaaacagtttgaggatgctacaaaagtggatgttaagtatgaagcggctaaggttttggatttggtctaggagcacattggttaagcaatatcttcggtggagattgagtttttagagatagtagatactaattcatctatggagacatgcaaattcatcaaaatgcttggatgaattagaaaaactaggtggagaatacagtaaaaaaattcaaaaagtgcatattgtttggacaacattaatatgtacaaatagtttacatttaaatgtattattttactaattaagtacatataaagttgctaaactaaactaatataatttttgcataagtaaatttatcgttaaaagttttctttctagccactaaacaacaatacaaaatcgcccaagtcacccattaattaatttagaagtgaaaaacaaaatcttaattatatggacgatcttgtctaccatatttcaagggctacaggcctacagccgccgaataaatcttaccagccttaaaccagaacaacggcaaataagttcatgtggcggctggtgatgattcacaatttccccgacagttctatgataatgaaactatataattattgtacgtacatacatgcatgcgacgaacaacacttcaatttaattgttagtattaaattacatttatagtgaagtatgttgggacgattagacggatacaatgcacttatgttctccggaaaatgaatcatttgtgttcagagcatgactccaagagtcaaaaaagttattaaatttatttgaatttaaaacttaaaaatagtgtaatttttaaccacccgctgccgcaaacgttggcggaagaatacgcggtgttaaacaatttttgtgatcgttgtcaaacatttgtaaccgcaatctctactgcacaatctgttacgtttacaatttacaagttagtatagaagaacgttcgtacctgaagaccaaccgacctttagttattgaataaatgattatttagttaagagtaacaaaatcaatggttcaaatttgtttctcttccttacttcttaaattttaatcatggaagaaacaaagtcaacggacatccaattatggcctaatcatctcattctcctttcaacaaggcgaatcaaatcttctttatacgtaatatttatttgccagcctgaaatgtataccaaatcatttttaaattaattgcctaaattattagaacaaaaactattagtaaataactaattagtcttatgaaactagaaatcgagatagtggaatatagagagacaccattaaattcacaaaatcatttttaaattacctaaattattacaacaaaaactattagacagaactaagtctataatgaaacgagagatcgtatttggaatgtagagcgagagacaattttcaattcattgaatatataagcaaaattatatagcccgtagactttggtgagatgaagtctaagtacaaacaactgaatgaatttataatcaataatattgattatattgtgattagaaaaagaaaacaacttgcgttatttttcaatattattgtgaggattaatgtgaacatggaatcgtgtttctcctgaaaaaaatatcagcatagagcttagaacaatataaatatatccaccaaaaataacttcaacatttttatacaactaatacaaaaaaaaaaaagcaaactttttgtatatataaataaatttgaaaactcaaaggtcggtcagtacgaataagacacaacaactactataaattagaggactttgaagacaagtaggttaactagaacatccttaatttctaaacctacgcactctacaaaagattcatcaaaaggagtaaaagactaactttctc

SEQ ID NO: 5095 - DNA, 4361 bp, Artificial Sequence
  P5318 APICAL MERISTEM-SPECIFIC STM PROM. DRIVER CONSTRUCT
agaatgtagcaatacaaatatatgacggtaccgttatccatcaccattatatgtatatatgtataatttgataaatattcactttgtgtttcgtcgtttgcttaataaacagctcatttccatggtattgagtcttctatatgcgagagaatcagattcccgctgggataacaaaagaacaaggtactgaaaaaaatagacaaaacttttttttaaattatataagctataaaagaaaagagtatagagagagattagccctactgtttaagagggagagagtagggtcattagggctttagagagagaagacattcggactgtccccacttgcttttctgtagaataacattatttaaatcttatttttaattaaatattacaactaaaagaagaaaccaacttttaaaataaatgcagattatatgctctgacttggactaaataaaacttgcaagtaacagtttcaagtccttttgttttagaactttttctttcgtagaagtgataaatgattgccctagacctgatagattctctaaaattctacgtattacagcataagttacctcctttatttgactattagaccatccatattggtgggcttttagcaaatgttcttaacaataattttataatttattttaatgttaagaggtttgataattttttttttttaagagtgtattttgtttattaaaatgtgttttgtttcttatataagaaccaaatcttaactattttaccaattaaacattaaatttaaattttaatatctctaagaattatattaagagccaatatagatgcttttaaaaccattggttgaataaataaatctaaccttcttaattatttctgtgtgaatattttctaaattttcattttaatttagcacaatataatccatgttctaaaaagaacaattaacataatatttacaaacctaaaaagattataaaacacaattttattttttacagcttataatgttttaaagttcaggtttattttttaaaagttcaggtttattacattaggtttgacttgtaatcatcatttatcacaacgatcaaactattattacaatcacaatagtagacaaaatttaggatatatatatatatatataattatgtataaactatgaacatttaaagtgagatttttcaaaataatatataaattcaaatagaaatagactatttggttcttaaatgagagacccccgaaaaaatctttttttttttctcatcaagctgtttacatttttagatataaaatcatattctttatagtttagaatatgaattaaatagttttatatgttattaacttatcataagatatgcgtgaggttggccaaaaactcatcaattaaccaaataagaaaagtaaaattgtattttgctttgctaaaaatgtaaatatttcattgaaaaatgaaaaaggtttaggtaatacaattaagtaaatcctacaattttggttccatggcaaaagaataaaattgtattgctttggtaaaagttgatccaactaatatattcagtagaaactgcaaaactgaagaaataagtttgtttagtagaattgctttcggttatgtaatgaatatacatccaaaatggctttttagtaatgatgtcttttcatactctttccaatccctactactttcagattatttgtcctactattatagagatatacgttcgttttcaataatatgaaaagtgatatatatttaaatagtgtgatatatatataagttttgcaagtgcatcacttcccaaaatcgcataaatcattaatcatattgtcgaaaacagtataataacttcttaaacgaaaacgcagcgcaattaaaaataacaactagagataattgacaaaacattgattaatatttacctataagttaattattgtatttaaaatttatttaaagttcataaggaaaacatatgcaaaaatatttatatctaatattttgctatgttatccttttttttttttacgttatcctaattttgtttatcctaatttgttgtggttaaaatcttattattgataaaaagagaacttttttttttgtcatcataaaaaagagaacttattacttcgattttaaaattctatgagcgtaggagacaaagaaaaaaaaaataaaaaaaaaaagaagagaaaaatcacttcttttcttctttttagtccagatccaacatattttggataactaaatgaagattttttaaaaaaatatattttagggtatatataaatcataatttgaagcaaatgaaataaaatccagtttggtaatatataaatatgatttgatgggttccttgtaatctctctctatctattagtttctcagttatcttttctttgccagaaatggcagtgaaggcagtggctgaggagagagttttttttcttctttcatggggaaagtaaaactttgccttgaagatttctctcttcaatatttttctaagacttttgatttcaacgaatcactgtccttaacctaaaagcaagaaaaattagctttatactggtctttacttttttttaacatatttatttttatatagtttacttataaacatagacatacgagtatgggaatatatagtatatccaacttctaaataatatttcgaatagtgataacaaaattagcaatacatacggctagtgaaatgttgatcgaataaacggcactgatgtaatgtacttatcaattttgataattttaattgtattgtttttctttttttcccacagtattgaactagacaattaaatttaaagtaaaattatacatttctttcgttgtgtattaaagtaacatgcataatatcattttccttcgtacaatcctccaaattgacaattgatgaattactttgtcaatcgtaaatgaatttttctcaagtctgtatactattttcagggataaacaggtacaggtgtcccatgcttattctcttgatagtaacatgtgtcctatgttgagtcaattctacgttcgaagaagtgctaacaattgttaatagcctcgtatattattctaattaaaatgcctcgatagatttggttagtggtctgaatgtgattggttattttttcaagtggcaagaggtctaccatctaatattacaatcaatcgaccaaaaaggtcgagaacatgataatggtggcaaatacaaatggttcattgttgtctaatataacaagccatcagttgtcactttttaaaaacaatacagaatacaagatactttttttttaaggtaaaatgtgtgtttaatattttcgtttatataacaaataaacagttacatgttttactctatgattatatttatgacatttttcttcttcttaacaacatttttttcccataagaacatttacaatagtattaaaactttgattgcaatcaaatgttagatcacttattataaaattactaagactgctatcttttcctattgacaaaagcgaatccaatatatgttactgaaacaaatgcgtaaattatactatatggagatctatcggttaattattgagagaatctaagaaagtttttgagtacaacagtcctaataatatcttcacataccatataatatacatatatacatatacacaaatgtactttttaaaccaacatcagcatacgtatatcccatcaggaaacttagacttttgggaattcatggtatgaaaaccaaaaccaaatgacaacattcgatttgatactcccgacccatggtaaagaaataacaaattccaatatatctttcactggactttccgaggcacattccggttttctccatttcaagaaattgtcaaaaataaattgagatccggtttattacctcaaaaaagaagaagagaaattacaacattaatttccgaaaaggcataaatgagaaatcatatttcagcagaagaacacaaaagagttaagaacccacagatcacacaacctctgtccatgtctgctttttacacttttttaaaataagtttctcctaaaaagttatttcctatttataataatttccttagatttatcttcctggtctctcttctgctgcttccctctcccccataactatcactatttagaattttcaatgtggaaaaggaagctgattgttgaagcataaatcccgggagaccacttttgcattttcaaataattaaattaaaccatagatacacacacacagttacttactcttttagggtttcccaataaatttatagtactttaatgtgtttcatgatattgatgataaatgctagctgtatttacaatgggggctcct

SEQ ID NO: 5096 - DNA, 4801 bp, Artificial Sequence
  P5319 EMERGENT PRIMORDIA-SPECIFIC AS1 PROM.
ggaccgtgtaatgggccattgggccaagttttcttgatataaaatctgaaatactactaaattacaatttttcttaaactcgatttcataattcatgtgggactcagttctccgcgtcttatgacttaagagttaagagtaaagacaattgattgtagtttgcattattaaggttgtgattttaaaggctatattggcccaggcaaagtggttatgaaagttaaaaggtattattaaatgtcgttatggactagctaaagaaaagagatggatatagaaacggatttgccagtttgtgaggttacgtactcgttactttctattgcatttttgtgtgtcattgtgcttgtgatttctttagtatatgtttttctttttgtcaaactctttagtacatgttatgctttattttcttgtttagcattgttattgttattttgatccatgttcttttacttaatgtgtagagtgttcacgtacgactctttatgatcgctatactaatatactatgaaactcgaatgagaacatgcatgtcataaatcaataaaacataacatacgacacttaacctaaatcatacattcattgattcatactatcatgatcctcatcacattagtatcatttgtctttatttattacttagctacttcgttatcttattatatctttacctgttctgctggtcatttgccataaacaccaagtacaagcaactctttagtccaatatcagaccaaattaacaaacatttccccaatccaaaacggaaatttaattataattagcatttaaataggttcgattacaaaaaaaaatcaacaaaggaacaagtcaatttcataatggtttgtcaattgtcacacaacgaaatggctagccggatcaagcatgcatgatccaaatttcaacatttccatgataacctgaattataacgtctacataaaccatatttaaataaataggatggtcgaaagatatcattaaaagaacgattcaatattctttattgttcaattgatacacatgttattctccttaaccagttatgaacatgtcctacaagtttcttgacccaaactcataatttcatataccataatcccaagttaagttttttttttttggggatcaaaatctcaagttaagttaagttcaattatttagctgtaatgctcggaaaaaagatcggatgaatatccaattggttcaatatataccccaatccggccaatctccctatctttatagcttaattattagagaatggtcaattcacgccatcagaaccagtttcatatcttcatgaaccaaaacgcctacaaccctattattcaagaaatcactataattgtccaagtaaaaccattaattaaccgagtcgatttttctatggtcctataggcatgttgttactcaaactactgattaattaataagaagttgtagtttgaaaaagaatctagctgaaaaatactcctactctaagaatttaagttagaataaaacatattaatacaaatataaaaatttagttattaaaaaagcgctactaccaagacgtcctaaagaaaaactagctttgtcttctaaaagaaaacctagcttaactacccaaaaaaatctagttttacaaacactaaagacaaattttatttttcaacaaatttaccaattaaagaaaattccatgtaggaatgtatccaaattgaaaatatccctacatattttgtaggaaaaaaggtttttataaatattaaaaaaacgagaaaaagaaaagagaaaagagaaaaaaaaaagccggagagaatggagcacatgaggtaaaaggcaagagatggcagagagaagatcagagaagggatctgcctcaatttgacaactcatatgtcatgtcatttccctcactactattattttcctatttcaaaaacacctttctctgataccatcaccttttaccttctctttttttttactgtctttgctctgtttcacattcccttctatatatacagtatagtatattttatccttcttttattgttttgcttactaaaagtttttttcctccggaatcaaaattctaaaatgtatatcatgttaggtcgcgagggccatgcaatattatgaactatgcatgatgattaatgtctgtggatccatcacaaatattattgaaggttgatcagagactatggaccaaaatggtccgaatcgcctgataataaaaaactattcatttttattttttattttttttattaaacatgtgattaatgatagatcttacgattcgcaactgggaaacatgcactaactcaaacttaaaacacacaatactaaaagttctattaaattttgaatgtaaagagaaatatattaggcaatcaaacggtcaagtaaatcatacacatcgataatttatttttttatccttcaaagcaggcccatccaaggcccaccactattctcatatcaacatacttttcttgttttggttaaatcaacctaccatgttggctgttctctccgctcctctgtgtaagatcacaccaacaccactgcataatttcttgtattattttgagacttgagagtaaactgattgacaaaaaaaaaaaaaaaaaaaaaaaattgagagtaaactagtttcttgaatattgattttttcagcttaatttgttggggaaagatattactactattgctgtaaaaaaaaaaaaaaaaaaaaaagatattattactatatttgtagtgattttattttgaaaattctcttcacttttttgtagttaacattctaattttgtgaaaagaacttttaatgtcaggtcatgtctcttaaaaagtttgcatgatgaaatgatttacaaattacaatagaaaatggaaaccattgcaaactaaatttttatcaaaaaaaatcgaaaataaaatgtattgacttagtaatgctgtgtctgctacgattaactattacacataatgcaacactgaattatccaaatacattattagaataatagtattacagtatcactattacaacaacaatgtcaacaataatcttattataataatatataaatagaccttagtgacatcatattatatagaaaacatgtggttgcctaatttgtataagctagatacttgggggtgatgagtgactagttgatgcaatgataaaagagtgaaagttttgtctgcctgattatagacgtcggagaaatactaaaatacgctatgaagattttggcgcatggtagcagaaaaaaaaaacggagggtgtgagtgagtagtggtagtcggatgtgatggaacaaagaaaagtatttttggtagggttatgggagagagaaggggaccattattacacacttacatgctttccccaaaagataccattcccattttctgacacgtgtccccctcatccccaattactcatacgtcaaatccaatttttagcctaaaagttttttttatttgtttagccaaatctattttactaattaaagttttcaaatggcaaatagaaagatcttctaaggttttataaaattacttgattatttctagttttgctcattttttaaataaaatttctcttttttttcttgcaacattattgattttttttttgatagggagtaacattagtgatgttctatctcttctcattgcaaaaactttattttctcatctctatttgatcatcattgcgaaatcttccattttcaacaaatacttttccatgttaatatgctgtttcaaaatataagtgtttggaaaataaatcaacaagtttaaatgttaactatttttatgctattataattatttttcttatgggtaagtggaaattaatgttactcaaattggacataaaattctattgtttgagtgaaggagtttataaatggagcattattttcttgaatggttagtttttcttctatcattttgacaagtaaatgacttttcagccactaaagtacaacactttttcatttaaatttaaagcatcccctacattagattgtcattttatttctcataatgttatagaaaaatgaattttgagatcccaatgtagtaaatatatataaaaaaaggtttaatattgtcaatgacaaacaacgaacttatggaatttcaacttttcacctccacgcgcctctgtcagagttttttttttccccacttgtgatgtaaaaaggggaaaacgtctgtgtctcagtcggtaaactttttctctctttttttttttaaagattttattttaattatgccgtctctgtggtctaatcgtgtacgtcgtctggttttaaaagcctctctcactttggtcttttcgttttctctcttccattttctccaactatataaaaaaaaaaaagtgagagagagagcaaatctgtgtgatggaagttgctcttgagtttgggattatttatcttttcaatatcatttggtaagcatttttattttgttttatagtaataattttaactctcttatcttcttaataagtctttgcttaatagtgttttggggtcagcattaatttcccctgtttggtttccagaatataggttgtatagtgtgataataacaaattattccaagttttgcttcaaacattgtcaaagtttttgtcattttcatttcttgaaacggaaatttttcagactttgtaatttctaattcgaaaattcgacagatcttgtagatttgtttcgatcttttagagttttgaattggagagatttatgaaacgggttgatttt

SEQ ID NO: 5097 - DNA, 1109 bp, Artificial Sequence
  P5324 FRUIT VASCULAR TISSUE AND COLUMELLA, SEED AND ENDOSPERM SPECIFIC CRUCIFERIN PROM. DRIVER CONSTR UCT
ctacacgttttgaaaagttaacctgttggttaaatggttagctatgactctcgcaacaaacccaacccttaagatgatgatggtttaacatttgacaacatagttaagactgtgtctatataatagtcaacaaattcagattgtagtattatggagtcaacatatttcgagatcaaaaacattcaaaacgtaaatctatcgacgtctcacatagttttgttatgaagctgatgaaaaaagttggaagacatagttttgcaaacatcatttgttgctaacgtataaacgttggtttgattaaatgtaataggataaggatatccgtttgttcatataattgagttaaattatattttggttattataatatgttaagttgaaaataaataggtccaacaaccttgtttaaatagattttttaggagtgattcccttttaatagtatagattatactctcttcctaatcgaccttccgtggggtaaagtggtcaattatattctttatggatgagcttgattgagaatgggtttatgggttatgacaagggcatgtacaaatgtcactgcctcttgacatgcaaccgaacagttggcgactcaagtcgcagaagatacaacggaccaaaccctccgagtgtcgccgcgtctgttatgtgtcacctttttgtctcctttccttaaaaattggtaactcatttttcaaaaaaagaagaggatagttttggctgtatctcctaaactattcgatcacaacgccagatattttaatactggatactagtgatgtaatttgatttgttaattgtcaaaaagtagattctcctatctcgtttttagttcaattattatatggttaaatgaatttaagtcgattagaaatgattagttaatcaaccagagttgctctataagtctatactgataacatgaaccattttctaaaaatgagatagatacatttgaattttgtcgtggtttggagtatgcggagatagtcgtacgcgcatgaacatcatgagacacttgcttcagctcacagagtgacgtgtaaagaccatagacccacgacttcatgcaaacccattcctacgtggcacaaaccttcatg

SEQ ID NO: 5098 - DNA, 3446 bp, Artificial Sequence
  P5326 FLORAL MERISTEM, STRESS INDUCIBLE-SPECIFIC AP1 PROM. DRIVER
cacggaccttggatctgaagttatgaacaataacatatttggcaaaacaaagaaaaaagaaacaacaatactaacatattttggtaaaagaacattgagaagtctcaaaaattaacttcttcttattttgtttcctaataagaccgtttgcttcatttcaagttcttaggaaataatttcatgtaacgtgtatgtagatatgtttatgtacagataaagagagatctgaaaatgatatatagagcttttgtggtgataagtgcaacaagcaggatatatatatcgaacgtggtggttagaagatagcgtcaaaatagatgctagctgctgcgtatacatcatattcatatcatatgtacttctcttttgtgatttctcatgtgattgaacatactacataaatcttgatagatttataaaaatgcaacaaattgttgtttatataagaaaaataaaacactgatatgatatttcattagttattatcaaatttgcaatataatgtttaacatccaagatttgttttacataatcgttacggttactaaagtttaatttatgatgttttaaaacaaattgagactaaatttctaaaagaaacatatacgtacatgtgtgtagctgcgtatatatatagaatggtggggctaaaagctaatgatgtgtacattaattggacatttgatgtggctggattggacccaacttgctctttgatagagacctaactaagacaattttgctcttcattcatttctcccgtatacataattgaattaactgtacataatgtttcacaacaagcgatctagctatatatttcaaaataacagagactgatattttaatctggtcttctaagctctaacgtcaaattaaaaaaaaaatccgatcttctaattaattagaagaaatcaattatagaacctctctctttaatttcatttatttaaaactgcttggaaatttaattattcactaaagactcactattctccttaatttatgataatttgtagatcatatgttcagtttttatttatttgccattcgaatgttgagttttaattaaaccaatatgttaatattcgaattaaaaaaacttacctataattcacttatttaaaaacataaaataataataattgcatcaccgtgatacaaagcaacctcacaagtcacaactctcgtgactacaaagatcactcattaaacaaaccttcctgccttctttttttctacttgggcacctcgaccgatcgaagactattcttgggatctgcttcaaaaacgactatatgttctaaatccacttcgtatgatgacgaacatttggtttactactgaagatagagattacgtccttctaattagaagtaattaattattttagtatttggaagctaatggtggagatgtaaccgtatcttagtggatcgagatattgtatataaaatatgtatgctacatcgaataataaactgaaagagagtaaaaagggatatttaatgggaagaaaagaagggtggagatgtaacaaaggcgaagataatggatattcttgggatgttgtcttcaaggccacgagcttagattcttttagttttgctcaatttgttaagtttctacttttccttttgttgcttactacttttgctcatgatctccatatacatatcatacatatatatagtatactatctttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagctcttctttatatctctcttgtagtttcttattgggggtctttgt

SEQ ID NO: 5099 - DNA, 1839 bp, Artificial Sequence
  P5486 HEMAGGLUTININ (HA) EPITOPE C-TERMINAL TAG, 35S
atggaagcgttaacggccaggcaacaagaggtgtttgatctcatccgtgatcacatcagccagacaggtatgccgccgacgcgtgcggaaatcgcgcagcgtttggggttccgttccccaaacgcggctgaagaacatctgaaggcgctggcacgcaaaggcgttattgaaattgtttccggcgcatcacgcgggattcgtctgttgcaagaagaggaagaagggttgccgctggtaggtcgtgtggctgccggtgaaccacttctggcgcaacagcatattgaaggtcattatcaggtcgatccttccttattcaagccgaatgctgatttcctgctgcgcgtcagcgggatgtcgatgaaagatatcggcattatggatggtgacttgctggcagtgcataaaactcaggatgtacgtaacggtcaggtcgttgtcgcacgtattgatgacgaggttaccgttaagcgcctgaaaaaacagggcaataaagtcgaactgttgccagaaaatagcgagtttaaaccaattgtcgtagatcttcgtcagcagagcttcaccattgaagggctggcggttggggttattcgcaacggcgactggctggaattccccaattttaatcaaagtgggaatattgctgatagcgcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagctgctgctgctgaggatcctgaagctcgaaaaacaaagaaaaaaatcaaagggattcagcaagccactgcaggagtctcacaagacacttcggaaaatcctaacaaaacaatagttcctgcagcattaccacagctcacccctaccttggtgtcactgctggaggtgattgaacccgaggtgttgtatgcaggatatgatagctctgttccagattcagcatggagaattatgaccacactcaacatgttaggtgggcgtcaagtgattgcagcagtgaaatgggcaaaggcgataccaggcttcagaaacttacacctggatgaccaaatgaccctgctacagtactcatggatgtttctcatggcatttgccctgggttggagatcatacagacaatcaagtggaaacctgctctgctttgctcctgatctgattattaatgagcagagaatgtctctaccctgcatgtatgaccaatgtaaacacatgctgtttgtctcctctgaattacaaagattgcaggtatcctatgaagagtatctctgtatgaaaaccttactgcttctctcctcagttcctaaggaaggtctgaagagccaagagttatttgatgagattcgaatgacttatatcaaagagctaggaaaagccatcgtcaaaagggaagggaactccagtcagaactggcaacggttttaccaactgacaaagcttctggactccatgcatgaggtggttgagaatctccttacctactgcttccagacatttttggataagaccatgagtattgaattcccagagatgttagctgaaatcatcactaatcagataccaaaatattcaaatggaaataccaaaaagcttctgtttcatcaaaaatga

SEQ ID NO: 5100 - DNA, 4276 bp, Artificial Sequence
  P6506 CONST. 35S PROM. DRIVER CONSTRUCT
catgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcggcggccgcaagacccttcctctatataaggaagttcatttcatttggagaggacacgctcgagtataagagctcatttttacaacaattaccaacaacaacaaacaacaaacaacattacaattacatttacaattaccatggaagcgttaacggccaggcaacaagaggtgtttgatctcatccgtgatcacatcagccagacaggtatgccgccgacgcgtgcggaaatcgcgcagcgtttggggttccgttccccaaacgcggctgaagaacatctgaaggcgctggcacgcaaaggcgttattgaaattgtttccggcgcatcacgcgggattcgtctgttgcaggaagaggaagaagggttgccgctggtaggtcgtgtggctgccggtgaaccacttctggcgcaacagcatattgaaggtcattatcaggtcgatccttccttattcaagccgaatgctgatttcctgctgcgcgtcagcgggatgtcgatgaaagatatcggcattatggatggtgacttgctggcagtgcataaaactcaggatgtacgtaacggtcaggtcgttgtcgcacgtattgatgacgaagttaccgttaagcgcctgaaaaaacagggcaataaagtcgaactgttgccagaaaatagcgagtttaaaccaattgtcgtagatcttcgtcagcagagcttcaccattgaagggctggcggttggggttattcgcaacggcgactggctggaattccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtagctagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatctagaacatatccatatctaatcttacctcgactgctgtatataaaaccagtggttatatgtccagtactgctgtatataaaaccagtggttatatgtacagtacgtcgatcgatcgacgactgctgtatataaaaccagtggttatatgtacagtactgctgtatataaaaccagtggttatatgtacagtacgtcgaggggatgatcaagacccttcctctatataaggaagttcatttcatttggagaggacacgctcgagtataagagctcatttttacaacaattaccaacaacaacaaacaacaaacaacattacaattacatttacaattaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctctagctagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatcgacctgca

SEQ ID NO: 5101 - DNA, 1510 bp, Artificial Sequence
  P9002 STRESS INDUCIBLE RD29A PROM. DRIVER CONSTRUCT
ggttgctatggtagggactatggggttttcggattccggtggaagtgagtggggaggcagtggcggaggtaagggagttcaagattctggaactgaagatttggggttttgcttttgaatgtttgcgtttttgtatgatgcctctgtttgtgaactttgatgtattttatctttgtgtgaaaaagagattgggttaataaaatatttgcttttttggataagaaactcttttagcggcccattaataaaggttacaaatgcaaaatcatgttagcgtcagatatttaattattcgaagatgattgtgatagatttaaaattatcctagtcaaaaagaaagagtaggttgagcagaaacagtgacatctgttgtttgtaccatacaaattagtttagattattggttaacatgttaaatggctatgcatgtgacatttagaccttatcggaattaatttgtagaattattaattaagatgttgattagttcaaacaaaaattttatattaaaaaatgtaaacgaatattttgtatgttcagtgaaagtaaaacaaattaaattaacaagaaacttatagaagaaaatttttactatttaagagaaagaaaaaaatctatcatttaatctgagtcctaaaaactgttatacttaacagttaacgcatgatttgatggaggagccatagatgcaattcaatcaaactgaaatttctgcaagaatctcaaacacggagatctcaaagtttgaaagaaaatttatttcttcgactcaaaacaaacttacgaaatttaggtagaacttatatacattatattgtaattttttgtaacaaaatgtttttattattattatagaattttactggttaaattaaaaatgaatagaaaaggtgaattaagaggagagaggaggtaaacattttcttctattttttcatattttcaggataaattattgtaaaagtttacaagatttccatttgactagtgtaaatgaggaatattctctagtaagatcattatttcatctacttcttttatcttctaccagtagaggaataaacaatatttagctcctttgtaaatacaaattaattttccttcttgacatcattcaattttaattttacgtataaaataaaagatcatacctattagaacgattaaggagaaatacaattcgaatgagaaggatgtgccgtttgttataataaacagccacacgacgtaaacgtaaaatgaccacatgatgggccaatagacatggaccgactactaataatagtaagttacattttaggatggaataaatatcataccgacatcagttttgaaagaaaagggaaaaaaagaaaaaataaataaaagatatactaccgacatgagttccaaaaagcaaaaaaaaagatcaagccgacacagacacgcgtagagagcaaaatgactttgacgtcacaccacgaaaacagacgcttcatacgtgtccctttatctctctcagtctctctat

SEQ ID NO: 5102 - DNA, 706 bp, artificial sequence
  P2404.1
cttctttaattagtttgccacctcgcacgtgtgacaaatccttcttcgccacgtgtgaaaacccttctccggcttgctactaatatacgactaatagtatgaatagttcaatggcttctgccggcttaggtagccggagaaaggatccggtgtacagaggaatccggtgccgaagtgggaaatgggtctccgagattcgtgagccgaggaaaaccacgagaatctggcttggaacttaccccatggcagagatggcagcagccgcctatgatgtggctgctatggctcttaaaggaagagaagctgtcttgaacttccctggatccgtcgggtcatacccggttcctgaatcaacatccgcagcagatatacgagccgctgcggcagccgcagcagcaatgaagggatgtgaggaaggggaggaggagaaaaaggcaaaggagaagaagagtagtagttcgaagtcgagagcgcgtgagtgccacgtagataatgatgttggatcttcgtcgtggtgtgggacagagttcatggacgaagaagaagtcttgaatatgcctaatctgctggctaatatggcagaagggatgatggttgcgccgccgtcgtggatgggttctcggccgtcggatgactctccggagaattcaaatgatgaggacttgtggggctattgatcggtttgtgttgtccacgtacgtatatg

SEQ ID NO: 5103 - DNA, 697 bp, artificial sequence; identical to SEQ ID NO: 369
  P9081

SEQ ID NO: 5104 - DNA, 882 bp, artificial sequence
  Artificial sequence
  P4709
cttgtggtccaataaaaccctaattttcttttctttcttttatccattgtattagatcctatatctttcttccttatagaccatctctcatgtcttcttatatatattaagatattcacaagaactacaaaagaaagaaaggagatggagtggtcaacaacgagcaacgtagaaaacgtgagagtagctttcatgccaccgccatggccggagtctagttcctttaactcgctccacagcttcaactttgatccttacgcaggaaattcatatacgcctggcgatacacaaaccggaccggttatctctgtaccggaatcagaaaagatcatgaatgcgtaccgatttccgaacaacaacaatgagatgataaaaaagaagagactaacgagtggacaattagcttcacttgagcgaagttttcaagaagagatcaaattagattcagacaggaaggtgaagctgtcgagagagctcggtctgcagccacgtcagatagcagtttggttccaaaaccgccgtgcacggtggaaggcgaagcagcttgagcagttgtacgactcgcttagacaagagtacgacgtcgtttctagggagaaacaaatgttacacgatgaggtgaagaagctgagagctttactaagagaccagggtttgatcaagaagcaaatctctgccgggaccatcaaagtttccggtgaggaagacacggtggagatttcatcggtggtggtagctcatccaagaacggagaatatgaacgcaaatcaaatcaccggagggaatcaagtttacggtcaatacaacaatccgatgctggttgcttcctctggctggccgtcatacccctgatagatgttgctgatctcagagagagggaaa

SEQ ID NO: 5105 - DNA, 1353 bp, artificial sequence
  P4762
cagattcttgaggagcgagcgatgaacagtatcttctccattgacgatttctccgatcctttctgggaaactcctccgattcctctcaatcccgactcttctaagcctgttacggcggatgaagttagccagagtcaaccggaatggactttcgagatgtttctcgaagagatttcttcgtcggcggtgagctctgagccacttggtaacaacaacaacgcgatcgtcggtgtttcttcggcgcaatctcttccttctgtttccggacagaatgatttcgaggatgatagtcgatttcgtgatcgcgattcgggaaatttggattgtgctgctcccatgacgacgaagacggtgaatgttgattccgatgattatcgtcgtgttcttaagaacaagcttgaggctgagtgcgcgactggtgtttctcttcgggttgggtctgtgaagcctgaagattcgactagttctccagaaactcaacttcaaccagttcaatccagtcctcttactcaaggagaacttggtgttacttcttccttaccagctgaggtgaaaaaaactggtgtatcaatgaagcaggttactagtggatcgtcgagagaatattctgatgacgaggaccttgatgaagagaatgaaaccaccggttccttgaagccagaggacgttaaaaaatctagaaggatgctgtcaaatcgtgagtcagctaggcgatctagaaggagaaagcaggagcaaacaagtgacctcgaaacacaggttaatgatctaaaaggtgagcattcatcacttcttaaacaactgagcaacatgaatcacaagtatgacgaggctgctgttggcaatagaatactaaaggctgacattgagacattaagagctaaggtgaaaatggcggaagaaaccgtgaagagagtaacaggaatgaatccgatgcttctcggaagatcaagtggacataacaacaacaacagaatgccaataactggtaacaacaggatggattcttctagcattattccagcttatcaaccacactcaaacctaaaccatatgtcaaaccaaaacatcgggatcccaaccattctacctccaagactcggaaacaatttcgctgctcctccatcccaaaccagctctcccttgcagagaattagaaatgggcaaaatcaccatgttactccaagcgccaacccgtatggctggaataccgaacctcagaacgattcagcatggccgaaaaaatgcgtggactgatcaaacaagaagcgggtttcgcactatattaatgtctatgcatctgtaatttgtaagtgttattaagttacgaatcatgagaaaacatcttgtggt

SEQ ID NO: 5106 - DNA, 1494 bp, artificial sequence; identical to SEQ ID NO: 4258
  P4546

SEQ ID NO: 5107 - protein, 8 aa, Arabidopsis thaliana
  misc_feature (7)..(7): Xaa can be any naturally occurring amino acid
  G1073 clade AT-hook consensus sequence
RPRGRPXG

SEQ ID NO: 5108 - protein, 10 aa, Arabidopsis thaliana
  misc_feature (2)..(6): Xaa can be any naturally occurring amino acid
  misc_feature (8)..(9): Xaa can be any naturally occurring amino acid
  G1073 clade consensus sequence
PXXXXXLXXY

SEQ ID NO: 5109 - protein, 10 aa, Arabidopsis thaliana
  misc_feature (2)..(6): Xaa can be any naturally occurring amino acid
  misc_feature (8)..(9): Xaa can be any naturally occurring amino acid
  G1073 clade consensus sequence
PXXXXXLXXF

SEQ ID NO: 5110 - protein, 9 aa, Homo sapiens
  AT-hook domain-Reeves
KRPRGRPKK

SEQ ID NO: 5111 - protein, 22 aa, Arabidopsis thaliana
  misc_feature (1)..(1): Xaa can be any naturally occurring amino acid
  misc_feature (4)..(6): Xaa can be any naturally occurring amino acid
  misc_feature (12)..(12): Xaa can be any naturally occurring amino acid
  misc_feature (16)..(17): Xaa can be any naturally occurring amino acid
  misc_feature (19)..(22): Xaa can be any naturally occurring amino acid
  DML Motif
XSKXXXVDMLRXHTYXXEXXXX

SEQ ID NO: 5112 - DNA, 534 bp, Oryza sativa
  G3836
atggccgaccaccatggcggccaccacgccgacgggcatcgccggcagcagcagctgcagggggaggcggcggatcaggcggcggcggagatcatcaaggagcaggacaggttgctgccaatcgcgaacgtggggcgaatcatgaagcagatcctcccccccaacgccaagatctccaaggaggccaaggagacgatgcaggagtgcgtctcggagttcatcagcttcgtcaccggcgaggcctccgacaagtgccacaaggagaagcgcaagacggtcaacggcgacgacgtctgctgggccttcggcgccctcggcttcgacgactacgtcgaccccatgcgcaggtacctcaacaagtaccgcgagctcgagggcgaccgcgccgccgccgccgccacctcccgctccggcgccggcgccgccgcgggccccgaccacccttcctcctcctcctccgccgccgccgccaccgccggtcatttcatgttcaacgccatggacaggtcgacggatagctccaggcagttctag

SEQ ID NO: 5113 - protein, 177 aa, Oryza sativa
  G3836 polypeptide
MADHHGGHHADGHRRQQQLQGEAADQAAAEIIKEQDRLLPIANVGRIMKQILPPNAKISKEAKETMQECVSEFISFVTGEASDKCHKEKRKTVNGDDVCWAFGALGFDDYVDPMRRYLNKYRELEGDRAAAAATSRSGAGAAAGPDHPSSSSSAAAATAGHFMFNAMDRSTDSSRQF

SEQ ID NO: 5114 - protein, 90 aa, Oryza sativa
  G3836 CCAAT-binding domain
KEQDRLLPIANVGRIMKQILPPNAKISKEAKETMQECVSEFISFVTGEASDKCHKEKRKTVNGDDVCWAFGALGFDDYVDPMRRYLNKYR

SEQ ID NO: 5115 - DNA, 1405 bp, Zea mays
  G3922
tgggaccctcgaggccggccgggatacgattccgaagaaggtagcgacccacgcgcgcgggccagaggccggaagagggagatacaggttaatttttaggtaccagatcatctgatttctcagaagcaaaatgttgtttggagctcagtgacaccatcttgtaatgcctgtgattttacgggaaatggaggatcattctgtccatcccatgtctaagtctaaccatggctccttgtcaggaaatggttatgagatgaaacattcaggccataaagtttgcgatagggattcatcatcggagtctgatcggtctcaccaagaagcatcagcagcaagtgaaagcagtccaaatgaacacacatcaactcaatcagacaatgatgaagatcatgggaaagataatcaggacacaatgaagccagtattgtccttggggaaggaaggctctgcctttttggccccaaaattacattacagcccatcttttgcttgtattccttatactgctgatgcttattatagtggggttggggtctcgacaggatatgctccacatgccattgtatgttcactcttaatctttcagtttctgtcttcctggccacattctgtccatccccagcaaaatgatacaacgaacactccgggtatgttacctgtggaacctgcagaagaaccaatatatgttaatgcaaaacaataccatgcaatccttaggaggaggcaaacacgtgctaaattggaggcccagaacaagatggtgaaaaatcggaagccatatcttcatgagtcccgacatcgtcatgccatgaaacgggctcgtggatcaggaggacggttcctcaacacaaagcagctccaggagcagaaccagcagtatcaggcatcgagtggttcattgtgctcaaagatcattgccaacagcataatctcccaaagtggccccacctgcacgccctcttctgacactgcaggtcttcagcagccagccaggaccgcggctgcttgccctcggtgggcttccgccccacagccaacttcagtgagcaaggtggaggcggctcgaagctggtcgtgaacggcatgcagcagcgtgtttccaccataaggtgaagagaagtgggcacgacaccattcccaggcgcgcactgcctgtggcaactcatccttggcttttgaaactatggatatgcaatggacatgtagcttcgagttcctcagaataaccaaacgtgaagaatatgcaaagtccttttgagatttgctgtagctgaaagaactgtggttaggttgagtttcttcctggagactgatccatacatgacatgctacctcgtgctgagtttctgaggtgaagccatcgaaacatgaccgtgtggttcagtaaaaaaaaaaaaaaaaaaaa

SEQ ID NO: 5116 - protein, 304 aa, Zea mays
  G3922 polypeptide
MPVILREMEDHSVHPMSKSNHGSLSGNGYEMKHSGHKVCDRDSSSESDRSHQEASAASESSPNEHTSTQSDNDEDHGKDNQDTMKPVLSLGKEGSAFLAPKLHYSPSFACIPYTADAYYSGVGVSTGYAPHAIVCSLLIFQFLSSWPHSVHPQQNDTTNTPGMLPVEPAEEPIYVNAKQYHAILRRRQTRAKLEAQNKMVKNRKPYLHESRHRHAMKRARGSGGRFLNTKQLQEQNQQYQASSGSLCSKIIANSIISQSGPTCTPSSDTAGLQQPARTAAACPRWASAPQPTSVSKVEAARSWS

SEQ ID NO: 5117 - protein, 60 aa, Zea mays; identical to SEQ ID NO: 3750
  G3922 CCAAT-binding domain

SEQ ID NO: 5118 - DNA, 755 bp, Sorghum bicolor
  G3910
aatccgatcactgtctccggaacaccctagcaatggagcccaaatccaccacccctcccccgcctccggtcatgggcgcgcccgtcgcgtaccctccgccccccggcgccgcgtaccccgccgggccgtacgcgcacgcgccggcagccgcgctgtaccctcctcccccgccgccgccggctcccccaacctcgcagcagggcgccgcggcggcgcagcagctgcagctcttctgggcggagcagtaccgcgagatcgaggccaccaccgacttcaagaaccacaacctgccgctggcccgcatcaagaagatcatgaaggccgacgaggacgtgcgcatgatcgccgccgaggcgcccgtcgtcttcgcccgcgcctgcgagatgttcatcctcgagctcacccaccgcggctgggcgcacgccgaggagaacaagcgccgcaccctgcagaagtccgacatcgccgccgccgtcgcgcgcaccgaggtcttcgacttcctcgtcgacatcgtgccgcgggacgaggccaaggaagccgactccgccgccgccatgggaccagccgggatcccgcaccccgccgccggcctgcccgccaccgaccccatgggctactactacgtccagccgcagtaacgaatttggcttcgcttccatggagcctctgcggtttttatttagtaaattaatttaattactactgagactgccctgttgttacccatgttctcctgttgccacccaataactcta

SEQ ID NO: 5119 - protein, 201 aa, Sorghum bicolor
  G3910 polypeptide
MEPKSTTPPPPPVMGAPVAYPPPPGAAYPAGPYAHAPAAALYPPPPPPPAPPTSQQGAAAAQQLQLFWAEQYREIEATTDFKNHNLPLARIKKIMKADEDVRMIAAEAPVVFARACEMFILELTHRGWAHAEENKRRTLQKSDIAAAVARTEVFDFLVDIVPRDEAKEADSAAAMGPAGIPHPAAGLPATDPMGYYYVQPQ

SEQ ID NO: 5120 - protein, 98 aa, Sorghum bicolor
  G3910 CCAAT-binding domain
REIEATTDFKNHNLPLARIKKIMKADEDVRMIAAEAPVVFARACEMFILELTHRGWAHAEENKRRTLQKSDIAAAVARTEVFDFLVDIVPRDEAKEAD

SEQ ID NO: 5121 - DNA, 1176 bp, Physcomitrella patens
  G3867
cagcatcctcacatcccgccttcctctgcaccccagatgtcgcatcctggcgccgtcatgcctttacagatgcactacccgcaagcccagcaacagatgatgccgcagcttggtgatcagcagatgcagccgcagcttcattatcagcaaattcagaaacagcagctgtcccagttctggcagcagcaaatgcaggaaatggagcaagtcaatgattttaagacccatcagctaccactggcacgcatcaaaaaaatcatgaagtcggatgaagatgttaagatgatcgcagccgaagctccagtgctgttttcaaaagcttgtgagatgtttattttagaattgacactgcgctcttggattcatacggaggaaaataagcgaaggacactacaaagaaatgatattgcaggggctatcactaggggagacatcttcgactttcttgttgacatcgttccacgtgacgagttgaaggaagaagatttgggtgtgccatggactggtgttccaggggatggttctgtaccttacggaggaatattctatccacccatggctggacagcaaatgcatcattctatgggggctcctgagatgatggttgggcagccaccaaacccacaaatgatgtatcagcctccacagactgcctttgtccccgagcagcagcaacagtgaatgcattaccacctagagaacgctgagcatcgaagacgggacaactcaaggaaagggctatcgcatcgagattctttcgtcacgtgggaatggtatttatcatactgttgctaccatctgtcattcttatggcaaaaggggtcacaggatcaggattttacctttcactacagcgcttttgtgttggctttcaactatattttaaggaaatcgtagctgtaggcggtgatgcgacagttctgagcactgctaattctagcagagtttatgtttggtttagcaagtcatgaagggcacaaagggacccgacccctccatggatctggtagaaatttgtgaatagtgatactagtgcaggcataattattagcatgtgcaggagttgctcttaatgttaggttcgaggatcgggtatccattttcttagtaccattgtttcttttatgtctccctggttttatctttcagactgaaaaaaaaaaaaaaaaaaaaaaa

SEQ ID NO: 5122 - protein, 214 aa, Physcomitrella patens
  G3867 polypeptide
MSHPGAVMPLQMHYPQAQQQMMPQLGDQQMQPQLHYQQIQKQQLSQFWQQQMQEMEQVNDFKTHQLPLARIKKIMKSDEDVKMIAAEAPVLFSKACEMFILELTLRSWIHTEENKRRTLQRNDIAGAITRGDIFDFLVDIVPRDELKEEDLGVPWTGVPGDGSVPYGGIFYPPMAGQQMHHSMGAPEMMVGQPPNPQMMYQPPQTAFVPEQQQQ

SEQ ID NO: 5123 - protein, 97 aa, Physcomitrella patens
  G3867 CCAAT-binding domain
QEMEQVNDFKTHQLPLARIKKIMKSDEDVKMIAAEAPVLFSKACEMFILELTLRSWIHTEENKRRTLQRNDIAGAITRGDIFDFLVDIVPRDELKEE

SEQ ID NO: 5124 - DNA, 1348 bp, Oryza sativa
  G3390
cttcagaggcttcacctttcatcagcttagctagctagctgctcgatccggcggcgtgatcgatcgatctctctgattctatcaggtgttcgaccagattccatcgatggacagcacgagctgtctcttggacgacgcgagcagcggcgcgtccacgggcaagaaggcggcggcggcggcggcgtcgaaggcgctgcagcgcgtgggcagcggcgccagcgcggtgatggacgcggccgagcctggcgccgaggcggactcgggcggcgagcggcgcggcggcggcggcgggaagctgccgtcgtccaagtacaagggcgtggtgccgcaaccgaacgggcggtggggcgcgcagatatacgagcggcaccagcgggtgtggctcggcacgttcaccggcgaggcggaggcggcgcgcgcctacgacgtggcggcgcagcggttccgcggccgcgacgccgtcaccaacttccgcccgctcgccgagtccgacccggaggccgccgtcgagctccgcttcctcgcgtcccgctccaaggccgaggtcgtcgacatgctccgcaagcacacctacctcgaggagctcacgcagaacaagcgcgccttcgccgccatctccccgccgccccccaagcaccccgcctcctctccgacgtcctcctccgccgcgcgcgagcacctgttcgacaagacggtgacgcccagcgacgtcgggaagctgaaccggctggtgatccccaagcagcacgccgagaagcacttcccgctccagctccctccccctaccacaacctcctccgtcgccgccgccgccgacgccgccgccggcggcggcgattgcaagggcgtcctcctcaacttcgaggacgccgccgggaaggtgtggaaattccggtactcctactggaacagcagccagagctacgtgctcaccaaggggtggagccgcttcgtcaaggagaaggggctccacgccggcgacgccgtcggcttctaccgcgccgccggtaagaacgcgcagctcttcatcgactgcaaggtccgggcaaaacccaccaccgccgccgccgccgccgccttcctcagcgcggtggccgccgccgccgcgccgccacccgccgtgaaggctatcaggctgttcggtgtcgacctgctcacggcggcggcgccggagctgcaggacgccggcggcgccgccatgaccaagagcaagagagccatggacgccatggctgagtcacaagcacacgtggtttttaagaagcaatgcatagagcttgcgctaacctagctagcacgctgatgcagctagcgttttttttgctcattcgcttgcttgcttaattat

SEQ ID NO: 5125 - protein, 394 aa, Oryza sativa
  G3390 polypeptide
MDSTSCLLDDASSGASTGKKAAAAAASKALQRVGSGASAVMDAAEPGAEADSGGERRGGGGGKLPSSKYKGVVPQPNGRWGAQIYERHQRVWLGTFTGEAEAARAYDVAAQRFRGRDAVTNFRPLAESDPEAAVELRFLASRSKAEVVDMLRKHTYLEELTQNKRAFAAISPPPPKHPASSPTSSSAAREHLFDKTVTPSDVGKLNRLVIPKQHAEKHFPLQLPPPTTTSSVAAAADAAAGGGDCKGVLLNFEDAAGKVWKFRYSYWNSSQSYVLTKGWSRFVKEKGLHAGDAVGFYRAAGKNAQLFIDCKVRAKPTTAAAAAAFLSAVAAAAAPPPAVKAIRLFGVDLLTAAAPELQDAGGAAMTKSKRAMDAMAESQAHVVFKKQCIELALT

SEQ ID NO: 5126 - protein, 66 aa, Oryza sativa
  G3390 AP2 domain
SSKYKGVVPQPNGRWGAQIYERHQRVWLGTFTGEAEAARAYDVAAQRFRGRDAVTNFRPLAESDPE

SEQ ID NO: 5127 - protein, 103 aa, Oryza sativa
  G3390 B3 domain
LFDKTVTPSDVGKLNRLVIPKQHAEKHFPLQLPPPTTTSSVAAAADAAAGGGDCKGVLLNFEDAAGKVWKFRYSYWNSSQSYVLTKGWSRFVKEKGLHAGDAV

SEQ ID NO: 5128 - protein, 16 aa, Arabidopsis thaliana
  G1792 EDLL domain, amino acids 117-132
VFEFEYLDDKVLEELL

SEQ ID NO: 5129 - protein, 16 aa, Arabidopsis thaliana
  G1795 EDLL domain, amino acids 104-119
VFEFEYLDDSVLEELL

SEQ ID NO: 5130 - protein, 16 aa, Arabidopsis thaliana
  G30 EDLL domain, amino acids 100-115
VFEFEYLDDSVLDELL

SEQ ID NO: 5131 - protein, 16 aa, Oryza sativa
  G3383 EDLL domain, amino acids 101-116
KIEFEYLDDKVLDDLL

SEQ ID NO: 5132 - protein, 16 aa, Arabidopsis thaliana
  G1791 EDLL domain, amino acids 108-123
VIEFEYLDDSLLEELL

SEQ ID NO: 5133 - protein, 16 aa, Glycine max
  G3519 EDLL domain, amino acids 128-143
TFELEYLDNKLLEELL

SEQ ID NO: 5134 - protein, 16 aa, Oryza sativa
  G3381 EDLL domain, amino acids 109-124
PIEFEYLDDHVLQEML

SEQ ID NO: 5135 - protein, 16 aa, Oryza sativa
  G3737 EDLL domain, amino acids 101-116
KVELVYLDDKVLDELL

SEQ ID NO: 5136 - protein, 16 aa, Oryza sativa
  G3515 EDLL domain, amino acids 116-131
KVELECLDDKVLEDLL

SEQ ID NO: 5137 - protein, 16 aa, Zea mays
  G3516 EDLL domain, amino acids 107-122
KVELECLDDRVLEELL

SEQ ID NO: 5138 - protein, 16 aa, Glycine max
  G3520 EDLL domain, amino acids 109-124
VIEFECLDDKLLEDLL

SEQ ID NO: 5139 - protein, 16 aa, Zea mays
  G3517 EDLL domain, amino acids 103-118
VIEFEYLDDEVLQEML

SEQ ID NO: 5140 - protein, 16 aa, Glycine max
  G3518 EDLL domain, amino acids 135-150
TFELEYFDNKLLEELL

SEQ ID NO: 5141 - protein, 16 aa, Zea mays
  G3739 EDLL domain, amino acids 107-122
VIELEYLDDEVLQEML

SEQ ID NO: 5142 - protein, 16 aa, Oryza sativa
  G3380 EDLL domain, amino acids 103-118
VIELECLDDQVLQEML

SEQ ID NO: 5143 - protein, 16 aa, Zea mays
  G3794 EDLL domain, amino acids 102-117
VIELECLDDQVLQEML

SEQ ID NO: 5144 - DNA, 918 bp, Oryza sativa
  G3406
atggcaggtctcgacctcggcaccgccgcgacgcgctacgtccaccagctccaccacctccaccccgacctccagctgcagcacagctacgccaagcagcacgagccgtccgacgacgaccccaacggcagcggcggcggcggcaacagcaacggcgggccgtacggggaccatgacggcgggtcctcgtcgtcaggtcctgccaccgacggcgcggtcggcgggcccggcgacgtggtggcgcgccggccgcgggggcgcccgcctggctccaagaacaagccgaagccgccggtgatcatcacgcgggagagcgccaacacgctgcgcgcccacatcctggaggtcgggagcggctgcgacgtgttcgagtgcgtctccacgtacgcgcgccggcggcagcgcggcgtgtgcgtgctgagcggcagcggcgtggtcaccaacgtgacgctgcgtcagccgtcggcgcccgcgggcgccgtcgtgtcgctgcacgggaggttcgagatcctgtcgctctcgggctccttcctcccgccgccggctccccccggcgccaccagcctcaccatcttcctcgccgggggccagggacaggtcgtcggcggcaacgtcgtcggcgcgctctacgccgcgggcccggtcatcgtcatcgcggcgtccttcgccaacgtcgcctacgagcgcctcccactggaggaggaggaggcgccgccgccgcaggccggcctgcagatgcagcagcccggcggcggcgccgatgctggtggcatgggtggcgcgttcccgccggacccgtctgccgccggcctcccgttcttcaacctgccgctcaacaacatgcccggtggcggcggctcacagctccctcccggcgccgacggccatggctgggccggcgcacggccaccgttctga

SEQ ID NO: 5145 - protein, 305 aa, Oryza sativa
  G3406,At-hook amino acids 82-90,2nd cons. domain 90-232,DUF296 109-227
MAGLDLGTAATRYVHQLHHLHPDLQLQHSYAKQHEPSDDDPNGSGGGGNSNGGPYGDHDGGSSSSGPATDGAVGGPGDVVARRPRGRPPGSKNKPKPPVIITRESANTLRAHILEVGSGCDVFECVSTYARRRQRGVCVLSGSGVVTNVTLRQPSAPAGAVVSLHGRFEILSLSGSFLPPPAPPGATSLTIFLAGGQGQVVGGNVVGALYAAGPVIVIAASFANVAYERLPLEEEEAPPPQAGLQMQQPGGGADAGGMGGAFPPDPSAAGLPFFNLPLNNMPGGGGSQLPPGADGHGWAGARPPF

SEQ ID NO: 5146 - protein, 9 aa, Oryza sativa
  G3406 At-hook domain amino acids 82-90
RRPRGRPPG

SEQ ID NO: 5147 - protein, 143 aa, Oryza sativa
  G3406 2nd conserved domain
GSKNKPKPPVIITRESANTLRAHILEVGSGCDVFECVSTYARRRQRGVCVLSGSGVVTNVTLRQPSAPAGAVVSLHGRFEILSLSGSFLPPPAPPGATSLTIFLAGGQGQVVGGNVVGALYAAGPVIVIAASFANVAYERLPL

SEQ ID NO: 5148 - protein, 144 aa, Arabidopsis thaliana
  G1667 second conserved domain
GSKNKPKPPIIVTHDSPNSLRANAVEISSGCDICETLSDFARRKQRGLCILSANGCVTNVTLRQPASSGAIVTLHGRYEILSLLGSILPPPAPLGITGLTIYLAGPQGQVVGGGVVGGLIASGPVVLMAASFMNAVFDRLPMDD

SEQ ID NO: 5149 - protein, 144 aa, Arabidopsis thaliana
  G1069 second conserved domain
GSKNKPKAPIFVTRDSPNALRSHVLEISDGSDVADTIAHFSRRRQRGVCVLSGTGSVANVTLRQAAAPGGVVSLQGRFEILSLTGAFLPGPSPPGSTGLTVYLAGVQGQVVGGSVVGPLLAIGSVMVIAATFSNATYERLPMEE

SEQ ID NO: 5150 - DNA, 862 bp, Arabidopsis thaliana
  G3001
gaactcattttctctcttcttcttcatcatcatcatcaatggatgagataaaaccaaagaaagaagagaattccaaacgacgtcgtaacgtcaaacccatttgccgtgaaactggagaccacgtccattatcttccaacatgcaaaaccaagcccaaacccacgcgtactcatcacgcgccaccaccgatcctcgactcaatcttcaaagtcactcacaagccacactactacgaatgcaggaagaatcacgccgctgatatcggaaccaccgcttacgacggctgcggcgagtttgttagctccaccggtgaagaagattctttaaactgcgccgcatgtggctgtcaccgtaacttccaccgtgaagagttaatcccggagaacggcggcgttactgagacggttcttgaagttctcaagatttcatcgtgtcagtttcgtcggatcttttgctcaccttacggcggtggaaaaagcgaaggaaagaagaagaagaaggagaaggagagttatggaggggatccgataattaaagatcgattcggcggtgcggaggaggaggaggggatagtgaagaggttgaaaacgaagttcacggcggagcaaacggagaaaatgagggattatgcggagaagcttcggtggaaggtgagacctgagaggcaggaggaggttgaagagttttgtgtagagattggagtgaatcggaagaattttaggatttggatgaataatcacaaggataaaattataattgatgaatgattatttaccaaacttaattgtgttacttttcttttcattctactttgttttaatttgtgtttgatttagtgtaatgtataaataacaagctcatt

SEQ ID NO: 5151 - protein, 242 aa, Arabidopsis thaliana
  G3001 polypeptide
MDEIKPKKEENSKRRRNVKPICRETGDHVHYLPTCKTKPKPTRTHHAPPPILDSIFKVTHKPHYYECRKNHAADIGTTAYDGCGEFVSSTGEEDSLNCAACGCHRNFHREELIPENGGVTETVLEVLKISSCQFRRIFCSPYGGGKSEGKKKKKEKESYGGDPIIKDRFGGAEEEEGIVKRLKTKFTAEQTEKMRDYAEKLRWKVRPERQEEVEEFCVEIGVNRKNFRIWMNNHKDKIIIDE

SEQ ID NO: 5152 - protein, 52 aa, Arabidopsis thaliana
  G3001 ZF domain
PHYYECRKNHAADIGTTAYDGCGEFVSSTGEEDSLNCAACGCHRNFHREELI

SEQ ID NO: 5153 - protein, 64 aa, Arabidopsis thaliana
  G3001 HB domain
VKRLKTKFTAEQTEKMRDYAEKLRWKVRPERQEEVEEFCVEIGVNRKNFRIWMNNHKDKIIIDE

SEQ ID NO: 5154 - DNA, 782 bp, Arabidopsis thaliana
  G2995
cagagtataaacgcactagtgagtgaaataagaatcagacatgagctcgttatcaaaaccaaacagacaatttttgtcaccaacaacaaacaaccaagacaccggcagagaacaaacaatcgcctgcgcccgagatatggttgtcttgtacaacgagtgccttaaaaaccacgcggtcagtctcggaggccacgctcttgacggctgcggtgagttcacaccaaagtcaaccaccatcctcacggaccctccgtcccttaggtgcgatgcttgtggctgccatcgcaacttccaccgtcgtagtccttctgacggcttcagtcagcaccggtcaccaccgtctccgttacagctgcagccactcgcccctgttccgaacttgcttctctctcttagctccggtttctttggaccctcggatcaagaagtcaagaacaaatttacggtggaaagggatgttaggaagactgcgatgattaagaaacataagaggacgaaattcacggcggagcagaaggtgaagatgagaggtttcgcggagagagcggggtggaagattaacggctgggatgagaagtgggtgagagagttttgtagtgaagttggaatagagagaaaagttcttaaggtttggatccacaacaataagtactttaacaacgggaggagcagagacacgacgtcctctatgtctttgaatttgaagttgtagatctctttacagtgatgggtcttcatcttcttgagataaggaaaaaccgaaacaaaaagaggttacggta

SEQ ID NO: 5155 - protein, 191 aa, Arabidopsis thaliana
  G2995 polypeptide
MVVLYNECLKNHAVSLGGHALDGCGEFTPKSTTILTDPPSLRCDACGCHRNFHRRSPSDGFSQHRSPPSPLQLQPLAPVPNLLLSLSSGFFGPSDQEVKNKFTVERDVRKTAMIKKHKRTKFTAEQKVKMRGFAERAGWKINGWDEKWVREFCSEVGIERKVLKVWIHNNKYFNNGRSRDTTSSMSLNLKL

SEQ ID NO: 5156 - protein, 56 aa, Arabidopsis thaliana
  G2995 ZF domain
VLYNECLKNHAVSLGGHALDGCGEFTPKSTTILTDPPSLRCDACGCHRNFHRRSPS

SEQ ID NO: 5157 - protein, 64 aa, Arabidopsis thaliana
  G2995 HB domain
KKHKRTKFTAEQKVKMRGFAERAGWKINGWDEKWVREFCSEVGIERKVLKVWIHNNKYFNNGRS

SEQ ID NO: 5158 - DNA, 1353 bp, Arabidopsis thaliana
  G2149
aatcttttatttttcttttagaaaccaaacttttcagatttctctctctccatttggcgatagaagaagtcatgtaccaatcatcatcctccacgtcatcatcatcgcagagatcatcgcttcccggcggcggaggactgatccgttacggctcagctccgggatcgtttctaaactctgtggttgacgaagtcatcggaggaggctcatcaaacgctcgtgacttcaccggctatcaaccgtcgtcggataacttcatcggtaactttttcaccggagctgctgactcatcctcgctgagatccgattcgacgacttgtggagtcaacaactcatccgacggacagaaacagctaggcaataacaataataataatagtaataaagatatcttcctcgacagatcctacggtggattcaacgagatctcgcaacaacacaagagcaacgacatcggaggaggaaacagctcaggatcttactctctcgctagacaacgtagctctcccgccgatttcttcacctacctcgcctcagataaaaacaatttctcgttgaaccaaccaaccagtgattatagtccgcaaggagggtctaatgggggacgaggacattccagattgaagtctcagctaagcttcacgaatcacgactctctggctcggatcaacgaggtcaatgagaccccagtccacgacggttcaggccattcgttttctgcggctagctttggtgcagccactactgattcttgggatgacggttccggttcgatagggtttaccgtgactaggcccagtaaacgatccaaggacatggactctggtctcttttcgcagtatagtcttccttcagacacttcaatgaactacatggataacttcatgcagcttccagaagattctgtaccctgcaaaatccgggccaaacgcggctgcgccacccatcctagaagcatcgctgagcgggagaggagaacgagaataagtgggaagctaaagaagctacaagatcttgtccccaacatggataagcaaacaagctattcagacatgctggatttagctgtacaacacatcaaaggccttcagcatcaacttcagaatttgaaaaaagatcaagagaattgcacgtgtgggtgcagtgagaaaccaagctagctcaaacccaaaggtagggtcatcctaattttatttgcattgttccgattttatcatatgagagaattagagaagatgtaaataaaatagattatattaaatgtctaatcctcttataattaagctcctcattcgttatcattataagatagaacagtgacaattgtccattatgtttttgtttcaagtttat

SEQ ID NO: 5159 - protein, 362 aa, Arabidopsis thaliana
  G2149 polypeptide
MYQSSSSTSSSSQRSSLPGGGGLIRYGSAPGSFLNSVVDEVIGGGSSNARDFTGYQPSSDNFIGNFFTGAADSSSLRSDSTTCGVNNSSDGQKQLGNNNNNNSNKDIFLDRSYGGFNEISQQHKSNDIGGGNSSGSYSLARQRSSPADFFTYLASDKNNFSLNQPTSDYSPQGGSNGGRGHSRLKSQLSFTNHDSLARINEVNETPVHDGSGHSFSAASFGAATTDSWDDGSGSIGFTVTRPSKRSKDMDSGLFSQYSLPSDTSMNYMDNFMQLPEDSVPCKIRAKRGCATHPRSIAERERRTRISGKLKKLQDLVPNMDKQTSYSDMLDLAVQHIKGLQHQLQNLKKDQENCTCGCSEKPS

SEQ ID NO: 5160 - protein, 59 aa, Arabidopsis thaliana
  G2149 bHLH domain
KRGCATHPRSIAERERRTRISGKLKKLQDLVPNMDKQTSYSDMLDLAVQHIKGLQHQLQ

SEQ ID NO: 5161 - DNA, 936 bp, Antirrhinum majus
  G3982
atttcatttgaagagatgggaagggggaagattgtgatccaaagaatcgacaaatcgacgagtaggcaagtgactttttcgaaaaggaggagtggacttttgaagaaggccaaagagcttgctattctttgtgatgcagaagttggagttgttatattttccagcactgggaagctctacgaattttcaagcaccagcatgaaatcaattattgaacgacacactaaaaccaaagaggaccatcatcagctgcttaatcatggctcggaggtcaagttttggcaaagggaggctgcgactttaaggcaacaattacaggatttgcaagaaaaccatcggaagttgatgggagaagagctacaagggttgaatgttgaagatctacacagattggagaaccaactagagatgagtttgcgaggcgtgcgcatgaaaaaggtacagatgttaaccgatgaggttcatgaacttaggagaaagggacatctcatccatcaagagaacaatgagctctatgagaaggtaaaactccttcaacaagaaaacaaggaattgtgtaaaaaggcttacggcacaagggatgtaagtgcagcaaatggaactgccttggttccatttggtttcgcaattggtagggaacaattcgagccaatccagcttcatttaagccagcctgaaccagaaaatattgaaacatcaagagcctcaggatcaaagtaaattatttttggactaccttacaaaactacatgtgcttgtgtatgtatcatccagcactaggcaattaagtaacttgtattttgaatgcacgcctagacattaatatttccaaattgtcacaatattcgacagagctttcatttggcgatacctgcaagaaaattcactgtactcaatttaagagttcatataatgctatgtgtaattgtttttagc

SEQ ID NO: 5162 - protein, 234 aa, Antirrhinum majus
  G3982 polypeptide
MGRGKIVIQRIDKSTSRQVTFSKRRSGLLKKAKELAILCDAEVGVVIFSSTGKLYEFSSTSMKSIIERHTKTKEDHHQLLNHGSEVKFWQREAATLRQQLQDLQENHRKLMGEELQGLNVEDLHRLENQLEMSLRGVRMKKVQMLTDEVHELRRKGHLIHQENNELYEKVKLLQQENKELCKKAYGTRDVSAANGTALVPFGFAIGREQFEPIQLHLSQPEPENIETSRASGSK

SEQ ID NO: 5163 - protein, 56 aa, Antirrhinum majus
  G3982 MADS domain
GRGKIVIQRIDKSTSRQVTFSKRRSGLLKKAKELAILCDAEVGVVIFSSTGKLYEF

SEQ ID NO: 5164 - protein, 7 aa, Arabidopsis thaliana
  misc_feature (2)..(2): Xaa can be any naturally occurring amino acid
  misc_feature (4)..(4): Xaa can be any naturally occurring amino acid
  misc_feature (6)..(6): Xaa can be any naturally occurring amino acid
  G1274 potential zinc ligands
CXCXHXH

SEQ ID NO: 5165 - protein, 6 aa, Arabidopsis thaliana
  misc_feature (3)..(3): Xaa can be any naturally occurring amino acid
  misc_feature (5)..(6): Xaa can be any naturally occurring amino acid
  homeodomain signature sequence
WFXNXX

SEQ ID NO: 5166 - DNA, 1302 bp, Oryza sativa
  Predicted polypeptide sequence is orthologous to G28, G22, G1006
gacaattccgctagtccgagtcaaaacaaaatcaaattcaaattcacgggataattcaaagatgctgcttaatcaggcgtcgagagaggtggccgcgctggacagcatccggcaccacctcctggaggaggaggaggagacgccggcgacggcgccggcgccgacgcggcggccggtgtactgccggagctcaagcttcggcagcctcgtggccgaccagtggagcgagtcgctgccgttccggcccaacgacgccgaggacatggtcgtgtacggcgccctccgcgacgccttctcctccggctggctccccgacggctcattcgccgccgtcaagccggagtcgcaggactcctacgacgggtcctccatcggcagcttcctcgcgtcgtcgtcgtccgaggcggggacgcccggggaggtgacgtcgacggaggcgacggtgacgccggggatcagggagggcgagggcgaggccgtggcggtggcgtcgagggggaagcactaccgcggggtgaggcagcggccgtggggcaagttcgcggcggagatcagggacccggccaagaacggcgcgcgcgtgtggctcggcacgttcgactccgccgaggaggccgccgtggcgtacgaccgcgccgcctaccgcatgcgcggctcacgcgcgctcctcaacttcccgctccgcatcggctccgagatcgccgccgcggccgccgccgccgccgcgggcaacaagcggccatatcccgacccggcgagctccggctcttcttccccttcatcctcttcctcctcgtcgtcgtcttcctcctccgggtcaccgaagcggaggaagagaggcgaggccgcggccgcgtccatggccatggcactggttccaccaccgccaccaccggcgcaggcaccggtgcagctcgccctcccggcccagccatggttcgccgccggtccgatccagcagctggtgagctaagtggcgatgtggtagtggtagtggtgatttagccatcttgtgcgactgtgcgtgatcgattgctgcttgatgggtcgagcaagttcagaacagagcatcactctctgcagaatagaagaagttcatgaacagagcaatgcactgctccaagaaatgtgacgagttccaggcaatcacgccattgttcttggatgattgcgcagcaccagaaaaaagggaaaaaaaagattgtttgtgaaatgtggtgaggttttgtaagacttgcacaaaatttgagaaaaagaaaaagatcaatacatataaaatcttactagaaaaaagactttccc

SEQ ID NO: 5167 - DNA, 957 bp, Oryza sativa; identical to SEQ ID NO: 2167
  Predicted polypeptide sequence is orthologous to G28, G22, G1006

SEQ ID NO: 5168 - DNA, 810 bp, Oryza sativa
  Predicted polypeptide sequence is orthologous to G28, G22, G1006
cggccgaatcctttgtgaccacgcgtcgcacactgcaaactactctctcggtctctccatccatccacctctctcgatcgtctcatgagctagcgcgccccgcgcgtacagccccgcatgtctctctccttggggtttagcgccggcgccggcgtcggtgccgatcgcctcgccgccgcgcccgcgctccaggccgccggtgctctgccgccacgcgtggacgtgtctctgtcgctggcgcgcgcggccaacgggcagccgtcgtcgtacctcccgctcaacgagaacgactcgctggacatggtcctcttcgacgtcctccgcgaggcctccgcggtggcggcgctgtcgtcgtcgtcgtcgtcgtcgccggagctgggcgcgcggacgacggcgccggtggtcgccggccaccccgccgggcgcaagggtggcggcggcggaggcggaggcaggggagcggcggcgaggggcggcgccgctggcgggcggcactaccgcggtgtgaggcggcggccgtgggggaagtacgccgcggagatccgtgacccgacgcggcacggcgcgcggctgtggctcggcaccttcggcacggccgaggaggccgccgcggcgtacgaccgcgccgcgttccgcatgcggggcgccaaggcgctgctcaactttcccgacggattgtgccggtgaacgggcccggttcgaggccagcggggcccggaagcaggtcggatgaacgaaggtaaatgcgtaaataacttgagaaccattggactgtacaggcgtagaaaggggtcaaaccaggttattgga

SEQ ID NO: 5169 - DNA, 452 bp, Oryza sativa
  Predicted polypeptide sequence is orthologous to G28
cttcaaccacattgattatgctaacaagattggccatgagatagatatggaaatggcatgggacgatgatgtcctccaagacgatgaatcagctggatcatcaccattggagacaccggcaggtctagcacaaatcaataccgtgcatgtgaaggaggagatggatctaattgagatggtcacacgcacacaatcttgtggctagtggatgagaaaataagcagtgatgtaactatgtgtgctactaaatacacattacacgacctttcggagtgcaacctggggaacctatatggtgaagaaatattagaaaaataagaaaaacaaacatgtatgggttcgaacgaagcacttgattatatattatattgtaactaatattctaagtttttctcttcgtacttttggcatgcactctctctttaataagtactttatttttaccttttctc

SEQ ID NO: 5170 - DNA, 837 bp, Oryza sativa; identical to SEQ ID NO: 1863
  Predicted polypeptide sequence is orthologous to G481, G482, G485, G1364, G2345

SEQ ID NO: 5171 - DNA, 1082 bp, Oryza sativa
  Predicted polypeptide sequence is orthologous to G481, G482, G485, G1364, G2345
aaccgccgtctcctcctccccccactctcgccttcccccctctctctcctctcctctccgcgactccctccacccccgcgcgcgcgcgttttttttttttcgtaagggtttttggagggcggcgcggggatggcggacgcggggcacgacgagagcgggagcccgccgaggagcggcggggtgagggagcaggacaggttcctgcccatcgccaacatcagccgcatcatgaagaaggccgtcccggcgaccggcaagatcgccaaggacgccaaggagaccctgcaggagtgcgtctcggagttcatctccttcgtcaccagcgaggcgagcgacaaatgtcagaaggagaagcgcaagaccatcaacggggaagatctcctctttgcgatgggtacgcttggctttgaggagtacgttgatccgttgaagatctatttacacaagtacagagagatggagggtgatagtaagctgtcctcaaaggctggtgatggttcagtaaagaaggatacaattggtccgcacagtggcgctagtagctcaagtgcgcaagggatggttggggcttacacccaagggatgggttatatgcaacctcagtatcataatggggacacctaaagatgaggacagtgaaaattttcagtaactggtgtcctctgtgagttattatccatctgttaaggaagaacccacattagggccatatttattagtagaagactaaagcacttgaagggtgttggtttagaaagggtgttaacagttggctgtggcgattgcttcacagatgtaaattgcttcataagtggtttaatgcttgtttttgcctgtatattcagagcaattttcacatattggtagttctgcaatcttttgcattcccatacatgtatcaggtggcacaaatctattgcaagtaccctagcattgaataatgctggttaacatataattctgtaacgtccgtattgtttcgactgtgatgcttgccgtatgggcaatggcatgtgttctagagggggcattcaatatttaggtatctcaagaatgtaccaaatactcccttcgttcaattc

SEQ ID NO: 5172 - DNA, 1225 bp, Oryza sativa
  Predicted polypeptide sequence is orthologous to G481, G482, G485, G1364, G2345
gaccccgaccccttcaatcgcgcccgcctcagccgccttctcttctccagcgtccgatctccccctctcgcctctccgcctcacctccgctccgcttcccacccccgcttcctctctctctcctctccccctctctctctctctctctcctcctcgcttcaccacctcgcgcccaacccccctctctctcctctccacgtcgcgccctctccgcgcgcgcccgcgcttctatataaggaggggggaggtgggatggcggatgggccggggagcccggggggagggggggggagccacgagagcgggagcccgagggggggagggggaggagggggaggtgggggtgggggtgggggggtgagggagcaggacaggttcctccccatcgccaacatcagccgcatcatgaagaaggccatcccggccaacgggaagatcgccaaggacgccaaggagaccgtgcaggagtgcgtctccgagttcatctccttcatcaccagcgaggcgagcgataaatgccagagggagaagcgcaagaccatcaacggcgacgacttgctgtgggcgatggccacgctgggcttcgaggactacatcgagcccctcaaggtctacctgcagaagtacagagagatggagggtgatagtaaattaactgcaaaggctggtgatggctctgtgaaaaaggatgtacttggttctcatggaggaagcagttcaagtgcccaagggatgggccaacaagcagcatacaatcaaggaatgggttatatgcaacctcagtaccataatggggatgtctcaaactgaagataggaccttttcatgcaactgttgctagcgcaggtggattttatttggtgctgcagtcgttagctaatatatatacctacacctcatggtgagcagtgaaggaagtaacttgctaccacctctaggtcccatgtttgtcaaccaggaactgatgctgcttggaagcgtcgagccaaggctgcttctcagatgtaaattactccccgtgaggatagtttcggttcgtggtctagctctgttgttgtatgtatattcaggataatttaacaattggtctttggctgtcattcggttccatataatctgtattgggaggcataaatattcatgttgtatttcgtcctgaactagcgtgttgtactattgagaaatagatgctctctgtaatggtagcaattttactctgattccc

SEQ ID NO: 5173 - DNA, 558 bp, Oryza sativa
  Predicted polypeptide sequence is orthologous to G481, G482, G485, G1364, G2345
atgcaagggcttcctagggcgtcgtcgtcgtcaacctcggcgtcgagagatcgagacggcggcgatggcgatggcggcggcggcggcgtgacgatgacgaacgggcaggacaacctgctgccgatcgccaacgtgggccggatcatgaaggacgggctgccgccgcaggcgaagatatcgaagcgggccaaggagacgatccaggagtgcgcgacggagttcatcagcttcgtcaccggcgaggcgtcggagcggtgccggcgggagcggcggaagacggtgaacggcgacgacgtctgccacgccatgaggagcctcggcctcgaccactacgccgacgccatgcacaggtacctgcagaggtaccgcgagggcgaggagctcgccgcgtcgctcaacagcagcagcagcgccgccgccgccgccgccgccgccggcagcaggggcggtggcgccatacagatcgacgtgagagctgagctctccatcttcagatcaggcaacaaccaaggtaaaaagggtgttaactctcttttcgtggaggtgaaacttaactga

SEQ ID NO: 5174 - DNA, 932 bp, Oryza sativa
  Predicted polypeptide sequence is orthologous to G481, G482, G485, G1364, G2345
cccgcgccctcctctcctcttcgtcttcctcctcgcttcgcttcgactgcttcgatcgaggagatcgaggttgcgatgccggattcggacaacgagtcaggggggccgagcaacgcgggggagtacgcgtcggcgagggagcaggacaggttcctgccgatcgcgaacgtgagcaggatcatgaagagggcgctcccggcgaacgccaagatcagcaaggacgccaaggagacggtgcaggagtgcgtctcggagttcatctccttcatcaccggcgaggcctccgacaagtgccagcgggagaagcgcaagaccatcaacggcgacgacctcctctgggcgatgaccacgctcggcttcgaggactacatcgacccgctcaagctctacctccacaagttccgcgagctcgagggcgagaaggccatcggcgccgccggcagcggcggcggtggcgccgcctcctccggcggctccggctccggctccggctcgcaccaccaccaggatgcttcccggaacaatggcggatacggcatgtacggcggcggcggcggcatgatcatgatgatgggacagcctatgtacggctcgccgccggcgtcgtcagctgggtacgcgcagccgccgccgccccaccaccaccaccaccagatggtgatgggagggaaaggtgcgtatggccatggcggcggcggcggcggcgggccctccccgtcgtcgggatacggccggcaagacaggctatgagcttgctttcttggttggtgttttggtaattaattaatcagaggacatgtcgggttaattaatcttaatctctgttttttcactctttttttttacctttctttctctctcttttatctttccttttctcaatgtgctaaaatgagtcaattatatggctaaattctctactaattcgcttc

SEQ ID NO: 5175 - DNA, 1717 bp, Oryza sativa
  Predicted polypeptide sequence is orthologous to G481, G482, G485, G1364, G2345
tctcattctcataaaataatcatcccctgcctaactccataacaaagaaatgcatactcctcggtcattagtatatgttagtataaattaaataattaacaccttaaacaatatctcttcgtcgtagtttgatcatcacctaagattttttagtcttttcaaaaatgatcatcaagctaacaagtgtatctttatttatttgtgcaagaagtaaatgagcatcattgaatgcgctgcacacatgtaatgcaaacaaccaagttaatttttattggtgcaacgggcgcgcactatttaaaacgtgacgcaatgcagcgatagagcaccttgatagataagaattaatttcagcatgatgtagattttgttatccttaatctctactcactttgcataggtgataaattaaaccgctgaactattactacatggtttacatgaaaggtgatcgggtagggacgagaatgtcgcgacacacatgatatatatagtagcgtccttatgtttgctttgtgtccgcatcgataccgtcttcccactcgcatctcctcacctcctttccttctttaaaaggagagcatcaccactccatcctcaactcccataacacctcccccttctctctctctctaactacacactctctctctagctagctagctagctatagctagtgttgttagcttcacatgaagagtaggaagagctatgggctcttgctgagcccggtgggcagcccgccgtcggacaacgagtccggcgcggcggcggcggcggctgcggcgggcggcggcggctgcgggagcagcgccgggtatgttgtctacggcggcggcggcggtggggactcgccggcgaaggagcaggacaggttcctgccgatcgcgaacgtgagccgcatcatgaagcggtcgctgccggcgaacgccaagatctccaaggaggcgaaggagacggtgcaggagtgcgtgtcggagttcatcagcttcgttaccggcgaggcctccgacaagtgccagcgcgagaagcggaagaccatcaacggcgacgacctcctctgggccatgaccacgctggggttcgaggcctacgtcggcccgctcaagtcctacctcaaccgctaccgcgaggccgagggcgagaaggccgccgtgctcggcggcgccggcggcgccgccgcggcgcgccacggcgagggcggttgctgcggcggcggcggcggcgccgatggcgtcgtcatcgacgggcattccccgctcgccggcggcctgtcacactcacaccatggtcatcagcagcaggacggcggcggcgacgtcgggctcatgatgggcggcggcgccgccggcgtcgggtacaacgccggggccgggtcgacgacgacggcgttctacgcgccggcggcgacggcggcgtcagggaacaaggcgtactgcggcggcgacgggtcgagggtgatggagttcgagggcatcggcggcgaggaggagagcggaggcggaggcggcggcggcggcggcgagagggggttcgccggccacctccatggcgtgcaatggtgaagactaaagaggagtactaattagctagctaggcacacgcgtagttttattattacttaattaccgcgttaattaattgttgatgctgatgctgtttaaaattgattctccttttgcatgaaaatgtttgatggtatggtttaaaaattgaagaa

SEQ ID NO: 5176 - DNA, 1800 bp, Oryza sativa
  Predicted polypeptide sequence is orthologous to G481, G482, G485, G1364, G2345
aacttcaaatcctacttagcagaagagaagtgctatacgaacgaccaatgcattcgactagcgtacgtctcatctcatcggattggcctgtttggtagagttttagcttctaaatttagcttcaagctccagaagttttaagtggagttgtggagctgtctaaactcatctctacctctctaaattattttgtgagagttttactcagcttcgctcctattttaagtagagctgaaactgtttggctaagttttagctataggagaggtggagctggagctgtgattacttttgtgggtccagtttttttatagctaatcatggtcatataggagttggatgtgcaagtcgtatgcatggtcattctgtgctcggcttattaaaaaaattgtgtaaatataaaaaacgaaaagttatgcttaaagtactttaggtaataaagcaagtaaaaaaaataaataataatttaaaattttttgaatcagacgagtgattaaaagtgcaaacaaaaacttaaaattttttgtattatgggacggagggaataggactgcaagtttaactaaagtatcctataaattcaagtattcaaaatattatgctttgcctgctgctggctggtgcagcaaattggtcctggccccggtgcacggtcctacgtggcgagccgggcactcgcgcatgtcaggggggccaaggcgccgtcccacgtggcctcggcccacccagacggcggggatccgtccgacgtggcgatgatggacagacggttgagcgccaagtggcacacgcttatcagcaaacgaacggctggggtcggtccacgtagacgcctcgatacgttcttatccgcgcgatccaacggaccgatccccccacgccattccccaccccaccatctctctctctctctctcttctcttcttcttcctcctagactagtcagtctctcccaagaacacccactcctctagtctctctctctcgagagagaaaattgatgattcttgggatgattttgaggcgtctgatttgctgaagaggaggaggaggatgccggactcggacaacgactccggcgggccgagcaactacgcgggaggggagctgtcgtcgccgcgggagcaggacaggttcctgccgatcgcgaacgtgagcaggatcatgaagaaggcgctgccggcgaacgccaagatcagcaaggacgccaaggagacggtgcaggagtgcgtctccgaattcatctccttcatcaccggcgaggcctccgacaagtgccagcgcgagaagcgcaagaccatcaacggcgacgacctgctctgggccatgaccaccctcggcttcgaggactacgtcgaccccctcaagcactacctccacaagttccgcgagatcgagggcgagcgcgccgccgcctccaccaccggcgccggcaccagcgccgcctccaccacgccgccgcagcagcagcacaccgccaatgccgccggcggctacgccgggtacgccgccccgggagccggccccggcggcatgatgatgatgatggggcagcccatgtacggctcgccgccaccgccgccacagcagcagcagcagcaacaccaccacatggcaatgggaggaagaggcggcttcggtcatcatcccggcggcggcggcggcgggtcgtcgtcgtcgtcggggcacggtcggcaagacaggggcgcttgacatcgctccgagacgagtagcatgcaccatggtacatatatacagtaatcagcagctgttcatttttctatgattactagttgactt

SEQ ID NO: 5177 - DNA, 693 bp, Oryza sativa
  Predicted polypeptide sequence is orthologous to G481, G482, G485, G1364, G2345
taattttttttttttgaatttgaaacccaactttgcataaacttgtgtcagcatcacacctgcttgcgtaatagagtttagaaaagtttctcttagatctctttacccctctgaatttagcatatgcaggacagccggaaacggccaaatatggttagacacaaccacacaacacacgactgaactagaacctacaacaaatttggacatcctggctaacacaagaacatttcaaaaagaacgacgactaacattcgtggtaacaaggtattggaactttggaagcatcctgcttacaacataacaggatgctggagcgttctttccctaaaaacgatggttctccttcctagatgccattagcgtgccaatcagtatcacactcctcgtcctacatgccttcaaacgatgatccaggatctccattaagtacaacatctttctttactggcagttcagaagctcttgaaccctttgtgtcaccctccgtctcccggtagagcctgaggtagagcttgagaggctcgacatagtcctcgaatccgagcgtgcccattgaccagatcaggtcgtccccattgatggtcttgcgcttctccttgaggcacttgtcgcttgcttcgctggtgatgaagctgatgaactcggagacgcactcctggacggactccttggagtccttggcgatcttgc

SEQ ID NO: 5178 - DNA, 661 bp, Oryza sativa
  misc_feature (147)..(147): n is a, c, g, or t
  Predicted polypeptide sequence is orthologous to G867, G9, G993, G1930
ccgtcgtgggcgcgggagccactgttcgagaagccgtgacgcccagcgacgtcggcaagctcaaccgcctgctggtgcccaagcagcacgcggagaagcacttcccgctgcgcggacgagctccgacgcctccgccaccgccgccancgccacctgcaactctgcaagggcgtgctcctcaacttcgaggacggcgaggggaaggtgtggaggttccggtactcagtgctggaacaagcagccagagttacagtgctgacacaagggatggagccagattcagtgagggagaagggcctccagcagcacggcgacaccatagtcttctccggctcaggcagtatggccccgacaagctgctcttcatcgactgcaagaagaacaaacacggcggcaggccaccggcgacgagaagccaaattacaagcaggcgaagcaacacagcgtcagtgaggctgttcaggcatggacatcaccggcggcggcggcagattgccaggaagcgggagaggcaggtggaaatggggcaagaggcagttcttgatgaagaggcaatgcagtggttcatcagcagtactcctgcccttggtgcccctgctgttataacatcaaatcaattcatatatacatcataaatcttccatctaaaaaaaaaaaaaaa

SEQ ID NO: 5179 - DNA, 801 bp, Oryza sativa
  Predicted polypeptide sequence is orthologous to G867, G9, G993, G1930
gttcttctctcccccttttctcttccccgttcgaacgcctcggcggcagcggcggccgggggccggagtggcgacggcggccgcgccaccgcctgccctgtctccaagctggcctaccatcgcgcaagctccgccaggggctccgccgggggcgcggcatgggcgcccgcgcgcagcccacgccgtcgtgggcgcgggagccactgttcgagaaggccgtgacgcccagcgacgtcggcaagctcaaccgcctgctggtgcccaagcagcacgcggagaagcacttcccgctgcggcggacgagctccgacgcctccgccaccgccgccgcggccacctgcaactctgcaagggcgtgctcctcaacttcgaggacggcgaggggaaggtgtggaggttccggtactcgtgctggaacagcagccagagttacgtgctgaccaagggatggagccgattcgtgagggagaagggcctccgcgccggcgacaccatagtcttctccggctcggcgtatggccccgacaagctgctcttcatcgactgcaagaagaacaacacggcggcggccaccggcgacgagaagccaattacaagcggcgaagcaacacgcgtcgtgaggctgttcggcatggacatcaccggcggcggcggcgattgccggaagcgggagagggcggtggaaatggggcaagaggcgttcttgatgaagaggcaatgcgtggttcatcagcgtactcctgcccttggtgccctgctgttataacatcaaatcaattcatatatacatcataaatcttc

SEQ ID NO: 5180 - DNA, 1512 bp, Oryza sativa
  Predicted polypeptide sequence is orthologous to G867, G9, G993, G1930
gatcatcttctttggcttctccctcttcactgccctaattacaacccatttgcttatctctctcctctctctctctctctcgctgcagccatagcttagctagagctagagctttcttggtgccgagatgggggtggtcagcttctcctcgacttcctccggcgcgtccacggccaccaccgagtccggcggcgccgtgcggatgtcgccggagccggtggtggcggtggcggcggcggctcaacagctaccggtggtgaagggagttgactcggcggatgaggtggtgacgtcgaggccggcggcggcggcggcgcagcagtcgtcgcggtacaagggggtggtgccgcagccgaacgggaggtggggggcgcagatctacgagcggcacgcgcgggtgtggctcgggacgttccccgacgaggaggcggcggcgcgggcctacgacgtggcggcgctccggtaccgggggcgcgacgcggccaccaacttccccggggccgcggcgtcggccgccgagctcgcgttcctcgccgcgcactccaaggccgagatcgtcgacatgctccggaagcacacctacgccgacgagctccgccaggggctccgccgcggccgcggcatgggcgcccgcgcccagcccacgccgtcgtgggcgcgcgagccgctgttcgagaaggccgtgacgcccagcgacgtcggcaagctcaaccgcctcgtggtgcccaagcagcacgccgagaagcacttcccgctccgccgcgcggcgagctccgactccgcctccgccgccgccaccggcaagggcgtgctcctcaacttcgaggacggcgaggggaaggtgtggcgattccggtactcgtactggaacagcagccagagctacgtgctgaccaaggggtggagccgattcgtgagggagaagggcctccgcgccggcgacaccatagtcttctcccgctcggcgtacggccccgacaagctgctcttcatcgactgcaagaagaacaacgcggcggcggcgaccaccacctgcgccggcgacgagaggccaaccacaagcggcgccgaaccacgcgtcgtgaggctcttcggcgtcgacatcgccggcggcgattgccggaagcgggagagggcggtggagatggggcaagaggtcttcctactgaagaggcaatgcgtggttcatcagcgtactcctgccctaggtgccctgctgttatagcatcaaatcaaattcatatatagatcaaatcaaatcttcttctcttccatcttttttgttgttcatcgtctgttgtttcatcttcgatttagagctgttctatcttcgactttctttttttgttttttgtctttattttgcatagaagtttgtcaggtcagagattgcaaatgatcgatcaagatcgagctgtatatgtacagccttattaggaaattaagtctagagatcattcaagtatgtacaattatctaatagtacatagtaataagttctgtttctttccg

SEQ ID NO: 5181 - DNA, 1182 bp, Oryza sativa
  Predicted polypeptide sequence is orthologous to G867, G9, G993, G1930
atggacagctccagctgcctggtggatgataccaacagcggcggctcgtccacggacaagctgagggcgttggccgccgcggcggcggagacggcgccgctggagcgcatggggagcggggcgagcgcggtggtggacgcggccgagcctggcgcggaggcggactccgggtccgggggacgtgtgtgcggcggcggcggcggcggtgccggcggtgcgggagggaagctgccgtcgtccaagttcaagggcgtcgtgccgcagcccaacgggaggtggggcgcgcagatctacgagcggcaccagcgggtgtggctcggcacgttcgccggggaggacgacgccgcgcgcgcctacgacgtcgccgcgcagcgcttccgcggccgcgacgccgtcaccaacttccgcccgctcgccgaggccgacccggacgccgccgccgagcttcgcttcctcgccacgcgctccaaggccgaggtcgtcgacatgctccgcaagcacacctacttcgacgagctcgcgcagagcaagcgcaccttcgccgcctccacgccgtcggccgcgaccaccaccgcctccctctccaacggccacctctcgtcgccccgctcccccttcgcgcccgccgcggcgcgcgaccacctgttcgacaagacggtcaccccgagcgacgtgggcaagctgaacaggctcgtcataccgaagcagcacgccgagaagcacttcccgctacagctcccgtccgccggcggcgagagcaagggtgtcctcctcaacttcgaggacgccgccggcaaggtgtggcggttccggtactcgtactggaacagcagccagagctacgtgctaaccaagggctggagccgcttcgtcaaggagaagggtctccacgccggcgacgtcgtcggcttctaccgctccgccgccagtgccggcgacgacggcaagctcttcatcgactgcaagttagtacggtcgaccggcgccgccctcgcgtcgcccgctgatcagccagcgccgtcgccggtgaaggccgtcaggctcttcggcgtggacctgctcacggcgccggcgccggtcgaacagatggccgggtgcaagagagccagggacttggcggcgacgacgcctccacaagcggcggcgttcaagaagcaatgcatagagctggcactagtatag

SEQ ID NO: 5182 - DNA, 954 bp, Oryza sativa
  Predicted polypeptide sequence is orthologous to G867, G9, G993, G1930
atggagcaagaagctgccatggtcgtcttctcctgcaactccggctccggtgggtcgtcgtcgacgaccgattcaaagcaagaggaggaggaggaggaggagttggccgcaatggaggaagacgagttgatccacgtcgtccaggcggcggagctgcggctgccgtcgtcgacgacggcgacgcggccgtcgtcgcggtacaagggggtggtgccgcagccgaacgggcggtggggggcgcagatctacgagcggcacgcgcgggtgtggctcgggacgttccccgacgaggaggcggcggcgcgcgcctacgacgtggcggcgctccgcttccgggggcgcgacgccgtcaccaaccgcgccccggcggcggagggcgcgtccgccggcgagctcgcgttcctggccgcgcactccaaggcggaggtcgtggacatgctgcggaagcacacctacgacgacgagctccagcagggcctccgccgcggctcgcgcgcgcagccgacgccgcggtgggcgcgcgagccgctgttcgagaaggccgtgacgccgagcgacgtcggcaagctcaaccgcctcgtggtgcccaagcagcaggccgagaggcatttcccgttcccgctccgccgccacagctccgacgccgccggcaagggcgtgctcctcaacttcgaggacggcgacggcaaggtgtggcgattccggtactcgtactggaacagcagccagagttacgtgctcaccaaggggtggagccgattcgtgagggagaagggcctccgaccaggcgacaccgtggccttctcccggtcggcggcggcgtgggggacggagaagcacctcctcatcgactgcaagaagatggagaggaacaacctggcaaccgtcgacgacgatgcccgtgtcgtcgtcaagctgttcggcgttgacatcgccggagacaagacgaggtaa

SEQ ID NO: 5183 - DNA, 1185 bp, Oryza sativa
  Predicted polypeptide sequence is orthologous to G867, G9, G993, G1930
atggacagcacgagctgtctcttggacgacgcgagcagcggcgcgtccacgggcaagaaggcggcggcggcggcggcgtcgaaggcgctgcagcgcgtgggcagcggcgccagcgcggtgatggacgcggccgagcctggcgccgaggcggactcgggcggcgagcggcgcggcggcggcggcgggaagctgccgtcgtccaagtacaagggcgtggtgccgcaaccgaacgggcggtggggcgcgcagatatacgagcggcaccagcgggtgtggctcggcacgttcaccggcgaggcggaggcggcgcgcgcctacgacgtggcggcgcagcggttccgcggccgcgacgccgtcaccaacttccgcccgctcgccgagtccgacccggaggccgccgtcgagctccgcttcctcgcgtcccgctccaaggccgaggtcgtcgacatgctccgcaagcacacctacctcgaggagctcacgcagaacaagcgcgccttcgccgccatctccccgccgccccccaagcaccccgcctcctctccgacgtcctcctccgccgcgcgcgagcacctgttcgacaagacggtgacgcccagcgacgtcgggaagctgaaccggctggtgatccccaagcagcacgccgagaagcacttcccgctccagctccctccccctaccacaacctcctccgtcgccgccgccgccgacgccgccgccggcggcggcgattgcaagggcgtcctcctcaacttcgaggacgccgccgggaaggtgtggaaattccggtactcctactggaacagcagccagagctacgtgctcaccaaggggtggagccgcttcgtcaaggagaaggggctccacgccggcgacgccgtcggcttctaccgcgccgccggtaagaacgcgcagctcttcatcgactgcaaggtccgggcaaaacccaccaccgccgccgccgccgccgccttcctcagcgcggtggccgccgccgccgcgccgccacccgccgtgaaggctatcaggctgttcggtgtcgacctgctcacggcggcggcgccggagctgcaggacgccggcggcgccgccatgaccaagagcaagagagccatggacgccatggctgagtcacaagcacacgtggtttttaagaagcaatgcatagagcttgcgctaacctag

SEQ ID NO: 5184 - DNA, 802 bp, Oryza sativa
  Predicted polypeptide sequence is orthologous to G867, G9, G993, G1930
ctctcttctctcccccttttctcttccccgttcgaacgcctcggcggcagcggcggccgggggccggagtggcgacggcgaccgcgccaccgcctgccctgtctccaagctggcctaccatcgcgcaagctccgccaggggctccgccgggggcgcggcatgggcgcccgcgcgcagcccacgccgtcgtgggcgcgggagccactgttcgagaaggccgtgacgcccagcgacgtcggcaagctcaaccgcctgctggtgcccaagcagcacgcggagaagcacttcccgctgcggcggacgagctccgacgcctccgccaccgccgccgcggccacctgcaactctgcaagggcgtgctcctcaacttcgaggacggcgaggggaaggtgtggaggttccggtactcgtgctggaacagcagccagagttacgtgctgaccaagggatggagccgattcgtgagggagaagggcctccgcgccggcgacaccatagtcttctccggctcggcgtatggccccgacaagctgctcttcatcgactgcaagaagaacaacacggcggcggccaccggcgacgagaagccaattacaagcggcgaagcaacacgcgtcgtgaggctgttcggcatggacatcaccggcggcggcggcgattgccggaagcgggagagggcggtggaaatggggcaagaggcgttcttgatgaagaggcaatgcgtggttcatcagcgtactcctgcccttggtgccctgctgttataacatcaaatcaattcatatatacatcataaatcttc

SEQ ID NO: 5185 - DNA, 1368 bp, Oryza sativa
  Predicted polypeptide sequence is orthologous to G1073, G1067, G2156
ataccagtagcagctaattaagtgggtgggttcgcttgcttgctttgcttttgcttggagacgggagcgacgctggcttcagcgattggcgtggagaagctagattgttggtgcgactttccgaccgcgaaaatagtagggctggcaaaccggtggccggccggcgatccggccgaggggatggggagcatcgacggccactcgctgcagcagcatcaggggtactcccacggcggcggcgcgggagggagcaacgaggaggaggaggcgtcgccgccgcccggcggtggctcggctacggggtcggcgggccgccggccgagggggaggccgccgggctccaagaacaagccgaagccgcccgtcgtggtgacgcgggagagccccaacgcgatgcgttcccacgtgctggagatcgccagcggcgccgacatcgtcgaggccatcgcgggcttctcccgccgcaggcagcgcggcgtctccgtgctcagcgggagcggcgccgtcaccaacgtcacgctccggcagcccgcggggactggggccgccgccgtcgcgctgcgggggaggttcgagatattgtccatgtctggcgccttcctcccggcgccggcgccgccaggggccacggggctcgccgtgtacctcgccggcgggcaggggcaggtggtgggtgggagcgtcatgggggagctgatcgcgtcgggccccgtcatggtgatcgcggccacgttcggcaacgccacgtacgagaggctgccgctggaccaggaaggcgaggagggcgccgtgctgtccgggtcggagggcgccgccgcgcagatggagcagcagagcagcggaggcgccgtcgtgcccccgccgatgtacgccgccgtccagcagacgccgccgcacgacatgttcgggcagtgggggcatgcagcggtggctcggccgccgccgacatcgttctagcactggcaccggttaatcaatgtctctctacctagctagttagccttccacttctttccctagttgtttgagtaggttaattaatcatttaccatgttaattaatgtgctatgtaatgcataagtactcgtgtgatcttatcgttccattttcttcagagtttgaagaatgtaaaattactgtgcgtatcaagatcggcagtggttgctcacttgctccttcactagctatctgctcgatcataagctcttgcatcttgttcttcgcaagcaccaattcacgcttgtgtcaattgcttggtcattttgcatactttggactactcgatcactacaaaatatttcttgagttttactccctgcatgcactgctcaatgcgtgattatgcctgaatacactaattgttttgtt

SEQ ID NO: 5186 - DNA, 1011 bp, Oryza sativa
  Predicted polypeptide sequence is orthologous to G1073, G1067, G2156
atggccgggatggaccctggcgggggcggcgccggcgccggcagctcacggtacttccaccatctgctccgaccgcagcagccgtcgccgctgtcaccgctgtcgccgacatcccatgtcaagatggagcactccaagatgtcacccgacaagagccccgtgggcgagggagatcacgcgggagggagtggaagcggcggcgtcggcggtgaccaccagccgtcgtcgtcggccatggtgcccgtcgagggtggcagcggcagcgccggcggtagtggctcgggtgggccgacgcggcgcccgcgcgggcgcccgcccgggtccaagaacaagccgaagccgcccatcatcgtgacgcgcgacagcccgaacgcgctgcactcgcacgtgctcgaggtcgccggcggcgccgacgtcgtcgactgcgtggccgagtacgcccgccgccgagggcgcggcgtgtgcgtgctgagcggcggcggcgccgtcgtcaacgtggcgctgcggcagccgggcgcgtcgccgccgggcagcatggtggccacgctgcggggccggttcgagatcctatctctcacgggcacggtcctgccgcctcccgcgccacccggcgcgagcggcctcaccgtgttcctctccggcggccagggccaggtgatcggcggcagcgtggtgggcccgctggtcgccgcggggcccgtcgtcctgatggcggcctcattcgcgaacgccgtgtacgagcggctgccgctggagggcgaggaagaggaggtcgccgcgcccgccgccggaggcgaagcacaagatcaagtggcacaatcagctggacccccagggcagcaaccggcggcgtcacagtcctccggcgtgacaggaggcgacggcaccggcggcgccggtggcatgtcgctctacaacctcgccgggaatgtgggaggctatcagctccccggagacaacttcggaggttggagcggcgccggcgccggcggagtcaggccaccgttctga

SEQ ID NO: 5187 - DNA, 652 bp, Oryza sativa
  Predicted polypeptide sequence is orthologous to G1073
accgcagcagcagcccacagcctcgcagtcctctgaggtgaccgccggtgacggcggcggcggcggcggtctcggcatgtatcttggaggccatgtgggatcctaccagcagcagcagcagcaacttcccggaccaggagacaacttcggtagctggagcggcagcatcaggccgccgccattctgatccaaacacctcaaatcaagctctcccccaacaacgccatgcatgtctaaatcctcacaagattcactccaagaagacgaagctgagtgagagtgatggatttcatttcatctcatcatttgtgacaatgcattcatttttttttgttgttgaaggctatacatcttgcaagattacaagttaatcgaggcgcatgcattcttgattggagatgtggaagaatctcttgcattgcagaagtactaatagaatcaacattggaaggcagaattttttttggctggagatggagggaggtcagtcaattagtgccaaggaactgaacaagatcccggtaaggcaggttagtaggaccccggtgtttagtggttcatcctgtagacttttgatcaagaatgatgcttgtcatgaccttttacttaaaaactttcccttggaatgatgcttgttattgcttttcactac

SEQ ID NO: 5188 - DNA, 1193 bp, Oryza sativa
  Predicted polypeptide sequence is orthologous to G1274, G1275
aagagagtcggccaacccacatgcacgtgtaccgatgtacatggcggcggcggctgcgggagcaagcacacccttcaatttttgccgccacggctcgcacgccgagtacgacgccgtcttcagcggcagctggatggcgcgccgcccctccgcggcgccgcacggtggcggcgcctccggctccggctccggcagcggctacggcgccgcctcgtacgttgctcccaccttcggcgcggcgtttaggcagcagcatctcgacctcctcgactacctgtccgacgatcagggcgttccggcgccaccaccagcggctgtgcccagcgcgtcgtacgtgacgccggcgccggcgatggcccccgctgaaccggtcgtgccggatgctgttgccgccgccggcggctatccgaggagcgtggctgcggcggcggcggccgtggccggcgagggaagagatcggacgacgacggacaagatcgcattccggacgaggtcggacgatgagatactcgacgacgggtataagtggaggaagtacgggaaaaagtccgttaagaacagccctaatccgaggaactactaccggtgctcgacggaggggtgcaacgtgaagaagagggtggagagagacaagaacgacccgcggtacgtggtgacgatgtacgaggggatccacaaccacgtgtgccccggcactgtctactacgccgcgcaggacgccgcctccggccgctttttcgtcgccgggatcagtcacccagaccttaattaagctaggatatgctttgccggcccagctgtggcttagcttgatgtgcagctctagttattgtatgggctgtacggttcagttatttgaagcgggttatacttatatgttgttaatgtttgcctactgattttaattaatttcttagagttagactcaatttggcggagggattcccttcaaaaaaagaaatcccttcaaaaaatttggcggagggacgactgatatatatggtgacattagctaggtttgctcacttttggcaaaaataacaagtttcctttcgtgccactctccgtccctaggtcagtgtttggcaaaacgcccaaaaaaatgtccgtgttgccaattaatttgtcgattgtgtacttcaatttcaagccaaatttcggcaaagctagtactttgtgtgttttagatgttg

SEQ ID NO: 5189 - DNA, 1091 bp, Oryza sativa; identical to SEQ ID NO: 2099
  Predicted polypeptide sequence is orthologous to G1274, G1275

SEQ ID NO: 5190 - DNA, 839 bp, Oryza sativa
  Predicted polypeptide sequence is orthologous to G1274, G1275
ctgtcaaacactcaatcagcagcagcagcagctagcttagcttagctaacgcacagtgacgcgagcatggcggcttcgctgggactctgccacgagacgtcgtacgcctactcgtacccggcgtcgaacacctcctcctccttgtgcttccctcctctcatggcggaccacatcgtcgacggcggcggcggcggcggctgttcctttggtgaattcctggagctcggccattccgtgtactcgctgccgcttccgccgccgccgtcgcagccggtggtggtcgccggcgggaacaatgatcagtatggcgtgtcgtcgtcgtcgtcggcggcggcgacgacgagcaggatcgggttcaggacgaggtcggaggtggaggtgctggacgacgggttcaagtggcgaaagtacgggaagaaggcggtgaagagcagcccgaacccgcggaactactaccggtgctcggcggcggggtgcggcgtcaagaagcgggtggagcgcgacggcgacgacccgcgctacgtcgtcaccacctacgacggcgtccacaaccacgcgacccccggctgcgtcggcggcggcggccacctcccgtaccctacttccgctgcgccgccgtggagcgttccggcggcggcggcctcgccgcctcccgcgcacgcgcaggcgtggggggcgccgctgcacgccgccgcggcggcgcactcgtcggaatcgtcgttctgaacgctgaatttacttctgtttttgtttttcttggttgcttgttagttgtaccgccgttcgtgatcgatcgatcggttcttgtatgcactagacttactacttaaaaaaaaaaa

SEQ ID NO: 5191 - DNA, 666 bp, Oryza sativa
  Predicted polypeptide sequence is orthologous to G1274, G1275
atggcggcagtcggcgcgcacgcagcggtctaccaccacccggtctcgggcctctcggcgccggcgggcgacgccgcctactcgatgtcatcgtacttctcccacgggggaagctcgacctccagctccgcgtccagcttctccgccgccctcgccgccgcaacgacgccgccgcttcccgacccgtcggggtcgcagttcgacatctccgagttcttcttcgacgacgcgcctccggccgccgtgttcaatggcgcgcccaccgccgcgctgccggatggcgccgccgcaaacgcaacaaggagcgcggcggaggcggtgccggcgccggcgccggcggccgtggagaggccgcggacggagcggatcgcgttccggacgaagtcagagatcgagattcttgacgacggctacaagtggcgcaagtacggcaagaagtccgtcaagaacagccccaacccaaggaactactaccggtgctcgacggaagggtgcaacgtgaagaagagggtggagcgggacaaggacgacccgagctacgtggtgacgacgtacgaggggacgcacaaccacgtgagccccagcacggtgtactacgccagccaggacgccgcctccggccgcttcttcgtcgccggcacgcagccgccaggttctctcaattaa

SEQ ID NO: 5192 - DNA, 1042 bp, Oryza sativa
  misc_feature (845)..(845): n is a, c, g, or t
  misc_feature (892)..(892): n is a, c, g, or t
  misc_feature (894)..(895): n is a, c, g, or t
  Predicted polypeptide sequence is orthologous to G1274, G1275
agtcgccgaggtcggcggaatccgggtgaccacgcgtcgcccacgcgtcgagaaaatcacggtgaaaaggttcagcactgtgcaatggcggcttccgtaggactgaaccctgaagctttcttcttcaacaactcctactcctactcctcatcccctttcatggccagctacacgccggagttctcggccgccgctatcgacgccaacttattctccggcgagctcgatttcgactgctctctcccagctccggcccaggagtacccggaaaatgaaaacactatgatgaggtacgagagcgaggagaagatgagggcgagggtgaacgggaggatcgggttcaggacgaggtcggaggtggagattcttgatgatggcttcaagtggaggaagtacggcaagaaagctgtcaagaacagcccaaatccaaggtacacgaatattgacgtcactgccactatgcccatttggctatcaatcttaattaattagtaccacaagtttaatcactagcttaattactggcgttctgcccaatcaaagttttataatcaccttttctgaaatatcatctgttcagggttaaaaattttagaatgcaaaaaaattgcggagatcttgaactgaattttcagacaaattttgtaatttgaacaggttttcactttacttgaaccgaatttgagaaaatccctcacatccgagggttgggcggattacttccaccgggaccctgttacccaatgattctttgaactgtacttgagggtcggaattgtccatatggtgggggaaatcaccctcatttgaacaacggggcgaggggcgcacgggtgaggggaganttccagggacaccgccggttcgtacaccccccgcgtggcaatacacntnngcgaacgtgcgtaaacaccgaggagacagctcgagaagagcaggacactggagacatatgaggaagaagcgacaaacatagaacattcgaacacaagcatgcggacgaacggtgagagaaagcaaaacagccagcacgaagcgaacg

SEQ ID NO: 5193 - DNA, 803 bp, Oryza sativa
  Predicted polypeptide sequence is orthologous to G1760, G152, G153, G860
atggggagggggaagattgtgatccgccggatcgacaactcgacgagccggcaggtgacgttctcgaagcggaggaacgggatcttcaagaaggccaaggagctggccatcctctgcgacgccgaggtcggcctcatgatcttctccagcaccggccgcctctacgagtactccagcaccagcatgaagtcagttatagatcggtatggcaagtccaaggatgagcagcaagccgtcgcaaatcccaactcggagcttaagttttggcaaagggaggcagcaagcttgagacaacaactgcacaacttgcaagaaaatcatcggcagttgatgggcgaagatctatctgggctgaatgttaaggaattgcaatctctagagaatcagctggaaataagtctacgtagtgtccgtacaaagaaggaccacgtcttgattgatgaaattcatgaactgaatcggaagggaagtctagttcaccaagaaaacatggaattatacaagaagatcagtttaattcgtcaagaaaatgctgagttatataagaagatctacgagactgaaggaccaagtgaagtcaatcgggattcaccaactccttacaattttgcagtaattgaaaaaacaaatgttcctgtgcaacttggactcagcacactaccacaacatagtgacgccgaacaatcaactgctcctaagctagggttacagttgaatccatgaccagaaaaacattgttttgctacacccttgtatgctgaagggatactatttgctgtcaagagttgatactcagatcaaga

SEQ ID NO: 5194 - DNA, 1845 bp, Oryza sativa
  Predicted polypeptide sequence is orthologous to G1760, G152, G153, G860
atcgctcgcggtcgcagtcgcagtcgcccacacccttgccgcaccatggctggaacccgcggcggattcgagaatcattagatgattacttgtggctttcttgcaagttgtgcagttgctgcctcaagcttgctgcctccctctgccaaatctatcagcaaaaaaagaaaatcatgtcagtttccttgaactatatacatatgattaatctagaaacgcagtatgttgccaaaaatcacacacaactcaatcacatatgcatttgagatgaggtaaaatgctatctgattcacatagttccaatatctcaagatgtgggatatgcgtagcacaagtgcatcagagtgttatagttgttcagtcttcagtacttattattctagattaatttggaccaacttgtcaattcagctgacacttgtttttgtctagtgctccagtagcttggttgtttcatcatcattagacttttaaacctttggtcctaaactcctagctgaaaaatttgcacactgaacttccctgtgttctaaggaaaaaaaaaatctagacataaccttgctgatctgtattatggaccggccattggagtgcataatgcataactgctgatcactttgttggcacaaaacttacgcatagacataggaggtacttatgtataattgtatctttaatcaggactttgttttcaaccattttgttgatataacagttatactgtagtaatgatgagtacagtctccaatgtaaactcagggcaaatcagatttatccctttttggtgcttggtatctttttgtatttttcatgagcgatggcatttttgaacccaaaatagagggaaagagaaggatctctgtgggggcatgctatgtactacagttctttgagaccatgtaggtgtggatgcttgttttgaccttttccttaacatatagaaagaataaacattaaataaatgatgacatggaaatgaaattcataaaggagtacataagctagtactcctgaaaatatcacttcatattcccccatgattcagtaacatgaatatcataccatcagcagcagtgaaatttttatgcgtagacggtttgtttcttaaggtatatattttttatgtttacaattgtctgtcgagtttactggtcaattgagcaacaacggtacttttaactgttaatatcacttggtttgctatgtatccttgttgttctggctttgttgctttacagccattctgcttacgctattggcatctgttatttagaaaaccattttctaacagtttttagatttcctttcgagtctccaactgtttttaacctccaagttgccacataatgcataaatataccgagtaagtttgcccccctctgaaatatggatgttagatactcagacaggttcagtatgtgttgggtgttgttttctgagtttgtggttgtcataagatgcagcgaaattactgcgctgtatcttggaccaatgcaatcagcgaagtccttatcgtgccaaaaggatgtgcatggattttccatcatttgcaaacttgaggatggcctgccctgatgccctcagatgctgatgaagtgtgtggttcatgaaaacgtgagaagctaagtagtggagtaacgggagtgagtaccagtgtggccactatgaagaaagttaattactgagaaattaagacttgagcatgttattttcaagcaacttgtacagcattatattgcactaccatcaaatgcttctcctgcctatacaatactctgcaagctcttgtattgtacactgttttatcttgtttaaagtatgcttgtttttgcttatgttgagatt

SEQ ID NO: 5195 - DNA, 1104 bp, Oryza sativa
  Predicted polypeptide sequence is orthologous to G1760, G152, G153, G860
gtgctatacgcatcttccctagcttgctaagctagctagtcttctccttcctttctcctcttcctcctcctcctcttcttctcaatcttgctcagcaaatcttgtcggggagagagagagagagatcagcaaggagaagagggaattaagctagatcgaggtagtcgtcgatcgatcgattgaagatggggagagggaagattgccatcaagaggatcgacaacacgatgaaccggcaggtgaccttctcgaagcggcgcggcgggctgatgaagaaggcccgggagctggccatcctctgcgacgccgacgtcggcctcattgtcttctcctgcaccggccgcctctacgacttctccagctcaagcatgaaatcaataatagagcggtaccaggaggcaggagaggagcattgtcggttgctgaacccaatgtcagaggctaagttttggcagcgggaggttacaactttgaggcagcaagtgcaaaacttacaccacaacaacaggcaacttttgggagaggaaatctccaacttcacagttagagatctgcagcttctccagaaccaagttgagatgagcctacattccataagaaataaaaaggatcaacttttggcagaggagattctaaaactcaatgaaaaggggtctcttgttcaaaaggagaacagtgaacttcgcaagaagttcaacattgctcatcaacgcaacatagaattacacaagaagcttaactctggagaaagcacgtcaagtgagcaagttaccagaagctcaaaggatcccggagaatcgagtacaccccgtgattcacgtgtgtgtattgaccttgaattgagtcaaaaagaagttgaagatgaataacacatgatcaagtgttaaaaacaacatgatggccagtaacttttgcagcatcacgcctactacaagcgcaagaaaagctagctactactggaacaagggatcttaatcatgttttgaaacttaattagtaatattttaaaaaatcgtactatactaatcatgatgtgtagcgtattgcaccactgaatttattactgtaattaacatggtgagtgttaaaatattttgtgatatc

SEQ ID NO: 5196 - DNA, 3149 bp, Oryza sativa
  Predicted polypeptide sequence is orthologous to G1760, G152, G153, G860
gttgtgtgcctacaaggctagagtaaagaccttatcgctcttgctaaacatacatacgtgcaagcacagtgcctagctaatccatcagcagaatagaagggtggagggggtgggaagaggccaggcccctccgccccctggcgtcgctcttgctgatacttttcttgttctggtacatctgcacagataaattataatgccttttcatctcttctgtctgcttatggctttttaagataaaacagagcattgatcttgcatgctctacacttcgcgcactgtttgtttttgccaataagtttgcacacatgtagctgtcatttgggtaaacaaacttgcagatagtgccaaatagtcataagaaaataattttcatgggctcttcagataatacatttttattcgaatagattttacagtatcagatattaatcatccaagcatgcaaactgtgtcttgttatgtgttagcttctttatgaccaatacattttaagagctctgaactgtagcccttaagaatagtgaaaatataggcaacacttccacaccataaattgtcatggatgcaattggagcctgcaataatttcattaagttataattgatgtttcactaaagaactgagaatggatagatggatcatgtgcagaaaatctgagttaccctagtttaggaggtgtggtttgctcagcatcattttgttggcttgggggattgagttcaagacgagcaggagtgttggcttcctcgataaccgcaaagttgtatggagttgttgaatctcgattcgcttcattttctgcccctgtctcatagagctgaggagagagattagctgtcatcatataatgaagcgtatatcctgtgaaatcatctatctgcatttatcaagtaccttcttgtacagctcagcattttcttggcgaatcaggttgacctttctgtacagttccatgttttcttggtggatgagacttccctgcaaataagccagcaatagagttagcttactagctgattcaaagatttagcaattgtacatgatgttgtagaacctttcgattcagttcgtggatttcatcaatcatgagctggtcctgaaaacaacaatattgatcttaagttaatccattatataatcaatcaggtgcccaacaaaaaaatatggttagtaggttgaccttttttgtccggatgcagcgtatgctcatttctagctgattttctagagtttgcagttccttgacacccaatccagaaagatcttgccccatcaactgcctgccatcaaccaatggatgttatagtgttgttctgatgatatacagagtgaatattgacacttaattttagctgatcaacagacagctgttaattgataataaaaataatttgtacctttctagtttaggtattgtaaattaggcctgaaggacaaaatggagtgtttgaacaataatttaccaggcagaaagcacaggtgaagaaaatgtgatattcactctcctttgtaaatttggtctgtccgcctttgatgggtgctcagttctgtttttcttttagagataaccggaaatgcataaaaatcgaatggctgaaggtatatatttcttacttttaaatgatatagaaaattcacgtgccttcttcatttcttttgtttgtgaaggttaaacaatgcattatctataggaaatttggaatcagcatatatcactttcatactctgttttttcttcttttttctaagtatcatatacccaagcactaggtgcttgtttttatgatctggtactagtttatatttactatacaatcaggtgctggaagtattattgtcgctagcagttgctggattcatgagcaagtccccacaaaaaaaaaagttcgtcatcaagggttcatgatgcatgtatttcatagtagtagatatatgatggtttatgtttttctatcttgaggaattttctgatggaacattgaaaaacttgcagggttttatggccataccgatgattttcttgcaagctgtgcagttgttgtctcaagcttgctgcctccctttgccagaactattggatatgaaaacagagtcaagaaatgcagaatccaggtttgccaaaagcagcaatataaatatgttgtgtatacccatagaaacatgctgggttatcaactcactagtttttttttaaaaaaaaggaaactcaattacattagacaagaagactatttgaactgaggaagttattgtgtatggtaaaagaagtaacaagaggcaaacaaagaaatttgttgtaaacaaataagggaagtagtattatctttccagtttgaagacagtttttttttccagataagacgatgagctaccaactctattgaatttggtactccattatcagtcctcgttttgcggggtgttaccccctattgtaaaaagcttgtttgtctaagcaaaatgcttccaagtcccaccaaagctagattaactacaaagtatctgcagagtgcacaagtcaggtaaaaaacttgtttgtctaagcaaaatgcttccaagtcccaccaagctagattaactacaaagtatctgcagagtgcacaagtcagataaaaaacttgtttgtctaaacaaaatgctcccaagtcccaccaagctagattaactacaaagtatctgcagagtgcacaagtcaggtaagtgatgattatatcatcctggtacaagctttattgcggtgaaagataagcagttagtctgaaatctgtacagatctgtcagctgttaccgaagcaaaaggttcaatgtgaacttaaagatgcagtactgatccttttaagaggatttaacacagatttaacaggtacgtgccccttgtgattctttgttagttttcttgttataatgatgtttttatcctctgaattcaagcagggtgttctgtatgcgagctgtgatgggatggttctcttcagaagcattttattttaactaaattcagaagcatttcgatggcatgaggactgttcgattgacaatttgtatgtacatttccaccgtttacgcagcttaggaattggaccataattagttgtgtacctgcaagttttgtatacgaattatcctgaagggtgttcggtggattg

SEQ ID NO: 5197 - DNA, 3308 bp, Oryza sativa
  Predicted polypeptide sequence is orthologous to G1760, G153, G860
acaatattttgtattaatttatgttttacaggcatacaacagatccaactttcaatgacatgtttattgtttagtttagctacaataattgttgggtagttgtagagcagcacatggtacttatgccacaagcccgcaaataaaataattcgcatttgctcatcctaattcatgctagcatctctattgcagaacaattttgatactattttttttttaaaattagccttgaaaatgccacttcccctaaggaatgacaaatgcatttttttttacaaatgcaaaaacttgcaggtagacacatatttggcaggtgaattcgtgtcatatggacatatctttcattggaagatatgtccatatgttggagctatttcaccagttctttcattggaataatgttagcatttaatcagtgatataggagatgattcaccttcaacaagctctcatttatcatcatgacgagtcagaagaatccgattgtcaagttacgccttctaccatatactccccaccaaaaacagctaccactggtaaataaattgctttctgttctaattggtgcctgaatttctgtatgctagatctgattgtttgttgctttcctggtattgtgtagtttttagttatgatgtacataatcctaagttaatccagaaattaatttttgagttctttctggagtttattcagtagtttataggttgtgaccaccagtgtccttttatggctgaatacaactcaaagaatcttcatgttggagttggattcactttggcagttcatacagtggatgctgatagatgcgctcgattattcctgtcgatagcatcctagtattgtgtctttatatagctatatctagcattttcatgtaaaagctatctgttctgtggatgggtgctcttattggttgcagcaatcaggataatcagctaaaataatgatatattgcagccttgtcagcctttattatatactgggttccctaaattgtcatctagtcattagtgccaaagtgcatgtagtcttctctgatcgttatttataactttatatgccaatggatgttacagacaacgtagtgtatgtcaatctatctggcgttttatttatcagaatactagaagagaatttgcaccagtggttcaagtaaatccctgaacattgaaactagatagtttgggctttttggcccctaatcttgtttgattgatacaaacaagtcaacgggtcacaagtgcttttgactgacagactacatccgtttctctcctctcatcttcactcttccccatcgaattctcctctcatcttcttcactcttccccatctttgaccaaattagccgcatcctatgcctggtggaatattctgacacaacatagcagtgtggcttgtttcagcagaaaattatttgacaggcgttgattgcaaagctgtcacagctgcacccatctgatcagatataggtaaactgagatgtggttctcagccagtgggaatgatgtacaaccacgttgtcattcaggggaactaaaaaccatctactcctgtttttagcaactcacatacagtacagatacctagaatcaacagatatccctactttaaccactttaaacaagtctgaggacatatattcctagtatcaatgttcatacacttgaaccagtaatgcaaggttcaggacatacaatgcaatttactcttgttttcttttatagttcatttgtcctcattttggtccctgatttaagttggacattcttatctcactagacggttgggtaagtaatgttaggggtcaaaatatagtggagttatgctatccaatcttgaaagcaatgtagagctttgatctgttactatccagtactacagtgaacagctagacttggagctagtgatttactcccttattggatacggatattgaagtagatatgggctggatgcctatactatgtaaattcacccattgacggttcattggctcagtcagatagagaacatgcctgcttaactgaattagtgaaagcaagtcaaataactaagtggcaactcttatcagcaaaactaatttgtgattatgatctgtggcttgtttatttcaaccatttcttttatatgaattgcgtgtaactcagaatttcatgtgaatactgagtaactagcacatctattttgatttgggcccaatttttcaactggcaagaaagaattggagtacaagatcaaagggtgggagtaactcttagtcttaggcatcgggattgggcaggatttgttgtgcacctaattttctttcatttctcgtacttgaacttgtttgtgcatataagtatgtgatcatccaactatttctaagaggaaattagccacaagcaacaaataggaagtttttatattcatacctttgcctcagaacttgcgttcatggtttgatggggatcttctttcgtctcattgtatctctcaattatggatttcatgctggttgaaaaaaaaaatcaagatcccattagaacacatgtcaacacatgccacagtagtgttgaatgctatcatatagctcctgcaagcttattttgtagtacatgggcatcagtatgtaagatgacaaatgcaaacttttaatgaaggcctagttctttgacaagtaatccacgtggatagataactgtaaggtcaacacaaagaattaagtgtggagtgttttgagttaattggttcttactgcttaatttcctgttatcttaaaacttcctgttatcttaaaactagacactgttctcctaatttgtcatccttttcctatttagtttgttgttttctacgaatcttgagctatttgtatggagaaaaagcagtgacaatggtaaaagatggttttgaaggcactacaagacatgcctcaagttataaccgtgctgttacgaggatccaagcatccaaaacacttggaagattaagcttcaggcgttgtcgacataatgcataattagttgcatacttcagtggatgattgaacgggatgtttggatatgcaaatatttctatgcatccggactgaatactttctgaacacaaagcaagccaacctgccatggccatgacacgatggttctatccatattttcctatttgtcatgtacggctgggctgggcctagcaccaaaactattcgttgttgtttattattattaggtaattaggttattcgtagatcatggttgtttattttattatgaacattttgataacattttttttaaaaaattaaagcctttatttttccgatc

SEQ ID NO: 5198 - DNA, 437 bp, Oryza sativa
  Predicted polypeptide sequence is orthologous to G1760, G152, G153, G860
aaacaaaagacccctccatttccattcctcctcttcctctcttctccccccccctccaataattcaaccccctcttctgggaaacctgggagctttctccttcaagagctccctgctagctagatctcctcctctctttctctctctctctctctctctttctgtccatttctatctgtgctctcgcctgagcggcgacaatccagctgagatcgatcgatcgatcgatggggaggggcaagatagtgatccggcggatcgacaactcgactagccggcaggtgacgttctcgaagcggcgcaacgggatcttcaagaaggccaaggagctggccatcctgtgcgacgccgaggtcggcctcgtcatcttctccagcaccggccgcctctacgagtatgccagcaccaccatgaagtcagtgattgatcgatatggg

SEQ ID NO: 5199 - DNA, 695 bp, Oryza sativa
  Predicted polypeptide sequence is orthologous to G1760, G152, G153, G860
ggaaaaggaggaggagatcgaaggggaagatggggagagggaagatagagataaagaggatcgacaacgcgacgagccgacaggtgacattctcgaagcggcggagcgggctgttcaagaaggcgagggagctctccatcctctgcgatgccgaggtcggcctcctcgtcttctccagcaccagccgtctctatgactttgccagctccagcatgaaatccataattgagagatacaatgagacgaaagaagatccccatcaaaccatgaacgcaagttctgaggcaaagctttggcaacaggaggcagcaagcttgaggcagcaactgcataacttgcaagaatatcatcgacagttgttgggacaacagctttctggtctggatgtagaagacttgcaaaatttggaaagtaagctggagatgagcttaaaaaatatccgtctgaggaaggacaatgtcatgatggatcaaattcaagaattaagcaggaaggttgttaccacttagcacattcactcaacattacttatgtacactagtctacttggtccaaatcttattggagtgagataatttgcttgacactgcacaaacttctcactgaattgtagggaagcctcatacatcaggaaaacatggaactacacaagaaagtcagccttgtccatcaagaaaacatcaatttacagaaaa

SEQ ID NO: 5200 - DNA, 708 bp, Oryza sativa
  Predicted polypeptide sequence is orthologous to G1760, G152, G153, G860
atggggaggggcaagatagtgatccggcggatcgacaactcgacgagccggcaggtgacgttctcgaagcggcgcaacgggatcttcaagaaggccaaggagctggccatcctgtgcgacgccgaggtcggcctcgtcatcttctccagcaccggccgcctctacgagtatgccagcaccagcatgaagtcagtgattgatcgatatgggcgagctaaggaggagcagcagcacgtcgcaaaccccaactcggagctgaagttctggcaaagggaggcagcaagcttgagacaacaactgcacagcttgcaagaaaatcatcggcagttgatggggcaagatctttctggattgggtgtcaaggaactgcaaactctagaaaatcagctagaaatgagcatacgctgcatccggacaaaaaaggaccagctcatgattgatgaaatccacgaactgaatcgaaagggaagtctcatccaccaagaaaacatggaactgtacagaaaggtcaacctgattcgccaagaaaatgctgagctgtacaagaagctctatgagacaggggcagaaaatgaagcgaatcgagattcaacaactccatacaactttgcggttatcgaggaagccaacactcctgctcgtcttgaactcaatcccccaagccaacaaaatgatgctgagcaaaccacacctcctaaactagggtaa

SEQ ID NO: 5201 - DNA, 992 bp, Oryza sativa
  misc_feature (876)..(876): n is a, c, g, or t
  Predicted polypeptide sequence is orthologous to G1760, G152, G153, G860
cagcggagggacggtcggagattccgggtgaccacgcgtcgctctctgtctctctctctcggggtattgcaagatagtagctaattaaccagcctttggccttcagtttccccatcggttcatcagagcacgccttcaatttcctaatcaatctcccatataattccccttagcttgtatgcctatcattagtacttcttgtgttgtgttgtcttcttgccttctttgagctagagctagctaggtttgtgacctgctgtacgtgcgtgtgttaattagatagatgtcttagatctgggagagagcgaggagatggggagggggaagatagtgataaggaggatagacaactcgacgagcaggcaggtgacgttctcgaagcgtcggaacgggcttctgaagaaggcgaaggagctatccatcctctgcgatgcggaggtcggccttgtcgtcttctccagcaccggcaggctctatgagttctccagcaccaacatgaaaactgtgatagaccggtataccaacgcaaaggaggagctacttggcgggaatgcacttcagaaatcaagatttggcagagggatgccgccagcttgaggcagcaactgcacacttgcaagaaagccaaaggcactgatgggtgaggagcttctggcctagtgttagagacttacaggcttccggatcgggtgaaatcagctacgtatatccaatggaacggccccctttgcacaggaacccgggctcctgtgaggggacctattccaggaaaatgaatcttaagctagtcgttgacaaaggggggttacgctggcggaacaagggcggttgtagatgacccaggtgggatcaggctgtctctcttagacacagagngaggatatcactaagacaccgcgccattcgtgcgcagtgatagtacctcagctcaggcgactaggcgtgctggcgtctaatcagagaggtagcagcagatgactggtgagtagagg

SEQ ID NO: 5202 - DNA, 882 bp, Oryza sativa; identical to SEQ ID NO: 2103
  Predicted polypeptide sequence is orthologous to G1792, G1795, G30, G1791

SEQ ID NO: 5203 - DNA, 660 bp, Oryza sativa
  Predicted polypeptide sequence is orthologous to G1792, G1795, G30, G1791
ccaatcggcgtcgtcaggcctctcgcgtgtgcgagcggttgcgtccgcatggaggacgacaagagtaaggaggggaaatcgtcgtcgtcgtaccgcggcgtgcggaagcggccgtggggcaagttcgcggcggagatccgcgacccggagcgcgggggagcccgcgtgtggctcggcacgttcgacaccgcggaggaggccgcgcgggcgtacgaccgcgccgcattcgccatgaagggcgccacggccatgctcaacttcccgggagatcatcatcacggcgccgcaagcaggatgaccagcaccggctcttcttcgtcctccttcaccacgcctcctccggcgaactcctccgcggcggcgggccgcggcggctccgatcggacgacggacaaggtggagctggagtgcctcgacgacaaggtcctggaggacctcctcgcggagaccaactatcgtgataagaactactagtgataagaactactagctagctagctactatggctacttagctagtacataccgatccgtcggtattagcaagacggacatggagcagtcgtgatctcgtctgtatgcgctccttgaaacgatcgagaccatgagcttgctagctagctacgcatagtagtagcaataacagaggaaaaaaaaaaa

SEQ ID NO: 5204 - DNA, 375 bp, Oryza sativa; identical to SEQ ID NO: 1849
  Predicted polypeptide sequence is orthologous to G1792, G1795, G30, G1791

SEQ ID NO: 5205 - DNA, 993 bp, Oryza sativa
  misc_feature (1)..(1): n is a, c, g, or t
  misc_feature (519)..(695): n is a, c, g, or t
  Predicted polypeptide sequence is orthologous to G1945
nacctgactgtgtacgaggcggacgacatgtacaaatcttctcaatttttctcccatttttcggagtaatcggtgtagaacatgtatatgtatacgaaaaagagccatatatttatgtataatccacaacgtacacgcacgtagtacaagtagtactccatgtacatgcagaagtacatatgcatatggtacaaaaactgatctctagctctcaggtacgtatagtcgatcgacgaatattttaaggaaacagatagcgtagtgaccggccgggcgatcaaccatgtatgcatggcgatggatcgacctagctagctagctctcatttaattcagcataaacacagataacacaagatacaaagcgtgagacgacagctgcatctcggccggcgctgcatgtcatcctccggtagcgatcgatcggattagttcacgctggagcagtcgatggaggggctgatggtctgcttagagcactctaatttcttcaaagtaacggagccggaggcacgacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattagcataatattcaagagataacggtaatcttccgggatctgcattacctacaatttcgtatgcaaccgtgaggaactagaccgagtacaacgaccaaatcgggacggccacgtccggaagaccgcaacacaaccgacagaaggagaacgaacctgccgcgcaacccacaacacggtacgcaaatccccacacacagaagaacaaacaacaacaaaccgacacacctcaccacacaaggaaccacagtccccaccagccacaacactctatcacgacacaactccacctagcgc

SEQ ID NO: 5206 - DNA, 2649 bp, Oryza sativa
  Predicted polypeptide sequence is orthologous to G2
gactacgttctctccattccatctccccccaatcgctcgggcgcaatgcgcagcagcagcagcaaggccacacccacaacctcccctgcttttcgcgtcctctgctctcctcctaggttagcagcggctttgccaacgagatagataggcaaaagagaaagtacttgcatagcccaacaaggcaacagctgctgctaccctctctttcttttctctgcttctccttgctctctcttctcttcctttctttctttctatctcctgctcgttctttccattttcgagagctcaacggaggaagaaggagagagagagaggcaaaggggagcaaaagaagagcagcatggacgggtttggtattggattcgtcttgttttgggcatttcttgcttctgctccttttacctttcatagcaacatcttatcaagttattcttgccatactctctcctctctctctctctctctctctctctcttctcttctctcatcactcaccatcttcttgtcttctctctctcctctcatccttttgtgcaatgcagggattgtggcaagcaggtctatttgggtaagtttcattcatgtccatcttgtccataccccccatacttgggaactgctacaagcggcctccacgattggctcgccaattggagccgttttttctctatgggcgcggtttcgattcctcacaatggctgcctttgtgacgactgaatttgcaggcggatttgacactgctcatgcggcggctcggtaagttggactcaattcctcgtcttccaatcgctgacttctattccctgctcgcccaatcgaatccggcgctgtcaaaattctaatcttttttgttatgttcatttcccaatcgcagggcgtacgatcgggcggcgatcaagttccgcggcgtggaggccgacatcaatttcagcttggaggattacgaggatgacctgaagcaggtgagagcgcgatcgattattattacctgaactttcctttcttttcatgagtcgccacggtttcgttagatcatactactattactgtagctgcaagattaacgggatcattgcagatgagcaacctgaccaaggaggagttcgtccacgtgctccggcggcagagcacggggttcccccggggaagctccaagtacaggggcgtgacactccacaagtgcgggagatgggaggctcggatgggccaattcctcggcaagaagtatgtcctaatcgatcaccgtttcttcctctttcgttcgatcgttcgttcttgggcaatctcccgtaaatcatcttgtgggtttttggtgcactgcaggtacgtctacttggggctgttcgacaccgaggaggaagctgccaggtaaaattattgggccgcactgtgcgcgcgcgcggccattgttgttgaatgtcgagtgtggctgctgcgccgtttgcgagtttacgcttctgggttagatgggcgagcggtgatggtgattgatgtttcttgtctcttggccacagggcgtacgaccgcgctgccatcaagtgcaatggcaaggatgcggtgacgaacttcgatccaagcatttacgccggggagttcgagccgccgggtgggtgtgtcatgtgtgcgcttactgctcatggctaggctgttcgtttgtgagttgtgactgctcatccggacaaaatctgtcactgttttgcagcagcggccacgggtgatgccgccgagcacaacctggacctctcgcttgggagctcggcgggctccaagaggggcaacgttgacggtggcggggacgacgagatcaccggcggcggtggcggtggcgcgggctccgaccagcgcgtccctatggcgttcgaccttgactggcaaacggcggcggcgaggagcaccaaagctaaggtaaaaaaagaatggggactttgctttccgcatcagccgattgtcttctcatcacgtaataaaaaggcttaaaaattcctcgttttcttgtctagttcgaccagaactcgaaccatccccagatgcctccggtcctgcaggtcacccacctgccattcagtcccaggcatcatcaccaagtgggtagctcactatacaactccactccacttcgctccatttgctgctgaatttctcgcgtttggtttcaccggtatccgtgagctgatgaattcttgatgtctgtgctgctagttcttgagcaatggtgatccggggacagcgggaggcctgtcactgacgatcggcgcaggcatggccgggcactggcctccccagcagcagcaagggtggggcaacgccggcggcatgagctggccgcacccgccgcacccgccgccgccgccgaccaacgccgcggccgccgcaaccgctacagcagctgcagcatcatcacgattccctccctacattgcgacgcaagcctcaacctggctgcagaagaacgggttccattccctgacccggcccacctaagatgatcaaagatttaaaattcaagatcgctgcattcatcgtctcctcgtcgatcgatcatggcaaagatcgatggagagagagaggtgtgtgtcactgacgcagggaaaaactcaatgcagatttaccagcaagaacaagagctggatgctattcttttgctct

SEQ ID NO: 5207 - DNA, 1671 bp, Oryza sativa
  Predicted polypeptide sequence is orthologous to G2
gtatgtcctaatcgatcaccgtttcttcctctttcgttcgatcgttcgttcttgggcaatctcccaatcatcttgtgggtttttggtgcactgcaggtacgtctacttggggctgttcgacaccgaggaggaagctgccagggcgtacgaccgcgctgccatcaagtgcaatggcaaggatgcggtgacgaacttcgatccaagcatttacgccggggagttcgagccgccgggtgggtgtgtcatgtgtgcgcttactgctcatggctaggctgttcgtttgtgagttgtgactgctcatccggacaaaatctgtcactgttttgcagcagcggccacgggtgatgccgccgagcacaacctggacctctcgcttgggagctcggcgggctccaagaggggcaacgttgacggtggcggggacgacgagatcaccggcggcggtggcggtggcgcgggctccgaccagcgcgtccctatggcgttcgaccttgactggcaaacggcggcggcgaggagcaccaaagctaagttcgaccagaactcgaaccatccccagatgcctccggtcctgcaggtcacccacctgccattcagtcccaggcatcatcaccaattcttgagcaatggtgatccggggacagcgggaggcctgtcactgacgatcggcgcaggcatggccgggcactggcctccccagcagcagcaggggtggggcaacgccggcggcatgagctggccgcacccgccgcacccgccgccgccgccgaccaacgccgcggccgccgcaaccgctacagcagctgcagcatcatcacgattccctccctacattgcgacgcaagcctcaacctggctgcagaagaacgggttccattccctgacccggcccacctaagatgatcaaagatttaaaattcaagatcgctgcattcatcgtctcctcgtcgatcgatcatggcaaagatcgatggagagagagaggtgtgtgtcactgacgcagggaaaaactcaatgcagatttaccagcaagaacaagagctggatgctattcttttgctctaccttttttcttctctctttcttcttctctgtttcttgattgggcgagcgagatggagatggatctgatcatgaatgggacacaagtgggcatgtaaatgaggagctccctagaaggcgagagagattggccaagcgtcgcctcaagcagtgtaggagtatctatcttttgccgtttcgctcgctttctttccttcttttctttcaccatggccaacaacgatgactctgggtgtcaacatcacagctcattttgttcggtctcatgttgcatcattcactgcatgatgaccatgattcgggaaaatttgctccatgcacctccgcttggccgacaacacttgccctctagtaagcatccttaaacacccacggtttctactactattcatcgctttataaatcctacggagtgctagctttacgctactactactgtcatgtaatctatcatcatcaaaagagacgatcagattaacatatatgtcaactatttaagctttggctctttgctttccaagaaacgtaactgccgagatgtggagcatatagaagtattcgtccttctagatgttggtactaaagtaatgttctttcttttctccctct

SEQ ID NO: 5208 - DNA, 2001 bp, Oryza sativa
  Predicted polypeptide sequence is orthologous to G2
gacgtcccatccatccctccccccccttttccctcctcctccacctccactgccatggccgcctccgccgctcctctctcccgcgtggtagccgccgccggttgccgccgctaggggagcgcgacgggggaacggtaggggcgacccagctcgctctgtcgccccgcggctggtgggggtgcgcgcgggggagagcggttggttagtatggtgctggatctcaatgtggagtcgccgggtgggtcggcggcgacgtcgagctcgtccacgccgccgccgccgcccgacggtggcggcggggggtacttccggttcgacctgctcggcgggagccccgacgaggacgggtgctcctcgcctgtcatgacgcgccagctcttcccttcgccgtctgcggtggtggcgctggcgggggacgggtcgtcgacgccaccgctgacgatgccgatgccggcggcggctggggaggggccgtggccgcaccgcgcggcggatctcggggtggcgcagagccagaggtcccccgccggcgggaagaagagccgccgcggcccgaggtctcggagctcccagtacaggggcgtcaccttctacaggaggaccgggcgatgggagtcgcacatctgggactgcgggaagcaggtgtacctgggtggtttcgatacagctcataccgcagcgagggcctatgatcgcgcggcgatcaagttcagaggcctcgacgcggatatcaactttaatctgaatgactatgaggacgacttgaagcagatgcgcaattggaccaaggaggagtttgtgcacatacttcggcgccaaagcacaggatttgcaagggggagctcaaagtaccggggtgtgacactgcacaagtgtggccggtgggaagctcggatgggccagctgctcggcaagaagtacatctatctaggattgtttgacagtgaaattgaggctgcaagagcatatgaccgggcagctatccgcttcaatggaagggaagctgttactaattttgatcctagttcttatgatggagatgttctacctgaaaccgacaatgaagtggttgatggagacatcattgacttaaatctgagaatttcacagcctaacgttcatgagctgaaaagtgatggtaccctaactgggttccagttgaattgtgattctcctgaagcttcaagttctgttgttactcagccaataagtcctcagtggcctgtgcttcctcagggcacatcgatgtcccagcatccacatttatatgcatctccttgtccgggcttctttgtgaacctcagggaagtacctatggagaaaagacctgagttgggtccccagtcgttccctacttcgtggtcatggcaaatgcagggctcccctttgccattactccctactgcagcatcatcaggattctctacgggcaccgtcgccgacgccgcccgctcgccttcctcccgcccccatccatttcccggccaccaccagttctacttccccccgaccgcctgactgccacctattctggtggaggcgacacctcaccgtgcatccaccgccgcttgctgataacattcgtcgtttgtccagagagggaccttctccatatgatatccctctctatgttccacctggttatgatcagaattctcacgctcatgattcttttatcttcatttttgagtgcgaaaccacgaatcgtgaccatgctaccaggtaaacacccttgtacctctttgactctacaataaaattaatgtaagatattctggctaaaagtgattggccctccctactgtatttttacagagttgtaatttgaacagtgggcactaaagctggggcccactcgcaccagtgtctagtggagcgaagctttgcccttttcttgctatccagcaactattcctccgcctgcctccattgctgacagtggagatagcttcccagtggtcactgttccactgtactctgtcatagtttctgatcacccct

SEQ ID NO: 5209 - DNA, 1380 bp, Oryza sativa
  Predicted polypeptide sequence is orthologous to G2
atgtgggacctcaatgactcgccggcggccgaggccgcgccgccgccgctgtcgccgtccgccgacgactccggcgcctcctcgtcctcggccgccgccgtcgtcgagatacccgacgacgccgacgacgactcggccgctgtggttgtcgtcacgcgccagttcttccctccggccgtcccgggcggcggcggcgaccccgcccccgggaacgcgcgcgccgggtggctccgcctggccggagccgccccgccggtcgctgcaacggggccggcggcgtcggcggcggtgtccaagaagagccggcgcgggccgcggtcgcgcagctcgcagtaccgcggcgtcacgttctaccgccgcaccgggcgatgggaatcgcacatatgggattgtggcaagcaggtctatttgggcggatttgacactgctcatgcggcggctcgggcgtacgatcgggcggcgatcaagttccgcggcgtggaggccgacatcaatttcagcttggaggattacgaggatgacctgaagcagatgagcaacctgaccaaggaggagttcgtccacgtgctccggcggcagagcacggggttcccccggggaagctccaagtacaggggcgtgacgctccacaagtgcgggagatgggaggctcggatgggccaattcctcggcaagaagtacgtctacttggggctgttcgacaccgaggaggaagctgccagggcgtacgaccgcgctgccatcaagtgcaatggcaaggatgcggtgacgaacttcgatccaagcatttacgccggggagttcgagccgccggcggccacgggtgatgccgccgagcacaacctggacctctcgcttgggagctcggcgggctccaagaggggcaacgttgacggtggcggggacgacgagatcaccggcggcggtggcggtggcgcgggctccgaccagcgcgtccctatggcgttcgaccttgactggcaaacggcggcggcgaggagcaccaaagctaagttcgaccagaactcgaaccatccccagatgcctccggtcctgcaggtcacccacctgccattcagtcccaggcatcatcaccaattcttgagcaatggtgatccggggacagcgggaggcctgtcactgacgatcggcgcaggcatggccgggcactggcctccccagcagcagcaggggtggggcaacgccggcggcatgagctggccgcacccgccgcacccgccgccgccgccgaccaacgccgcggccgccgcaaccgctacagcagctgcagcatcatcacgattccctccctacattgcgacgcaagcctcaacctggctgcagaagaacgggttccattccctgacccggcccacctaa

SEQ ID NO: 5210 - DNA, 1342 bp, Oryza sativa
  Predicted polypeptide sequence is orthologous to G2
gtgtttggttgggttgccggtgtggtgaggattggagatgttgttggatctcaatgtggagtcgccggaacggtccggcacgtcgagctcctcggtgctaaactccggggacgccggaggcggcggtggcggtggcggtggcggaggattattccggttcgacctcctcgcgagcagccccgacgacgacgagtgctccggggagcagcatcagttgccggccgcctcggggatcgtgacgcgtcagctcctcccgcctccgcctcccgcggcgccgtcgccggcgccggcgtggcagccgccgcgccgcgcggcggaggatgccgccctcgcgcagcggccggtggtcgcgaagaagacgcggcgcgggccgaggtcgcggagctcgcagtacaggggcgtcaccttctacaggaggaccggccgctgggagtcgcacatatgggattgcgggaagcaagtctacctaggtggtttcgacacggcgcacgcggcagcaagggcttacgatcgcgctgcgatcaagttccggggactggaggctgacatcaacttcaacctgagcgactacgaggacgatctgaagcagatgaggaactggaccaaggaggagttcgtgcacatactccggcgacagagcacgggattcgcgagggggagctccaagttccgcggcgtcacgctgcacaagtgcggccgctgggaggcacgcatgggccaacttcttggcaagaagtacatataccttgggctctttgacaccgaagttgaagctgcaagagcatatgacagggcagctattcgcttcaatgggagggaagctgttaccaacttcgagcctgcatcctacaatgtggatgctttaccagacgccggaaatgaggcaattgttgatggcgatcttgatttggatttgcggatttcgcaacctaatgcgcgtgactccaaaagcgatgtcgccacaactggcctccagttaacttgtgattcccctgaatcttcaaatattacagtccaccagccaatgggctcgtctccccaatggactgtgcatcaccaaagcacaccactgccccctcagcatcaacgtttgtacccatctcattgtcttggcttcctcccgaacctacaggagaggccaatggacagaaggcctgagctgggtcccatgccgttcccaacacaggcttggcaaatgcaggccccttctcacttgccattgctccacgctgcagcatcatcaggattctctgccggcgccggcgccggcgtcgccgccgccacccgccggcagccgccgttcccggcggatcaccccttctacttcccgccaaccgcctga

SEQ ID NO: 5211 - DNA, 759 bp, Oryza sativa
  Predicted polypeptide sequence is orthologous to G2
ggattgtgggaagcaggtgtacttgggtggattcgatacggcacaggctgctgcaagggcttatgaccaggctgcaatcaagttccgtggagtggaggcagacatcaacttcaccctggatgactacaaggaggacataaagaagatgaacaacttcagcaaggaggagttcgttcaggttctccggcgacagggcgccggcttcgtcagggggagctcgcggttcagaggtgtcaccctgcacaagtgcggcaaatgggaggccaggatcggccagctcatgggcaagaagtacgtgtaccttggcctgtatgacacggagatggaggctgccaaggcttatgacaaagcggcgatcaagtgctgtggcaaggaggctgtgaccaactttgacacccaagcgtacgaggacgagctcaacctgcaatcttgggatagcgagcttgatcttgagctcagcctcgggtgctccggtggcgaacgggccgccggcgaggtcctccactctgcaccaagcaaccagaggacgagcctgacgttcatgctgccggaggaggaggagatgaccgcctgccaccgtcagaggagcatctgggctaggccttccttggctccggcgatgccggacggcggcgcggtcatccgccctgatcagcatcagcatcaccccagtagccggaacatgctcctgatggtatgtatgcttactgacagtggtgttcctacattgatcttcctgagatcacgggccctgagtag

SEQ ID NO: 5212 - DNA, 1305 bp, Oryza sativa
  Predicted polypeptide sequence is orthologous to G2
atgttgttggatctcaatgtggagtcgccggaacggtccggcacgtcgagctcctcggtgctaaactccggggacgccggaggcggcggtggcggtggcggtggcggaggattattccggttcgacctcctcgcgagcagccccgacgacgacgagtgctccggggagcagcatcagttgccggccgcctcggggatcgtgacgcgtcagctcctcccgcctccgcctcccgcggcgccgtcgccggcgccggcgtggcagccgccgcgccgcgcggcggaggatgccgccctcgcgcagcggccggtggtcgcgaagaagacgcggcgcgggccgaggtcgcggagctcgcagtacaggggcgtcaccttctacaggaggaccggccgctgggagtcgcacatatgggattgcgggaagcaagtctacctaggtggtttcgacacggcgcacgcggcagcaagggcttacgatcgcgctgcgatcaagttccggggactggaggctgacatcaacttcaacctgagcgactacgaggacgatctgaagcagatgaggaactggaccaaggaggagttcgtgcacatactccggcgacagagcacgggattcgcgagggggagctccaagttccgcggcgtcacgctgcacaagtgcggccgctgggaggcacgcatgggccaacttcttggcaagaagtacatataccttgggctctttgacaccgaagttgaagctgcaagagcatatgacagggcagctattcgcttcaatgggagggaagctgttaccaacttcgagcctgcatcctacaatgtggatgctttaccagacgccggaaatgaggcaattgttgatggcgatcttgatttggatttgcggatttcgcaacctaatgcgcgtgactccaaaagcgatgtcgccacaactggcctccagttaacttgtgattcccctgaatcttcaaatattacagtccaccagccaatgggctcgtctccccaatggactgtgcatcaccaaagcacaccactgccccctcagcatcaacgtttgtacccatctcattgtcttggcttcctcccgaacctacaggagaggccaatggacagaaggcctgagctgggtcccatgccgttcccaacacaggcttggcaaatgcaggccccttctcacttgccattgctccacgctgcagcatcatcaggattctctgccggcgccggcgccggcgtcgccgccgccacccgccggcagccgccgttcccggcggatcaccccttctacttcccgccaaccgcctga

SEQ ID NO: 5213 - DNA, 1005 bp, Oryza sativa
  Predicted polypeptide sequence is orthologous to G3
attccgcgaggatggataggtgggaggccaccgtcttcttgcccccgccgccgccaccgcagccgacgcagccgcagcagcagcctgcggcggcggcggtgagggctccggtaggcgggaggggtgggggaggagggaggcagtatcgcggggtgcggatgcggaagtgggggaagtgggtggcggagatccgcgagccgaacaagcggtcgcggatctggctcggctcctactccaccgccgtcgccgccgcgcgggcctacgacaccgccgtgttctacctccgcggccgctccgcgcgcctcaacttccccgaccagctcgacggcgcgggtggtggtggcgcgggcgccggcggcgccgaggaccacagggagctcaccgccgccgtcatccgcaagaaggccgccgaggtcggcgcccgcgtcgacgcgcagcactccgtcgtcggcgccgcggcgcccgtgccgctccagccgccgcagcccccgccgccccagcgccgccggaccaagaaccccgacctcaaccgggagcccaccccggacacctccgacgacgagtagtaatccgtgctaattttgcctcccttcttccatccatctagttcgtagtccttagccaccccaagacacagagagagagagagagtagcagctagtagctatagctagtcagcgaagcagatagcgccaaggaggcggtcgtggacggggcgcatgcaaggtgttcggcgaaatgcgattgaggtcggaggagcccacaagtatatccaataatggagccgcgacgtcgccgtcaagccggggaagtggtggttagcaagtaggaatctagagctcagctcgtcgtctgttccggcgacggcgactgtactaggagcgtgcgtgtcagcgtgagcatgtagctaaaagcaagacggctatgtacctcacccttttcgcttaagcgtttgtttgtaaagagaagatacccagcaagcaagacaaaaaaaacagcttcaag

SEQ ID NO: 5214 - DNA, 427 bp, Oryza sativa
  Predicted polypeptide sequence is orthologous to G4
ccgacttcgaggagttcgaggtggactccggggactcggatttggagctcggggaggaggacgacgatgacgtcgtcgagatcaagccggccgccttcaagagggccctctccagagataacttgatctccattaccactgccggatttgatggtcctgctgcaaagtctgccaaaagaaagagaaagaaccatttcaggggcatccgccaccgcccttggggtaagtgggctgctgaaatcaaaatcctcgcaagggtgttcgtgtctggcttggcactttcaacagtgctgaagaagctgcaagagcttatgatgctgaaccacctcggattccgtggcaaagaaggcccaaggtgaatttttccagaaggctcccaacaacttgcctcaaaaagcgttctgttgctgggctcccccccacttgc

SEQ ID NO: 5215 - DNA, 1260 bp, Oryza sativa
  Predicted polypeptide sequence is orthologous to G4
gtctcaaacccaatcaaactccaaccaaactcacctacctacccccaacccatccagagctagagctatgtgcggcggcgcgatcctcgccgacctcataccgtcgccgcgctccggcggccacaccaaaaagaacaagcggcggcggatcagcgacgacgaggacttcgaggccgccttcgaggagttcgacgccggcgacgacgactccgactccgactccgagtccgaggaggtagacgagtacgacgtcgtcgtcgacgacgacgacagcgaggacggcgtggtggttcttccgccgccgccgccgccgccgccggtgattccacatgagcgccatggcgcgaggcggttccgcggcgtgaggaagcggccgtgggggaagtgggcggcggagatccgcgaccccgtgcgcggcgtgcgcgtctggctcggtaccttccccaccgccgagtccgccgcgcgcgcctacgacgccgccgcccgccgcctccgcggcgccaaggccaagcccaacttcccctccgcgccgccgccctcggctgctgctcaccgccgcaagaagcgccgcgcccacgccgccacgcgctcgccgtcgtctccgcccgccaccagcgaggtcacggcggcgtccgcgtccgcgtccagcgatgtccccgcgccggcgttcgcttccttcgtcggcgagcccgggcacggcggcgccaagtcgatgccgacgacgagccacacctcgcagccagccccgccggcgacggtggcgtccgagaacgtcgacgacccggaggtgttcgacccgtacgacgtccacggcggcctcgcctcctacttcgccggcggcgcgtacgagtccctggagagcctgttcgcgcacggcggcgacagcgccgccgtcgaccaagcggcgagcgaccactggccggcggcgctatggagcttcgcagacgacggctcgttctgcttctgatgctgtcaaatcacatcgccattggcggccattgcaagccatggcatggcacctgatgatgctgatccagcgaactggtcactcgttcttgatgcgttttcagtttcttgtacagtgtttttccccagcaacagtgaagtagtattcagttattcactgttcagtcatgagttcatcgcaaaatatgatgtaagtatgtgtcttgagattgttttagcagtggcttttgtttgtataatgtatttctctgtaattaattaatagctgttttcagtgatgaactaaattttctg

SEQ ID NO: 5216 - DNA, 1433 bp, Oryza sativa
  Predicted polypeptide sequence is orthologous to G4
agactacaagccattaaacagagacgaccaacgacttaaccacacttcttctttgtgctgtccaacctccattgttgggtgtgaaagctttggctcatctgccatgtgtggaggatccattctcggcgaccttcacttgccggtgcggcggacagtgaacgccggtgacctgtggggagacgccggcaagggtagagatggtggcgacggcttgaagaagaggaaggggagttcttgggatttcgatgttgattgcgatgatgatgatgatgatgactttgaggctgattttgaggagtttgaggatgactatggcgatgatgatgatgtgggtttcggggacgacgaccaagaatccgacatgaacggtctcaagctcgccggattcagcaccacgaagctcggcctcggcggcagcaggaagaggaagacgcgataccgagggatccggcagcggccatgggggaaatgggcggcggagatcagggacccccgcaagggcgtccgcgtctggctcggcacgttcggcaccgccgaggaggccgccatggcgtacgacgtcgaggcacgccgcatccgcggcaagaaagccaaggtcaacttccccgacgccgccgccgccgccccgaagcggccacggcgttcttcggcgaagcattcgccgcagcagcagaaggccaggtcgtcgtcgtcgtcgccggcgagcctgaacgccagcgacgccgtgtccaagtccaacaacaaccgcgtcagctcggctgggagcagcaccgacgccaccgccgccgccatcgccatcgacgacggcgtcaagctcgagctgctctcggagacggatccttctccgcccatggccgccgccgccgccgcgtggctcgacgcgttcgagctgaacgatcttgacggatcaagatgcaaggacaacgcattcgatcaccagattcacaaggtagaagcggctgtcgctgatgaattcgcgttctacgacgatccgagctacatgcagctgggttaccagctcgatcagggcaactcgtacgagaacatcgacgcgctcttcggcggcgaggccgtcaacattggtggactctggagcttcgacgacatgccaatggagttcagagcttattgagcatttgattctatttaggagggagtgaattatttgggaggaagaatcgatgttgtaacttgtaaaatctctgatgatgatctctgcatcatatgatcaatttgagtgcagttttgtttttgtaaatacgaattctttattatgatgttaggttcttaatttgcccttcttcatcagggatttgttcaggcttttgttgtgatgactgattggacgagggaaagattgcgttttttgttgtcatgttgggtactctactcttctgttcctaaagttgataagtgccaaaatttgtgagagg

SEQ ID NO: 5217 - DNA, 1107 bp, Oryza sativa
  Predicted polypeptide sequence is orthologous to G4
agatattcagacacacaccttcaataacttgcaaggataactcaaactacttgaatcagatcagacaaaaacatcataagaatatcacgatgtgtggaggagcactgatcccgaacgactatggcgacaagccgccgccgccgccgtcggagtcgtcggagtgggacgccacaacgaagatgaagaagaagaagaagcgtggtggcggcggcgacgacgactgggaggccgccttccgggagttcatcgctggcgacgacgacgacgacgacggcggcgtttccatgttcccttctggtgcagggacgatggagacgaccacagaggtggcgccggcggcggcggtggtggagaggccgcggcggcggcgaagggtgaggcggagctacccgtaccgcggcgtccggcagcggccgtgggggcggtgggcgtcggagatccgcgaccccgtcaagggcgcccgcgtctggctcggcaccttcgacaccgccgtcgaggccgcgcgcgcctacgacgccgaggcgcgccgcatccacggccacaaggcaaggaccaacttcccgcccgacgagcctccgctgccggcgccatcgcaggcgccgttctgcttcctgctcgacgacgacgacgacgacgacggcgtggcccgtggaaacagcccggcgtcgtcgtcggcgccggacagagcctccgcttgcacgacgtcgtcgacggtggcgtccggcgagcgaggcgatgagctcatactgctggagtgctgctccgacgacgtgatggacagcctcctcgccggcttcgacgtgtccagcgaaccacgcagtgttttgggaatggttaattagcagcgcgcacgcctgattagatcggtacatgtgaagtacaagagaagtagttactactagctaggagcaaattaacttggagtgcaagaataaaatatgcatgtctctgcactactactgtagtgttagcaagtttgctcattgttctgttgtatcctttcatgtccatttcagacttcccaatgctacataaggatgtacatatgtatgatgttgtgtgccttgttaatcaatgaatgtaaatatctttatattgcttttgtac

SEQ ID NO: 5218 - DNA, 1689 bp, Oryza sativa
  Predicted polypeptide sequence is orthologous to G4
gtctctccaatattttgtcgaaccgattgagggaaaaaaaaaagagaaaaagaaaagaaaaaaaagaagaagaagagagaactcgaactctcgcctaccatttcgcccccctccgcaagcaatccaccactgcatcggcggcgagggctcaccggcggcgagccatgtgcggcggcgccatcatccaccacctgaaggggcacccggaggggtcgcgccgggcgacggaggggctcctgtggcccgagaagaagaagcccaggtggggcggcggcgggaggcgccacttcggggggttcgtggaggaggacgacgaggacttcgaggccgacttcgaggagttcgaggtggactccggggactcggatttggagctcggggaggaggacgacgatgacgtcgtcgagatcaagccggccgccttcaagagggccctctccagagataacttgagcaccattaccactgccggatttgatggtcctgctgcaaagtctgccaaaagaaagagaaagaaccaattcaggggcatccgccagcgcccttggggtaagtgggctgctgaaatcagagatcctcgcaagggtgttcgtgtctggcttggcactttcaacagtgctgaagaagctgcaagagcttatgatgctgaagcacgcaggattcgtggcaagaaggccaaggtgaattttccagaggctccaacaactgctcagaagcgtcgtgctggctccaccactgctaaagcacccaagtcaagtgtggaacagaagcctactgtcaaaccagcattcaacaatcttgccaatgcaaatgcgtttgtctacccatctgctaacttcacttcaaacaagccgtttgttcagcctgataacatgccatttgttcctgcaatgaactctgctgctcctattgaggaccctatcatcaactctgaccagggaagcaactcatttggctgctctgactttggctgggagaatgataccaagacaccagatattacatcaattgctcccatttcaaccatagctgaagtcgatgaatctgcattcattaagagcagtaccaacccaatggtccctcctgttatggagaacagtgctgttgatctgcctgatttagaaccctacatgaggttccttctggatgatggtgctggtgactcaattgatagccttctcaacctggatggatcacaggatgttgtcagcaacatggacctctggagctttgatgacatgcccgttagcgatttctattgaggaattcgaagtcttctagtcggagcatgtacacagggaaaaaaaaggaataaatactattggagattgggaggcacctgcatggcaccttgggggtagcatatcgttatgtttagcttagatgcaaaaggctgcatcctgaaactctttggtgattggacctgttccctatccgctgtctatgtatggcagccatctatgagactcaagaactgcttttttttttccgttctagttttctgtcgttgctacctgtatatggctatgaacatcgtgaatccatggccattatgttttaatctatgttgttgactgctctttctttcggtctttgctgtgctgcgctatgttggtgataactagctaccatattgattttctgtacataattcatttgttgaatccgaaattaaatagtgcattgacc

SEQ ID NO: 5219 - DNA, 1575 bp, Oryza sativa
  Predicted polypeptide sequence is orthologous to G4
gaaaggcattcgcaacacacacttgaagaaaaaaaacacgacgaacacgttaaaaaaaggtcgaagagaagtgggagacccaaaccgcgaacaatgtgtggaggcgccatcctcgccgagttcatcccggcgccgtcgcgcgccgcggcggcgaccaagcgggtgaccgccagccacctgtggccggccggctccaagaacgccgcccgcggcaagagcaagagcaagaggcagcagaggagcttcgccgacgtcgacgacttcgaggccgccttcgagcagttcgacgatgactccgacttcgacgacgcggaggaagaagacgaaggacacttcgtgttcgcgtccaaatctcgtgtcgtcgccgggcacgacgggcgcgcggcggcgagggcggcgagcaagaagaagcgggggcggcacttccgaggcatccggcagcggccatgggggaagtgggcggcggagatccgcgacccgcacaagggcacgcgcgtctggctcggcacgttcaacaccccggaggaggccgcacgcgcctacgacgtcgaggcgcgccgcctccgcggcagcaaggccaaggtcaacttccccgccacgcccgccgccgcgcgccctcgccgtggcaacacgagagccaccgccgtgccaccgccggcgacagcacccgccgccgccccgccgcgcggactgaagcgagaattctcgccgcctgctgagaccgcgctacctttcttcaccaacggcttcgtcgacctgacgaccgccgcggcgccgccaccggccatgatgatgacgagctccttcaccgacagcgtcgccacgtcggagtccggcgggagccccgccaagaaggcgaggtccgacgacgtcgactcgtccgagggcagcgtcggcggcggcagcgacacgctgggtttcaccgacgagctggagttcgacccgttcatgctgttccagctcccctactccgacggctacgagtccatcgacagcctcttcgccgccggcgacgccaacagcgcgaacaccgacatgaacgccggcgtcaacctgtggagcttcgacgacttcccaatcgacggcgcccttttctgatgtactcctccattgatgcagtttgtgcactcaattgttaatcacgtcgtcgttgatgaatgtttaaccggaggatgatggggtgcagctgatatcatggcttgcttgattaccgaattatattgcggtgtttgtgtttgtcaattagattctgaatctgtactactgccgatcttatgatcaaaactatatattaagtttatgtactcttaatttgtgggctacttttacggggtcttcgtactgctggtcaaatagtcctatgaaatcgatcatgtcggcaatatcgtcgtcaattatcgtggtcgtggttgttaatgatgtcaaataagtctatgaaaacctggtcctcttggtgtttatgtaccactgatcgatccatcatttgatctctgtcatgttgagatggatcgtgtaagaatatcataatttgctggattcagtccagtcgtaatgtattttggtttgtacaactgc

SEQ ID NO: 5220 - DNA, 1516 bp, Oryza sativa
  Predicted polypeptide sequence is orthologous to G4
gacccacaacccccaagcatcagcatcacaacccaccaatcgaatcgatcgaacaagacacgacaccatgcgccgccgcgtctcctcctcctcctcctcctcctcgtcctcgtcgccggcgaggcatcacaaggcgcggcgcagcaggaggaagctcgccgtcgacgaggactgggaggccgccttccgcgagttcctctcccgcgaccacgacgacgacgacgacgaccacgacggtcagcatgtcgttgttgcgccgttgatccgtggtagtgacaagtgcgtccacggccacgaggtggtggcgtcgacggtcggcggtggcgcaagcggcggacgacgacgagccgacgacgacgacggcgagcggcggcggcggcggcggagggagaagcggagctacccgtaccgcggcatccggcagcggccgtgggggaggtgggcgtcggagatccgcgaccccgtcaagggcatccgcgtctggctcggcaccttcgacaccgccgagggcgccgcgcgcgcctacgacgacgaggttcgccgcatctacggcggcaacgccaagaccaacttccccccatcgccgcccacgccgccgccgccggagaagccagcggcggagaggagcccctcgacgacgccgacgacgaccacggaggactccggcgactcgcgcatactcatcgagtgctgctccgacgacctgatggacagcctcctcgccgccttcgacatgaccaccggcgacatgcgcttctggagctaacgaacaacagagcagattcaggtaattaaatccacacccaagcaggtctaaaagtttttaacaatttcatgaaacaaaattaacaacaaatccagtaagataaataggatttaacaaggattgcaatggtaattattgcacaattttaccatttcggtgctttcaactgttcaatcaccgaaagaaattcagcaacttttgaagggcactgctacgcgtacttaatttctttttttcttctacaaaacactttctaaacaagttctcgaatgttccatttaattagatgggagtaaaaaagaaatccagaattagttatagcatgtggcattagccatgaaagttttagtaaaaaaaatttgcacttttgaatgatctagatcatagaggatcagtcgaattctgtgtgttcatgccatttctagcatttacgtgcagtattaaataaagttactactatttttttcttgttttctctatgttactcatcatgattttacatttttctttcccttttgacaggacaacataaacggcacgtctttgcaaccttgacatgcgactcgcctaataatcttgtcaaacaagggccgccagcttaattagctttttccaaaggtggggaacaattttgggggatgcaattaggacgcacagagatgaccccaacttgtcaatgggaattgaactctgatgacctttgtaatgataatcaaggcaccacattgtggggttaagcaaagttttggc

SEQ ID NO: 5221 - DNA, 1430 bp, Oryza sativa
  Predicted polypeptide sequence is orthologous to G4
cccgcgtcgcgccatagcgacgtctctcccggagaaagaagagcgcgccgcgccatgtgcggcggtgcaatcctcgccgatttcaccccggcgagggtgccccggcggctgaccgccgccgagctcctgccggtgaccccgactccccccgccgccgagaggagaaccacccggaagcgcaagtccgacgtcgacttcgaggcggagttcgagcttttcgaggacgacgacgacgacgatgagttcgagctttccgacgatggcgacgagagtttggccgtgtcatgtgtgtcgtcccccaagtcgaaggcagtaccttcgttttctttttcgtcggatgtctcctcgagctccaggccgcggcggcgcgtggcggcggcggcggccggtcgtcggaaggcgagcaagaagagcaagtacaggggcgtccggcgccggccgtcggggaggttcgcggcggagatcagggaccccaagaaggggcggcgcgtgtggctcggcacgtacggcagcgccgaggaggccgccatggcctacgaccgcgaggcccgccgcatccgcggcaagggcgcgaggctcaacttcccccgcgacggcgatggctcccctcgccggagtaacgaccggccctgctggaccatcgacctcaacctccccgcggcggccgtctccggtgacgacgacgacgccatggccgtcgacgccgcagacgcagacgcaggcagtgctggccgtgcagcagcctatgcagatcaagaagcactgagcgcggcaaagtgcaagatcaagcagtgtcctcgcgacgaacagatggcgagcgccacacctgagctcatggaggaggacgcgagcagcagcagaaacatggtgcccctgtccatggcgctgcagctgcagtatgcggcgatgatcgccgaatgcgaccgcgagatggaggagatcgccgccgtggagagggacctcgagaggcgcaggaggcaggtgttcgagcgcagaggccacctggtcaggcaggcctctcttctgctcgactgacgatcttgctgaactgaactctgaatgtttgagcttgtctgaagtctgaactctgcactatgccatatggtgtttcaccttcactgtgaggctgacatgtgggccagacgtccgtttgccttgcttgcttttgagctgcaactgggcgttgtgctgcaagcctgcaaagtgcctgtgtaaagtttgtgggattgtgtgtgtggatcttgtatccttgtgactttgcaagctttaattttgtgaggaacaatagtattttagattggtgtgtaaaatatagaaataaataatagtagcaactaaattttggttttcagctcttcatcagatggtttgtcatgggaacaaaatttcaaacatgagcaaattaaggtcatgttattatcaattgtgat

SEQ ID NO: 5222 - DNA, 927 bp, Oryza sativa
  Predicted polypeptide sequence is orthologous to G4
atgtgcggcggcgcgatcctcgccgacctcataccgtcgccgcgctccggcggccacaccaaaaagaacaagcggcggcggatcagcgacgacgaggacttcgaggccgccttcgaggagttcgacgccggcgacgacgactccgactccgactccgagtccgaggaggtagacgagtacgacgtcgtcgtcgacgacgacgacagcgaggacggcgtggtggttcttccgccgccgccgccgccgccgccggtgattccacatggtgaggcgatcgatcgatcaagaattgagcgccatggcgcgaggcggttccgcggcgtgaggaagcggccgtgggggaagtgggcggcggagatccgcgaccccgtgcgcggcgtgcgcgtctggctcggtaccttccccaccgccgagtccgccgcgcgcgcctacgacgccgccgcccgccgcctccgcggcgccaaggccaagcccaacttcccctccgcgccgccgccctcggctgctgctcaccgccgcaagaagcgccgcgcccacgccgccacgcgctcgccgtcgtctccgcccgccaccagcgaggtcacggcggcgtccgcgtccgcgtccagcgatgtccccgcgccggcgttcgcttccttcgtcggcgagcccgggcacggcggcgccaagtcgatgccgacgacgagccacacctcgcagccagccccgccggcgacggtggcgtccgagaacgtcgacgacccggaggtgttcgacccgtacgacgtccacggcggcctcgcctcctacttcgccggcggcgcgtacgagtccctggagagcctgttcgcgcacggcggcgacagcgccgccgtcgaccaagcggcgagcgaccactggccggcggcgctatggagcttcgcagacgacggctcgttctgcttctga

SEQ ID NO: 5223 - DNA, 1687 bp, Oryza sativa
  Predicted polypeptide sequence is orthologous to G4
ttctctccaatattttgtcgaaccgattgagggaaaaaaaaagagaaaaagaaaagaaaaaaaagaagaagaagagagaactcgaactctcgcctaccatttcgcccccctccgcaagcaatccaccactgcatcggcggcgagggctcaccggcggcgagccatgtgcggcggcgccatcatccaccacctgaaggggcacccggaggggtcgcgccgggcgacggaggggctcctgtggcccgagaagaagaagcccaggtggggcggcggcgggaggcgccacttcggggggttcgtggaggaggacgacgaggacttcgaggccgacttcgaggagttcgaggtggactccggggactcggatttggagctcggggaggaggacgacgatgacgtcgtcgagatcaagccggccgccttcaagagggccctctccagagataacttgagcaccattaccactgccggatttgatggtcctgctgcaaagtctgccaaaagaaagagaaagaaccaattcaggggcatccgccagcgcccttggggtaagtgggctgctgaaatcagagatcctcgcaagggtgttcgtgtctggcttggcactttcaacagtgctgaagaagctgcaagagcttatgatgctgaagcacgcaggattcgtggcaagaaggccaaggtgaattttccagaggctccaacaactgctcagaagcgtcgtgctggctccaccactgctaaagcacccaagtcaagtgtggaacagaagcctactgtcaaaccagcattcaacaatcttgccaatgcaaatgcgtttgtctacccatctgctaacttcacttcaaacaagccgtttgttcagcctgataacatgccatttgttcctgcaatgaactctgctgctcctattgaggaccctatcatcaactctgaccagggaagcaactcatttggctgctctgactttggctgggagaatgataccaagacaccagatattacatcaattgctcccatttcaaccatagctgaagtcgatgaatctgcattcattaagagcagtaccaacccaatggtccctcctgttatggagaacagtgctgttgatctgcctgatttagaaccctacatgaggttccttctggatgatggtgctggtgactcaattgatagccttctcaacctggatggatcacaggatgttgtcagcaacatggacctctggagctttgatgacatgcccgttagcgatttctattgaggaattcgaagtcttctagtcggagcatgtacacagggaaaaaaaaggaataaatactattggagattgggaggcacctgcatggcaccttgggggtagcatatcgttatgtttagcttagatgcaaaaggctgcatcctgaaactctttggtgattggacctgttccctatccgctgtctatgtatggcagccatctatgagactcaagaactgcttttttttttccgttctagttttctgtcgttgctacctgtatatggctatgaacatcgtgaatccatggccattatgttttaatctatgttgttgactgctctttctttcggtctttgctgtgctgcgctatgttggtgataactagctaccatattgattttctgtacataattcatttgttgaatccgaaattaaatagtgcattgac

SEQ ID NO: 5224 - DNA, 1447 bp, Oryza sativa
  Predicted polypeptide sequence is orthologous to G4
gcctccttcagactacaagccattaaacagagacgaccaacgacttaaccacacttcttctttgtgctgtccaacctccattgttgggtgtgaaagctttggctcatctgccatgtgtggaggatccattctcggcgaccttcacttgccggtgcggcggacagtgaacgccggtgacctgtggggagacgccggcaagggtagagatggtggcgacggcttgaagaagaggaaggggagttcttgggatttcgatgttgattgcgatgatgatgatgatgatgactttgaggctgattttgaggagtttgaggatgactatggcgatgatgatgatgtgggtttcggggacgacgaccaagaatccgacatgaacggtctcaagctcgccggattcagcaccacgaagctcggcctcggcggcagcaggaagaggaagacgcgataccgagggatccggcagcggccatgggggaaatgggcggcggagatcagggacccccgcaagggcgtccgcgtctggctcggcacgttcggcaccgccgaggaggccgccatggcgtacgacgtcgaggcacgccgcatccgcggcaagaaagccaaggtcaacttccccgacgccgccgccgccgccccgaagcggccacggcgttcttcggcgaagcattcgccgcagcagcagaaggccaggtcgtcgtcgtcgtcgccggcgagcctgaacgccagcgacgccgtgtccaagtccaacaacaaccgcgtcagctcggctgggagcagcaccgacgccaccgccgccgccatcgccatcgacgacggcgtcaagctcgagctgctctcggagacggatccttctccgcccatggccgccgccgccgccgcgtggctcgacgcgttcgagctgaacgatcttgacggatcaagatgcaaggacaacgcattcgatcaccagattcacaaggtagaagcggctgtcgctgatgaattcgcgttctacgacgatccgagctacatgcagctgggttaccagctcgatcagggcaactcgtacgagaacatcgacgcgctcttcggcggcgaggccgtcaacattggtggactctggagcttcgacgacatgccaatggagttcagagcttattgagcatttgattctatttaggagggagtgaattatttgggaggaagaatcgatgttgtaacttgtaaaatctctgatgatgatctctgcatcatatgatcaatttgagtgcagttttgtttttgtaaatacgaattctttattatgatgttaggttcttaatttgcccttcttcatcagggatttgttcaggcttttgttgtgatgactgattggacgagggaaagattgcgttttttgttgtcatgttgggtactctactcttctgttcctaaagttgataagtgccaaaatttgtgagaggaaaaa

SEQ ID NO: 5225 - DNA, 1214 bp, Oryza sativa
  Predicted polypeptide sequence is orthologous to G4
atcacaagctcacaagttcacaacccaacacccaaaagcaaaagaaaagcagcaaccaaagatgtgcggcggagcgatccttgcggagctcataccgagcgcgccggcggcgaggcgcgtcacggcgggccacgtctggccgggcgacgccaacaaggccaagaagaagggcgcgcgcgccgacgacttcgaggccgcgttccgcgacttcgacaacgactccgatgacgaggagatgatggtggaggaggcggaggaggaggaggcgacctccgagcacaagccgttcgtcttccgcgccaagaaggcggcggcggcggcgtcgagcaggcgcaggaagccggcgcagtacaggggcgtgcggcgccggccgtgggggaagtgggcggcggagatccgcgaccccgtcaagggcatccgcgtctggctcggcaccttcaccaacgccgaggccgccgcgctcgcctacgacgacgccgcgcgcgccatccgcggggacagggccaagctcaacttcccttccgctaccacccctgacacccgcaagcgcggccgcgccaccgccgccgccgccccggccgtcaaggcgaccccggtcatcaacctcgtcgaggaggaggacgaggaggaggtcgccgccgccatggcgtccatcaagtacgagcccgagaccagcgagagctccgagtcgaacgccctcccggacttctcctggcagggcatgtcggcctccgacgagttcgccgtcgccgcggcggcgctgtcgctcgacagcgacgacgacctcgccaagaagcgtccgaggaccgagccggaggacaccaccgactccggctccggcgacgacaccgacgcgctgttcgacgcgctgctgttcgccgaccagtacaaccacttcaacggcggcgcctacgagtccctggacagcctgttcagcgccgacgccgtgcagaccaccgccgccgccgccgccgccgaccagggcatggggctctggagcttcgacgacggctgctgcctcgtcgacgtcgaggccagcttgtccttctaggctctagccgtcgtctccggcgaccctgtgactcgatcttgtaccatgtcatgtacatagaagagtggttttgccaagcaagcatgtgttcgtcctggttcctttcggtaatgaaaaattatgtgaggcttctcgttctcgtaaaaaaaaaaaaaaaaaaaaa

SEQ ID NO: 5226 - DNA, 1613 bp, Oryza sativa
  Predicted polypeptide sequence is orthologous to G4
ctgtagcttattagcggccatgtgcggcggagcaatcatctccgggttcatcccgccgtcggccgctgcggcggcggcggcggcggcggcggcggccaagaagcagcagggcaggagggtcacggccgacgtgctgtggccggggatgctgcggaaggggaaggcgggggcggcggaggaggactttgaggccgacttccgcgagttcgagcgtggcatgagcgacgacgaggcggaggggggcggcggcgaggaggaggaggaggaggaggacgacgtggtcgtggaggtccccccgccggcgacggcgaggttcgtcgtccgtgccgcggccaaggcggcgcccccaactgcagatgggatgttgactacaaagcttgtccaacatgatggacctactgctagatcggcaaagcgcaagaggaagaatcagtacagggggatccgccagcgtccctggggcaaatgggcagctgaaatccgagaccccagcaagggtgtccgtgtttggcttggaacatataacactgctgaggaggcagctagggcatatgacgctgaagcccgcaagatccgtggcaagaaagccaaggtcaactttcctgatgaaccagctgttgctcagaagctctccctgaagcaaaacgctgccaagcaagagaaactagctccacctctgaagtcctgtggcgatgatgctttctttcagctaaacagttcagacaatgatttgtttgcaatgcttgcaaaggtgcctgcaaagccggcagagcctgttgatctcatgcctccagtcaaacctcttgcttccactgagacattcgagatgaacatgctctctgatacgagcagcaactcatttggctcttcagactttggttgggaggatgacaccctgaccccagactacacttcagtctttgttcctaatgctgccatgccagcatatggtgaacctgcttacctgacaggtggagcgccaaagagaatgaggaacaactatggtatcgccgtgccccagggaaatggcatgcctaatctcgcacaaaacatgcccaccttcgatcccgagatgaagtatttgccattaccttatgttgagagcagctcagatgaatcaatggacaaccttctgcaaaatgatgctacacaagacggggcaagcaacgagggcatctggagccttgatgagctgctcatggcagctggtgcctactgaggagacgaaatgttctggtcagtgtggtctgtcactagcaaaccatgtaaggcactccacactacctactattttgatttcttgtagatacattttcatgtttgaatgtgtatggccaagatgaagagctggtgatgtctgctatgttttgtagagggatgctaccaaagtaatgctagaatattacaagctgctatcagctgtactctctatgacaatgtttatactatgtttgctgtatggtgtggtctatgatttgaagtatgtcggagactaattcaaataatgcccttgggccatggtgctgtgccttggtaaatggtgctttatttaagggttatattaggttggtgcctcagtaattgccgttttctaccaaaaaaaaaaaaaaaaa

SEQ ID NO: 5227 - DNA, 420 bp, Oryza sativa
  misc_feature (24)..(24): n is a, c, g, or t
  misc_feature (29)..(29): n is a, c, g, or t
  misc_feature (41)..(41): n is a, c, g, or t
  misc_feature (63)..(63): n is a, c, g, or t
  misc_feature (70)..(70): n is a, c, g, or t
  misc_feature (73)..(74): n is a, c, g, or t
  misc_feature (92)..(92): n is a, c, g, or t
  misc_feature (119)..(119): n is a, c, g, or t
  misc_feature (163)..(163): n is a, c, g, or t
  misc_feature (177)..(178): n is a, c, g, or t
  misc_feature (185)..(185): n is a, c, g, or t
  misc_feature (210)..(210): n is a, c, g, or t
  misc_feature (224)..(225): n is a, c, g, or t
  misc_feature (228)..(228): n is a, c, g, or t
  misc_feature (236)..(236): n is a, c, g, or t
  misc_feature (261)..(261): n is a, c, g, or t
  misc_feature (278)..(278): n is a, c, g, or t
  misc_feature (300)..(300): n is a, c, g, or t
  misc_feature (303)..(303): n is a, c, g, or t
  misc_feature (337)..(338): n is a, c, g, or t
  misc_feature (340)..(340): n is a, c, g, or t
  misc_feature (359)..(359): n is a, c, g, or t
  misc_feature (361)..(362): n is a, c, g, or t
  Predicted polypeptide sequence is orthologous to G5, G974
tggcccaagacggaggggttcgcnctcancaagtacccgtngtacgagatcgactgggactcnctgctcnacnncaataactagctcttctnttccatagcccgccattgccggccggngcagattaggttttaggcattctgcgcggcggcgaggcgatggnttatatgttcgttnntgtgtanatccttttctttttgtgttggtttnttaggttccggagnntgntcgccggngtcgtttttgtgtccggcgtctccnatgtctagtaagcagtnactcgttagtgtagtagttgtncanctctacaaatgtacaaatacttgtgcatgtaggnngntgtaatcaattgttggtancnncccgtaatagaactactgtgaattaactgtattaatgtgcaaaaaaaaaaaaaaaaaa

SEQ ID NO: 5228 - DNA, 802 bp, Oryza sativa
  Predicted polypeptide sequence is orthologous to G5, G974
ggcacgttcgacaccgccgaggacgcggcgctcgcctacgacaaggcggcgttccgcctccgcggcgacgccgcgcgcctcaacttccccacgctccgccgcggcggcgcccacctcgccggcccgctccacgcctccatcgacgccaagctcaccgccatctgccacagcctcgccgccgcgccgcccgcctcctccaagaaagccgccgccgccgccgctcacccggactcgcccaaaggctccgcgtcgacgacgaccacgacgtcggagggagacgagtcggcgatctccgcctgttcgcctcctctcccgccgccgccaccgccgccgccggcggcgctccccgagatggcaaaccttgacttcacggaggcgccatgggacgaatccgacgccttccacctctacaagtgtccgtcatgggagatcgactgggactccatcctctcgtgatcaaatcaactttaattaattaaaattaaattaaattaaattaatgtaatcagtagcttccatgatccgatggaatattagacatcggccatggctgctgcaattagggtttaaggaggtcgtcgtcgtcatcgtagtaggattaagtcattaagaagggtttaagataagtgttcttagcttattattgctgtattaattttctgtacttagtagttattatgatctcctggttacttcgccggttgtttttttttcactcggcaaggccagttgagggtgtaatgtaatgtaacttttggttactgctgttgcaattcactctttaaaatttttgtaatgtaaa

SEQ ID NO: 5229 - DNA, 757 bp, Oryza sativa
  Predicted polypeptide sequence is orthologous to G5, G974
caacagcttagaatccttctcagtaaatctgttgattgctcgtttcaaatcatcatcggtgtttcgtttcttgatttcttgatccatccatggcgacgacagtggattggtgtggccgtggcagcaatcttcctgctgcgatgtatgacatggtggtggatagcaaggagctaatgggcgcgcttgctccgtccatggtgtccttctcctacccgtgttccgagcagagcgcgagctcgcttcttgctggcgccaactacctgactcccgcgcaggtgctccatgtccaggcgcagctacagcgcctgcgccgcccgggcgcggcgagcggctgcctcgccgcggcgccgccgctgccgatgaagcggcatggcgcggtggcggtggcggcggcggcggcggcgcgggcgccggtcaagctgtaccgcggcgtcaggcagcggcattggggcaagtgggtggcggagatccgcctgccgcgcaaccgcacccgcctctggctgggcaccttcgacaccgccgaggaggccgcgctggcgtacgacagcgccgcgttccgcctccgcggcgagtccgcgaggctcaacttccccgagctccgccgcggcggcgcccacctcggcccgccgctccacgccgcggtcgacgccaagctccacgccatctgccacgggatggacctgccccaaccccaaccccaaacccagagcaatgcgacgacgacgacgatgtcgacgacggcgacgaacaccccaag

SEQ ID NO: 5230 - DNA, 1403 bp, Oryza sativa
  Predicted polypeptide sequence is orthologous to G5, G974
cttggttaggttgcttgcagagagcgagagacccagggccttttagatccagggctcccagatctgctgtttttctttcatcttctttgtgttctagtgttaggttggtagccaagaggggttctttttccacacctcacttgctagatctaccaccaaaaagccatctgtttttttactgtggctgtcgatttctccctccttcctgcctgttcttgattttggattcggaaccaggcaaatctttgttactactgttttagtatcagaaaaaaaaatcccaaaaaaaagagtgagtagatggctgcagctatagatctgtcaggggaggagctgatgagagcactcgagccttttatccgagatgcctccggctcgcctccggtttgttcccagtttagtcccacctcgccattctccttcccgcacgcgttagcgtacggtggcgggctggcccagcagccagagctcagcccggcccagatgcactacatccaggcccgccttcacctccagcggcaggcggcgcaggccggcccgctcggcccgcgcgcgcagccgatgaaggcgtcgtcgtcgtcggcttcggcggcgggggcggcggcgacgccgccgcggccgcagaagctgtaccgcggcgtgcggcagcggcactgggggaagtgggtggcggagatccgcctcccgcggaaccgcacgcggctctggctcggcaccttcgacaccgccgaggaggcggcgcttgcctacgaccaggcggcgtaccgcctccgcggcgacgcggcgcggctcaacttccccgacaacgccgcctcccgcggcccgctccacgcctccgtcgacgccaagctccagacgctctgccagaacatcgccgccgccaagaacgccaagaagtcctctgtctccgcctccgccgccgcaacatcctccgcgcccaccagcaactgctcgtcgccgtcctccgacgacgcgtcgtcctgcctggagtccgccgactcgtcgccctccctgtcgccgtcctccgccgccaccacggcggagacgccggcgaccgtgccggagatgcagcagctcgacttcagcgaggcgccgtgggacgaggccgccgccttcgccctcaccaagtacccgtcctacgagatcgactgggactccctcctcgccgccaattaacaccaccaccacttcttggctagtactcacgccgtcgttagcctaatcgtcgccgccgccgccgccgtgcagatgggattttagacattctgcaccgcacggacgggcatggattagcagttttatagtccctaatccttttggtttggttcgtttgtgtacgtagatcgatctccggacttgtttcctctgtagatgctagggttggttggtgttcttcctcaacc

SEQ ID NO: 5231 - DNA, 1654 bp, Oryza sativa
  Predicted polypeptide sequence is orthologous to G5, G974
tttttctcttctggattcttgccgatttttaggcttcctttgcttttctaaggccagaaagggttgttttgcaatacccttctagttcatcctctcaaatttttcttctttctattcaaaagctctttctttctttgcaccctttgtttctctacttttattgaggaacagggctgatttttcacttcttgcatccaaaaagcaccccttttttctttcctgtttttaagatttccatacccttgccatcttcatcttctacctccatccagtcctcatggccgcagcaatagacatgtacaagtataacactagcacacaccagatcgcatcctcggatcaggagctcatgaaagcgctcgaaccttttattaggagcgcttcttcttcctccgcttcctccccctgccaccactactactcttcttctccttccatgagccaagattcttacatgcccaccccatcttatcccacttcctctatcacaaccgccgccgccaccaccacctcgtctttctcgcagctacctccgctgtactcttcgcagtatcatgctgcttcacctgcggcgtcggcgacgaacgggccgatggggctgacccacctgggcccagcccagatccagcagatccaggcccagttcttggcccagcagcagcagcagagggccctggccggcgccttccttcggccgcgtggccagccgatgaagcagtccgggtcgccgccgcgcgcggggccgttcgcggcggtcgccggggcggcgcagtcgaagctctaccgcggagtgcggcagcgccactgggggaagtgggtggcggagatccgcctcccgaagaaccggacgcggctgtggctcggcaccttcgacaccgccgaggacgccgcgctcgcctacgacaaggccgccttccgcctccgcggcgacctcgcgcggctcaacttccccaccctccgccgcggcggcgcccacctcgccggcccgctccacgcctccgtcgacgccaagctcaccgccatctgccagtccctcgccacgagctcgtccaagaacacccccgccgagtcagcggcctccgcggcggagccggagtcccccaagtgctcggcgtcgacggaaggggaggactcggtgtccgccggctcccctcctccgcccacgccgctgtcgcccccggtgccggagatggagaagctggacttcacggaggcgccatgggacgagtcggagacattccacctgcgcaagtacccgtcctgggagatcgactgggactcaatcctctcataaacaagcagaagcagctactactagtctattactagtactagtagtagtcttcgtcaagctagagtcactcaactcaactagctgtgtaatcttctctgaattccgtggcttccatggctcggtggcattttagacgtcggccatggctgctgcgagtagcagtaactagtcagtactcagtagtagtaaggtcgttggtattacgtcgtcgtgcaagtgtcgttggtgtactcagtgatctgatctcctggttgagctgccggttgtttttttcacggcgcggccggtcgagaattaagctgtaatcccttgttacatgttggaaattcagtagcttatgtaactatatgtacctttctc

SEQ ID NO: 5232 - DNA, 1657 bp, Oryza sativa
  Predicted polypeptide sequence is orthologous to G5, G974
aacccaaacgacggagacccactactccgagccatcaagaacacacacacatccagaaagcctaatccaatccaaaagccctaatcacccagactccatctctgtgaggtttgagagaggtaggtgagccgtagatctgagcgagttcttgggtcttccagcaggtagatcacttcatctgaggatcaatcttttttttttcctttgtttttgagcttctgttggtgtacaggacagagagttccagagccttttagtttctggtgttctgatctgttcttggtgtaagattattggtctgatttggtagccaagagggttaattttttccacacctccttgtgctagttagcttagcttataccccccttgtaaagtgattagtagatctagaacttctcttttcgtctgccagttcttggattttggaaagaacaggtggtttgttattcagatttttaggttagaaaaaatccacaaaaaaaaagatattcgatggcagctgctatagaaggaaatctgatgcgggcgctgggagaggctccgtcgccgcagatgcagaagatcgcgccgccgccgtttcatcccggcttgccgccggcgccggcgaacttctcctcggccggagtccacgggttccactacatgggcccggcccagctcagcccggcccagatccagcgcgtccaggcccaactccacatgcagcggcaggcccagtcggggctcggcccgcgggcccagcccatgaagcccgcttcggcggctgctccggcggcggcggcggcgcgggcgcagaagctgtaccgcggcgtgcggcagcggcactggggcaagtgggtggcggagatccggctgccgcgcaaccgcaccaggctctggctcggcaccttcgacaccgccgaggaggcggcgctcacctacgaccaggccgcgtaccgcctccgcggcgacgcggcgcggctcaacttcccggacaacgccgcgtcgcggggcccgctcgacgccgccgtggacgccaagctccaggccatctgcgacaccatcgccgcgtccaagaacgcctcgtccaggtccaggggcggcgccggcagggccatgcccatcaacgcgcccctggtcgccgcggcgtcgtcgtcctccggctccgaccactccggcggcggcgacgacggcggctcggagacgtcgtcgtcgtctgcggcggcgtcgccgctggcggagatggagcagctggacttcagcgaggtgccgtgggacgaggcggaggggttcgcgctcaccaagtacccgtcgtacgagatcgactgggactcgctgctcaacaacaataactagctcttctcttccatagcccgccattgccggccggcgcagatgaggttttaggcattctgcgcggcggcgaggcgatggattatatgttcgttcttgtgtagatccttttctttttgtgttggttttttaggttccggaggctgctcgccggcgtcgtttttgtgtccggcgtctccgatgtctagtaagcagtgactcgttagtgtagtagttgtacaactctacaaatgtacaaatacttgtgcatgtaggttgttgtaatcaattgttggtaactacctgtaatagaactactgtgaattaactgtattaatgtgcg

SEQ ID NO: 5233 - DNA, 966 bp, Oryza sativa
  Predicted polypeptide sequence is orthologous to G5, G974
atggatcgccaatggcgttgcctcgctgctgcggcttctactagtggtaatagtaagcttcctccgctgccgatggcgctgggcggcgccgtggagtacgggcagctcgtccatggcgcggcggcgcccgtggcgccgttcttcgtggacgccgagcagcagagcctgtcgccggcgacggccatggttcttggcgccgggtggtataactataaccttgtcacgccgtcgcaggcggcgcagctgcaccaccggctgcgacgggcggtgggcgcggcgccgtgctcgatgaagcggtgcggtggcatggcggcggcggcggcggggcggcttgcgctggtggggccggcgccggtgcaggcgaagctgtaccgcggcgtgcggcagcggcactgggggaaatgggtggcggagatccggctgccgcggaaccggacgcggctgtggctgggcacgtacgacaccgccgaggacgccgcgctcgcctacgacggtgccgcgttccggctgcgcggcgacgccgcccgcctcaacttccccgagctccggcgcggagggcggcaccacgcgccggcgctcagcgcgtccgtcgacgccaagatcctccaagccaccaccaccaccacggcggacaccgccgccgccgcagcaccggcgtcgacgaacaccacgccgccgccgtcgccgcgcgtcgtcaagaccgagccgggctgctgctccgtctccgaagcctccacgacgacgacggccgacgccgccgacgtctcgtccacagggtcttccccatccccgacctcatcgaatcaggccgccaccgccacgccgccggcgccgcggccgccgccgccgttgccggagacgattcagcagctggacttcacggaggcgccatgggacgaggccgacggcttcgcgctgcgccggtatccgtcgtgggagatcgactgggacgccatcctctcctga

SEQ ID NO: 5234 - DNA, 1539 bp, Oryza sativa
  Predicted polypeptide sequence is orthologous to G8
atggagttggatctgaacaacgtggcggaaggggtggtggagaagcatgagacggcggcgaggagcgactccggcacgtcggagtcgtcggtgctcaacggggaggcgtctggcgcggccatcgcgccggcggaagaggggtcgagctcgacgccgccgtcgccgccgccgcctcccgcggcggtgctcgagttcagcatcctgaggagctcggcgtcggcgtcgggcgagaacgacgccgacgacgacgaggaggaggaggccaccccctcgccgccgccgcaccaccaacaccagcagctgctcgtcacccgggagctattcccttccgccgctccctcgccgcagcattgggcggagctcggcttcctccgccccgacccaccgcgcccacacccagacatcagaatcctcgcccacgcgcctcccccggcgccaccgccgccgccgccgcagccgcagcctcaggcggccaagaaaagccgccgcgggccgcgctctcgcagctcgcaataccgcggcgtcaccttctaccgccgcaccggccgctgggaatcccacatctgggattgcggcaagcaagtctacctaggtggattcgacactgctcacgcagctgcaagggcgtacgacagggcggcgatcaagttcaggggagtagaggctgacatcaacttcaacctgagcgactacgaggaggacatgaggcagatgaagagcttgtccaaggaggagttcgtgcacgttctccggcgacagagcaccggcttctcccgcggcagctcaaagtacaggggtgtcaccctccacaagtgcggccgctgggaggctcgcatgggccaattccttggcaagaagtacatatatcttgggctattcgacagcgaagtagaggctgcaagggcttatgataaggctgcgatcaaatgcaatggcagagaagccgtcaccaacttcgagcccagcacatatgatggtgagctgcctactgatgctgctgctcaaggagccgatgtggatctgaacctgagaatatctcagcctgcagcctcacagcagagccccaagagggatagcggctcccttggcctgcaaatccaccatggatcatttgaaggttctgaattcaagagagcaaagaatgatgcagctccctctgaacttgctagccgccctcatcggttccctcttctgaccgagcatccgccaatctggactgcccaacctcatcccctattcccaaataatgaggatgcatccagatcatcggatcagaagaggaagccatcagagggggtagctgttccaagctgggcatggaagcaggtgagccatcatcaccctgctcctcctcacacgctgccattgcccttcttctcctcctcctcgtcgtcgccgtcgtcgtcctccgctgcagcatcatcaggattctccaaagccgccacgacagcagctgctgcccaacacactgccaccctccggttcgacccgacggcgccgtcgtcttcgtcgtcaagccgccatcaccaccaccattga

SEQ ID NO: 5235 - DNA, 536 bp, Oryza sativa
  Predicted polypeptide sequence is orthologous to G12, G24, G1277
tcctccgacctcaatcgcatttcgccgaacaccttgcatgcgcccccgtccacgaccgcctccttggcgctatccgcttcgctgactagctatagctactagctgctactctctctctgtgtcttggggtggctaaggactacgaacaagatggatggaagaagggaggcaaaatcagctcggattactactcgtcgtcggaggtgtccggggtgggctcccgttgagtcggggttcttggtccgcggcgctggggcgcggggctgcggcggctggagcggcacgggcagccgcggcgccgacgacggagtgctgcgcgtcgacgcgggcgccgacctcggcggccttcttgcggatggcggcggcggtgagctccctgtggtcctcggcaccaccgccgctgccgccaccaccacccgcgccgtcgagctggtcggggaagttgaggcgcgcggagcgccgctctagaggatccaagcttacgtacgcgtgcatgcgacgtcatagctcttctatagtgtcacctaatcatcatg

SEQ ID NO: 5236 - DNA, 1216 bp, Oryza sativa
  Predicted polypeptide sequence is orthologous to G12, G24, G1277
aagaagaagccgcccaaccaacgccaaaagctactgctgcttgcacaggagagggcagagagagagagagagagagagagagaagagggcggctgcggcggcggcgcgcttcgctcatgcagggcgagtaccaccgctcctccagcgaggactcggctgcttctgctgctgctgctgcggcggcggcggctgcggctatggctcctctcgccgcggctgcggcggcggttgctgccaaggaggagcaggcggcggcggcggcggtgctgccgctgcagcagcagcagccgaggcggcagtaccgtggcgtgcggatgcggaagtggggcaagtgggtggcggagatccgggagccgcacaagcggacgcgcatctggctggggtcgtacgcgacgcccgtggcggcggcgcgcgcctacgacacggcggtgttctacctccgcgggcggtcggcgcggctcaacttccccgaggagatctcctcgctggcgtcgctgtccgagggcggcggcgcgagcgagccccgcgagcccgacggcggcacgctgtccgcggcctcgatccggaagaaggccatcgaggtcggctcccgcgtcgacgcgctccagaccggcatgatggtcgcgccgacgacccaccaccgcgagcggcagaagcaccaccaccaccaccaccaccaccacccgcacctgcagccgcacggcgaggagcaacaccaccaccacgagcagaagcaccagcggacggcgtggagcggccgcgccaagaacccggatctcaaccaggcgccaagcccggagaactccgacgccgagtagaagccaacaaaaccgcctccgcgcggcaagatcgatcaacggcttcgtcaacatgcagccagcgtatgatcacctccaccacgtacgctcgctgcatccatccacctaccacctattcgtccacccctcatctccacctcggcggcggcggcggcggcttcgtggcgagatttttcgatgcggttttggataagaacaagggaagggcagcgtcgggaggagggcggtggagacgggggaggaggacgccacaagtggcggtctttccaaatgtcaaaaaagacagctgtaacagtgataaaacaagtcatcctctctgttttttttttcctctctctcttctccgtgttattatcgactagataagcagcgattaattaatccgtccttcccccttt

SEQ ID NO: 5237 - DNA, 1440 bp, Oryza sativa
  Predicted polypeptide sequence is orthologous to G15
agaaggaaggccagaccaggaaagggaggcaagtttatctcggtgggtatgacatggaggagaaagcggcgagagcgtatgacctggcggcgctcaagtattggggcccttccacacacatcaacttcccgctggaggactaccaggaggagctggaggagatgaagaacatgacaaggcaggagtatgtggctcacttaaggaggaaaagtagcggtttctcacggggagcttccatgtaccgtggtgtcacaaggcatcatcagcacggacggtggcaggcacgcatcggccgagtctccggcaacaaggacctctacctcggcactttcagcacgcaggaggaggcggcggaggcgtacgacgtggcggcgatcaagttccgggggctcaacgccgtcaccaacttcgacatcacccgctacgacgtcgacaagatcatggccagcaacaccctcctccccgccgacctcgcccgccgcaacgccgccaccaccacctccaaggacgaccactccgccgccggcgccggcgccattgtctcggtgcactccgccgccgacatcgccgtcgccgacaccctctggaaggccaccactgccccgaggcagcagcagcagcaccacgacgacgtcgtgctgtccggcgccgaccaggccgcattctccgtcctccacgacctcgtcgccgtcgacgccgcggcggcgcaccagcagcagcagcagcagcagcacatgtccatgtcggcggcgtcgtcgctggtgacgagcctgagcaactcgcgcgaggggagccccgaccgcggcggcggcctctccatgctcttcgccaagccgtcgcccgccgtggcggcgtcggcgcagcagcaggcgtcgaccaagctcatggcggcgccgctgccgctcggctcctgggtctcctcgccgccggcgtctgccaggccgcccgccgtctccatcgcccacatgcccctcttcgccgcctggaccgacgcctaatcaccctcgccgccatggctcaccggagtagtaattagctagctatagctagagctaggcaacgacgacgacgacactagcttaattagctcgtgtttagttggttaatttagggttcttggttgctcggcgacatgattagctaagctagcgatgtagtagtagcactagcagctagttggagtattaattagtatcactcaaggcgaggaaaccgacgcacgccatggccgcggcctctcccccacctttccttcttctccggcgacggccggccgccatgtatcagagagctcgatcggcgccggagaagaagggtttttgtaacacggaggccggagatctatcgaggcggtgcttctcctccaaaatccaaaactatatatcttatattaattaattaattaattatagcctcaccaaattaatttctcaaaaaaac

SEQ ID NO: 5238 - DNA, 2510 bp, Oryza sativa
  Predicted polypeptide sequence is orthologous to G15
tccttttgcagtttttttctgctcagctcaccgggtcccctctctcatcttcctcgtcgtgcaccttgcatggatgtagaagtagcgagctagcgcgcggcgactgcgagccgagagagcaacgcaagaacggcacgagaggctggcagcgagcgagcgtgtgcatggttggtgcgagcaaatggccagcggcggcggcagcagcaactggttaggcttctcgctctccccgcacatgccggccatggaggtgccgtcctcctctgagccatcgactgctgctcatcatcatcatcatcatcatccacctgctgctgctgctgctgccggagccatgtcgtctcctcccgacagcgccacgacctgcaacttcctcttctcccctcctgcagcacagatggtcgctccttcacctggctactactacgtcggcggcgcctacggagacgggaccagcaccgccggcgtctactactcgcacctccctgtcatgcctatcaagtccgatggctccctctgcatcatggaaggcatgatgccgtcgtcatcgccaaagctcgaggacttcttggggtgtggcaatggcagtggccatgacccggccacctactatagccagggccaagaagcagaggatgcaagcagggcggcctaccagcaccaccagctagtcccctacaactaccagccattgacggaagcagagatgctgcaagaggccgcagcggcgccaatggaggacgcaatggcggcggccaagaacttcctcgtcaccagctacggcgcctgctacggcaaccaggagatgccgcagccgctcagcctctccatgagcccagggtcccagtccagcagctgcgtcagtgcagctccccagcagcatcagcagatggcggtggtcgctgcagctgctgctgctggtgatggccagggaagcaacagtaatgacggtggcgagcagcgtgtcgggaagaagaggggcaccgggaaagggggccaaaagcagcctgttcaccggaagtccattgacacgtttgggcagaggacatcgcagtataggggcgtcaccaggcacaggtggactggaagatatgaagcccacctctgggataacagttgcaaaaaggatggacagacaaggaagggaaggcaagtatatctaggtggttatgacactgaagataaagctgcgagggcttatgatctggctgcgctgaaatactgggggctatctacgcatataaatttcccgttagaaaactaccgagatgagatcgaggagatggaaaggatgacaaggcaagaatatgttgcgcacttgagaaggagaagcagcgggttctctcgcggtgcttccatctaccggggagtaacaaggcatcaccagcatggaagatggcaagctcggattggcagggttgctggcaacaaggacttgtatctcggcactttcagcactcaagaagaagcagcagaggcatacgacattgctgccatcaagttccgtggcctgaacgcggtgacgaactttgacatcacaaggtacgacgtggacaagatcatggagagcagctcgctgctgcctggtgaggcagcgcgtaaggtgaaggcgatcgaggcagcgccggaccatgtgccaataggccgcgagctcggtgcgaccgaggaagcgagcgctgctactgtcacgggcaccgactggagaatggtgctccatggatcacagcagcagcaagctgcagcgtgcaccgaagcaacggcagatcttcagaagggcttcatgggtgacgcgcactcggctctccacggcattgtcgggttcgacgtcgagtcggcggcagctgacgagatcgatgtcccgggagggaagatcagtggcatcaacttctcgaactcgtcttcgctggtgactagcctgagcaactcgagggaggggagccctgagaggcttggcctcgccatgctctacgccaagcatcatcccaccgccgtcagcctcgccgccatgaacccctggatgccgatgccggcgccggccgcagctcacgtgatgaggccgccgagtgccattgctcatctccctgtttttgcagcctggacagatgcttaattagagccatgttgctgcttgctcgatcttgcttttgatcggctctttttgtaaactaaagcaagatcagcagcaatcaggtgcttatggtacttaaattagctggaagcctggagtagcatacttggttatgatggtaagcactaggctggtggtgtaagtgtttaaccagtaaacccataggtaggacattcaagcaaaatccaaatctctagagcatccactggtagtagtagtagtagacctttagtgttagaccggtagtgttctttgcttcttttgagcctctttttttgggggaaatttggttggaatgtatggctttttaacacgaaatcaggaatgtatggcttttaacacgaaatctggctgtggcattaaaaggaaaaggttcagtgag

SEQ ID NO: 5239 - DNA, 593 bp, Oryza sativa
  Predicted polypeptide sequence is orthologous to G15
cttgatggctacagctatggcgtcggctacggcagcagctgcatcgatcaggtcgacaacgacaagctgttccagcatcatcatcagcaggatcaggcacaagaacagcagcagcagctggtgtacaactacgacgagatcaagcagctgctgatgaacacatcaaccacaagtaatagtattaatgctggtcaggatcatggcggcagcatggaagcagggttgatcggctcacaagggaaggtaaccatgatgtaaattaaactgatcgattaaagaggaggggaaggcagcagctgggcacggcaagattaaggatggattaattaaaccaaggtgtgttgttttttttactgttctttgattggattctaccgtacgtacgtgatgcatggcgcgtttaattgttgtggttaaaaaaaaaaaacaaaggaaagaagtgtgtcccgtgtcacggtcgcatgcacgtgccagtgcagctgctagtatagcgtttgcgttcgtgttacagcctgcagtgtgttgtatgtcactgtgacatgggatcgatcgatggatatcatgactagagataatctctctctctctctctc

SEQ ID NO: 5240 - DNA, 1164 bp, Oryza sativa
  Predicted polypeptide sequence is orthologous to G19
acctcgctctcctcgtcaccgcgatcgatcgatcgccgccggtttagatttccttcctacgcggaccgcacccacgcgctaggtttagctagctagtttgcttgcgcgcaagcgtcgatcgagctagctagtgaagatagatatgtgcggcggcgccatcccgctgatcagcagccgcggccccggcggcaagaggagcctctccgccgccgatgagctctggccgccgccgccgcagcacgccagcgacgacccggccgagcaagcggcggcggatgaggaggagcaggagcagcagccggcggcgaggaggcagcggcgaggggagcggaggacgctgtaccggggcatccggcgcaggccgtgggggaaatgggcggcggagatccgcgacccggccaagggcgcccgcgtctggctcggcaccttcgccaccgccgaggctgccgcgcgggcctacgaccgcgccgcccgccgcatccgcggcaccaaggccaaggtcaacttccccaacgaggacaacgccttcgccgccgcgccgccgccgtaccacctcgccgcctactacggcgacgcctcctccacctcctacctctacccgatggccatgacgcccgccgccgccggactgagggagcagcagctgatgacgacgacggcggtggagtacagcgttaatgacgccgtcgacgtggccagcgtttacttccagccgccgccgccggcggttgcttacgagttcagcgccgtcggcggtggcgccgtcgtcgtgccggtgtcggcggtggcgccggcgatgacgtacggacagagccaagaggtggcggctccgctcatgtggaatttcgatgacatcacggccatgccaatgtgattgtcttaccgtggagattaaggcatttaaaggcttatagataacataaatttgccatgtatgatcaatggttaattcctattgctcaagggcttatattaagggttacctacacggcatggctagcttagcctacaatttatgtttcttgcatttctttctctttttttgagatgagctagtgtgttatactatttgttcatcttttctggtagtggtggatacattttcgccggctagggttggaatttgtaaatagaagatggtcaataataagattgtttctggct

SEQ ID NO: 5241 - DNA, 1050 bp, Oryza sativa
  Predicted polypeptide sequence is orthologous to G19
gagaagaaaagccttgtgagttggtaattgatagtagcaagacaatgtgtgggggagcgatcatcgccgacttcgtcccgcccgccggcgcccgccgcgccgctgcctccgacatctccgacaacgccgtcctctccgctgccggtgccggtgacgagtcgttcgcggcggccaaggcgccggcgccggggaggaagacggcgtaccgcggcatccggcgccggccgtggggacgctgggcggcggagatccgcgacccgaggaagggcgcccgcgtctggctcggcacctacgccaccgccgaggaggccgcccgcgcctacgacgtcgcggcgcgcgacatccgcggcgccaaggccaagctcaacttccccccgaccatcggcgccgccgccgcgccaccgccgcccaagaagcgacgcaaagccgccgccgcggcgaaccaccaccaccaccaccaccagcaggagagctcaggctcctcgtcggcgtcgtcgctgcctcccaccccgccgccggccgccgagcaccagctccgcgagtgcatgtccgggctggaggcgttcttgggcctcgaggaggaggaggacgacggcggcgccggtgagccatgggacgccgtcgacatgatgctcgagtaggctcgccgggaatggcagcgttgccatgctcatgcatccaagcttattcatgcatgcagcagcaagatatacaactttagtactactactatgttaattactacttactgcgtaggtaaatgaaataaaatggggttggttaattagggtgttcttctgggaatccttggctttgctaattgctagtactactatgtactttggcgttaagcattgcattgccaggtgatgcatgtcatgtaatcgtggtaattatatggccgtcctcctagagctagctagcagattagatttactatataaagtggtagtagaaatatatgtcctcctagagctaactagtgtcttgtaatgatttcagacttcttgggcaacatgagcaatgcatttcgacttccactttacatct

SEQ ID NO: 5242 - DNA, 1236 bp, Oryza sativa
  Predicted polypeptide sequence is orthologous to G20
aggtgcatatgatgatgaagaggctgcagcaagagctatgaccttgctgcattgaaatactggggagctgggacacaaataaactttcctgtctctgattatgcaagagatcttgaggaaatgcagatgatctccaaggaggattatcttgtgtctcttcggagaaagagcagtgccttttccaggggtttaccaaaatatcgcggccttcctaggcagctccataattccagatgggatgcttctttgggacacttgcttggcaatgactacatgagcctagggaaggacatcacgctggatgggaaatttgcaggaacctttggcttagagaggaaaattgatctgacaaattacataaggtggtggctcccaaaaaagacacggcagtcagatacatctaaaatggaagaggttactgatgaaatccgtgctattgaaagttcaatgcaacggactgagccttataagtttccttcccttggcctccattctaactcaaagccctcttccgtggtcctatcagcatgtgatatcttatctcagtctgatgccttcaaaagcttctcagaaaaatctacaaaactatctgaagaatgtacttttagcaaagaaatggatgaaggaaagacagttaccccagtacctgcaactggacatgacacaactgcagttaacatgaacgtgaatgggttgcttgtgcaaagagctccatacacattgccctctgttactgcacaaatgaaaaatacctggaaccctgctgatccttctgcggaccctcttttctggaccaacttcatcctgccagcaagtcaacctgtcacgatggcaacaatagcaacaacaacgtttgcaaagaatgaggtgagttcaagtgatccattccatggtcaagagtgaccgtacgagcttaccaaagtgcatgcaggatttgctttttggcttggtgggtgataacatcctgcacgtctatgggtttccttcttcctagcttttgaggtgacccgtgaacaaataccctttgtatccatagttcataagccatgaatagaaggtaagagaagtacaaccatagttatgtaatatatacagtgcctagtggcctagtgccccgttaatgatatttagttatagagctgtctgtacatatcgcggttcttatttcagctacttggttggttctatagaatgaagagaacagaagaacacgaatttttcaaagcttaattgttt

SEQ ID NO: 5243 - DNA, 1038 bp, Oryza sativa
  Predicted polypeptide sequence is orthologous to G21
accacacaccacgccactcgcctcgcctcgcacagtcgctcgctcgcccgctctagctagctcacagctcgctcactcgctctcctcttccaaccaactccaccaccaccaccagtccaccacagcgcgcggcgccatggacgactcgtcgttcggttccgagccgaccacgtcctcctcgggcggggaggcgccggcctccccgccgtccaccgcgtcgtcgtcctcagacggcgccggcggcaagaagaagcggccgcgcaaggacgggcaccacccgacgtaccgcggggtgcgcatgcggagctggggcaagtgggtgtcggagatcagggagccgcggaagaagtcgcgcatctggctgggcaccttcgccaccgccgagatggccgcgcgcgcgcacgacgtcgccgcgctcgccatcaagggccgcgccgcgcacctcaacttcccggacctcgcccacgagctgccgcgcccggccaccgcggcgcccaaggacgtccaggccgcagccgcgctcgccgccgccgccgacttcccggcctcctccgccaatgcgggcgccagcaataaccccgacggatcggacgacgcgagcgccgggtccgcctcgccgcccccgccgccggacgccgctgacgacgcgctgttcgacctccccgacctcctcctcgacctcagatacggcccgcccagctcgggcctctcgtgcgcgtcgtcttgggaagacgaagtgggcttaatctccggcgccggtgccgccgccgccggcgtgttccgcctggaggagccacttctgtgggagtactaaaagccaaagcgccgccggtaaaacactcgtcagtgctaaaatcgagcagcctgcatgtacaacccgtaattttccacgcatgaccaaaagaattcatgcatgcaagccagctacggcctacggcgcacagaaacttgagccaaaaaatcagcgtcgttttgtcctgcgtttgcgtcgccaaatttgggaagcagaccatgtataaaaaatcatccttcttttcc

SEQ ID NO: 5244 - DNA, 1109 bp, Oryza sativa
  Predicted polypeptide sequence is orthologous to G21
cctggaaggaagcgcatctccttcctgcggtattctgtgtgcctctctctctctctcctccaccttgtcgtagagaggaggcggccatggaagctgccgcgatccatgcgcccaccaccaccacctcctccgactccggctcgtgcgtcaccaatggcacgcgagagaagcgcgagatctctaagcacaagcagctcaagcggaagaggagcacctctcctgctcctcctcccggctgcggcggcggccaaggacaggaagcggcggtggagactgacgctgacgctggcgccgccggcgaggaggagagcagcagctgcggtggcgctggcgccggcgagggcgagcgcaagaggggtgacgccggcaggcacccgtcgtaccgcggcgtgaggcggcggagctggggcaagtgggtgtcggagatccgcgagccgcgcaagaagtcgcgcatctggctcggcaccttcccgacggcggagatggccgcgcgcgcgcacgacgtggccgcgctcgccatcaagggccgcgccgcgcacctcaacttcccgagcctcgcccacacgctcccgcgcccggcctccacctcaccctccgacatccaggccgccgccgccctcgccgcagctgcagccgccaccgaccaatgcgagtcctcctcctctgccgtcgccgccgccaccgccaccgacgccgaggcggcggagtccacctcgtcggccgcggccagcccgtgcgccgccaccagcagcgtcgaggagaacgcgctgttcgacctgcccgaccttctcctcgacctgagcgacgggctctggtgctcacccgtctggacgacagcgccggccgatcagtacgacgccggcgacgacggcgacgacgccgcggcgccgctcctgtgggccgagcagtgctggatggacgccccagcggcgcccgtgcagcctgactaattaagccaatccacctgctccgactcgccggccggccattgcaccggttgggttggtcgcagcagtcaacctatcgacaccatgggcgtctttttcttttctctctgtttttttttcttttttggacagagtaataaggaaaaaaatatagattaaaaa

SEQ ID NO: 5245 - DNA, 870 bp, Oryza sativa
  Predicted polypeptide sequence is orthologous to G21
atggccatggcgaaggagctccaagaaacctcctcgtcttcgtcctcctcggctgcctccacgtcctcctgctcctccgccgtcacggacgcgtggtcgtcgccggccagacccaatgctgtggccggggggaagaggaagaaggaggtggtaggagaggctgatgaggctgcaggcggcggcgcaggagaggaggaagaggaggaggcggaggcggcggcggcggggaagtcgtcggcggcgacgaagaagaggaagcggagcagcgacgggaagcacccggtgtaccgcggcgtgcggatgcgggcgtgggggaagtgggtgtcggagatccgcgagccgcggaagaagtcgcgcatctggctcggcacgttccccaccgccgacatggccgcgcgcgcccacgacgtcgccgcgctcgccatcaagggccgcgccgcgcacctcaacttcccggacctcgccggcgtcctcccgcgcgccgcctccgcctcgcccaaggacgtccaggccgccgccgcattggccgccgcgttcaccacgtccccgtcctcgtcgccctcctcctccttgtcggccgacgacgtcgcgccatgcgtcgtccacgccgacgccgacgagcagcctgccgctgccgccaagaacgacgacgacgacggctcaaccaccgcgccggtggcggcggcggcggcggcggcggcggcggatgagcagcagctgttcgacctgccggacttgctgttcgacatccaggacgggccgttcgggttcccggcgatgtgggcgccgctcgccgacgtcgacgaggtcaatgcggagctccggcttgaggagccattgctttgggacttgggagtaacagatgcttaa

SEQ ID NO: 5246 - DNA, 741 bp, Oryza sativa
  Predicted polypeptide sequence is orthologous to G22
tcaatcacataagttagttccctttaaacctattcttgaaatctagtactgttagatggtttaactctatagctaaacattagagttgatttattctatagcttctgctatattagttagccacaagtttgtaaatacccatgtatcttataataatatctcctctggagccttgttcaaatttatgcaatgaagatccagattattgaacctgtatcaatctactgatccagggcttgatacagtctaaatatgtcgattaccgaattattagttttgggacccgacaaggggaagtaggagccgtcggacaggagtaccgtcggcacaagcaccgctctgaccgaactgccatcactgtcaccggtctctcgttcggtcaccgccaatgatgcaatttgggagaagggcattgggagagaataatttggggacttgggttttgctccaccccttccaccagcgacttcacccgcacgaaagaaatatcagcaatccattagatcagacggctcaccatctcctcgtgttgggtcgtcgccgttggtgggtcacttggctcttgggccatagaatttgattagaatttttacattaccgtgatattatttttttgttacttcttcccaacggtgatgtgatttaggacattaatgtctttagctaatcatttctgcccaacgatgacttgattttgattgtaagtaatttcatttaatgtttccttcgttttgtcaaaaa

SEQ ID NO: 5247 - DNA, 885 bp, Oryza sativa
  Predicted polypeptide sequence is orthologous to G25
gactcgtcagcttagagcaccgcaagcgcgcacagccagcaaagatgtgtggcggcgcgatcatttccgacttcatcccgcagcgggaagcccaccgcgcggccaccggcagcaagcgtgccctctgcgcctccgacttctggccgtcggcgtcgcaggaagccgccgacttcgaccacctcaccgccccctgcaccttcacccccgaccaagcggcagaggagccgaccaagaagcgggagcggaagacgctgtaccgtggcatcaggcggcggccgtgggggaagtgggcggcggagatccgcgacccggcgaagggcgcgcgcgtctggctcggcaccttcgccaccgccgaggcggcggcccgcgcctacgactgcgccgcccgccgcatccgcggggccaaggccaaggtcaacttccccaacgaggacccgccactcgacgacccggccgccgacggccacagccacggcggcgccgccatcccgtgcagggagttcatggactacgacgccgtcatggcgggcttcttccaccagccctacgtcgtcgccgacggcgtgccggccgtgccggcggaggaggcgcccacggtggcgtacgtgcaccaccacctgccgccgcagccgcagcaggacgcggggctggagctctggagctttgataacatccacacggccgtgccgatgtgagatcgatctgatgatcattcagatcgatgctagctcatgtgttttttaattatatcttcacagcagaaacaaaaaaaagttcaattcagtttattttgttgttatacgttttaaaatgtttcattaggttttcatgttataggagtgatttatcggattgaactctcaagtgaccgacttctgagttctt

SEQ ID NO: 5248 - DNA, 990 bp, Oryza sativa
  Predicted polypeptide sequence is orthologous to G25
acgcacacacttcttctgcttccctccccttgtttccgctccacttcccttccaagcaagaaaaccgaggcttcagcttagctaggaccgaccgatccgatgtgcggcggtgcaatcatctacgactacatcccggcgcgccgccggttgtgcgcctccgacttctggcccgacgccgacgactccgacccccacacccccgctcccgagaaaccgccgcgcgcgaagagggagcggaagaaccagtaccgcgggatcaggcagcggccgtgggggaagtgggcggcggagatccgcgacccggtgaagggggtgcgcgtctggctcggcacctacccgaccgccgaggccgccgcgcgggcctacgaccgcgccgcgcgccgcatcaggggcgccaaggcgaaggtcaacttccccaacgacttcggcgccgcccccgcgccggccgcggcggcggcgaaggccgtccctcgcgtcgcgcccacgccggccgtgctcccgccgcccaagatggaggcggtgtccgagggcgccggcgcctgctcctccgacgaggtcaaggagctgtccgaggagctgctcgcgtacgagaactacatgagcttcctcggcattcccctacatggagggctgggccgcctccgccgacggtgccgacgaaggcgcggcgcccgccgggctctgggaccttcgaagactacgagctgccgtcgctagcgctctagtaccattgtccattaacctgactttgtatgtgaccaccccgttttcctacccggtagtacgtaccaggggtctacggtacccgtactcaatgcgtgatttcggttgaccttatccattgtgcagttgtaactgtgcttgggcggggcccgtccccgtgaacctttgctgaaccaagtttactctatgtgacaaacaacacagggccgcggtctaaaggtccagttacgaacggtgttgcacgggctagaccccaataaggcccaa

SEQ ID NO: 5249 - DNA, 706 bp, Oryza sativa
  misc_feature (64)..(64): n is a, c, g, or t
  misc_feature (100)..(100): n is a, c, g, or t
  misc_feature (111)..(111): n is a, c, g, or t
  misc_feature (141)..(141): n is a, c, g, or t
  misc_feature (178)..(178): n is a, c, g, or t
  misc_feature (622)..(622): n is a, c, g, or t
  Predicted polypeptide sequence is orthologous to G27
aacgtgggtcaatattcccttcccaatcgctgcacctttcttctgcatggtcggtgatgtcgtnccggatccggctatcccgatcgagtccggtcgcttnttggtgaggtnccgccgcgctgccgccagatccggcggatntagggtcgtccatcgccgtcccgagcgccgtggtggntctcacgtcgtcgggggctgccgaagccgggccgggaagcacgtgcacgatctccggttaattgaggagcacagggcggtgcggcccttggcggcacagcggcaaaatctgatgataatgatccggcgacaatggcgtgtaatgatccggcgacaatggcgtcttggacttatattttgctgctgtgtttgccgatagttcggttgcattgcttgctattgacctcttctcttgttgatctggtgggtggctcccgtctggttgcgttgattgctatttacctcttctcttgttgaactggttggtggtggctcccttctggtgtttggtatttattggagagtcaatcaagattagtttaggaatcggtgacaatcaagattgtcagagtcggattgtttagggtgtttttattttggaatctactgtcttaggccgtgtttngatccaaagtttggatccaaacttcagtcctttttcatcaaaaaaaaaaaaaaaaaaaaaaaaaaaaaaaaaaaaaaaaaaaaa

SEQ ID NO: 5250 - DNA, 988 bp, Oryza sativa
  Predicted polypeptide sequence is orthologous to G27
aagcctccaactactccagtccacacccgcaccaccgcggcagccatggacgactcccacgacctggcctccccgacctcccctgacacggcgtcctcgtcgtcttcgtctacgtcgacatcatcgtcctccgccaccgtcgccccgaagaagcggccgcgcaacgacggccggcacccgacgtaccgcggcgtgcgcatgcggagctgggggaagtgggtgtccgagatcagggagccccgcaagaagtcgcgcatctggctgggcacgttcgccaccgcggagatggccgcgcgcgcgcacgacgtggccgcgctcgccatcaagggccgcaccgcgcacctcaacttcccggacctcgcgcacctgctcccgcgcccggccaccgcggcgcccaaggacgtgcaggcggcggcgctgctcgccgccgccgcagccgacttcccctccgtctccgtcgacgccaatgccaagagccccgacacctgctccgtcgccagcgccgcctcgccgcagccgccaccgccggacgccgaagcggaccctgacagcacgctgttcgacctcccggacctgctcctggacctgagatacgagacgtcctcgagcctctcgtgcggggcgtcgtgggccgtcgatgacgacgtggccggcggcgtcgtgttccgcctcgaggagcccatgctgtgggattactgatcaatgtggctgctcatgggagccagtcatgcttccgtgtattagatcgatcagtggcttgtacatggcggtgcttcttttcttcttctttactctgcttctgctctgttctctttcttcttttctccctttgtattttgttttttttccttccattttttcttcttttctttgccaaatctagcatgcgaggttgtataaagtcagttccttttcctcgccttgcttgatttgggggacaagaatatgtataattaacaagcatcttatcttcgactatcccttttct

SEQ ID NO: 5251 - DNA, 1136 bp, Oryza sativa
  Predicted polypeptide sequence is orthologous to G27
gcagaccgcacttccatcgatctctctcctcgccacgggccacggccttctcctaacgggagccatggaagcagacgcgagccatacacccaccacctcctcctccgtctccgtctccttctcctcctcgtcgctgtccacttcctcctccacctcctccctcgtcgacaatggcgcgcaagaccggcccaagagctccaagcccaaacacgccgccaagaagcgcaagagagcggccgcggaggaacctgccaatgccgcccacggcgcaggggaggataccagcagctgcagcaccgacgacaacgcggcggcgagcggcaaggcgcaggcgggcggcggcggcggcggcgtcgacagcagcagcacctgcaccgccgcctcggcgccgaggagcggcttcaagcacccgtcgtaccgcggcgtgcgccgccggagctgggggaagtgggtgtcggagatccgggagccccgcaagaagtcgcgcatctggctgggtaccttccccaccgcggagatggcggcgcgcgcccacgacgtggccgcgctcgccatcaagggccggaacgcgcacctcaacttcccggacagcgcccacgagctgccccgcccggagtccacctccccggcagacatccaggccgccgccgccaaggctgccgccgaggtgcggtgcgaggaggagtcgtcgccgtcgtcgtcgcccaccgccgagcaacccgaggaggaagccgcctgccctgacacggtgcacgccgacggcggccaggacaatgctctcttcgacctacccgaccttcttctcgacctacgggacgggctctggtggtcgccggtgtggccggcggcactggcggccgaggagtacgacggcggcgacgccgtcgtgctcaatgagccactcttgtgggccgagtagccattttacctttctgggctcatgaataggctacaacgacaactctcaagaaagaaagaaaaaaaagggaaaaatgttattaccgctatatttagtagttactgctattgacaaagtttagtctatgttgtgcttgattaggccatgaagcctgtgtgctttgtgtaccaacaatcaaaaagatctctctactaatagaagttaattaattcgaagc

SEQ ID NO: 5252 - DNA, 1473 bp, Oryza sativa
  Predicted polypeptide sequence is orthologous to G27
gttggggtccatattcccctcctcaccgctgctcctttcttcggcatggtcggcgatgtcgtagccgccggatccggctatctctatcgagtccagtcgctttttggcgaggcgctgccgcgaccgccgccggatcggggtcgtccatcgccgtcgcgagcgccgtgtggctctcacgtcgttgggggctgccgaagccgagcggggaagcacgtgcgcgatctccggttagttgaagaggacgggggtggcgcggcccttgatggcacggcggtggcgaacgtgcagagccagatgcgcgagttcttgcgcagctctcagatctccgacacccacttgccccaactccacatgctgctgctagatccaacgggcggcgagcttcgtcggtggagagcttttgcgccgactgctcgagcatccagcaaaatgtaaggtggaggtggtgcggtggttgggtcacggatcggccagggtggcgagcctgggggaattggcaggcaggcaaaggagggaaagacgggccaaacattaaaaaaaaataaaggttgccagtggaagaaaacaaactgtagaaggcaaatccggtgacttggagctgctaaggggctgtttggtttccagggacttattccaagtccatgtcacatcggatatttggacactaatttggagtattaaacatacattaattacaaaacctattccataagcttggactaattcgcgagacgaatcttttgagtctaattatgtcatgattttgacaatgtgatgctacagtaaacttttgataattatggattaattaggcttaaaaaaatcgtctcgcggattagctctcatttatgaaattagtttttttattagtctatgtttaatactctaaattagcgttcaaacatctgatgtgacttgggctaaaaagttttagccccatctaaacaccccctaagcaaatccggcgacttttgctatctcgctgttctgattgccagcaaatttgatgatttggagctgctaagcaaatccggcgacttctgctatctcgctgttctggttgccagcaaatttgatgattgccactggttgcatgttgtttgctattgacttgatttgttgttggctgtgggatgtgaatccgatcgtcaaagcagtcggtttcggtgacagtcatagcagtcggtttcggtgaataatagcagtagtttggaaaagttttggctataggaatctttgcatgtcaatccgtgtgctacactgtttcagtgaaaagtagtagtatttttatgtcgtgctatgagtagtactccctccctccgtataagcatattttcaaatctgaaaattctatgaaaattctatttttgataagcatatttcaatttaacaatctatcatcttaatgactttctcggatttaatgtatgactctccattcttctatacaagattggctacttgagcatcgcg

SEQ ID NO: 5253 - DNA, 1648 bp, Oryza sativa
  Predicted polypeptide sequence is orthologous to G27
gtttcttctcctctcctcttctctcgtttcttcctgtgctgcctcttatcacccttctcacctccttcaatggccagatctgatcaggtgaggtaaaatccgatgaggagaagtaactgaaagggagaggtggaacctgagggaaacttctctctcagcatggggtccatattcccctcctcaccgctgctcctttcttcggcatggtcggcgatgtcgtagccgccggatccggctatctctatcgagtccagtcgctttttggcgaggcgctgccgcgaccgccgccggatcggggtcgtccatcgccgtcgcgagcgccgtgtggctctcacgtcgttgggggctgccgaagccgagcggggaagcacgtgcgcgatctccggttagttgaagaggacgggggtggcgcggcccttgatggcacggcggtggcaaacgtgcagagccagatgcgcgagttcttgcgcagctctcagatctccgacacccacttgccccaactccacatgctgctgctagatccaacgggcggcgagcttcgtcggtggagagcttttgcgccgactgctcgagcatccagcaaaatgtaaggtggaggtggtgcggtggttgggtcacggatcggccagggtggcgagcctgggggaattggcaggcaggcaaaggttggttgacgctatttttcttttctaatcatttgcatgaattatatgtttggatgcttcatgtgcaatcggttgcaaaattaggtctgtatatatagaggtgataaaaaatcataaataaaataacagatcgcatagtaatatatctcagtttattcacatacaatattcagctattataatatagtacatgtaatgatctgtattgactatgagctattctttctagctagtatcattaactgcaggatattctaccgaggtactgctaattatgaactattctcatgagctctaagcactatctgtatacttagaattcattttccttgttctctgaggccttgtgttgcatgctatattgtctggttgaacacatgttttcttacgtttctcaacagagctttccttgcctatgccattgatggttttcgcctgtctttttcctgccttgatggattcttgaacaactgatttgtttatttcatggctgtagttgtcatttctgatttctgcctttgtgggttttgcatgagcgccttttgcatttttgcctcgaacttttgcatctacacattttatcatacttgtttcgttgctctcctcttctgaatcgtcttctattatgtatgtcctccgtcttatttgtttgcaactgggaggtttgtccgacgaagtgagttcatcttcactcatgatttcctggtcactatcctctagctcttgcttcacgggtagcagtgagatggatctgttttttaataagagggcccctgctggtttgttccttcaaaggcaataaagtatttgtcatatgtgctatatattataaataaatgaatatttgtattatgtgttcaaatacctgttgatctgtctctctatcttgttttagtatgttatccacatcgtcgtccattaactcctgtaaaatcataatgtggaaacatttcggaaataaaattttcaagattttgtgt

SEQ ID NO: 5254 - DNA, 306 bp, Oryza sativa
  Predicted polypeptide sequence is orthologous to G27
atggaaaacgagtgtagcttctgcgactccctcgtcgtcaagtccaacctgctatgtccactcgccgtcgacgctgccctcgccgccgtcgatccggctcacccggacctcctcgatctccacagcagcggcagcgaggcggacctggatcgagttggcgttgtccgactcgggaagtccgccgcggcggcaagtgcggctacggcttggacatccttgggcgccgcgatggctgggcgtgacagcgcgtgggcgaggtccgagacgtcgagggagggggatgaggaccgaatggagacggtgtga

SEQ ID NO: 5255 - DNA, 528 bp, Oryza sativa
  Predicted polypeptide sequence is orthologous to G32
atggcggacgcggcggagcagcatcaccggcaggaagagactgcggcggcgacgacgacgccgcagcagatgatgatgcggcggcggcgggcgcgcgcgtcgagcgagtacctgggcgtgcggcggcggccgtgggggcggtacgcggcggagatccgcaacccgtacaccaaggagcgccactggctcggcaccttcgacaccgccgaggaggccgccgtcgcctacgacctctccgccatctccatctccggcgccgccgccgcgcgcaccaacttcctctaccccgacatgcaccaccaccacccttcgccgccgcagcacgcgctgtctccggcagtgccaccgccgccaccgccgccgccgccgtcgccgctgtacgatgatgattacctgtcgccggcggcggcggaggaggaagtggaggccggcgacgacgagtcgctgacgatcgcgaccatcctgcagagcttccagtatcagcagagcgtcccaccggcgtcatcgggttccatgttttattattag

SEQ ID NO: 5256 - DNA, 879 bp, Oryza sativa
  Predicted polypeptide sequence is orthologous to G32
atgatgaacttctcctcgtacttctactcgtcgtcggcggcggcggcgggtggtggtggtggtggtggggagaagaagtcgtcgtcgtcgtcggcgtcgaagaagaagcagcagcaggcggcggcggcggagggagggaataaccagacgaggtaccttggggtgaggaggaggccgtgggggaggtacgcggcggagatcagggacccggcgacgaaggagaggcactggctggggacgttcgacacggcggaggaggccgccgtcgcctacgaccgcgccgcgaggtcgctccgcggcgcccgcgcgcgcaccaacttcgcctacccggacctccccccgggctcctccgtcaccccctacctctcccccgacctctccgccgacgcctccgatcagctgctccagccgttctacgccaatccctccgccgccgccgcgctgcccactccggcggcggtgatggccggaggaggaggagtcgaattcggcggcgagtacatgtacggcggcggcgtcgacatgtcgtcgctgatggacgacattgcggccatgcccgacgacctcccgcccagcgtgacgggcggcggcggcggcttcgccagcagcgacgaatactccagcggcggcggcgggatggtcgacgacgtctccatgtactgcggcggcaatggcggagggtcgtcgtggtgcgacgcctccgacttcgcctcgtactcgtcctcctcgccggcggcggcggcggcggcaggctcgcacgggatgtacttcgaggaggggtacgtgcacagcccgctcttctcgccgatgccggccgtcgacgacgccggcgccgacgggttccagctcggcggctcgtcgtcgtcctactactactga

SEQ ID NO: 5257 - DNA, 1151 bp, Oryza sativa
  Predicted polypeptide sequence is orthologous to G38
gattctgatacatcgatacaatcaagctagcatggagatggacatcggcgagggcgagagctgctgcggcaggcgaaagcagcagcagcagcagaatattagcagcagcaagtcacgcaagtgctgcccgctgcggcggtcgcggaaggggtgcatgaaggggaagggcgggccggagaaccagcgttgccccttccgcggcgtccggcagcgcacctggggcaagtgggtggccgagatccgcgagcccaaccgcggcgcccgcctctggctcggcaccttcaacaccgccctcgacgccgcccgcgcctacgactccgccgccagggccctctacggcgactgcgcccgcctcaacctactcctcgccgccgccaccgccggtgctcctcctgctgctgctaccccttccgtggccacgccctgcagcaccaacgacgactccaacaactcgtcttccacgacgcatcagcagcagctgacgacgatgctgcagctggacgacgacaactacacgctgcagccgtcgtcgtcagatcaagaggacttcgagacgtacgtcacgcggctacccaaggcggaggactttgggctggagggcttccaggaggttccactcgacgtcctcgacgaagccggcggtggcatcagcatctgggacctctccatctgccccgccgatttcatggccaccgccgccaccaccaccgccaaatcatcttaattatatattcataataataataataataataataataataataattaacgacgacgacgacctacctacatcatatatctatctatctagcgcccgcgcgcggctgcctatatagatatatgatgatcagctccatctctctctaaagtctaaacatgcatgcttgtcgtcgtcgtcgtcgtcatcatcgtcgttacttgtatatatactccactacttagtactaactactataattagctctagcgtactgctacttttatacggcatgcaagcggccgacatcctgatcgatcaactgtgagcatgctgtatgcatcgatcgatcttaattagttaggcgagctgtgcttgcttatcgatcttaattatatcatccgatcccatattatataagtaatactaattaatactatatatattatgt

SEQ ID NO: 5258 - DNA, 1616 bp, Oryza sativa
  Predicted polypeptide sequence is orthologous to G38
ggcctttccttccgatctctctccctctctctcttcttcttcttcttccttccctctcaacccgacgacccacgcgaagcgaactctcgcgcgagacgagagtagtaaaccctagaaacctagaggagatccccaccaccaccatgacggtggatcagaggacgacggcgaaggcgatcatgccgccggtggagatgccgcccgtccagcccggaagaaaatgtggaggcgaggaaagtactggaaaccttgattccgtccaaccgataggaaaaagcgaccacggagatcacgcgatggacctacttcagttgcagagaccatcaagcggtgggccgagctcaacaatcagcaggagcttgatccacagggtccaaagaaggcaaggaaggcacctgcaaagggttcaaagaagggctgcatgaaggggaaaggaggaccggagaatacacgttgtgacttccgtggtgtgaggcaacgtacctggggcaagtgggttgctgaaattcgggagccgaatcagcaaagtagactctggttggggaccttcccaactgccgaagctgcagcttgtgcttatgacgaggcagccagagcaatgtatggtccaatggctcgcactaattttggccagcatcatgcccctgctgcttccgttcaggttgcactagcagctgtcaaatgtgctttacctggtggtggcttaacagcaagcaagtctagaacatccactcagggtgcatcagcagatgttcaagatgttttaactggtggcttatcagcatgcgagtccactacaacaacaattaataatcaatctgatgtcgtctctaccttacataagccagaagaggtttctgagatctctagtccactgagagctccaccagctgtcctggaagatggttctaatgaagacaaggctgaatcggttacctatgatgagaacattgtcagccagcagcgtgcccctcctgaagccgaggctagtaatggaagaggcgaggaggtctttgagcctctggaacctattgccagcctaccagaggaccaaggagattattgttttgatattgatgagatgctgagaatgatggaagctgaccctacgaacgagggtttgtggaaaggcgacaaagatggatcagacgccatcctggagcttggccaggatgaacctttctactacgaaggggttgatccaggcatgctggacaacttgctcaggtctgatgagccagcatggttattggcagatcctgcgatgttcatctccggtggcttcgaagatgactctcagttctttgagggcttgtgatttccccttggcggcagccggccatactaaaattttctggtgctttggtcggctagctcctgcacatcgccctcaggatcagcaagagaaacactggaccggattgggttcgttggtggaactggatgagcatctagtagctaaggaaaaaagatccttttatttagttctgtaggcaatggaactccttgagaactccgtttcagtgtttgttaatttgataacgcttgcttgtttgtgtgtgtatatcgatctcttttgaagcaatgagaaaaaaaaaaggactgaagaaaatgtg

SEQ ID NO: 5259 - DNA, 811 bp, Oryza sativa
  Predicted polypeptide sequence is orthologous to G43, G46, G1419
ctttttttgcgctcaattgctctgagcctctgatgttcttcattagtactcttcaacttgtaattaatacatatttatatcatttcattgacaaatcgcaatgaagctactatgatcatcgatcacctgagcagcaatagaacgaaagaattcaatatttggccgaaagccaaatcgattacctaatattacgaagtttagcgaattaatcaaagaacaccctatctaattcaggattaaggccatatccttcgcacgtgacgtcacggacaccaccacgcggcagccatgcgtgtaccgcgccgggcgcgcgccatggctgcactccaagctcgccacggcgccgtccatggccggagctagcgatcgatcagcttacgaacagctgcgggaaggccatgtgcgggtgcggcgacagcggcgagagcggcggcaggctgcagatccccttcagctcgtcccagatgtctccggctgccgccgccgccgacgacgacgacgaggaggagttctccggcggcgccatgatcagcctctccttcttcacctccctcaagtagtactgctcctccgacctcaccctcttgcctcttccggcggacatggcggcggcggggataggggcgacgggaggggcccacttgacggcggcgtcggcggcgacctcgttggggaagttgaggatggccttggacccgcggagctggaacgcggcgcggtcgtaggcgcgcgcggcctcgacggcggtgtcgtaggtgccgagccacaccctcgcgcccttccctcgcgggtcccggatctccgccgcgta

SEQ ID NO: 5260 - DNA, 1399 bp, Oryza sativa
  Predicted polypeptide sequence is orthologous to G43, G46, G1419
gaggcacagctaactcaacgcaaacaaatcaaacgccacgcacctctcgctctcccactgaagttgtgtgtgccaccgcaccgtgtcgttccctctccttgcaacggcccacgaccagccgccatacgcagcatacatggacttccaccacggagacgccgacgacttcgccctcgagttcatccgcgagcaccttctcggcgtcgacggcgccaccgccacggccaccgagccggcggacctcgaggtcgtcgaaccggcggcggcgtacccgcctatgtcgtggcaagagcagcggcagcaggagcagcatggttgtcacgtagaactaacggacgagcacctggaatccgcacccgctgctgaggcagcggcggcgttccgaacggcgcccgcgcagccggcggccgaggtgatgatcaagttcggtggcgagccctccccggtgaggccgtcgtcgtcgctgaccatatccctgccaccgagctcgttcggcagctgggcgtccgcggcggcgccggccgcggccgccgtggaggacttccgcaagtaccgcggcgtgcgacagcggccgtgggggaagttcgcggcggagatccgcgacccgaagaggcgcgggtcgcgcgtgtggctgggcacgtacgacacccccgtggaggccgcgcgcgcgtacgaccgcgccgccttccgcatgcgcggtgccaaggccatcctcaacttccccaacgaggtcggcacccgcggcgccgaactgtgggctcctcccccgccgccacccgcgcactccgccgccgcctcgacgacgaacaagcggaagcggcagccgtcggaggaccccgacgacggcgtcgaggtgatcggagtggtaagcaaggccgtcaagaccgaggcgccgacgtccaactcgtcgtcactgtcgtcgtccctgacgtcgcgggacacgacgccggccacgtcgtcggcgggggcggagcacgccggcgcggccgccgagagttcgccggcgacgccgtcgagctggagctgggagcagtactgggaagcgctgctcggtggcctcccgccactgtcgcctctgtcgccgcacccggcgttggggttccctcagctcaccgttaactgagaaaattaaacaatgattagctgacgtgggcacagaaataatgcgtttttttcccgttgttaacgacgtcatgtgtacattggaactttttttgggagcttaacagaaggggcgtatagacaaacatcagaaagtggtagtcgtgtttacttttttttttctttcgagttgagaaccttgagatcaatcgatgcttgtaaagaataagcagagggtgctgtttggcatttgatatgacaatgtaaacaaatagtacaagttactttgtttactgag

SEQ ID NO: 5261 - DNA, 1312 bp, Oryza sativa
  Predicted polypeptide sequence is orthologous to G43, G46, G1419
cccatcttagctttctcctcgcagatgcaattgcgcgaacacctccaaactcccgagtcccctctcctctctcgtcttcctctccacgacgacctctccgcttcaattctgcgccgccgcctcagagcgccatggacttcagcggcgacatcgatgacctgatctccctccagctcctccacgatcagctgctcggggtcgaggccgacgcgtgcctcccggtggcagttcatcacgatggcgtcgccgcgttcgccgagcatcagcagggtttccatcccgcggcgttcttgccgcagcagccgatgacgatgacaccggctgggtacgtggacatggcgaatgatcagtatttgggtgcgcatgccgccgctggcgaggcggaggcggtctaccgggcggcggcggcggagccggtgatgatacggttcggcggcgaggtgtccccggtgtcggacccccggaggccgcccctgacgatctcgctgcctccgacgtcgcacgcgtgggcggcggcggaggcggtgcacccggccgctctgctgcaggcgcaggccgcggccgcggccgccgacccgaacgacttccggaagtaccgcggcgtgcggcagcggccgtggggcaagttcgcggcggagatccgcgaccccaagaagcggggctcgcgcgtgtggctcggcacgtacgacacggccatcgaggcggcgcgcgcgtacgaccgcgccgccttccgcatgcgcggcgccaaggccatcctcaacttccccaacgaggtcggctcccgcggcgccgacttcctggcaccgccgccgccgcccccgccgccgacgacgtcgacccacggcaaacggaagcggcacgagacggcggcggccgacccggacgtcgaggtgatcggagaatcatccaaatccgtcaagaccgagacgtacacatcgccggcgtcgtcgtcgctggcctcaacgacaacctcaacggtgacatcatcatccacgtcgccttccccctcgtcggaggcagctgcctgcggcggcggcggcggcagcgagctgttcgtcccaccgatgccgtcgagctggtcgtgggatcagttggaggggttcttcggcatcctctcgccgctctcgccgcacccgcaaatgggattcccggaggtcgccgtaaactaattaagcgcgctaatgatctctctaagcatgattaattaggcgcaataatcggcaattaattagtggcttctagttctcgacggccttcgctttggacacatctcaggagatttggcttggagcagtgtactataaaaaaaaaa

SEQ ID NO: 5262 - DNA, 1145 bp, Oryza sativa
  Predicted polypeptide sequence is orthologous to G43, G46, G1419
ctcgctcgcgcgccacactcctcgaaccaccaccaccaccaccacgtgttcgatcgcgtcctccaagccccagcacctacgcgtcgtcgcgccatggccggcttcggcttggaccagcacctcgacctcatccgcgcccacctcctcgaagacgcccaccaccacgtcctcgcgccatcgccgtcgccctcgccaccgggtactgggcgtgtcaggccggcgcccgtgtcgctgcccccgaggccgccgctcctgtgggcggcggcgtcggcggcgccgcggcagcaggaggagtgcttcgagctcggcggcggctacgcgggggagggggagggggaggaggaggacgacttccggcggtaccgcggggtgcggcagcggccgtggggcaagtacgcggcggagatccgggacccggcgaggaagggcgcgagggtgtggctcggcacctacgacaccgccgtcgaggccgcgcgcgcctacgaccgcgccgcgttccagctccgcgggtccaaggccatcctcaacttccccaacgaggtcgccgccgacgccgccgtcaagtgggcccctcccgtcgcccctatccccgccgccgccatgtccgccggaagaggcaagagggtgaggtcggaggagcagtactacttgagggaggtgaagaaggagaggctgatcatggcgccgccggagaactcctcctcgtcgtcgtcgtcggcggcggcggcagccggagacatctgggacgagctgaaggggatctgcagcctgccgccgctctcgccgctgtcgccgcacccgcacatggccttcccgcagctgttcgtaatcgatttggctttcggccaaatattgaattctttcgttctattgctgctcagaacacgtgattttgcttttgactatgctatttgatgattaaacagagaagaaatattcgtcttacaagatcatatcaccgaaaagactagctaggcgcatggagtagtactggaaacaagctctgctaaggccctctttgtttaggcttaagcttattggactagacttttaagccagctgtggttaatctaggcccattttggaaaaaaaaacattagctgtaatttttctcgaagttatatatttcttgcactaaaaaatta

SEQ ID NO: 5263 - DNA, 1511 bp, Oryza sativa
  Predicted polypeptide sequence is orthologous to G129, G136, G140, G146
aatcagattggaattggccacaaaagctactgctaactacattcacctcacatttcttcttcccctttccctcctcctcctcttcttcctcttcttctcccccacctctctctttaatacctctcctcctcctgttgctgcttctgcctctctcacatcttctttctttccttctctggatctcttccatcttcagaagagagagcactagttagcatacccatccatgatgaacatgatgaccgatctgagctgcgggccatcgtcgatgacggagctgaccgcggcagcggcgccggctgggtcaggatcgtcggcggcggtggcggcggggagcagcgagaagatggggagggggaagatcgagataaagcggatcgagaacacgacgaaccggcaggtgaccttctgcaagcgccgcaatggcctcctgaagaaggcgtacgagctgtccgtcctctgcgacgccgaggttgccctcatcgtcttctccagccgcggccgcctctacgagtacgccaacaacagtgtgaaatccaccgttgagaggtacaagaaggcaaacagtgacacctccaactctggcacagttgcagaagtcaatgcccagcactaccagcaggagtcctccaaactgcgccaacaaatcagtagcttacagaacgcaaacagtctaactcggcttgcctaaatatctctagtaggaccatagtgggggattctatcaacaccatgagcctcagggaccttaaacaggtagagaacaggctggagaaaggcatagctaagataagggctagaaagaatgagctgttatatgctgaagttgagtacatgcagaaaagggaagttgagctgcagaatgacaacatgtacctgaggagcaaggttgttgagaatgagaggggacagcagccactgaacatgatgggggcagcatcaacaagtgaatacgatcatatggttaataacccatatgattccaggaactttcttcaagtgaacatcatgcagcagcctcagcattacgcccatcagctgcagccaactacccttcaactcgggcagcagccggccttcaattagttttggtgtagacaccgtacgtacacacgtacgttagatgaaatctgaaggcgtcgatacccgcggctacgtaacagcgtgatcaacctgaagaaatcgatgcagtaattctatgtgttcgtcagatcatcataaccagtattgtcattaggcgttgtgaaaaaaaaatgtgtcagcatgcattgcaagctagcgtttgtggctgctcatcagctgcatgcgtaattgcgtacgtgcacaaattaaacagaccttgccaccattgtgccatattgtgtgtgttgtatgatatatatatatatatatatatatatatataaacagcacgtttgtgctctgattcgtgtaactgatcagcagatcaaactctaccactgccgatatatatgtgaggaccatggattgatgcattgtcgttgatcttc

SEQ ID NO: 5264 - DNA, 1407 bp, Oryza sativa
  Predicted polypeptide sequence is orthologous to G129, G136, G140, G146
gataatgtgcatcagccataactaccagcacacacaacgactacccttctttaaaaggaaacctcacagagcccaaggcttctccatgccgttgccctaagttgtcttctccaatctccactccccacccatcgatcaactcacagctcgatccagccccctccagatcttcagatcggtggatcgattgatcaacatggggagggggaagattgagataaagagaatcgagaacaagacgagccgtcaggtgaccttctgcaagcgcaggaatgggctgctgaagaaggcctacgagctcgccatactctgcgacgctgagatcgcactcatcgtcttctccagccgaggacgcctctatgagttctccaatgtaaacagcacaaggtcaacaatcgagaggtacaagaaagcctctgccagcacttcaggatccgctccagtgatagacgtcaattctcatcaatactttcagcaagaagcagcaaaaatgcgccaccagatacagaccttgcagaatgcaaacaggcacctcatcggtgagtccattggcaatatgaccgcaaaggagctcaagagccttgaaaatcggcttgaaaagggcatcagccgaattcgatcaaagaagcatgagctgctgttctcggagatcgaatacatgcagaaaagggaagcagatcttcagaacgagaacatgttcctgagagccaaggtggcagaggccgagcgagctgaacatgatgatcagcaggcggcggaggacgacgagatggcgccggcgccggcggtcggcggcgggtcatcgtcggggacagagctggaggcgctgccggcgacgttcgacacaagggaatactaccagccggcgccgccggtgagcatgctggccgccgcggcggcggcggcggcggcgcagtactcgtcggaccaccaccagactgctctccacctcggctacttcaaggtcgactccggcaaaggcggcctcctctagatcgatcgccatggatgcaaatattgcatgcattcgatcgaattatactgtattccgtaagagcgacgacgatgaagatgacaataattattgtggtattgtacgtatagtacgctggtagacctacgtatacgtatacgtatgtatgatgaagaataaggtggtgtttggttggaggggctaaagtggggctaaactttagttcctctcacaaaaatataagttcctattatagagacttatatttttgtgagagagactaaatttagtcctagttcccaaacacccctaatatacatttgtggtgtgcatgcatggtgtgtgggtactatatgatcagagtgtgctgcatatgcgtattccgtttgctagctctgacatgcatttgtctaaatatatatttttatttatgc

SEQ ID NO: 5265 - DNA, 1214 bp, Oryza sativa
  Predicted polypeptide sequence is orthologous to G129, G136, G140, G146
gagaaaacccaccaactggagctctcctttcctactccaagaaacgaagttgagagcaagaagacatggggaggggcaggattgagatcaagaggatcgagaacacgacaagccgccaggtgaccttctgcaagcgccgcaacggacttctcaagaaggcgtatgagctctccgtcctctgcgatgccgaggtggctctcatcgtcttctccagccgtggccgcctctacgagtactccaacaacaacaatgtgaaggctacaattgacaggtacaagaaggcgcatgcttgtggctcaacttctggtgcacctctcatagaggtcaatgctcagcaatactaccagcaggagtctgccaaactgcgccaccagattcagatgctgcaaaacaccaacaagcacctggttggcgataatgtgagcaacctgtcactgaaggagctgaagcaacttgaaagccgcctggagaaaggcatttcaaagatcagagccaggaagaatgaactgctggcttcagagatcaattacatggccaaaagggagattgagcttcagaacgacaacatggacctcagaaccaagattgctgaggaggagcagcagctgcagcaggtgacggtggcccggtcggccgccatggagctgcaggctgcggcggcggcgcagcagcagcagcagaatccgttcgcggtggcggcggcgcagctggacatgaagtgcttcttcccgttgaacctgttcgaggcggcggcgcaggtgcaggccgtggcggcgcagcgccagcagatcatccccaccgagctcaacctcggctaccaccaccaccttgccattcccggcgccgccgccgccgacgcgccgcctcctcacttctgaacctcatgaacttcattctgcaccggcctgctgccatggatatgatgatcagctcatcttctatatcttatgctgttatgcagacagacactactgatgtggctatatatatagtatttgtgtgctgctgcattttgttaatcccttataaattgctacttaattatctcatggagaattggagagaccaaatgggcagagctagctagttagctgtgcccaattaagaagctaaatctatcagaagtgtgtactgatgagtgatgagtatttttcttcatttgggatcaaattaaactaagtaaaacatatatatttgacttatgttttacgtgc

SEQ ID NO: 5266 - DNA, 1181 bp, Oryza sativa
  Predicted polypeptide sequence is orthologous to G129, G136, G140, G146
gactccatctcatctcatccttccccaaccattctcttctccttgaacacacccctctcttcctcattataatctcttctttgattagagaggaattagcaaacatgcacatatacaaagagcaggaggctgaaccatccactggcctgatgatgccagagccagcacctgttgcttcccccggctccggtggctcaggtggctcaggctcggtgggagctgagaagattgggagcaggggaaagattgagatcaagcgcatcgagaacacgacgaaccgtcaagtgaccttctgcaagcgccgcagcgggctactcaagaaggcgtatgagctctccgtgctctgcgatgccgaggtcgccctcgtcgtcttctccagccgtggccgcctctacgagtactccaacaacagcgtgaaggaaactattgagaggtacaagaaagccaacagtgacacctccaacgccagtacagttgcagagatcaatgcccagcactaccagcaggaagctgctaagctgaagcaacagatcaccaacctgcagaactccaacaggaccctagtaggtgataatatcaccaccatgaaccacagagaacttaagcagctggaaggcagactggacaaaggcctaggaaagattagagcacggaagaacgaattgctgtgtgctgaaattgagtatatgcagagaagggaaacggagctgcagaatgacaacatgtacttaaagagcaaagttgctgagagtgaaagaggactgcaaacagtgaacatgatgggttcagcatctacgagcgagtacgtgcaaaatatgatccattatgatccaagaaacttcctgcaattcaacatcatgcatcagcctcagtattatcctgaacaggaggaccgaaaggcctttatgtcagatgaaagataaatatggatccgtatcatgcaactatctcaatcatgcatgtgccttcttcaaggagactgatcagttagatattacactgtgtcagtagaacttttatgtgtgaactcttgtatgcatgaataattaactttatcccataattcaggcttggcactatcaaggtgatgtacctaagtattggttcaacctgtgaaattaaaatacttcatacccttcctatgtttatatatgaaatattggtgataatatcttgtgtat

SEQ ID NO: 5267 - DNA, 1373 bp, Oryza sativa
  Predicted polypeptide sequence is orthologous to G131, G135, G155
ctcgatcgatccatccatcgatcgatcggtcccccccaccgcgcgcgacgcattccgccgccgtctcgccgtgtccacgtgatgggggccggggctaggggataggcggatagccagcagccaccaccaccagtagttgccgtgtggggataggtgtggctatagggctagtggtcgtcgctgatagcgaggtgggtagggttaattttggttggaggtagagagagagagagagggagggagggaggaggaggaggaggaggaggaggaggaagaacaggaggaagatggggcggggcaaggtgcagctgaagcggatcgagaacaagatcaaccggcaggtgaccttctccaagcgcaggtcaaaactgctcaagaaggcgaatgagatctccgtgctctgcgacgccgaggtcgcgctcatcatcttctccaccaagggcaagctctacgagtacgccaccgactcatgtatggacaaaatccttgaacgttatgagcgctactcctatgcagaaaaggtccttatttcagctgaatctgacactcagggcaactggtgccacgaatataggaaactgaaggctaaggttgagacaatacagaaatgtcaaaagcacctcatgggagaggatcttgaatctttgaatctcaaagagctgcagcagctggagcagcagctggaaaattcgttgaaacatatcagatccagaaagagccaactaatgctcgagtccattaacgagcttcaacggaaggaaaagtcactgcaggaggagaataaggtcctacagaaagaactggtggagaagcagaaagtccagaagcaacaagtgcaatgggaccagacacaacctcaaacaagttcctcatcatcctccttcatgatgagggaagcccttccaacaactaatatcagtaactaccctgcagcagctggcgaaaggatagaggatgtagcagcagggcagccacagcatgaacgcattgggctgccaccatggatgctgagccacatcaacggctaaggaggcttcgagtccataccagtaatcacaagttgcaacctgacccggtccggtcgcctgctgctctggtttactactagtactattgtcatcttgcggttgcgagacgaggaaagcattttagccctaaattcagcattagtagcaagctgcaatgtgtatattttggcttcgtccagcaccgtcttcctcccaccagtaatttacccatgtaatatatgcgagcagcatgaacaaattttcccgtttccaaccatctccattggtgtcatgtgtgacttaaatagcgaaatttcagcattgtgcatagtgtgattactgtaagataaaaaaaaaaaaaaaaaa

SEQ ID NO: 5268 - DNA, 1347 bp, Oryza sativa
  Predicted polypeptide sequence is orthologous to G131, G135, G155
ctcctcctcctcttcttcttcttccactagctagttcgtcttcctccttcagctagcttgtagcagctaaggttaggtcggatcgagatcgggatcggccgccggcgagcggcgagcggcgaggatggggcgggggaaggtgcagctgaagcggatagagaactcgatgaaccggcaggtgacgttctccaagaggaggaatggattgctgaagaaggcgcacgagatctccgtcctctgcgacgccgaggtcgccgccatcgtcttctcccccaagggcaagctctacgagtacgccactgactccaggatggacaaaatccttgaacgttatgagcgctattcatatgctgaaaaggctcttatttcagctgaatctgagagtgagggaaattggtgccatgaatacaggaagcttaaggcaaagattgagaccatacaaaaatgtcacaaacacctcatgggagaggatctagaatccctgaatctcaaagaactccaacagctagagcagcagctggagagttcattgaagcacataagatcaagaaagagccaccttatgcttgagtccatttccgagctgcagaaaaaggagaggtcactgcaggaggagaacaaggctctgcagaaggaactggtggagaggcagaagaatgtgaggggccagcagcaagtagggcagtgggaccaaacccaggtccaggcccaggcccaagcccaaccccaagcccagacaagcttcttcttcttcttcatgctgagggatcagcaggcacttctttcaccacaaaatatctgctacccgccggtgatgatgggccagagaaatgatgcggcggcgcggcggcggtggcggcccaaggccaggtgcaacttccgcattggaggctttccgccatggatgctgagcaccttcaaggcttaagatgatcatcggcgtcgtcgtcgggccaacaagttgccgattgcaccgggaatcatgggagcaaccttgaatgaaatggaagcattgggattggaagcggataatatatatgaatctcctaaaaggaaatggactcaaaaaaaaaaacctagcgattaagctattcttatatatgcgtttgcctgctgctccctaccctacaggctacatatgatttgcaagaaattaattatgagcaaggatcaggatgtgtctttgtgtaatcatcagcacgtacctagtgcttcctactgatatatatgcatgcaattgtgtgcatataaatatatttgcatgccatgctcccgtgatggttaattaatttatgattgtgtttatacgctaattaactgcagatgcaaactaatcaatcgaattat

SEQ ID NO: 5269 - DNA, 998 bp, Oryza sativa
  Predicted polypeptide sequence is orthologous to G131, G135, G155
atggggagggggaaggtgcaggtgcggcggatcgagaacgaggtgagccggcaggtgaccttctccaagcggcggccggggctgctcaagaaggcccacgagatcgccgtcctctgcgacgtcgacgtcgccgccatcgtcttctccgccaagggcaatctcttccactacgcctcctcccacaccactatggagcgaatccttgagaagtatgacagacacgagttattatctgaaggaaataatgtgattgaagagttccctgagctggagggaagcatgagatatgaccacatcaagctgaggggcaagattgaagctctaaaaaagagccaaaggaatcttatggggcaggaacttgactcgctgacactgcaagatatccagcagcttgaggaccagatagacacttctctgaataacataagatcaagaaaggaaaagttgctgatggagaaaaacactattctggagaagaaaattactgaactggagacactgcatacaagcatcagggcgtcacccactgaagctgctgctcctcctgcctgcaatattgctgatgcatttgttcccaacctcaacatctgctgcggcgattccggcgagccggaaaccgtgacggcgccacttggctggaccagcagcaacaatggcttgccatggtggatgctccagtcatcatcgaacggcaagagctagaagatgttcagatgaaatggtccctgcagccattgcatggttgctgaataatgtcgtcccagatggttaggcaagcaacctacctagaactttcagttagtgagcggtagtagtatctcccccttcttaatccctactatactccgtagattaattctaagcatccttttgtttccattatctacgctgctggtttgatgaaattcctgtgttgtattcagctgcattgggatcattgctcagcctttggtcatgtctctcactggaatcaatgtgtcatgtctgtcttgcaatca

SEQ ID NO: 5270 - DNA, 2563 bp, Oryza sativa
  Predicted polypeptide sequence is orthologous to G131, G135, G155
gactgacacccgtccccaaaagcaaagaggcctctctctctctctctcgccgatccctctcctcctcctcttcttcttcttccactagctagttcgtcttcctccttcagctagcttgtagcagctaaggttaggtcggatcgagatcgggatcggccgccggcgagcggcgagcggcgaggatggggcgggggaaggtgcagctgaagcggatagagaacaagatcaacaggcaggtgacgttctccaagaggaggaatggattgctgaagaaggcgcacgagatctccgtcctctgcgacgccgaggtcgccgccatcgtcttctcccccaagggcaagctctacgagtacgccactgactccaggatggacaaaatccttgaacgttatgagcgctattcatatgctgaaaaggctcttatttcagctgaatccgagagtgaggtaaaacacagtaggttgtatgatatataacttttacatgaagggaatattattgttccttttctattgcattagcatttcaatcatatcatttccttgtggccttttaaatcacatgttaacaaagcagtttttctgaattctatcgttctacttgccaaaactagatgttggtaaccttctgttttatactttttaacttcaaacctcgtgtcttttgcactctggcatatttcttaaaatttctacttattgggatatcatgcaggagagtcctcattcccttcatttaatcccctcaaattttatttattatggtcatacaattaatgggccacatgcatggaagtcgatcgccagcttgcgatcagcatcctatcattaatgttatgatctatactaattcttctgtaaataaattaaaattgcactagtttttaactaaatgctactattctatttttttatccatactccgtttgagtggtttcttttgtgtttcatgaagccatataatatgcttaagaaaacatagaaacatgcacaatacaataatagcgctggtaggatccggttggagaccaaatgtttcgatattctaagtgcatatttatatatactaagtaaaactgtaatcataaacatgcatatggactgtgatcgatgaaatgtttcttcattttttttttcaagataactcttccccagttgacaacatgcactgcatccagaagtactcatggtatttgttttcagtactgtttgatgagtaaaactttggtaagtgttaaaaaatgatgataagtgcaaatatttgttcctttaccacttccaccttcttggagtaaagaaaaaaatgtgtgtggtttggcaaagttgttgcatatatcacggcattagtgtgcggataatgcgaataaatgcatcaataagcactaggagtaagttaattagttctctaccttaattgaaaagttcatgtacatttaaaaaaattaaacatgcctctttttatcatttgttgaatttctacatttatcaagacagcaaaggagttctcatctactaataaattaatttaaggagctataactcccttaattttatcaaatattcacatacacggttgcatttgaggattttctatatactccactaaatgaggatgcatttaggttctttataatattttatttccatcgtttcatcatctgtttatgtttacagtaatttagtaatagttctctaattttgacagtaatggttggctcacagaaaacatcaaccaaccatatatattggtttatactgacaaagagtttttttttgtacagggaaattggtgccatgaatacaggaaacttaaggcaaagattgagaccatacaaaaatgtcacaaacacctcatgggagaggatctagaatccctgaatctcaaagaactccaacagctagagcagcagctggagagttcattgaagcacataatatcaagaaagagccaccttatgcttgagtccatttccgagctgcagaaaaaggagaggtcactgcaggaggagaacaaggctctgcagaaggaactggtggagaggcagaagaatgtgaggggccagcagcaagtagggcagtgggaccaaacccaggtccaggcccaggcccaagcccaaccccaagcccagacaagctcctcctcctcctccatgctgagggatcagcaggcacttcttccaccacaaaatatctgctacccgccggtgatgatgggcgagagaaatgatgcggcggcggcggcggcggtggcggcgcagggccaggtgcaactccgcatcggaggtcttccgccatggatgctgagccacctcaatgcttaagatgatcatcgtcgtcgtcgtcggccaaacagctgccgtatgcaccgtgaatcatgggagcaaccttgaatgaattgaagtcattggtatcgatcctagcgatgatatatatgattctcctaaaatgaaatttatctcaaaaaaacaaacctagcgattaagctattcttatatatgtgtttgcctgctgccccctaccctacaggctacatatgatttgcaagaaattaattatgagcaagg

SEQ ID NO: 5271 - DNA, 1088 bp, Oryza sativa
  Predicted polypeptide sequence is orthologous to G131, G135, G155
ctccccccatttccatcttccccgagctctccaccctccacccgccaccgccaccgccgccttcgccgccgccgccgccgccgacgacgatggggagagggccggtgcagctgcggcggatcgagaacaagataaacaggcaggtgaccttctccaagcggaggaacgggctgctgaagaaggcgcacgagatctccgtgctctgtgacgccgacgtcgcgctcatcgtcttctccaccaagggcaagctctacgagttctccagccactccagtatggaagggatccttgaacgctaccagcgttactcgtttgatgaaagagccgtactggagccaaatactgaggaccaggaaaactggggtgatgaatatggaattttgaagtccaaactggatgcacttcagaagagccaaaggcaactcttaggtgaacaattggacacactaacaataaaagaactccagcaattggaacatcaactggaatattctctgaagcatataagatcaaaaaagaatcagcttctgtttgaatcaattcctgagcttcagaagaaggaaaagtcacttaaaaaccagaataatgttctgcaaaagctcatggagacagaaaaggagaaaaacaatgctataataaacactaaccgggaggagcaaaatggagcaacaccaagcacatcatcaccaacaccagtgacggctccagatcccatcccgacaacaaataacagtcaaagccaaccaagaggatcaggggagtcagaagctcaaccgtctccggcacaagcaggcaacagcaagcttccgccatggatgctccggacaagtcacacatgaaggcatctgttgatctcaaacgtcactccactcaatggccaacatcaacatgtttcttccaactaaggcagccactgttgtgcaatccatcttccagcgatattgatatatcggcattcggcatagccaatatatattaatgtaatgtatcttgtcaaagcttcatagggttaatgacgccttgagcttctctgttctatatctgtcttgtaacgatctttgcatatctgctgcatttttttttctctc

SEQ ID NO: 5272 - DNA, 1784 bp, Oryza sativa
  Predicted polypeptide sequence is orthologous to G131, G135, G155
gctcgtcgtctcccccactcgatcgatccatccatcgatcgatcggtcccccccatcgcgcgtgacgcattccgccgccgtctcgccgtgtccacgtgatgggggccggggctaggggataggcggatagccagcagccaccaccaccagtagttgccgtgtggggataggtgtggctatagggctagtggtcgtcgctgatagcgaggtgggtagggttaattttggttggaggtagagagagagagagagggagggagggaggaggaggaggaggaggaggaggaggaagaacaggaggaagatggggcggggcaaggtgcagctgaagcggatcgagaacaagatcaaccggcaggtgaccttctccaagcgcaggtcggggctgctcaagaaggcgaatgagatctccgtgctctgcgacgccgaggtcgcgctcatcatcttctccaccaagggcaagctctacgagtacgccaccgactcatgtatggacaaaatccttgaacgttatgagcgctactcctatgcagaaaaggtccttatttcagctgaatctgacactcaggtaaaaataaagagctctaattctgttgtttctcatatctcaatatcttgtttattttttgaacttttcactacacctgtttcggttgactcattcaagacgggtacatccaacattttagctctcctcaagttggataaatcaattaggcatcattttttatggcaattttccattgttatgtagatcaacttttaataaatattgctttacatctctttgaacagtaatctcttacttcaatgtatttatcaaatatgtagatttattctaaattagattatatccattttttattacatagcgtcctgaccttttggcatcccagcccaattgaacctatttgctgtctgaaatcttgaaaactcaaactgaactgttctttatattggtgcaattaattaggctctctctctcaggtcagatcattaaaaattgtggtattgttacatttcataagtgaaattttgttcacaaattagatcaaatttatcttccatgtttgtttacacgtatacagctttgccagttccctcttattcaaacattttttacactatgattcaatataccttttgtggattttactggaacaaaatcatagttattgcctaatgaaaaactataaaaaaaaattttggatgcatgactacatcaacactcattatggaattttgtgtgccagagaatatcacaaaacatatttttcatcaaataaaacaaaataaacattttccagaacttttggcgtggctcatcagaagtttggaaccttaaataatccttgttttcatttagctgggacttactatagtcaattatgctattaaaaagatccattcgtctatttgttacgaataatctttactctttagttggggttgatggactaatggtgtactccaaaatcagaagttcttttatggctagatacatgtagaccggatttgaaaactttcaagtttagatttgacaaaaactttcaactcgcgattgaaaattttcaagtccacatttgaaaactttcaagtttagatttgaaaactttcgacccagatttgaaaactttcaactcgagatttgaaaactttcaagcctagatttaaaaactttcaagttcagattgaaaaactttcaagttaagatttgaaaattttcagctcaaatatttttgaaaacacgtatcctaacaattaaaaaaatcagaaaaaacacg

SEQ ID NO: 5273 - DNA, 980 bp, Oryza sativa
  Predicted polypeptide sequence is orthologous to G131, G135, G155
ggtacaggtcggaattccgggtcgaccacgcgtcgaaatctctcccatacatacactacagcggcgaacctttccttattctcgcaacgcctcggtaacgggcagcgcctgctccgcgccgcggttgcgagttcgggaaggcggccggagtcgcggggaggagagggaggattcgatcggccagaatggggagggggcgcagcgagataaagaggatagagaaccccacgcagcggcagtccaccttctacaagcgcagggacggcctgttcaagaaggccagggagctcgccgtcctctgcgacgccgacctcctcctcctcctcttctccgcctccggcaagctctaccacttcctctcccccaccgtcccctccgtgagggagtttgtcgagaggtacgaggccaccacgcacaccaaggtttgggcagatatcaggcaggagaggcgcgccgagctggagaaggtgggcagcatgtgcgacctcctggagaaacagctgaggttcatgacggtggacgacggcgaggagtacacggtgccgtcgctggaggcgctggagcacaatctggagggcgccatgcgcaatgtgcgctccgagaaggaccgcaagatcggaggcgagatctggtacctccagaacattatcagggggcgaaagaggagcggtacggctgtgggaaagatggtcatgacagatctgaaggatgtggatgggatcacgtcataggaagggttggacttactggttgtctagacgaatcgttctatgttaatggtaccgtgatggtctaacctggattgcggtaaagaaaagacgtgataatatagggtagcgttataatatgatgggtagaaagctatggactttacacataaaaacgtctattgtgtgtatgtgaagtatgataagaattgatataattagagtgtatatatcacgaaaatgttgtgttctatatgtataatttttttatag

SEQ ID NO: 5274 - DNA, 1063 bp, Oryza sativa
  misc_feature (617)..(617): n is a, c, g, or t
  misc_feature (804)..(804): n is a, c, g, or t
  misc_feature (814)..(814): n is a, c, g, or t
  misc_feature (847)..(848): n is a, c, g, or t
  misc_feature (850)..(851): n is a, c, g, or t
  Predicted polypeptide sequence is orthologous to G131, G155
gcccacgcgtccgggccgacttctctctctctctccatttctctcgatttctccacttctctctctctctctccctttctctcggtgtgcagcggcggcctggcagggagagaggggagcgtgcggcggcccagcggcggcggcgccctcccctccaccagatctaacaggagcgggaggagaggcgcggtcatggcgaacggtctggaggtgcaacgccggtgaccacaagccgactagggctccaagtttggacaacccgagctcggggggctgtggatctagctgtcccgagtttgggtactccagatccagtggcctccggcgccaacagcgccagatccaggctcatggtgagtggatggcgtctcctctctcctccaatcggctgtgtgcgctgccgtccgccgtcaaggcctatcggctgtacggcgagcatgtgcttctcctcatcctgtgcagtcaccacctaccggctacatgagctagacatctttggagctgcttctccagttgctgcagctctttgagattcagagattcaagatcctctcccatgagatggctgcaggaattaccgacaatcacttttgctgcaagatcctcttctccataangtaataggggtccatagactatggagtggtgacttgagataatgatgatcggtttctaaggcagcctgtgtcttgggttatttatccgactgggagtgggcgggctgttctttggaaccaaggccttggagggcgcctcaatggaggctgcaaacggctcagggagagctggatcggtgagggaacnatccgcgacntccatctgctttgtgccgcccggtcgtgcgggnntnngaacagaacagaaaaaaaaacacgcaaacacgaagaacacaacgaaacagaaaaacacgacaaaagcacggaaaatcaaataaaaagatacacaaacaaaacaaacacaaagacaagaacaagagaaaataaacacacaaaagaaagaaacacaataataatagcaacacaagacaaaatcaaaataagaaaactaaaaacaaaacgaatag

SEQ ID NO: 5275 - DNA, 1210 bp, Oryza sativa
  Predicted polypeptide sequence is orthologous to G133
ggagttgggaatccgttgctgtcgtacgtctcgtctatggcgtgctgtatgtcctctccttctttcttcctttccaaataagcactcctcttcttcctcctcctcctcctccgcctcctcttctcattcccaactcatcgatccatcagtagctagctagctagctagctagctgcattgtccggcgagagagatagctgctgcagggggcggccatggggaggggcaagatcgagatcaagcggatcgagaacgcgaccaacaggcaggtgacctactcgaagcgccgcacggggatcatgaagaaggccagggagctcaccgtactctgcgacgcccaggtcgccatcatcatgttctcctccaccggcaagtaccacgagttctgcagcccttccaccgacatcaaggggatctttgaccgctaccagcaagccatcggcaccagcctttggatcgagcagtatgagaatatgcagcgcacgctgagccatctcaaggacatcaaccgcaacctgcgcaccgagatcaggcaaaggatgggagaagatctggacgggctggagttcgacgagctgcgcggtcttgagcaaaatgtcgatgccgccctcaaggaggttcgccacaggaagtatcatgtgatcaccacacagactgaaacctacaagaaaaaggtgaagcactcctacgaggcgtacgagactctgcagcaggagctggggttgcgcgaggagccggcgttcgggttcgtggacaacaccggcggcgggtgggacggcggcgccggcgccggcgcggcggcggacatgttcgccttccgcgtggtgcccagccagcccaacctgcacggcatggcctacggcggcaaccacgacctgcgcctcggttgatatatcatcgccgccgccgccgccgccgccggcggcctgctcgtcgccggccggccggccgccggacaccgtatcatcgctcgatctagataacaagccgacgaataaattgcagtgctcgtgttacttacctgcatgcgcatgcattattatcgatcaacgcaagaacttcatttcatttaccaaaccacttgatgtgtgctatgatccagcggttaaaccgtgtgttgtctcttgacattttgtaccagttactgatgatgttgtattatgtatgcgtggtgtgcaactgtgcttggataatttcacacttatttgtc

SEQ ID NO: 5276 - DNA, 1027 bp, Oryza sativa
  Predicted polypeptide sequence is orthologous to G134
gaccctcttgtttcttcgagagcgaggtgaagatttgtttcttggtttgtgttcttggagtggaggaggaggaggagttggatatggggcgcggcaagatcgagatcaagaggatcgagaactcgacgaaccggcaggtgacgttctcgaagcgccgcgccgggatactcaagaaggcccgcgagatcggcgtgctctgcgacgccgaggtcggcgtcgtcatcttctccagcgccggcaagctctccgactactgcacgcccaagaccacgtccgtgtttcccccgctgtcaaggatcttggagaagtaccagaccaactccgggaagatactctgggatgagaagcacaagagcctcagcgcagagatcgatcgtgtcaagaaggagaacgacaacatgcagatcgagctcaggcatatgaaaggggaggatctgaactccctgcagcccaaggagctgatcgcgatcgaggaggcgctcaacaacggccaggccaatctgcgggacaagatgatggaccactggaggatgcataaaaggaatgagaagatgctggaggacgagcacaagatgttggcttttagggtgcaccagcaggaggtcgagctgagcggcggcataagggagctggagctcggctaccaccacgacgacagggacttcgcggcctcgatgccgttcaccttcagggtgcagcccagccaccccaacctccagcaggagaagtaggctgctgagcactgccaatttggctgaacctcctgcttgctagctttgcatttcctcatgcgctgctagatgtatctgtggtttctctcatgcctgtctgaatgaactcacactgatgagagggtgtcagttgttttgtgctcctcccagcattagcactcagaattcagaaatgactcaatgtcagttgcttttgtgcttctcccagcattagcactcagaattcagaaatgactcaatgtcagttgcttttgtgcttctccctgcttgtttaattagccactgttcttgtttcc

SEQ ID NO: 5277 - DNA, 1098 bp, Oryza sativa
  Predicted polypeptide sequence is orthologous to G134
cctcgaaagcctcctcatcaccattcctcttcctcccatggcgaactcctttactcctcctccacccccaccgcctcgcccatccacaccgacgccaaggcagcgcttgttcttgttgttgttgttgttgttggcttcgctttgctgctaagctagctggaggaaggaggaggaggaggaggaggcgggatgatggggcgcgggaagatcgagatcaagaggatcgagaactccaccaaccgccaggtgaccttctccaagcgcaggagcgggatcctcaagaaggcccgcgagatcagcgtcctgtgcgacgccgaggtcggcgtcgtcatcttctccagcgccggcaagctctacgactactgctcccccaagacctcgctatcaagaatcttggagaagtaccagaccaattccggaaagatactgtgggatgagaagcacaagagccttagcgcggagattgatcgaatcaagaaagagaacgataatatgcagattgagctcaggcacttgaaaggtgaagatctaaactctctgcagcccaaagagctcatcatgattgaggaggcacttgacaatgggatagtgaacgtgaatgataaactgatggaccactgggaaaggcacgtgagaactgataagatgctggaagacgagaacaagctgctggcttttaaactgcaccagcaagatatagcgctgagcgggagcatgagggatcttgagcttgggtaccatccagacagggactttgcggcccagatgccgatcaccttccgcgtgcagcccagccaccccaacctgcaggagaacaattaagctgctaggttgccccgccacttcgatcagttatctcatccactgatccaccactggattgaatgtcctagtgcattgtcaactgtatccctgttttcatgtctgtttcgatgaactattgagcatgtcatatgtgagttgctttgtgtgccaatatatagtctgtctctagtacaagctctgtgcttgccattctgcctcgctgtagatagcaccagcaatggagctagctcagatatcagtaacttcgtgcaagctgcaaggtaaaaaaaaaaa

SEQ ID NO: 5278 - DNA, 715 bp, Oryza sativa
  misc_feature (715)..(715): n is a, c, g, or t
  Predicted polypeptide sequence is orthologous to G135, G155
tttttttttttttttttttgacatgaccaaatggctgatcaatgatcccaatgcagctgaatacaacacaggaaattcatcaaaactagcagcataggaaatgcttgcaatctacttagggattaagaagggggagatactaccacggtactaccactgtactactgctcactaactgaaagttctagctaggttgcttgcctagccatctgggacgacattattcagcaaccatatgcaatggctgcagggaccatttcatctgaacatcttctagctctagaagtttgatgatgactggagcatccaccatggcaagccattgttgctgctggtccagccaagtggcgccgtcacggtttccggctcgccggaatcgccgcaactgcggttttagttgatggccagatgttgaggttgggaacaaatgcatcagcagtattgcaggcaggaggagcagcagcttcagtgggtgacgccctgatgcttgtatgcagtgtctccagttcagtaattttcttctccagaatagtgtttttctccatcagcaacttttccttctgtcggagctcgccgatcgacttgagcaagagattggtctttcttgatcttatgttattcagaagaagtgtctatctggtcctcaagctgctggatatcttgcagtgtcagtgagtcaagttcctgccccccccttgtctcgtcctctggctcn

SEQ ID NO: 5279 - DNA, 1284 bp, Oryza sativa
  Predicted polypeptide sequence is orthologous to G137, G145
gaattaagccacagcttgagcagatcagctgcaggccggccggtgtgcgtgtgtgacagtaggagagagagctagcgagagagagcaaggaatcggaattgatttcatgcactgatcgatccatccatcatgcagatgctgcatggatgagaagagctagcagctaagctttgctgaagaaaattcttcagaggtttgtgttgatttgctggtctgctagagatcgatctagagagagagagaggaagggaagactgaagagagatctcgagcgggagatcgagatggggcgaggcaaggtggtgcttcagcggatcgagaacaagatcagccggcaggtgacgttcgccaagcggcggaacggcctgctcaagaaggcctacgagctctccatcctctgcgacgccgaggtcgccctcgtcctcttctcccacgccggccgcctctaccagttctcctcctcatccaacatgcttaagacgcttgagagataccagaggtacatttatgcttcgcaagatgctgccgcaccaactagcgatgagatgcagaacaactatcaggaataggtgaacttgaaggcacatgttgagattctgcaacaatcacaaaggaaccttctaggtgaggatttagctccactggctacaaatgaacttgagcagcttgagagtcaagtagtcagaaccttgaagcaaatcagatcaagaaagactcaggtactacttgatgaactctgcgacctaaagagaaaggaacaaatgctacaagatgcaaacagggtcctgaaaaggaagcttgacgagatcgacgtagaggcagctcccccacagcctccatggaacggaaactgcagcaatggccatggcggcggcggcggcgtgttttccagtgagcctccccaaccagagcacttcttccaggccctcgggcttcatgccgtggacgtgaaccagccgccggcgccgccaccgggcggttatcctcctgagtggatggcctagctagctagctagctaccgtttcagcttcagttaatcagggtcaagtatcagctgagtttggccatatgtatggattctatatgttgcttcagaagttcctctctccttcctcttcaatttgttgctaattaagtgcttgccaaacttttctcagtgtaatgtactactactatgtatagttttgtcttgtatgaacagtttgtgagtactgtcactgcgagtaaggtgcgtgatatggtaccgtgaaaacaaaagcgggacaaccatcctttttgcgttt

SEQ ID NO: 5280 - DNA, 1203 bp, Oryza sativa
  Predicted polypeptide sequence is orthologous to G137, G145
gagctttcccctctctttcgcttcgcgagattggttgattcatctcgcgattgatcgagctcgagcggcggtgaggtgaggtggaggaggaggaggaggaggagatcgggatggggagagggagggtggagctgaagaggatcgagaacaagatcaacaggcaggtgacgttcgcgaagcggaggaatgggctgctcaagaaggcgtacgagctctccgtgctctgcgacgccgaggtcgccctcatcatcttctccaaccgcggcaagctctacgagttctgcagcggccaaagcatgaccagaactttggaaagataccaaaaattcagttatggtgggccagatactgcaatacagaacaaggaaaatgagttagtgcaaagcagccgcaatgagtacctcaaactgaaggcacgggtggaaaatttacagaggacccaaaggaatcttcttggtgaagatcttgggacacttggcataaaagagctagagcagcttgagaaacaacttgattcatccttgaggcacattagatccacaaggacacagcatatgcttgatcagctcactgatctccagaggagggaacaaatgttgtgtgaagcaaataagtgcctcagaagaaaactggaggagagcaaccagttgcatggacaagtgtgggagcacggcgccaccctactcggctacgagcggcagtcgcctcatgccgtccagcaggtgccaccgcacggtggcaacggattcttccattccctggaagctgccgccgagcccaccttgcagatcgggtttactccagagcagatgaacaactcatgcgtgactgccttcatgccgacatggctaccctgaactcctgaagggccgatgcgacaaccaataaaaacggatgtgacgacacagatcaagtcgcaccattagattgatcttctcctacaagagtgagactagtaattccgtgtttgtgtgctagcgtgttgaaacttttctgatgtgatgcacgcacttttaattattattaagcgttcaaggactagtatgtggtataaaaggccgtacgtgacagcctatggttatatgctgcacaaaaactacgtatggtacagtgcagtgcctgtacatttcataatttgcggtaaagtttattgactatatatccagtgtgtcaaatataataaaatgtcgaggtttaattacc

SEQ ID NO: 5281 - DNA, 1188 bp, Oryza sativa
  Predicted polypeptide sequence is orthologous to G137, G145
gaggtagccaaaccacaccaccataaagctagcttgcaaaggggatagagtagtagagagagagagagaggagaggaggaggaagaagatggggagggggaaggtggagctgaagcggatcgagaacaagatcagccggcaggtgacgttcgccaagcgcaggaacggcctgctcaagaaggcctacgagctctccctcctctgcgacgccgaggtcgccctcatcatcttctccggccgcggccgcctcttcgagttctccagctcatcatgcatgtacaaaaccttggagaggtaccgcagctgcaactacaactcacaggatgcagcagctccagaaaacgaaattaattaccaagaatacctgaagctgaaaacaagagttgaatttcttcaaaccacacagagaaatattcttggtgaggatttgggcccactaagcatgaaggagctggagcagcttgagaaccagatagaagtatccctcaaacaagtcaggtcaagaaagaaccaagcactgcttgatcagctgtttgatctgaagagcaaggagcaacagctgcaagatctcaacaaagacttgaggaaaaagttacaggaaaccagtgcagagaatgtgctccatatgtcctggcaagatggtggtgggcacagcggttctagcactgttcttgctgatcagcctcatcaccatcagggtcttctccaccctcacccagatcagggtgaccattccctgcagattgggtatcatcaccctcatgctcaccatcaccaggcctacatggaccatctgagcaatgaagcagcagacatggttgctcatcaccccaatgaacacatcccatccggctggatatgatgtgtgtgttcagttcaggcttcaggcttcagagaagccaatgcaaacagtgtcctgtaatccagtaattacagggcatatgtaatgtaatgtaatgtaatccctgatctatattttgctaagtacgtgcgtgctctcttacgaccttctcccccgaacagttaatcaggggaataataatttcgtttgatgcacgtactgtatgtctgtatctgtcactgtatcgtaggaccgtccatgtataacaatttccgttttggatgtggtaacaagttaattggcacttaaatttatatttgtgatgatctgggagagtacctaatctc

SEQ ID NO: 5282 - DNA, 1265 bp, Oryza sativa
  Predicted polypeptide sequence is orthologous to G137, G145
caatccaacaaatctacataggaattactctttcggactcaaactcctcaattttttcccacttaaaaatccttcgccctaattaaagttcacccgttacaaatggagagcgatcgagctctcaactagcctaattcaagaggtgatgaagaaaaatggcagagaaaaagaagaagaagaagaagaagaagccgcaatcactcctagtccttacaagctggagatcgatcgggatggggaggggtcgggtggagctgaagaggatcgagaacaagatcaaccggcaggtgacgttcgccaagcgcaggaatggcctgctcaagaaggcgtacgagctctccgtcctctgcgacgccgaggtcgccctcatcatcttctccaaccgcggcaagctctacgagttctgcagcacccagagcatgactaaaacgcttgagaagtatcagaaatgcagttacgcaggacccgaaacagctgtccaaaatagagaaagtgagcaattgaaagctagccgcaatgaatacctcaaactgaaggcaagggttgaaaatttacaacggactcaaaggcaatactacaaatctaaacataggctgtgtttagttcggtccaaagtttggaatttggttaaaattagagacgatgtgactgaaaagttgtgtatgtatgaaagaaatttgctgggtgaagatcttgattcattaggcataaaagagctcgagagcctagagaagcagcttgattcatccctgaagcacgtcagaactacaaggacaaaacatctggttgaccaactgacggagcttcagagaaaggaacaaatggtttctgaagcaaatagatgccttaggagaaaactggaggaaagcaaccatgttcgcgggcagcaagtgtgggagcagggctgcaacttaattggctatgaacgtcagcctgaagtgcagcagcctcttcacggcggcaatgggttcttccatccacttgatgctgctggtgaacccacccttcagattgggtaccctgcagagcatcatgaggcgatgaacagtgcgtgcatgaacacctacatgcccccatggctaccatgatgatgacggggacaatgaattacgaaataacaaggatatgtggcatatatgtggtgccgcatacatgcatgtatcatggctagctacttaattggagtgatggatttgaactagtttcgtatgtagcctgtttgtgtgtaacttgtgtgagatactaccttaaaaacaaaaaaaaaa

SEQ ID NO: 5283 - DNA, 1094 bp, Oryza sativa
  misc_feature (992)..(992): n is a, c, g, or t
  Predicted polypeptide sequence is orthologous to G137, G145
ctgcaagggagagggagagagagggaagcttgcaggctgcagctaactagctaggcggggagagagaggagatagatcaagaagagattttgagaccgagagagagctagagagagatcgatggggcgagggaaagtagagctgaagcggatcgagaacaagataagccggcaggtgacgttcgcgaagaggaggaacgggctgctgaagaaggcgtacgagctgtccgtgctctgcgacgccgaggtcgccctcatcatcttctccacccgcggccgcctcttcgagttctccacctcctccggtatgtacaagacactggagcgataccgcagttgcaactacaaccttaactcatgtgaagcatctgctgcactggaaactgaactaagcaattaccaagagtacttaaagttaaagacaagagttgagttcctacaaacaactcagagaaatcttcttggcgaggacttggttccacttagcttgaaggagctcgagcaacttgagaaccagatcgagatatccctcatgaatatcaggtcatcaaagaatcaacagttgcttgatcaagtatttgagctcaaacgtaaggaacaacaacttcaagatgctaataaagacttaaaaaggaagatacaagaaactagtggagaaaatatgcttcatatatcttgccaagatgtagggcccagtggccatggttagtaaggttaccaaggagttttccatcatgcatttgggaccttcccgggatatgggtatcagcttaatggttacctcaccatgatgatggctttccctatggacatcccagggggagcgggcgacgaagcccctactgcggtacctaggtgggggcaatcgggtggaacgccgacgacagagaacgtgaagaggccaacacctgtcggccagtcaattggcccaaacaaaacaaaggggcaacacacgagaaatagaaagctagacatcccgaccgcgccctcgcnacaacatacacaagaaacaccacgaagaaacagaacacacaacaaaaagcaaaaacaacacgaagagacacacaacacagcacgaaaataccaaacgaaacc

SEQ ID NO: 5284 - DNA, 690 bp, Oryza sativa
  misc_feature (28)..(28): n is a, c, g, or t
  misc_feature (77)..(77): n is a, c, g, or t
  Predicted polypeptide sequence is orthologous to G142, G148
aagaaaggccttacgagctgcccgtttnttctgcgacgccgaggtcgcgctcatcatcttctccagccgcggcaagntctacgagttcggcagcgccgggtataattaatacagacacaacaacacacacaaccaacaaaccagcatcaatttgaacctgcagatctgctgttttctctgatcaattgcttctttttttttgttcttttttgtttcttttatctgctgcaacggcgtcctgctcctctggggtttctcgttttctttttcatttatttttagcaggtgccaagtagccgagctactatacttacctggccatgttaattattttattccgtctgtctgtgtgtgtctgtgcatactactatagggacatggcgcggtgttcttataaaccgggaggccggatccctaactagcatgggaggatatcttttcagcggatctatacaaaccctactcctgctgacctctttcttccagtttctccgggtcttccttggattattattgcccatcttccgggttgtgcgtgtgtcagagacagctcgaacgataaatttctcaaaaccagtactagagagggtgtgttgtgtgtgagaactgagtggagagttagcatgaaggctgcaaactagaaaggaaggtatgttctttcctttttgatccaaaaaaaaaaaaaaaaaa

SEQ ID NO: 5285 - DNA, 566 bp, Oryza sativa
  Predicted polypeptide sequence is orthologous to G142
gagttcgtaaatttttattagagttatttacatagttaataatatcaatcaaaaaaagcaattttaatttttttggtggaatttttaaaagttttttaaaattaaaaaaagcacttttagttttttttggtgggtttttagggtattttaaaattaaaaaggcaattttacaaaagagattatactataaaaatttacaaaagaaaaaatgacaagagagatttgaaaattcttggctgctgttcttcaatccattttgatggtcatatggggttgttgggagggagttgttgctgagaagatggtggaaggtctaccggggtttattccaagatatatatattggatccggcctaaatccaaaaatggattagttttaagaccaacttgccttggatgttgtctgttttgaggcagcatggagttgttggggcatagggaggatcactgggttgttcgtgcaggatggagttgcattatggatcatggaccaccgttgttgttgtagttgccaccagccatctttgaatcccaaccagaagaagaagagaagaccaaatcctttc

SEQ ID NO: 5286 - DNA, 1134 bp, Oryza sativa
  Predicted polypeptide sequence is orthologous to G142, G148
gatattctcgtcatcattggaggctttagcaagcaagaagagaggcagtggtggtggtggtggaggaggagctagctagcctgtgcttgctgatcggtgctgagctgaggaatcgttcgatcgatcgggcgagatggggaggggaagagttgagctgaagcgcatcgagaacaagatcaacaggcaggtcaccttctccaagcgccgcaacggcctcctcaagaaggcctacgagctgtccgttctctgcgacgccgaggtcgcgctcatcatcttctccagccgcggcaagctctacgagttcggcagcgccggcataacaaagactttagaaaggtaccaacattgttgctacaatgctcaagattccaacaatgcactttctgaaacccagagttggtaccatgaaatgtcaaagttgaaagcaaaatttgaagctttgcagcgcactcaaaggcacttgcttggggaggatcttggaccactcagcgtcaaagaattgcagcagctggagaaacagcttgaatgtgcactatcacaggcgagacagagaaagacgcaactgatgatggaacaagtggaggaacttcgcagaaaggagcgtcagctgggtgaaattaataggcaactcaagcacaagctcgaggttgaaggttccaccagcaactacagagccatgcagcaagcctcctgggctcagggcgccgtggtggagaatggcgccgcatacgtgcagccgccgccacactccgcggccatggactctgaacccaccttgcaaattgggtatcctcatcaatttgtgcctgctgaagcaaacactattcagaggagcactgcccctgcaggtgcagagaacaacttcatgctgggatgggttctttgagctaagcagccatcgatcagctgtcagaagttggagctaataataaaagggatgtggagtgggctacatgtatctcggatctctctgcgagccacctaatggtcttgcgtggccctttaatctgtatgtttttgtgtgtaagctactgctagctgtttgcaccttctgcgtccgtggttgtgtttccgtgctacctttttatgttttgatttggatcttgtttgaaaataatcttaccagctttgggt

SEQ ID NO: 5287 - DNA, 1134 bp, Oryza sativa
  misc_feature (54)..(54): n is a, c, g, or t
  misc_feature (121)..(121): n is a, c, g, or t
  Predicted polypeptide sequence is orthologous to G142, G148
tagatcatatctcatcccatcatcggtcatattctcctcagcttcatgttgctnagctataggcgaatggttgacaagagtactagttagcttaataatatagctttgcaaaagttgaggnaatggatcgatcagagatggggaggggaagggttgagctgaagcgcatcgagaacaagatcaaccggcaggtcaccttctccaagcgccgcaacggcctcctcaagaaggcgtacgagctctccgtgctctgcgacgcggaggtggcgctcatcatcttctccagccgtggcaagctgtacgaattcggtagcgccggaataaacaagacattggaaaagtacaatagttgctgttacaacgctcaaggttcaaatagtgctcttgctggtggtgaacatcagagctggtaccaagagatgtcaaggctcaagactaagcttgaatgtctccaacgctctcagaggcacatgcttggtgaagatcttggaccattgagcataaaggaactgcagcagctggagaagcaacttgagtactcactgtcacaggctcgacaacgaaagacacaaatcatgatggagcaggtcgacgatcttcgccggaaggaacgccagcttggagagctcaataagcaactgaaaaacaagctagaagctgaagccgatagcagcaactgcagatcagccatccaggattcctgggtccatggcaccgtcgtcagtggcggcagagtgctgaatgctcaaccaccaccagatattgactgtgagcctactctgcaaattgggtactatcaatttgtccgtcctgaggcggccaatccaagaagcaatggaggaggaggggatcagaacaacaactttgtgatgggatggcccctctgaagtccaagcttgctaataaaaacgctggcgtgctataatatatagttcggcaaatgttgaaacacatgtgttctcagtatgtatatttctcccctatccggtggtactcttagcacgtacctatgagtgtatgtttgtacgttatctatactctatgctaggcaaccctatactattatggtaagacgtctatcttttcaatctatctatacgtaccatactaattggcaaattttgtaaaaaaaaa

SEQ ID NO: 5288 - DNA, 1164 bp, Oryza sativa
  Predicted polypeptide sequence is orthologous to G147
cgaagcaagagatagggataaggggaagaggaggaagaaggaggaggtgtagggagaaaccggagcaacctcgaagctagtccaaactagtgggaggttgtctttccggcaagccggagcccggagctatcgatcatcaagctttctaccccgaccgacgaggaagaagacgactgatcaattgatcaaaccgatctctccatagctaggtagacaggaggagaggaggaagaagagggggagaggagacttatcttgatcgatggcgcgaggcaaggtgcagctccgtcgcatcgagaacccggttcaccgtcaggtcaccttctgcaagcgccgtgccggcctgctgaagaaggccagggagctctccatcctctgcgaggccgacatcggcatcatcatcttctccgcccacggcaagctctacgacctcgccaccaccggaaccatggaggagctgatcgagaggtacaagagtgctagtggcgaacaggccaacgcctgcggcgaccagagaatggacccaaaacaggaggcaatggtgctcaaacaagaaatcaatctactgcagaagggcctgaggtacatctatgggaacagggcaaatgaacacatgactgttgaagagctgaatgccctagagaggtacttagagatatggatgtacaacattcgctccgcaaagatgcagataatgatccaagagatccaagcactaaagagcaaggaaggcatgttgaaagctgctaacgaaattctccaagaaaagatagtagaacagaatggtctgatcgacgtaggcatgatggtagcagatcaacagaatgggcattttagtacagtcccactgttagaagagatcactaacccactgactatactgagtggctattctacttgtaggggctcggagatgggctattccttctaacactaataatggcctgggggatacttgtgttcattactagtgtgtaatatggttaataatgcttgtgttgctgtttgctttgctattctgatgtaccttatttagacaagttcccgcaggaagtgtcttttagtattgtatttgtcttgggctgtggtgctttgtttttccctaaagaactcttgaggagctctgttgttgaaccatttcaagtaattgagactattgtttcc

SEQ ID NO: 5289 - DNA, 881 bp, Oryza sativa
  misc_feature (34)..(34): n is a, c, g, or t
  Predicted polypeptide sequence is orthologous to G147
tggaggcgcattgtgttggtaccgtggaatcggncattatggccggtgggacgagacaaatgtcaatatctccttgcttactagtgccacagctgtagcttcaagtctagtccaggccaaaggttatctgcaggaagagtgaaacaacatggtcagaggaaaggtgcaaatgcgacgaatagagaaccctgtccacagacaggtaaccttctgtaagcgccgtggggggctcctcaagaaggccagggaactatcagtgctttgtgatgctgatgtaggtgttatcatattctcctctcagggaaaactccatgaattagctactaatggaaatatgcataacttggttgaaaggtaccagagcaatgtagcaggtggtcaaatggaaccaggagctctacaaagacagcaggtagcagaacaagggattttcttgttaagggaagaaatagatctactacagaggggtcttaagtctacatatggagggggagcacgggaaatgacactagataaatttgcttgcactagagaaaggtcttgaactatggatttaccaaatacgcaccacaaagatgcagatgattgcaacaagagattccgattctctgaaccacggaacggatactcaacgacgggcactgccagcttccacagaaggggccgacctctccggcccatacagcacacagaaaagacaccccaaagagacaacatagcgacccacggcccacgacaccgcgtcgcgatcatccgtacgagcttgtcaacaaaccgggaaccacaggacccagcaccaagacagtagaatcaccgccaaccacagctataacagagcagaacacagcgacaacaacggaacccagcacatcagcgaacca

SEQ ID NO: 5290 - DNA, 2110 bp, Oryza sativa
  Predicted polypeptide sequence is orthologous to G153, G860
gagctgccggcggaggtgcgaagccatcgaggtgagtggaagcttctggaaccttaccctcctttttcctttctatctcgctgcggttggcttaatttgcctctgcgggcgcgtcgcggttttgcttctagaaccttctagttcttgtggtggtatgaagtttctccgtgagtgtcaaatgtggatccgccattagagatggatttgagttcgctgtgctttgtgacgataggcttgtttcggtggagatttcatggataggtcgacgacgagttcatagaaggaggggctttatatgcattagatgaacggcttccaacagtttccgtagcaagaagcttctatggtttaatctaattctaggagggcggtaggggtgatgtttgtgtgccgaagtcttgctaacctggatcaatggaatgcgcttgttgtgcaatgcagttggaaactgtggagtagcccgtgtgacagtgtgagttaattacttggttgcttatttgaggattaggatacacacaggaggtcatgagatgttgtttggttaaactgaacatttaatttgtagtctattaggctgaaaggaaaataaagaaccattcagcctagttgcaagactagtttttctttgtaacgttggtgaattgtactgtgtttaagccaaactaagttgttaaaggtttagactgacgtccccttatgtgatgtttatctttgttgttgttgtcatattttgaaaattgtgcattcaccatctctaaaatagctcatagggcattaacgagtgatttcaatcgaggtgccttgtttacaactattgctttgcatattctgatcattgcaatgttttcaaccagttattgcatatggtggcaccaagcatgaggttacaactgcattacttgcaagggaatcacaagtcacaagaaacacatgttattacaatggatgtaagatttttttattcccagtttattttcccatgattttgcgacagtgaatagttttattttttttaaataaaatgaacttacatgatcattgatgttgtctttaacaacaactcaccaatgaacaaccatacattgtcatatgtgaactctggttaaagagtatctttttgtaacttaagataaatgggcatctgtcctgcaaatggagatggaaagtttgcatagaagtaacagtgatatgctattctgcttataatcacctttccagatatatgttgtgctgtactagcagtctaatacatactatatgatgtctgttgttaatattcagaaaatgaccctgttttttgccaccataagtttccaacttttcaggctatcatatttcagtatgctgtgatagataagtgaacctctttgtgtgtaaatgtttcatggtctgatggataaacaagataattgtgtacagaacccagcttgcagcatatctgcattaagcagatgtagttttgctgcaagcaaagcatggcttattgctataccattgcctttgtgagtggaatggtatatcttctaaattaaggaaaagatgactttctccttttctggagctatgttggggttggctctgttcaagatcagagggagtatattcctcctctcaagagctcaaaacttttcttgtgaataagtttccatgttaaggactgcatagagccccttttccattgataggtacacccaaggcagcgggcagtctcattatataaaattatgttggtatggtcaaagcgcaccatcagcaggttgaaccttcctacttagttcttcaattccttgtgtcaaaggtggtcctatggcagaagattgattgcttcaatctaaatggaattaaaacaaagttgcagatattaatgaagcacatgctaaggtgaccttcatctgagatgtgactattgacatcacatacgctcattttgagttggttctctaaattccagagatctcttgcatttaggccagcaagctcctgtccatatttatcaataaacacaggacggagttgatttaacattctgagaaaaattgtcacaatttgatttcttatacatgtattctttctcactaacttactaatattatggaagagaagctgcttc

SEQ ID NO: 5291 - DNA, 1406 bp, Oryza sativa
  Predicted polypeptide sequence is orthologous to G154, G627, G1011, G1797, G1798
catttcggggggggtagtttataagggcttgcgcgaggagggggaggagtagcgggtagcggcgggctcgagtcgagtcgagtcgccgtcgtcgtcgggcggcggcggccgagagagatcgggatcgatggtgcgggggaggacggagctgaagcggattgagaacccgacgagccggcaggtgaccttctccaagcgccggaatggcctcctcaagaaggcgttcgagctctccgtcctctgcgacgccgaggtcgccctcatcgtcttctccccccgcggccgcctctacgagttcgccagcgcccccagcctacagaaaaccatcgaccgctataaagcatacacaaaggatcatgtcaacaataagacaattcaacaagatatccagcaagtcaaagatgatactttaggtttggccaagaaacttgaagctcttgatgagtccagacggaaaatattgggagaaaatttagaaggatgctctattgaagaactgcgtggtctagaaatgaaacttgagaagagcctccacaacataagactaaagaagaccgagcttctggagcggcagatagccaagctgaaagagaaggagcggactttgcttaaagacaacgaaaatttacgcggaaagcatcgcaaccttgaggctgcggcgctggtggctaaccacatgacgacgacgacggcgccggcggcgtggccgcgggacgtgcctatgacgagcagcacagccggcgccgccgacgccatggacgtggagactgatctgtacattggattgcccggcactgagcgctcctccaaccggtcggagacaggttgaagaaggccagccacagcaacagctgctatatagcatgcagtagcagcaacgacgccagtgacatcctgttcatctcacaagaataaccagagctctacgcatgcgcacatgaaacccaggcatgcagttctcggtgggtaaattattatctcgcattattagctatatgcgtgtccttgtctttttctttaggcaatggaataaaatttccggtaagtacaaacacaaacggaaacaaagaattaacaaagctgtagcagaccagatcggcaaattgaaatgccaggtaatccagtatatatttcgctaaagttattcatgttggtgtgatgggcctgtgagtgtgggtgcttgggaggagatttcttgggttttttccccgagcaaaatcaatctgctcgtgcccttgagatttcagttccgcccataagaactccgacgcacatttagcattcggagagtaattttgttaggttaaaagtatggtaagttataggtggtatgttatgtttttctttttcttttctcaatgttatctggtacctaagtttgtcaagaaaatcatagtggacaagtc

SEQ ID NO: 5292 - DNA, 257 bp, Oryza sativa
  Predicted polypeptide sequence is orthologous to G154, G627, G1011, G1797, G1798
cttagcttagctagggttcgtggtcgatcggtggaggagttggggaatggagggaggagggaggaggaggaagagggggaaggtggagctgcggcggatagaggaccggacgagccggcaggtgcgattctcgaagcggcggagcgggctgttcaagaaggcgtacgagctgtccgtgctctgcgacgcccaggtcgccctcctcgtcttctcccccgccggccgcctctacgagttcgcctcttccacctccagca

SEQ ID NO: 5293 - DNA, 1117 bp, Oryza sativa
  Predicted polypeptide sequence is orthologous to G154, G627, G1011, G1797, G1798
gggggaccaaaaaggaaagccgaggaggagagggaggggagagaagggagagggggtcggggagaaagaagagcgagcgagcagctttggctacggccaaaccctacagcgcctccaccaccactccttgccttttttggccgcagccgctcgtgtggttggttggttcatcggcgatcgaagatggtgcgggggaagacgcagatgaagcggatagagaaccccacgagccgccaggtcaccttctccaagcgccgcaacggcctgctcaagaaggccttcgagctctccgtcctctgcgacgccgaggtcgcgctcatcgtcttctccccgcgcggcaagctctacgaattcgccagcgccagtacgcagaaaacaattgaacgctataggacgtatacaaaggaaaatatcggcaacaagacagtacagcaagatatagagcaagtaaaagctgacgctgatggtttggcaaagaaacttgaagctcttgaaacttacaaaagaaaactgctgggtgaaaagttggatgaatgttctattgaagaactgcatagcctggaggtcaagctggagagaagcctcattagcatcaggggaaggaagacaaagctgcttgaggagcaggttgccaaactgagagagaaggagatgaagctgcgcaaggacaatgaagagttacgcgaaaagtgtaagaatcagcctcccttgtctgctcctttgactgtccgggccgaagatgagaacccggaccgtaacatcaacaccaccaacgacaacatggatgtcgaaactgagctattcatagggctgcctggcagaagtcgctccagcggcggtgctgcagaagatagccaagcgatgccccattcttaagtaacaggccaggaataagctggatctctgcgttgagaaaggagatgatgctaggcatgcaatgacaccaaaccatcctaaaaacagaccacgctgtatattttacttacccgtattgtcgtccatggatgcgaaatgctagacgcatatgcacccacccattcagcaccaccaggcagaaacccttcgatcggcagactccactacccatctaaatctaaatcgagagatctcaagtgcg

SEQ ID NO: 5294 - DNA, 583 bp, Oryza sativa
  Predicted polypeptide sequence is orthologous to G154, G627, G1011, G1797, G1798
ctgcatctctcgctgctcctcctcctcctcctccgccgtgcaggccgcagccgctcgtgtggttggttggttcatcggcgatcgaagatggtgcgggggaagacgcagatgaagcggatagagaaccccacgagccgccaggtcaccttctccaagcgccgcaacggcctgctcaagaaggccttcgagctctccgtcctctgcgacgccgaggtcgcgctcatcgtcttctccccgcgcggcaagctctacgaattcgccagcgccaggaaaattcggcctgaaaagacggcaaaaactatatttccccgtgtggcgattgattgccgtctaaacagtcacactacttccataaagaaattagttgtgagactggcaaggttagaaattctgaaaacataggcaacttagtactggcattccggagggcaatatgatatgagcactaattagttaatgataatgtacgttgcagtaatcttgccgtgcatatgaatttctatgcgtaacatgcatgaaagcacactaacgggagtttccagggagcctccaatcttattaatgctgtacaactaaaaaaaaa

SEQ ID NO: 5295 - DNA, 437 bp, Oryza sativa
  Predicted polypeptide sequence is orthologous to G154, G627, G1011, G1797, G1798
gaggtttgggatgctttcctttgcgaggaaaatcagccagcagcgacatagatcgatctgttcccggccggcgagccggagtagatctctcgcataccctgcacgcacgtactgcttatggcggcggcgggagggcagcagaggcggcgcggcgggcggcgagagatgcggcggatcgaggacacgacgaggcggcaggtgacgttctcgaagcggcggaaggggcttctgaagaaggcgtcggagctgtcggtgctgtgcgacgcggaggtggcgctgctcgtcttctccccgcgcggccgcttcttccacttcgcctccgctccctccctggaggggacaatcgaccgctacattagccacacccaagaggcgcctgcaaacaagaagccccgtgaacttactaatatgaaatctcaatccgaaaccttagcaat

SEQ ID NO: 5296 - DNA, 561 bp, Oryza sativa
  Predicted polypeptide sequence is orthologous to G156
atggggcgtgggagagtagagctcaaaaagattgaaaatccgacaaaccgccaagttaccttctccaagaggaggatggggctgctcaagaaagcaaatgagctggccattctttgtgatgcacaaattggggtgattgtgttctcaggcactggcaagatgtacgagtactccagccccccttggaggattgcaaatatctttgatagatacctgaaagcccccagcacccgttttgaggagatggatgttcagcagagaatcatccaagagatgacaagaatgaaggatgagaacaacaggcttaggatcatcatgaggcagtatatgggtgatgacttggcttcactgactctgcaagatgtgagtaatcttgagcagcagattgagttttctctgtacaaagttcgtctaaggaagcaacagctacttgatcagcagctgcttgagatgcacagccgggtatgtaacaagaggatataccggttcagtattcttccctaccttatacactatattgaaataatcaagttttgattgccctctttccatcccaatagg

SEQ ID NO: 5297 - DNA, 729 bp, Oryza sativa
  Predicted polypeptide sequence is orthologous to G156
atggggcgagggaagatcgagatgaagaggatcgaggacgcgacgaggcggcaggtgacgttcagcaagcgcagggctgggtttctcaagaaggcgaacgagctcgccgtgctgtgcgatgcgcaggtcggcgtcgtcgtcttctccgacaagggcaagctcttcgacttctgcagcccgccggtcatcttgatggagctgtttcaccgttatgagatcaccaccagaaacactcggcttcaggagacaaaccgtgatgatgagcaaatggtcatggagatcacaaggctaaggaatgagatcgaccagctcgaagccagtttaaggaggcaaactggagaagacctgtcatctgtgtccacagtggatgagctcagccagctgcagctgcagcttgaatcatctctcagcaaagttcatgcgaggaaggatgagctcatgagccagcagctggaggatatgcgtcgcatgcatcagaccgtgcatgagcagaacaatttcttgtgccgcatggtaactaaaatactcctactaaatgtgatcacaataatgatacttgctgccatgatttctatcactcatgcacgcattgcccttgatgattgtatgcagttgggatatattgtcatcaagcaagaaaattcttggcgattctggtttatatgacttcctggaagcagtaggaacaacaagagttactgaaccagaaattgaacttgccttcttcat

SEQ ID NO: 5298 - DNA, 1325 bp, Oryza sativa
  Predicted polypeptide sequence is orthologous to G156
agcctttgaagcaagcttagcacttcacaagtttcctcttgtgcagaagaaggagaaacaaaagaacacagaaattaaattaaactcgatcaggaaggtatagcaggcatggggcgcggcaagatcgagatcaagaggatcgagaacgcgacgaacaggcaggtgacattctcgaagaggcggggagggctactgaagaaggcgaacgagctcgccgtgctctgcgacgcccgcgtcggcgtcgtcatcttctccagcaccggcaagatgttcgagtactgcagccctacctgcagtttgagggaactcatcgagcattaccagaccgtcaccaacactcatttcgaggagatcaaccacgatcagcaaatatttgtggagatgactcggatgaggaacgagatggagaagctggacggtggcatcaggaggttcaccggcgacgacctctccaacctcacgctcgccgacatcaacgatctcgagcagcagctcgaattctccgtcaccaaagtccgtgcgagaaagcatcagctcctgaaccagcagctggacaaccttcgtcgcaaggagcacatcctggaagaccagaacagcttcctgtgccgcatgatcaacgagaaccatcatcaggcggcggtgggcggcggcgacgtgaaggcgatggtggagatggcgccggtgctgtcgatgctgacggcggcgccggcgtactacggcgaggagtcgtcgagcaccgcgctgcagctcaccccgccgctgcacgccgtcgacgccgccgccgccgccgggttccggctgcagccgacgcagcccaacctgcaggaccccggctgcagcagcagcagcttccatgccgccgccgccggccacggcctgcagctgtggtaagaacaaacgaagcaaagcatacatggcacatcctgatactctcatcagagatctagatgattgcttgctaattaagcacatgatggcattgtcgattctgggagctaggagtaacttggagaccatgaagatgcatgatcagctgatgatagacgatcgagttgggttgctgtgttgttcaattgttcatcgttctggacatatatatatatatatatgtgtgtgtgtgtgtgtgtgtgtgtgtgtgtgtgtgtgtgtgtgtctaattagcacatcagaataatcaagcttttctacctagttaactagtacagctgctaagtaccttttgatttgttggtgtgtgaactactgaactggagttggatattaaggtctccatgcatttgcatggttaattagcagagagatcattgaggtttttaggatgtaac

SEQ ID NO: 5299 - DNA, 2287 bp, Oryza sativa
  Predicted polypeptide sequence is orthologous to G162
ccacccaaaccctctcgtgtcgcgcggctcgcctgcccccgctccgccgaccacgggcgcaccatggcgctgccgccaccgacgccggaggtcatggacgacctcaccgcctcgctcgcgccggagctcctctccgagatcctcctccgcctcccgccggacgagcccgagcaactcttccgcgctgccctagtctgcaaggaatggctccgcgccatctgcgaccccggcttcctccgccgctaccgcgccttccaccgatcccctcccctgctcggcctcctttacgccgccaagttctacagggagcccccgccccccacctcgcccgcaccaccgcagtgcccctctcgcccgatcccacctttcgccgggccctcgattgccgccatggccgtgccctcctccacgcttcggacgatgattggtatctcattgtctgggaccccgtcaccggcgaacagcaccgcgtgccagagcccggcatcccgtggctgatctactccagcgctgtgttctgtgccgtgagcggctgtgaccacctcgactgccacggcggtcccttccgagtggtctttgtggccaccgatgacggggcggatccaacacctacacccacaaaactcatggataccccggagcacccccttcgattttttcactatgaatgaactaaaagtccctaaatggctggaggttgaaaaaactgtgtaattgagcctccctaattttttgtttctgatccacccgtgatgagtacaaagatctcgttaaggcgagcatgtactcatcggagaccggggcgtggagcaccccggtagttcttgatgatggtcttgattcctgggaacagcgatggcgagatgcacagagtagaggtgaattctaccgcgtaccttatgtcatgcctaggcgagttgcccttgtcggagatgaaatctacttcacacttcgggaggataatgccatcatcaagtacaactggggcatgcactgcttatctgaaattgactcgccgtcgccagacgtgtatggcattgccctcatggagatggagaacggttcactgggttttgcctgcattgaggattccagcctttatgtgtggtcacggaaggtgaattcagaaggggcagcagaatgggtacaatgcagggtgatcaagctggacaaaatgatacctgttgccaatctcagtgatgaagcatttgtggttggctctggggagggtatgggtgccatattcgtgagcacaggtgttggcttgttcacgatcgagctcaagtcaaggagggtgaagaaggttgcagagcctgaggtctactttagcatcttaccctacatgagcttctacactcctgatcgtggcacattgttatcgctagcaaggactcactgatctttgatgtcatgctcaagagtaacttgttgcaaaatggacaaatccattgtcttgactcttgaatctgctgccactgacttcttccagaactactactactactaagctgtttattttttgttgggcagtacaagtacgaacaatgccaagtctgatgttcaaatgtggttgttgtgtcaaattcatcctaccgaccatgaactagatcagcaagtcgtgctaagctgaatagctggctccctattctttattgttcgttttgagagcatggtttgcgctttggccttacaggaatgggccaactatcggaataagcatcaacacgctgatgaggccatgaaggctcaggtgatagtgaagggtaagcagccatgagaaggggaaaagttaagatcaagcccattgcaaatagaaaggctcgtgatgtatgcttctccaagcgccgccaggttgtaatcaagaaggctaacgaactcagcatattatgtggtgtcaatgttgctgttgctgtgctctcacctgctggtaagccctttttctttggctgccctactgttcaagctgtcactcgtcgcttacttggtgtgggtcctagtaaccctaccatgggtgatgggggcaatggtgatgagactgacatagtgcatgagctcaatctgaagtaccagaagttgcaacaagagaatgaagtggagaagaagaaaaaccagcgtggtcaggatgtgaggctagctagtgatgtaaatgcattggggctgcatgagttggaggcattcgacagtaacctcaatgtaatagatgacattgtcgattcaaatgatgtggttaagaatgccaagcaaacagctgagccccagactcagatgagcgtggcatcaaccttgc

SEQ ID NO: 5300 - DNA, 746 bp, Oryza sativa
  Predicted polypeptide sequence is orthologous to G175, G877
gctatgctgggttctctcttgctaaggccctgtttggaaggcatgaattttagtttcacatgaaacggctcgatttccacaggaatatgagcatattcccgcataccaaacgagcccctaagccctaactaaaccaatgcaagaaccaacctacagagccaatacacgctgctcagcggcgcttggaagcagcacacccgaattggactgaagaatagaacaatttacccagctaaacactaccaaaatttcatgctatccactctcttcttttaactgtaaggaagaaactgaagatgcattccgcaaaccatctctgcgcgacgaccgttgcgccctgtccttgtgaggtaaattgctggaagaccatacgctggcattaccggaagaatggctactgttcctggctgctggcacgtcatggctgtgcttgccttcatatgtagatatcacagcctttgggtcttgtgaggatctctcaatatgcttcttcacatcacatccttggtacgtgcatttgtagtaactccttgggtgaggagtcccttttactactttttgaccatacttgcgccatcggtagccatcagtccaaaagatcaacctcactatttgtttgcacaatgattctttgagctggagctggcacatgtcttttgttcgcatttccatcactagtagctgcacccttaaccttcacttcttcctcaccttgatcattgctatcacttgagcccgatatttgc

SEQ ID NO: 5301 - DNA, 2353 bp, Oryza sativa
  Predicted polypeptide sequence is orthologous to G175, G877
gtccttcgcttcaccacctcgccaaaaccgccttcccttcccttctcttcccttccaacctctcgttgcggtttgcgctagaaaaaaaagagaggagagatttcaagaaaccgtgggggagaaagaagcaggcaagaagtagcagcagcagcgagtgaggctaatctgtttgagcttgggattgtcaccttttcatggacgggaccaacaaccatggagcactgatggacgattggatgcttccctcacccagtccaagaacactcatgtcgagtttcttgaacgaagaattcagctccggtcccttttcagacattttctgtgataatggcagtaacaaacatcaggatggacttgggaagagcaaagctttcatcgattcaagccgggaagaaactgctcagctagcaaaaaagtttgaatcaaacctttttggtgccaaccagaaatcaagctcaaatggctgtctgtcagagaggatggctgcaaggacaggttttggtgtcctgaaaattgatacatctcgtgtcggttattctacaccgattcggtctccggtgacgatcccgcccggtgtgagtccaagggaacttcttgagtcgccggtttttcttccgaacgccattgcacaaccttctcctaccactggcaaactgccatttttgatgcatagtaatgttaaaccatcgatccctaaaaaaactgaagatgaaacacgccatgatcgtgtattcttctttcaacccattttgggatctaagccaccaacttgtccagttgcagagaagggtttcagtgttaatcatcaaaaccagccttcagtgacggataatcaccaggagctcagtcttcagtctagctcaactgcagccaaggatttcacttcagcaactattgttaaacctaagacatctgattccatgttagacaatgatgatcacccttcccctgcaaatgatcaagaagagaatgcaacaaacaaaaatgaagagtattcttcagacctgatcattacccctgctgaggatggatataactggaggaaatatggacagaagcaagttaagaacagtgagcatcccagaagctactacaaatgcactttcacgaattgcgctgtcaagaaggtggagcgttctcaagatggccaaataacagagatagtctacaaaggttctcacaatcaccctttgccgccttccaaccgccgaccaaatgttcctttctcacacttcaatgatctgagagatgatcactctgagaaatttggttccaagtctggtcaggccacagcaacttcatgggagaatgccgcaaatggacacctccaagatgtcggtagtgaagttctgacaaaactgtctgcttctcttacgacaacagaacatgctgaaaaatctgttatggacaaacaagaagctgtggatatctcatcgacgctctccaatgaagaggatgatagggtaacgcatcgtgccccgctttctctgggctttgatgcgaacgatgactatgttgaacacaagagaagaaagatggatgtttatgccgctactagcactagcaccaacgccatcgacataggagctgtggcgtcaagagctatccgggagcctcgcgttgttgttcagaccacaagtgaggttgacatccttgatgatggttaccgttggcgcaagtatgggcagaaagttgtcaaaggaaacccaaatccaaggagctactacaagtgcactcatccgggttgctcggtgcgcaagcatgtggagcgatcatcgcatgatctgaaatccgtcatcacgacgtatgaaggaaagcacaaccatgaagttccagctgccaggaacagtggccacccaagctcaggctcagccgctgcaccacaggctaccaatggtcttcttcaccggagacctgaaccggcacaaggtggtggtggtggtagccttgctcagtttggctatggctcagctggtcacagaccagcagagcagtttggtgcagcagcagctggtttctcctttggaatgctgcctcgtagcattgcaactccggcgccgtctccggcgatcgccgtgccggcgatgcaggggtacccagggcttgtgctgccgagaggtgagatgaaggtgaacttgctgccacagtctgggaatgctggtgcagcagctagccagcagctgatgggcaggttgccaaagcagcatcctcagatgtaaaaatggcaggaacatgagacaaatggtgtttgctgcttatgtatatgaaacatttttggtgcttttgttaggagaatggagtgttattgtagctcaatttactttcgggggaaaaaaaagcagatagttcaggc

SEQ ID NO: 5302 - DNA, 2764 bp, Oryza sativa
  Predicted polypeptide sequence is orthologous to G175, G877
gagtcttctcttcaccttcttctcatcctcttcttctcctcctcggtcaaaccgccttttcttctctcccctatcctccgctccgagggagaaaaaaaaacaaagaaagaaagaaagaaagaaaaagagtactagtagcacccggagagtggaggaaagggagtaggcggagccaaatctcgtttctctttagttgttgttagtacccttagtggaagaatctctccccttttcttgtgtttcttgggttttgaagttttttgttgttgggaggtatgaggaatgaaggcctaacctgaggcaagatcttcgttttccttcatttgtgggggtgtttgttggtggaaacggatcaagaaaagccggaatttcggttctgaaatcgtcggttttgatatcggtttctctctgttgattggagagagagggagagagcaaacgcatgatctgtgtctgattctgacgggccttgtcgcggtccgtatcagttcatccatcccaacttgctgttcgttttgtgtggtggtgtttcgcttttttgggaagagaggagaggaagcaatcattcggcggcgacggccccgcccacttgagttaaacttgattgctctgtcgcatggccagcagtagcgaccatggatccctcatggaggactggatgccaccacccacacccagcccgagaacactcatgtcaagcttcttgaatgaagattttgtctctggttcattttccaatattttcagtgatcatgagagcaacaaaccccaggatcagtttgagagaaacagagagcttgtggatttgagtaaggaagtgccttcccaattcgcaagacccgcattccagagggatgcttccctggatcatagcttggtcagtcctacacagagatcaaactcgcatggtggtttggcagagcgcagggctgcgagggctggtttcagtgtcccgaaaatcgatacatcccgtggtggttcatccacagtaattcgatcgcccgtggcaattccaccaggtcttagtccaacaacacttctcgagtcaccggttttcctttacaacgcaatggcacagccttctccaaccactggcacactgccatttttgatggcttcaaatgctaagtcaacaataccgtcagctaccaagatggacgaagattgcacatttggcaatgacactttctccttccaaccgcatgtagggtcgagacggccaaatttctccgctgcagaaaagggtcccaatgcttgtcaccaaaaccaatcgctgtcgaatatccatcagcgggaatccagtcttcagtcaagctttactgcagtcaaagatatcactgatgaaaaaaacattaaaacaaagacatctgactccatgtttggtgataaccactcttctgatgaacaagatgatgagactaaccaaaatggagaaaactctatgccacctccgaaccaccgttcaggtgtccctctgtcacataccaatgatccagaagtgaatgtcctagagaaccgcggttcacagacatgccataactctgcatccttgtgggacaatgccaaaaatgattgccttcaagatgttcaaagtgaagttattgaaacaagaacagctgcttgtcttccagtatcaaccaattgtgatacatctatcatggagtcccaagatgcagttgatgtgtcgtcaacactatctaatgaggaggatgatagggcaacgcatggcacggcttctatagagtgcaacggggatggagatgagactgattccaagagaaggaagctggatgctttgacagctgcaactgctgctattaccaccaccagtaacattgacatgggagctgcggcatcgagaggtgtccgggagcctcgtgttgttgttcagacaacaagtgaggttgacatccttgatgacggttaccgctggcgcaagtatggacagaaggttgttaaaggaaatccaaacccaaggagctattacaaatgtacgcaccaagggtgttcggtgcgcaagcacgtggagagagcatcgcatgatctaaaatccgtcatcacgacgtacgaggggaagcacaaccatgaagttccagctgccagaaatagtggacatgggagctctggatctggaaacgctccatctgcaccgcaatctaacggctctcagcgcaggcaagaacaagggcaagccagcttcagccagtttggtggcgcggctcccttcagctccttcgttctcccaccaagaaaccaatttggaccatcggcgagcaatttcccctttgggatggtcccgccaggcatggcgattcccatgccatctctagggtctcttgctccagcaaagatggctggtcatccatccaccatgcagggctaccaggggctcatgattccggaaggagagatgaagacagagcccatgtcgcagctcggcttccccgcggtaaaccaatcttcatcatccttccaacagatgatgaacaggcctccatcatttggacctcagatgtaaataataatattaaagaaagaaaagaaaatgatagatgtgcttcagcttctatacatggtagcaatgctacaacatagctttgttgttctagcttttacctgttattttttctttgggcttttattttttggaagcaaagaatgcagaagatgttacccgttttgtttatgttgtaattggaaaaaaaaggtggtggtagtgttcaggacaaaaggcaaaatcattcaattggaagtgctgatggtg

SEQ ID NO: 5303 - DNA, 3152 bp, Oryza sativa
  Predicted polypeptide sequence is orthologous to G175, G877
ctctgctggctccctcctcgatgacgatgacgaccgcgacgctggatccgccgccgcctcccctcctcatcgccggctccctcctcgacgacgatcgcgacgctggatctgccgcctcctcctctcctcgctggctcccccgggcgcgcggatccaccgtcggctcccctcctcgccggggaggggaggagaggggaggggaggcggcgacgaggaggaaaggcaacagctcctgtcctgacgacgacgatgactgccgcaacgacgaggacgactgccgcaacgacgacgactaccgcgacgatgatgtgggggcgacgacggatggaggaggagacgcggcggctcttctcccgatggcgatgatgactgccacgacgatggcgccgatgcctgtcgaggcagcggtggacggaggaggagagctgtcatcggccggagagggtggccagcggcgggtgaatctactgcctacgaagatattgtccgcctacgaaaatcatctattttcgcaggcccttgcttgcagggaagatgaatggatcatcgagaagcttgcggtcatcgctgctagacgctcatcatttgtctctgaagaatccttgtgctctgttccggctgcggctttggtctctttggccattgcccatttggctttctcccccatgttggtctatggcgttcttgatcgtttatgttccgtttgccatctgggtgagatggagggagacatagcgatggaggagtggaaggattccaaccatcgaggcgcggattacctgatgacgatgccgatgcagaacttcctcgccgacgcgttcccgccaccggagctcttggagggagaaggcgggttcgagaagcacggcctgtcggtggccgttggctcgccgccgccgacgccgccgcctccggaggacgggtgctcgccgctgccactgacgccgcagttcggccagaagttcggctccggcggcggcggcggcggcagcctcgccgacaggagggcgagaggcgggttcagcaacgtcgccaggatcagcgtgccgtacaaccagccggcggcggacgtgtcgtcggcgggggcgccgtcgccgtacgtgacgatcccgcccggcctgagcccgacgactctgctggaatcgccggtcttctccaatgccatgggccaggcctcgccgaccactgggaagctgcacatgcttggtggtgccaacgacagcaatccaatcagatttgaatcccctcggatcgaagaaggatctggtgcattttctttcaagcctctgaatctcgcatcctcacactacgcagctgaagaaaagacgaaatctctacccaacaaccagcatcagtcgctaccgatttctgtcaagactgaagctactagcattcaaaccgcacaagatgaagcagcagccaaccaactgatgcagccgcagttcaacggcggcaagcggagccgcgctgcacctgacaacggcggcgacggcgagggccagccggcggagggcgacgcgaaggctgactcctcctccggcgcggccgcggtcgccgtcgtcgccgccgccgcggcggcggtggcggaggacgggtacagctggaggaagtacgggcagaagcaggtgaagcacagcgagtacccgaggagctactacaagtgcacgcacgccagctgcgcggtgaagaagaaggtggagcgctcgcacgagggccacgtcacggagatcatctacaagggcacccacaaccaccccaagccggcggcgagccgccgcccccccgtccatcctccgccgccgtcgccggcgacgacgacgacgacgccgctgccgccaggcgacgcgcaggccgaccacgcgcccgacggcggcggcggcagtaccccagttggcgccggacaggcgggcgcggagtggcacaacggcggcgtggttggcggcgaggggctggtggacgcgacgtcgtctccctccgtccccggcgagctctgcgagtcgacggcgtcgatgcaggtccatgaaggcgcggcggcggcgcagctgggggaatcccccgagggcgtcgacgtcacgtctgcggtgtccgacgaggtggacagggatgacaaggcgacgcacgtgttgcccctggccgccgccgccgccgacggcgagagcgacgagctggagcgaaagagaaggaagctggactcctgcgccaccatggacatgagcacggcgtcgagggcggtgcgcgagccgcgggtggtgatccagacgacgagcgaggtggacatcctcgacgacggctaccgctggcgcaagtacgggcagaaggtcgtcaaggggaaccccaacccaaggagctactacaagtgcacgcacccggggtgcctggtgcggaagcacgtggagcgcgcgtcgcacgacctcaagtcggtgatcaccacgtacgaggggaagcacaaccacgaggtccccgcggcgaggaacagcggccacccggcgggctcggcttcgcccggcggcggcgcggggtcgtcgtcgcagccccacggcgtcggcgtcggcgggcgcaggccggaggtgccgtcggtgcaggagagcctgatgaggctcggcggcggctgcggcgcggcgccgttcccgccccacttcggcctgcacctgccgccgccgccgccgagggacccgctcgcgccgatgagcaacttcccctactcgctcggccacgcgccgtcgccggcgctgcggggcctgccgccgcccccgcccccgccgccgtcggcgtcggcgctggcggtggcggggctcggcggcgtggtggaggggctcaagtacccgatgctggcgccgccgtcggtgcactcgctgctgaggcaccgccagggcggcggcatggaggcggtggtggtccccaaggcggaggtgaagcaggaggcgatgcggcccgccgccgccgtcgccggcgcggggcgcggcgcggcggtgtatcagcaggcgatgagcagggtgtcgctggggaatcaactgtagataaataataaaaaaagaagagcagttttaggaggagcttttatattcatatgcttaggttaattaattaattaattaatgttaccatgataagtataacgatcagttcttgttcttagtgtttgatttttgcaa

SEQ ID NO: 5304 - DNA, 1190 bp, Oryza sativa
  Predicted polypeptide sequence is orthologous to G180
ggtctctgtctctctttcttctagctctctctctctctctctctctctcatggtcatcgcttcccttttaacctaaagaaagagatctttcttggcatctcgatcgtcttcgatctctctctagctagctatacctcaccggcaatccaagctgcatgatctcttgtagagcatactactagtagctagttaattagttgctgcatgtatgcgtgcatggaagggagccagttggagacggcttgcctccctgccgcgctctacgcgccgctctgcccgtacacgccgccttcccctccttcctttcttgcgccattgccgagcctgcagcacaagcttccccagctgccgcagctggtccacgaccacgccgccgccaccgggacgaaccatggcgtgatgttctcgtcggaccatggctgcctgtacccgctgctcccggggatcccgttctgcctcgactccggctgcggcgccgccgcctgcgacgacgacaagcccgccggtttcgcgcacttgggctccgccgaggcggacacatcggcggcggcggcgagagtggatagcgagattgctgcagctgccaccgcaaccacttgccatgggcctaattcatggtggaaggggacggagaaggggaagatgaaggtgaggaggaagatgagggagccgaggttctgcttccagaccaggagcgatgtggatgtgctggacgacggctacaagtggaggaagtatggccagaaggttgtcaagaacagcctccacccaaggagctactacaggtgcacccacaacaactgccgcgtgaagaagcgggtggagcggctgtcggaggattgccgcatggtgatcaccacctacgagggccgccacacccacaccccctgcagcgacgacgccaccaccggcgccgccggcgaccacaccgccagctgcgccttcacctccttctgacgaacgcatgcttatgtacatggatcggtgatggattattgttctctgatctgatggtggcaattgggaaatcgaagaagcagggatcgatgtaaaatgaaaatgtactaggaaagcttttagaactcttatggatgctatttaatttcctggtcaatcagctagccgatcgatcaacacgttgcatgatattcagtctaattatgaatgaaaatgtagtaggaagcttaatt

SEQ ID NO: 5305 - DNA, 3435 bp, Oryza sativa
  Predicted polypeptide sequence is orthologous to G180
gaaggaggtggccaactggggacttgtcttccgaatttctatcttttgccagatcaccacggcatgcctcttcctcctccacttcaactaccgtgccatccgaagctactccagatgccattcgaccaagaagatcagcccggaatccatggcgtgatgctctcttctgaccactgcgggctgtaccctctgccggcgcttccgttaagcaactccgccgccgccgccgccgcaaccgtcgcattggggaagcacagtgcagccgccggttccatgcccaatattggcggcgctgaggaggtggccaccactgtaaccaaagctggcaatgagagtactacttgcaatggctccactacatggtggaggggctcgacgatggcggcgatgggggagaaggggaagatgaagatcaggaggaagatgagggagccgaggttctgcttccagaccagaagcgaagtggatgtgctggatgacgggtacaagtggaggaagtacggacagaaggttgtcaagaacagtctccatcccaggtacatatgctcaacttaaccaaaaccctacatatttgatttcttatatcatttatacatatgtgtagataatagattccccgtttcttatcaattaactaattataaacataaacagaagaatgtctcgatgcctatttaatttggttaattagtaatacgcaagtttatatataccagataaaatatcaattttatatgtacagaactgagccatgttgatcttgttttttctcctaaagggcttcttcagaacatggaaaatttgtaggattttcacaggaaacatttcaatttctcccaaattctcgtgaaattcctcccaacccaatataccaagggtactctctatggcagaagagaattaatgcatgcctggttaaactaacttgtcaacaaaggtcttgatatgaatagattagaagctgatttaagacaaggcaaaatatctacaaatataattatatatatgcaggctagattattacttttcctttttatatcaatatagttaaaagcgattttacagtacttaagagatgttaggaggtgccaccgtttttaatgtaaattctggtacctctgtaattagtatttaaggtactaccaagtctttacaatagaaaatatggtatctcttaacaagggaaatgtaaaattcctcatttaatttggtatgtgcttatctattagctctgtacttatgatatatatgtttattttgcttctacctacaatcgaaataaacgcagctactcctataacatattgctgtccaattatatgatccatatgtcaaaagtgttcgccagtatatggaaaagtttcacacacttgtcatcagatgacccttgcaaataatcttaattatgtactagttaattaaggtccaagaattaatgggtattttaattaaatgggggttcactttgttataacaatgaaaataatctattgagctgaatctgacaggctcaccttctgcacagttttattaaaaaaatatttttaatgcaaattgttacattttggtgaacaagcttaattagttactagttacatttcggtgacaagtttaacaaactcatcatacataactagccgtatcagttctttaatttatgataggtactgtcatccctgatgcagataaagggacgggtcataaatagattaaggatcgagttcttaccacaaatattctgaatatgcatgtatgagaaggagtcttggggtaattaattaaggtataacggatcctaatatgggcaccatgaaagagaggaccctaaatttgccaaactaaggacgatgcatgccattctacacactcatacaacacaagtagtgtaagccttagctatttcatgcgataaaataaacggcaattagcagccaattaacataggcacaaaaggtacattaataagaaagatgcttcagttcccaattcatacatccgtttgtgagaagctgtgttaggagtatactgcactgtatctggcatcttatatatctatgtataatgttcatataatgatactatttctttatctcattaaaccatatcacctcaattgtctttgacacttagatgattaatttatggtccaaattatttttatcattttctttctcatacgaagttatatcaccttagttttgtctttagatgattaatctatattatttctccttttttttattttgtcgttgaggcatatcaccttagttttactttttaatgatcaatttatatatgatttaaattattaaaaatcacgccatctaaactatttttaacttttttcatggtcgatcaaagatgaaaattatataaaattacgtcatccgtcatctagctatttttacatgttatttgttctattattatacagaacttccgctgcgatgcgcgggcccaatctaactcccatctccttgcagaactcgatcgataaaaattaattaatgttgtcaattagctaattacgtcgcatgcgggagtcatcgcacggccaaatatctaaaaaaacatgtaatagtcctttcatttcagtaaataaacacatctatatttttttaatctatatattagattgagaaatggaaattggttagtcagtactccctccgtcccctagtataagggatagactagtactccatccgtttcataatgtaagtcattctagcattttctacatttatattgatgttaatgaatctagacatatatatctatctagattcattaacatcaatatgaatgtgggaaatattagaatgacttacatggtgaaacggaggaagtatataggaggacaccatgaatataactctctggttttgcggagcttctgatctgttggagatcagaactacaaacaggcatttttgtgtgatttggatgtacacatgccaaaactgatcgacgatatatatatgaatgcgcatatgcatgcatgcaggagctacttcaggtgcacgcacagcaactgccgcgtgaagaagcgggtggagcggctgtcgacggactgccgcatggtgatcaccacctacgagggccgccacacgcactccccctgcgacgacaactcctccggcgagcacaccaactgcttcagctccttctgaagattttagcactttgcattttcgtcgttgatccatccatcaatatatataccgtcgtatacctatatgtccaccgtttgatcgattaactgtggctagctctagctctctttcattttgatggttgagatatataggcgacgtaatatcgagccatgcctgcgcaatgtaccagtactgctagctatacgtgagatgtattgcgtgcatgcacgtacaatttacaagcagcagtcaataaattaagctatgtatttcttct

SEQ ID NO: 5306 - DNA, 1124 bp, Oryza sativa
  Predicted polypeptide sequence is orthologous to G181
aacctgcgccgatcgagatatggagaacctccagctccagggagatgatcacgacgacgaagcgctccctcacttcccctacttcgcggtgccgtcaccgccgccgctcgccgtcgcgccggcggcatcggcgacgacgtcggatggtcaccagcacggcccactcgaggtgctcgagcagccgccgtgtagtaataacctgcatcccgatggcctggtcgatggccctcagctagcggcgacgacggcggtgccgatgatgctgccggcgatgacgtccttggactggcagtcgctcctgcagacgtgcctgcaggtaccgcctccggtgctggagcagcagcaaccggcggcggcggcgcaggcggatcagtacagcggggagaacgatcacggcgatctgcaggcggccgagagcagcggggcaggtaacaaggagaagcaggtgatggcgaagggcggggcggggaggccgtcggggacgaagaagaaggcgagccggccgcggttcgcgttccagacgaggagcgacaacgacatcctggacgacggctaccgatggaggaagtacgggcagaaggccgtcaagaacagcaagcaccccaggagctactaccggtgcacgcaccacacgtgcaacgtgaagaagcaagtgcagcggctcgccaaggacacgagcatcgtggtgactacgtacgagggcgtgcacaaccacccctgcgagaagctcatggaggccctcacccccatcctcaagcagctccagttcctctcccagttctaattaacgacccatatcgatcggtctcggtcggtctcaaactctgaaatgatcgatctttcaagttgctacacaaacacaataacacacattcacgtgtacatatatacctgcaacaaattaaactctctgtttagcttggggggaagaaaaggagaacaatgtggcctacctcccccgtctcccgtcaatacagtacaatatactgctagttgatcatgtatgtcgtcatactgtatatacgtactccctgtacgtgtatccttgtatattttcatatgtacgctaagcttacgcatatattgtatatgtgacacaaataatgcccccggaaagttaaaat

SEQ ID NO: 5307 - DNA, 1606 bp, Oryza sativa
  Predicted polypeptide sequence is orthologous to G184, G186, G916
agtcttctcttctctatcttctccgcctccgggaagaaggacaagaggagtaggagctccagttgcatggacaagggccacctcggtggtggcggaggaggaggaggtgggctgctcgctctggacgcgtcgccgcgcccgctcggcttcttgaacctgctctccccgccgccgttccacaggtcgaccatggaggccgacgacagcggcggtggcggcggcagggcacgcaggtccgtcgaggtggacttcttctccgacgagaagaagaacatgaagaagagccgtgtctcgggcggcgtcgccgccgaggcggacgacgccaagggacccgccgccgccggcctcgccatcaagaaggaggacctcaccattaaccttcttcccgccgggaacaacgcgaggagcgaccggtcgatggtggtcgacgacgacgcggcgtcgcggccggatcacgaggagaagagccggagcagcaacgagctcgcggcgatgcaggcggagctgggccgcatgaacgaggagaaccagcggctccgggggatgctgacccaggtgaccaccagctaccaggcgctgcagatgcatctcgtcgcgctcatgcagcaaaggcctcaaatgatgcagcctccgacccagccggagccacctccgcctcaccaggatggcaaggccgagggcgcggtcgtgccgaggcaattcctcgatctgggcccgtcctccggcgccggcggcgaggcggcggaggagccgtccaactcgtcgacggaggccggcagcccgcgtcggtcgtcgtctaccggcaacaaggaccaagaacgtggtgacagcccggacgcgccgccgggcgcgccgaacgccgtgccgctcaacgccgcgcggccgggcgcgccggcgccgcagttccaggtgccgctgccaggcggagggatggcgccggcgttcgccgtgccgccgcaggtgctgtacaaccagtccaagttctccggcctgcagatgtcctccgattcagccgaggccgccgccgccgccgccgccgccgcgcagttcgcgcaaccgaggccgccgatcgggcagctgcctggccctctctccgacaccgtcagcgcggcggcggcggcgatcaccgctgaccccaacttcacggtggcgctcgcggcggcgatcacgtccatcataggcggccagcacgcggcggcagctggcaacagcaacgcgaacaacaccaacaccaacaccacgagcaacaccaacaacacaagcagcaacaacacgacgagcaacaacaccaacagcgagacgcagtaaaaacgagttcggatcagtaattttcacatagatttccaagtttttactcttctttgttcaggataggttcttgatttctctcctttggtttcgatagctcggccgagctgtgcagtgggcacatggtatacactttcttttttcttctccactttcctggttttgcagcagcaaaaagttgtattaattcattgctttttcttagttctttttctaccgcaaaaacagctgttgatacttcgcagtaagtaataatcagtacaataataagtataataatagcatcttcctgagaatt

SEQ ID NO: 5308 - DNA, 373 bp, Oryza sativa
  Predicted polypeptide sequence is orthologous to G184, G186, G916
ggactgaaggagtagaaactgccgtgccggaaaccgagggtgtccgtgcgtgcgcgatccgaagcaccaatgattagtgatgggtgccaatggaggaagtacgggcagaaaatggcaaaggggaatccatgcccgcgagcgtactaccgatgcacaatggctatcggatgcccagtcaggaagcaggtaactaaattaatatatatgcattctcataatatgcgttttcttgtgtagctttaattagcatggcgctatatataaaaaccagctgaaattggaattcatatattttttaaaaaaaaaaaaaaaaaaaaaaaaaaaaaaaaaaaaaaaaaaaaaaaaaaaaaaaaaaaaaaaaaaaaaaaaaacc

SEQ ID NO: 5309 - DNA, 1908 bp, Oryza sativa
  Predicted polypeptide sequence is orthologous to G184, G186, G916
atgctgacctcaatatttcttccctattgcacacctgcatcggcgctcgtaccgccggagatcgaatccgagataaccgtagtagtggcgatcgatcgacacgtcgagcggcggagtggacgtgtacggtgcaccgtccatctgcccgtgcaaatgtacacaaaacctctttcatcaagctacgtggtgtgggcgagtgacagcgcaacggtggatggatggatgatggatgttgaaaaccggtcgaccatggaggccgacgacagcggcggtggcggcggcagggcacgcaggtccgtcgaggtggacttcttctccgacgagaagaagaacatgaagaagagccgtgtctcgggcggcgtcgccgccgaggcggacgacgccaagggacccgccgccgccggcctcgccatcaagaaggaggacctcaccattaaccttcttcccgccgggaacaacgcgaggagcgaccggtcgatggtggtcgacgacgacgcggcgtcgcggccggatcacgaggagaagagccggagcagcaacgagctcgcggcgatgcaggcggagctgggccgcatgaacgaggagaaccagcggctccgggggatgctgacccaggtgaccaccagctaccaggcgctgcagatgcatctcgtcgcgctcatgcagcaaaggcctcaaatgatgcagcctccgacccagccggagccacctccgcctcaccaggatggcaaggccgagggcgcggtcgtgccgaggcaattcctcgatctgggcccgtcctccggcgccggcggcgaggcggcggaggagccgtccaactcgtcgacggaggccggcagcccgcgtcggtcgtcgtctaccggcaacaaggaccaagaacgtggtgacagcccggacgcgccgtcgacggcggcggcgtggttgccgggacgcgccatggcgccgcagatgggcgccgccggcgcggcgggcaagagccatgatcagcaagcccaggatgccaacatgaggaaggcccgcgtctccgttcgcgcgcgatccgaagcgccaatcatcgccgatgggtgccaatggaggaagtacggtcagaagatggcgaagggaaacccttgtccacgcgcgtactaccgctgcaccatggccaccggctgcccggtgcggaagcaggtgcaacggtgcgcggaggaccggtccatcctgatcaccacgtacgagggcacgcacaaccacccgctgccgccggccgcgatggcgatggcgtccaccacgtcggcggcggcgtcgatgcttctgtcggggtccatgccgagcgccgacggcgccgcggggctcatgagctccaacttcctggcgcgcaccgtgctgccgtgctcgtccagcatggccaccatctcggcgtcggccccgttcccgacggtcacgctcgacctcacccacgcgccgccgggcgcgccgaacgccgtgccgctcaacgccgcgcggccgggcgcgccggcgccgcagttccaggtgccgctgccaggcggagggatggcgccggcgttcgccgtgccgccgcaggtgctgtacaaccagtccaagttctccggcctgcagatgtcctccgattcagccgaggccgccgccgccgccgccgccgccgcgcagttcgcgcaaccgaggccgccgatcgggcagctgcctggccctctctccgacaccgtcagcgcggcggcggcggcgatcaccgctgaccccaacttcacggtggcgctcgcggcggcgatcacgtccatcataggcggccagcacgcggcggcagctggcaacagcaacgcgaacaacaccaacaccaacaccacgagcaacaccaacaacacaagcagcaacaacacgacgagcaacaacaccaacagcgagacgcagtaa

SEQ ID NO: 5310 - DNA, 1785 bp, Oryza sativa
  Predicted polypeptide sequence is orthologous to G184, G186, G916
atggagctcaggccgccgccgcccaagcaccaccaccaccgccgccgtcgcggcggcggcggcgaagacggcggggaggaggaggaggaggagactggccgcctgtcgctgcgcggcggcggcttctggcggcgccacgacggggaggaggaggaggagaagggcggcgggaggaggggcgagatcaaggaggtggacttcttcttgggcgccagcggccgcgatgtcgtcgtggcctcccggcggcacgacgacggcttccgcgggacgacgcatggcggcggcggtggcggcgacgtcaacatcgggctagacttgctgaccaccaccaccgccggcgcggcggcgggtggtgcggcggccggcgccggcgaggaggacacggggaagaatcatagaaaggaggcgacgacggcggcggtggatgtggagctccggcgagtggtggaggagaaccggcggctgcgggggatgctggacgagctcaaccggagctacagcgcgttgtaccatcagtatctgcaggtcacgcagcagcaaaaccatcgccatcctgatcatcacctgattatgaacaacaacaacaaccggccttcactagctcaaacacaccggaccgcggcgacgacgacggcgacgacgcagcaattcctggagccgcgagcgtcgtccacggcgcaggccaccgccgacgcggacatggcagcgtccgacgacgaggccggccgcggcggcggcgacggcgacgcgtcgtccccttcgctgagcaacgccgccggcggcggcggcggcggcaacaagatgaggagggttggtggtcaagacgagactgcggcggcggcgccggcgagggagaacggcgagcagcaggcggcggcggcggccgagctgccgtgccggaaaccgagggtgtccattagtgatgggtgccaatggaggaagtacgggcagaaaatggcaaaggggaatccatgcccgcgagcgtactaccgatgcacaatggctatcggatgcccagtcaggaagcaggtgcaacggtgcgccgaggacaagaccgtgctgatcaccacctacgagggcaaccacaaccaccagctgccgccggcggccaccaccatggccaacaccacctccgccgccgcggccatgctcctctccggcccggctgccagccgcgacggcgccgccgccgccctgctcggccaccaccaccaccaccacccggcggcgatgttccaccagtccttcccctacgcctccaccatggccacgctctccgcctccgcgccgttccccaccatcaccctcgacctcacgcagacgcctgccggaggcgccggcgccgccagcctgctgcacgcgctccaccgcccgccggtcatccaccctggtgcggctgcccaggcgatgccgttcgccgtgccgccgcagctggcgatgtacctcccgcagcagagggcggcggccgcggggctgggcggcgccggcgccgccaggcagccgtcggtgatggagacggtgaccgccgcgctcgccgccgacccaaacttcacgacggcgttggcggccgccatctcgtccgtcgtggcgggaggggctcatcatcaggctctgtccaccacaccccgtggcagcgccgccggcgccggagacggcaacggaaacgggagctccgccgcggccgtcgccaccggcgccgcctcgccggcggcgacggccgaggcacctgcggcgtccggatcacctcctcggctcgcgacgcagtcctgcaccacgtcgaattga

SEQ ID NO: 5311 - DNA, 1521 bp, Oryza sativa
  Predicted polypeptide sequence is orthologous to G185
acttcactgcacggcgtcgcggttttcccaagctgagagttgtcgtgcgagagtgaggagcatggcgatgctggggagctcgtcggcggtggtgctggagctgatgacgatggggtaccagtcggcggcgtacctcggcgagctgctccgggcggcgtccccggcgcaggcaggggatgagcagcaggagctcgccgcggagatcctccgctgctgcgaccgcgtcatcgccgagctgaaccggggaggagccactggtgctactaccggcaagaagcggaaggcggcggagtccgccgccgccgccgccgtgacctccccttctctccccgtcacgccgaccaaaagaagggcgcgtggcgcggaggcggtgagggaggtgaggagcggcacgacgacggacgggttcatctggaggaagtacgggcagaaggagatcaatggctgcaagcacccgaggctctactaccgctgcgcgttcaggggccagggctgcctcgccacgcggcgggtgcagcagtcgcagtcgcaggacgacccggccgcggcgttcgtgatcgcctactacggcgagcacacctgcggaggcgacgccgccgccgccgccgcgtgccgggacggggaactaatgccacctgccgtcatcaactccggcgcgtcgagcttcgccgccgcttggaacatggcctcgcgtgagccggcgtcgtcgctcgccgtcgagcggaggagctgcgacggcgacgctcccagcgagacgtcgcaggggtggtctccctccttctcgtcggaggtggagctggacgtggtgggattcgacctcgccggagccgactcgtcggcgtcgccggtgtgggagttcttgaatggcagcttcgactgggaattcgtcatcaactccctctgaattttcgatgcttcgtgatcagtagcacaccagctgccccaagagtgcagtagtctttgcaaaacgcacaaaatttcgcgggaactatcgaatttcccgcgtttgcgcttaagttaatagcctcagtagttcgtcagataatcgcacgcactattttaattcaggaagggatttagattgacaaagtatattaggtgagagttaatatgggagaattcgtaatgaagagttgaatgtgttgacgttgacgtacaggggaaaaacacatgctaagaagaaaaatggcaggtgaaaggggcaagaaatggcaaagctgagcaacagagcaggtaataatagagaattgctactcctactacttgcaagcatatatgtccagaagagcagccaaagagaacacaagaccgtcagcttgacgcataactgacgcacttctgatggtaacaaaaaaccggccaccatgtcccatgtgaacgaatggattcattagttgtaataatggtaatagtagtgacactcaattgcaatatcatgcttggtacagggttaaggatcagatggttagtttaaccaccaatagcaacaagctgaaacgaatactggttttgctggatttc

SEQ ID NO: 5312 - DNA, 1492 bp, Oryza sativa
  Predicted polypeptide sequence is orthologous to G187
acataagctagctccccatactctcacaccccatgtcttctggaggaggaggaggaggaggaggagatcgccatggcccctaccaccagcacgggcacctcggccgcggcgaaggcgctgattacgtgtacagcagcagcgacatggagagcttcttcttcagccaacccgggggcgtcggcatcggcgggggtggtggtggcgtcgtcggcgccggcggtgccgacgagatcatgccgtactccagcatcacggactacctgcaggggttattggacccctccgggctagctcggcacctcgacgtggcgtgcccgtcgtctcaggacacggtggtcaagcaggagctgtcggtggatgtgacgagccacgacagccagggcaccggcggcgtcgccggagaaggcgtcgcgcaggccacgccgaactcgtcggcgtccttctcgtccagcgacggagaggcggagggcggcaaatcgtcacgccggtgcaagaagggtcaggcgaaggcggaggaggaggacgacaaggatgaggaggatggagagaactccaagaaaccgaacaagcccaagaagaaagctgagaagaggcagcggcagcctcgcgtggcgttcctcaccaagagcgaggttgatcacctcgaggacggctaccggtggcgcaagtacggccagaaggcagtcaagaacagcccatacccgaggagctactaccggtgcacgacgcccaagtgcggtgtgaagaagcgggtggagcggtcgtaccaggacccctccacggtgatcaccacgtacgaagggcagcacacgcaccacagcccggcgagcctccgcggcggcggcggcggcgtcggcatcgtcggagggcaccaccaccaccacctcttcatgcccggcgtgcatggcctgccgccgtcgcacctcatgccggcggggttccaccctgagctgatgggcctcatgcaccaccacccggccatggccgccgccgccgcaaaccctagcatgtacttcccgggcgtagctgcttctgctccgccgcctcctgctgtggctggcggcggtgcaatgccgcccaacgatcatcctcctcttcagcagcatcacttcactgactacgccctgctgcaagaccttttcccttccacaatgcccagcagcaacccatgatgatgactgatctaactgattctgcacaaatatatactactcaatatttaactagcacccggaatttatcaagatgcttttcaaacattggagtcgttgcgccaaaaatgtgatggctagggagtgcttgatgatcagcttggtcttgagatggaagctacaactttataactagaacggctgcattccacttgattcttcagcatagccctttactgttctgcacctctagacttattgtacatgcatgtactagtgtatatcatgtgtacctcattgactcattttcggagagagcaaattaattaatatttcgtctc

SEQ ID NO: 5313 - DNA, 1064 bp, Oryza sativa
  Predicted polypeptide sequence is orthologous to G187
caactatacaagatcttcagcagctggctccctccatttaggttgcaactgacatgcaactacctgagttctacgtacggtgaccaccttctcccatggcatcaaattcacagactaccacaacaggggccggaggagggagaggccaaggcgacgacgaggagccgacgccgacgccgccacctgcgccgccgccggagacagcgccatccactgtcggcggcggcggcgacggcgttcagctagtgatgcccgaggacgggtacgagtggaagaagtacgggcagaagttcatcaaaaacatccagaaaaacaggagctacttccggtgccgggaccagcggtgcggcgccaagaagaaggtggagtggcacccgcacgaccccggcctcaacctccgcgtcgtctacgacggcgcccaccaccacggctccccctcgtcggccgccggcgaaggaggcacctccgctgccgccgccgccaaccagtacgacctcagcacgcagtacttcggcggcgccggcgggccccgctcgcagtgagcaacggtggctggccaagaacggctaattctctcttcttccatgtacgtactacgtcttgatcagcgtctctctcgccggagtaactagcagggcgcgagcggggggtggggcccacggcggcgaccggcggggcgacgccggccggccgccatcgatcagatgcctacgtgctttgcaacttgcaagtggcgggtgccggttgaaggcttgcgccggtagctgtgtgcaatcgtgacgttgaccggcaattatagagggtcaacgctgttggacgccagccagccgtgcgtgcatgacgattattagtagagttaattaattaagcacctgacgctggcagctagctgtcacgtactagtactactggtagattagctagactgaatattagtagtaactagtgctattgttttctttagataatggattaattagtggttaattactagtactactacacatttcaacacatatgtactggtagtagttattatatggagtaacattggtagctctctt

SEQ ID NO: 5314 - DNA, 1715 bp, Oryza sativa
  Predicted polypeptide sequence is orthologous to G188
agatgcaaagtctctctcaagcttgcctaggaaatataaaaagagagagaaaaaaaagggttgttttgatcagccaagaactggaaggatttgatgctctcctactgctaccattgctaaacaactaatttttagtatgctgctgctgatggtgatgatgacgatgattaatggcggattaattggatgctctaatctcttcctccctcttcctttccctttcctttttcttgcgagctgatgagctaaaaaaagctaagaacggcgcggcgatctgtgcgagctagctgccggcggcggtgggctccgtccatggcgagggcaagaagggctcgtcggcgatgtcctccacgagcagctcttcctcctcctcctcctcctcgtcctcctccatggacggcgtccgcagcggtgtggtcggggagagccccgccgcctcggctccaccacccccggcgccgaccaccaccaccgacggcggcggcggctggggctgcgcggaggcggcggaggcggcggaggaggaagggagcttgttgcgggtggtgccggcgagcgagttgcggtgggtgggcgccgagtggttgtgctcgccggtgtaggtgaggatgaaggtgttggggtcggagcggctcctctccacctgcttcctcgccgggcaccccttcgagctactgcaccggtagtaccccctgttgcaacaaaaccatagctccggaaggagatgaggagttcagctgctgccatttctggcgaggtgaaaaagagaagctcgctcacctcctcttggatctaggcacgccgccagctggcacctgcctcgccgccgccggctgcgacgccctcgccggagccgtcgtcggagccggtagattctcctgcaccgtcaccggtttctgctgctctggctgcggctgcgtcggaggaggaggaggaggcgtcggcagaggcgacgacttcgacgaggaagaagaaggaaaggcggcgcagaacgccttgaggagctcgtcggcgtcgcggccgagcccgccgccgccgccgtccctgaccgtcagctccgggaagctccacgcagcctccaccccgacctccttctccgccgcaacctccatcgccaccccctgctgcaagaacgacgcgaacggatccacctgctgcgccaccgccgccggagagatcctccgtcggcagcagccgaggcggacgacggcgtcgaggtcccagttgttgccgcagagctcctcctccatggccgtcgagaagaaatcaagaaaatcctcaagaggaggaggtggtggtggtggtttcttgggctctagagaggagataagagggaggcgctgacttttgctagtttattgattgatttggaagagagaaggagactatgggaaagggtaaaaggagagagagagagagaggaggaatggtggtgatggcattggatcctgccctaaaaaggagtgagggctactggtctattttcttgggttttttttttctttttcttcttggagggaggctggttttataggggtgtgggggcagcacaccccccacttgactctgcagcatgtcaaaggggtgagaaaggggatactccatgggtgggaggggtataatgggaaaagctcactgtgattttttttggacttttcttggagaaaatgtatacctcctgtattggatttaagaaaatgggaggtgatcagtat

SEQ ID NO: 5315 - DNA, 1841 bp, Oryza sativa
  Predicted polypeptide sequence is orthologous to G188
gattcctcctctctctctctctctccttttaccctttcccatagtctccttctctcttccaaatcaatcaataaactagcaaaagtcagcgcctccctcttatctcctctctagagcccaagaaaccaccaccaccacctcctcctcttgaggattttcttgatttcttctcgacggccatggaggaggagctctgcggcaacaactgggacctcgacgccgtcgtccgcctcggctgctgccgacggaggatctctccggcggcggtggcgcagcaggtggatccgttcgcgtcgttcttgcagcagggggtggcgatggaggttgcggcggagaaggaggtcggggtggaggctgcgtggagcttcccggagctgacggtcagggacggcggcggcggcgggctcggccgcgacgccgacgagctcctcaaggcgttctgcgccgcctttccttcttcttcctcgtcgaagtcgtcgcctctgccgacgcctcctcctcctcctccgacgcagccgcagccagagcagcagaaaccggtgacggtgcaggagaatctaccggctccgacgacggctccggcgagggcgtcgcagccggcggcggcgaggcaggtgccagctggcggcgtgcctagatccaagaggaggaagaaccagcagaagaaggtggtgcggcacgtgccggcggacggcgtgtcggccgacgtgtgggcgtggcggaagtacggacagaagcccatcaagggctcaccctacccaagggggtactaccggtgcagtagctcgaaggggtgcccggcgaggaagcaggtggagaggagccgctccgaccccaacaccttcatcctcacctacaccggcgagcacaaccactcggcgcccacccaccgcaactcgctcgccggcaccacccgcaacaagctcccttcctcctccgccgcctccgccgcctccgcgcagccccagccgccgccgccgtcggtggtggtggtcggcgccgggggtggtggagccgaggcggcggggctctccccgaccacaccgctgcggacgccgtccatggaggaggacgaggaggaggaggaggaggaagagctgctcgtggaggacatggagatggccggcgaggacgagctcctcttcctcaacggcggcgacgacaacgccgcattggatggcacccccatgtcctccctcttcgacatcgccgacgagcccttcttgccctcgccatggacggagcccaccgccgccggcagctagctcgcacagatcgccgcgccgttcttagctttttttagctcatcagctcgcaagaaaaaggaaagggaaaggaagagggaggaagagattagagcatccaattaatccgccattaatcatcgtcatcatcaccatcagcagcagcatactaaaaattagttgtttagcaatggtagcagtaggagagcatcaaatccttccagttcttggctgatcaaaacaaccctttttttctctctctttttatatttcctaggcaagcttgagagagactttgcatctcttcttttctttcttttttttttcttttcttcaccttaggtgtctggttttttttttttacatttgtaaatagaaagtggtagatgatgaaccaacaaaaggagatgaaacaaaaggggaaaaaaagatgatggtgtgtatcatgtagtactatctctctgcatggatgcagcaggggtgctttgctcttcttggctcttcctttctctgttcaacaacctaacctttctgcatgtagctcccttgggatgtttgtaagcttgaagaagagagaaagaagctccctctaatggc

SEQ ID NO: 5316 - DNA, 1077 bp, Oryza sativa
  Predicted polypeptide sequence is orthologous to G190
atgcaggcgcaatcccgcctcgctgctgccgcgagcggcggcagcggcagtggaattagcgggagcggtggcattagcaggttgggtggtggagcgggggaggagcacgaggcggtggtgagggagctgacgcgcgggcacgagctgacggcgcggctgcgggcggaggcgctgcgggcgctgcgcgggcaggggcaggccgaggccaccgctacattcatcctcggggaggtctcccgcgccttcaccgtctgcctctccatcatggccagcgcctccccgtccgcctcgccgccacaaccggacgagacgccgccggccgactcagccgtctcgccaccaccaccgcgcgcggcgagagaggacaacgtcccgcgaaagagattattgacagcctctccttacgacgatgggtaccagtggaggaagtacggtcaaaagaagatcaacaacaccaacttcccaaggagctactacaggtgcagttaccaccgggagcgcagatgccccgcgcagaagcacgtgcagcagcgcgacggcgacgacgtcccggcgctgcacgtcgtcgtctacacccacgagcacacgtgcctgcagggggcgcccgccgagcttcccgacgcggcgacgaacggtggcgccgccgccgccgcgtcgccggactacttccccgccggcggcgagacgccgtcgtcgctgcggcggctccggggcgtcggcggcggcggcctgcagcctcagttcgtggaccaccgcgccgccatggaggagcgcgagcgccaggtgctcgtctcgtccctcgcccgcgtgctgcaggggcggcagtgctacgacgacgacgacgacgacgacaccgacgtcgcctccctcggcgccgtgcacgcgcgcgcgcctgcggcggcggcgccggtcgccgcgtcgtcgtcgtcgtccgggcccgtcgacgctgccggcgaggagctggacgtcatggactacgacatgacggacgcgctgttctgggggcctttcggcacggacagcaactcgtacgacggaaacctgacgtcgacacgctgttttgatctaattaattaa

SEQ ID NO: 5317 - DNA, 840 bp, Oryza sativa
  Predicted polypeptide sequence is orthologous to G190
atggcgtcgccgcggctgaagagggagcagtcgttcgacttcgaggaggcgagcgcgcaggaagccgtgggatccgcgtcggcgtcgtacagccctcccgggggcggcggcgtctttggcatctcgccgccggagtcctcgccgcgcgacggccggaagagaaggaaggatagaccatcattggtgaaacatacgttcacacctcattttgatggtcatttgtggaggaagtatggccagaagaacatcaaggactctgctttccctagatgctcttaccgtgaggacagacagtgccttgcctccaagctggtgcagcaggagaacgacgacgacccgccactgtacagggtcacctacacgtacgagcacacctgcaacaccacgcccgtcccgacccccgacgtcgtggccgagcagccgccgccgggcgccgccggcgacgcgtacctcctcaggttcggctcctccgctggcggcggcggcggcggcgctcatcagcagcagaccgagcgagaacgacagcagcaaaatacagcgagaagaaggccattcatgatgctgagcttcgattctagtagcagccatcagctgcacgagcagccgcacgcgttccctcccgacggccagctgccggccacggccgcggccgcgtcgccgtcgtcgttcacggcagccgaggcgttggcggcgccgccgctcacgacgacgatgaacgacggaggcgacctgttctcgacgtgggacgcgctcaggtatggtttggactatgaccacgggcaccttggtaaccatgtttatctccctgatgactgtaatggtggtgatgataattactga

SEQ ID NO: 5318 - DNA, 1387 bp, Oryza sativa
  Predicted polypeptide sequence is orthologous to G192
gagcttgccgacgtcggcgttcatgcgcggcccgctgctgctgcgcgccgtcgtcgtcgtcgccatggagcacttcaacgactgggacctgcaggccgtcgtgcggagctgcagcttcccgcaatcggagcctcctcgcgtcggcgtcggcgtccccgcggcgccgggagcgggcggggctccggtggtggtggcgccgcccgcgcgcgcaccggatggtccggatcagatggcgcgggcgtcggcgtcggcgctgtacgacctcgagtacctggatttggatcataagccgttcttgctgcccgggtcgtcgtcttcgtcgtcgtcgtcccgagcggtggcgcgggcgcgaggggaggatgacggcaaaggcagacacgaggtgatgatctctttccccgcggcggcggcggcctccacgtccggtgcgcagccgcggtcgccgtccggtcggaagccgggcatacgcaccccgcggcctaagagaagcaagaagagccagctgaagaaggtggtgtacgaggtgccggtggcggacggcggcgtctcctccgacctgtgggcgtggcgcaagtacggccaaaagcccatcaagggctcgccttatccacggggatactacaagtgcagcagcatgaaggggtgcatggccaggaagatggtggagcgcagcccggccaagcccgggatgctcgtcgtcacctacatggccgagcactgccaccccgtgccgacccagctcaacgcgctcgccggcaccacccgccacaagtccgcccctaccggcgacgacgacaagccgacgtcgccgggccctgcagccggcagagcggccgccggcgagggagtggtcaagtgcgaggacgtcgacggcaacgagctgtcggcgatggccgcggatggcggcgcagaggacacggcggcggcggcggatgacgacggtgagttgtggccggaggggatggggctggagctggacgagttcttgggtcccatggatgacgacgtgttcgagttcgaccatgtcttggaggacgacggcgtgctggggcgacggctctcgctatagctgcaagagaaaagctgtactagctagctttgacgagccttttaggacagttgactgtcagctccaacctcttcaggagatccaagccatgtataggcggtttttattcgtgcgtgtttgtggcatgatctctctcaagtcaaggttccaagtttcaaatttgcacaagtgtatatacttgtaatattcgcagggatgtcagtgcgcattgacacttttgcattcctgtacataattctcgtggttggtgactttgtcccaacacgtggaccgggctcaaagggaagtgacagcttcagtgcagtttgcctgcttgcc

SEQ ID NO: 5319 - DNA, 930 bp, Oryza sativa
  Predicted polypeptide sequence is orthologous to G192
atggagtactccaacgattgggatctccaggcactggtcaggagctgtggcacggccgtcgccgactcggagccggagccgccggcggcgccgtcgacgacgcggcgggctgaagccgaaaccgtcttcgttggccgtgctggtggggtgccggagttcgttgggcaaccggtgaggtcgtcggcggcatcgttttacgacttggagtacttggacctgtaccacgagcggcctcgggcgccgttcttggtgacggcgccgtcgacgagccgcgagcgtggggagggcggcgagcatgaggtgctcatctccttcccggcgattgcctcgacgtccgggcagggtaggaagcagcctggccggaaaccgggcgttcgtactgccaggcccaaaagaagcaagaagagccagctgaagaaagtggtgtgcgaggtgccggttgccgacggcggcgtctccaccgacctttgggcatggcgcaagtatggccagaaacctatcaagggctcgccgtatcctcggggatactacaagtgcagtagcctcaaggcgtgcatggcgaggaagatggtggagcggtcgccggagaagcccggggtgctggtcatcacctacatcgccgagcactgccacgccgtgcccacgcagctcaactcgctggccggcaccacgcgcaacaacaagccggcgtcccctgaccagcagcagcagcagcagccgtctcccggcggcgcgtcgacggacgaggcggcggcggcggcggccaagacggaggacagcgccgacactacgtgctccatggcggacgacgagaacgacctctgggcgccggtggagatggatatgaacgatttctttggccccttcgacgatgatctcgaccactttttggatgacgacgccgttcttggacgccggctgtcgctctag

SEQ ID NO: 5320 - DNA, 673 bp, Oryza sativa
  misc_feature (72)..(72): n is a, c, g, or t
  misc_feature (130)..(130): n is a, c, g, or t
  misc_feature (294)..(294): n is a, c, g, or t
  misc_feature (351)..(351): n is a, c, g, or t
  Predicted polypeptide sequence is orthologous to G194
tgggcgccaaagtacggcaagaaagtccggtccaagaaacagccccaacccaaggaactactaccggtgctngacggaaggggtgcaacgtgaagaagagggtggaacggggacaaggacgacccgagcnacgtggtgacgacgtacgaggggacgcacaaccacgtgagccccagcacggtgtactacgccagccaggacaccgcctccggccgcttcttcgtcgccggcacgcagccgccaggttctctcaattaaccgcgcgcgtacggttaatttgatcgatcgggtcanccatgggacttttccaatgctagctagctaatagtgtaggtgttctgggccggattnttgatcgagatagcagcctcttgattgagatgcccagatgggtcattttggatgtagctggatctttttttccccttttcttctctcgatctctgtcccgtcctttttgcctgtttcgatcattggaaggccgggccggcctggctggtttgcagcgatagtgatcaaatgctgtgctgctgtgtttctgtgctcttgaggatcctcccaactatcccccttgagcctaggtaatatagccatgggaaatgtaacatatatatactgtttaaccgtgcaataaaaatgtacagagcttgaaaaaaaaaaaaaaaaaaaaaaa

SEQ ID NO: 5321 - DNA, 1776 bp, Oryza sativa
  Predicted polypeptide sequence is orthologous to G194
cgcctttgcaaaactcctctcatttcatttcctcccaagagtcaagctagcccttcttgcttgctccgttcaacgcctcttccccagcttcacagtactccatgtctggacctggaggaggaggtcatggcctctacgaggatcatcctgcagccgccggcttcctccccttcgaccacgacgacgacgtggtggccagcttcttctttggcagatcggcggcgtccggaggaggagccggcgccggcgccggcgctggagacgatgatggtgttgggctcatcacgccctactccagcatcacggattatctgcaaggcttcctgcaggaccccgtgtacgcgtcgtccccgttgggcggcgatgctgccgtgaagcacgaaacggtggtggatcatcccagtcaggccggcggcgtggcggcggcgccggccacgccgaactcgtcggtgctgtcgtcgtccagcgaggcggctggaggggacgatctgcgccggtgcaagaaaggtcgtcggccggaggacgaggaggaggaggagattgacgatgagggatcggccgttcagagttgcacgaacaaaatgaagaataaaaaaggggcgaagaaggagcgtgagccacgtgtggcgttcatgaccaagagcgaggtcgaccacctcgaggacggctaccggtggcgcaagtacggccagaaagccgtcaagaacagctcctacccaagctactaccggtgcacggcgccgcggtgcggggtgaagaagcgggtggagaggtcggagcaggacccgtccatggtgatcaccacatacgaagggcagcacacgcacccgagccccgtgagctaccacatgcacaggcagcaggggctcatgcatgtgagcgcgcgcggtgtcatgcccggcgccgccggcgcctaccagttcggcgcgccgccgccgccgctccttggcttcgacgaagccctcgccgctcggtcccaggacacagtgctggtatcacaggaagacagattatcacagcaacagaggtctctttattatagagtagatgtacagtcatgttgggctgcggacagatcccgagctcacaactgcattacaaaagggaaacggaagccgggacttggaccaaacaacacaggcgcgacttgggaactaggccgaaaccctaaaactcatcgtagccggcttgctcctggaagaactcctcatcagcaggatccgcttcgtcttcttcagcgactggggggggattatttatatagagcaaggaggggggtacactttacccacacgacattactaacccggatcacccagcccgtggggatcagccacgtcgggagacctccaagctttcatgacaaggcatttccaaagccgatacaggtttaccatatgccgacgagaggggtcccagaccaacaacaggaatcggttcttaagtgcgagagcgggaaaaccgtacacccggctcaagatgttcaaaggtggcttgccttgctcgagatctggagcttgatcctcgaaatcctcgcactgcgggtcttcgggctccggaactacacgcgaaacgggacaactcaacaaacggcgaaaatgaagccctaataatgacctctaagcgtgccattagatagatctcgagatttgaggaattttggaagttgaacggagtcaaacggatctacggttgggaagatattgaatttctaagattattggatttttggtctaaaggaaaaggatttaattaaatcctttttggaaaagaaaa

SEQ ID NO: 5322 - DNA, 621 bp, Oryza sativa
  Predicted polypeptide sequence is orthologous to G196
tttttttttttttttttttttttttgtttgaaaagagctctcataatatcatagtcctgatggaatttacatatattgttacagtagatgttagtagtgcttgaagttgcatggggaagataatatctatgcctaaaattaagtgattggagataataaatcttaccaagtttattaaaattgagcacgtagtattacttacatgcattatatagacccccaaaaaagtcatgatagaataatttgtcattagcatttccctacaacagtgttcttgcatcaaagaagctgcactcttggaccacgaaagataagcttggcaagggagatgcagacactgggagctcctcaagctcatcaaagaagtcacagctctcctcttcaccggacagcttggaggatgcaactgttactacctcagcaagggacatgccattgctgagaggatcacttgtgtcaggattatgtgcctgttcttggactgaatttgtagtagtagcagcatagttgtcatggttgtgatctgaggtgtaggtgatgatgagcagagatgcatcattcctgcacttgtctacttgcttcctggctgggcatccccttgctcgtcctctggctcaccta

SEQ ID NO: 5323 - DNA, 1533 bp, Oryza sativa
  Predicted polypeptide sequence is orthologous to G196
ctagctagctaagctagccatgtgcgactacttcctgcagaggatggagggcgaccaggccggcggcgacctcaccgacatcgtccgcgccgggggaggggccatgccggggagcgtcgtcgtcgacctcccgtcgacggccgccgagtggcagctcccggctgagccgatgctcttcccgccgccgccgtcgttgtcgtcgacgacggacggctgtggcgccgggggagcggcaggcgccgacatcttcggcggtggcggcggcgaccttttctccggcctcgtggacccgttcagcagcgactactcgtccggcgcggacttcttggacgccatgccggacgcgatggcgaaggtcggcttcgacacagctgtcgtcgccggcatgcagatgtcgtcgccgcgctccggcgggatcaagcgcaggaagaaccaggcgaggaaggtggtgtgcatcccggcgccgacggcggcgggaggaagacccagtggtgaggtggtgccttctgatctctgggcttggaggaagtacggccagaagcctatcaagggctcaccctacccaagaggctattatagatgcagcagttcaaaaggttgctctgcaaggaagcaagtagagcgcagccgtactgacccaaacatgctcgtcatcacctacacctcggagcacaaccacccatggccgacccagcgcaacgccctcgccggctcaacccggtctcaccacagcaagaacagcggcggcggcggcggctcgggttccaagggctctcagaacgacaagtcacagcagcagccaagcgttaaagaagagcagaaggatcaggcgacgacggcgacgacgacgaccaccagcacaatcactaccacgaatagtgcttctcctgtggttgtgaaggaggaagaggcggcactggcaggatcgtcggaagcattggagttggagagagtcatggacactactgcagctggagtagtagaccacagtgagctcatggatcatgttttcagtgagagctacaagccgatgataccggagactggccagccggatgatttcttcgcagacctcgccgagttggagtcagatcccatgagcttaatcttctcgaaggagtacatggaagccaagccaagtggtggcgatcatgcccaggagaaggcaatggccaaggaattggatccattcgacatgctagactggtctactactactaactcttcggcagggagctcatttgagcaagggaagagaggctaaacccatgggcataaagccatgcatgagggtttatgcatgcatacggttacataaacttgatcccagctaataaccataaagattgtgacaatgtcagcaaaggaaagatgagatttttttttttacttttcttttcttcatttggtctctctgcttcttcatattattgtgtgtgagaattaaattttgtttcaaggtctaggtatatggacctcattttttaggctgtgtcaacttgttgtacttatgcatgagatgatgaccactct

SEQ ID NO: 5324 - DNA, 1623 bp, Oryza sativa
  Predicted polypeptide sequence is orthologous to G196
aatcgagctggtagtagccggccagtagcactctgagtgcgtgcactactagtgctcctgcaggcaaggctggacgggagtgggagtgtgtgtaccagtactagctactagtgaatactgaataggcagcagcaacagcagcagcagctaattaagcatcagacagaaactagaaagagcgagcacgccactatggatatgatggaggaggaggctgccaacgccgccactgctcaagctgctgctgctggcgacctcgccgacgtcgtggcccgtgccaatgcacgcgcattcctcgtctccacccctcaccatcacccctcacctctgcatcctcttcctcctcctcccatgcctcaggcgcctcaccaatactatcccgccccccagatcaccatcccttaccaccaccaccaccacggagagcttcggcgccctaccaccatcgcttacaccgacgcacctgtgccgttcgagacggcggggccgccatccacggtcgtcgactcataccaccacctcacacccggcgacgccggctacgggatgccgcggccgcttgctctccagatctcccagcacgccctctgtggcggcggcgacgtggtgatgggcggcggaggcgcaggcgctgccgatgatggagaagaagccatcaggatctcgccactgacgccgtctgctcatcatcaaatgatgaaaaggaagaatgaggtgaagaaagtggtgtgcatcccggcgccgccagcgacgagtagccgtggaggtggaggagaggtgatcccgtctgatctatgggcatggaggaagtacggccagaaacccatcaaaggctctccttatccacggggttactacagatgcagcagctcaaagggatgtatggcgaggaagcaggtggagcgcagccgcagcgaccccaacatgctggtgatcacctacgcggcggagcacaaccacccatggccgatgcaacgtaatgtgctcgccggatatgcccgttctcatcacagtactcatgctactgcctccagcagccgccacaagcaacagcagcagcagcagaccaaccagctgcagcctgcactgatcacaagctcatcgtcttcttcctcctccccattcaatctctacgccgacgtcgtgctcggtggccaacaggccaacatgatgatgacgacggagggcgccggcgctggacttggcatccaaccttcagcagctgatgaggtctttgcagagctggaggagttggagcctgataatcctactatgatcaatgcaaacatgcaggtgtactccaccaccagcaggccaggggtaagcagctatgatcatcagtggcacaagttctaataattaaaccatgcagtacctatatatatatatatcagaacttcaatattcgagagaggagatcagaggaaattgaattctagcacgtacaattaatacatcatgactatgcaaaatttacatatatatgatatgatggtcgcctgtgcgattattagtgaccaaattaaagattgtcagagatataggcgtgtacttacgcttatatgtatcacgctgaggtatactgtatttacaagaagataaataaaatatccatatccctct

SEQ ID NO: 5325 - DNA, 1633 bp, Oryza sativa
  Predicted polypeptide sequence is orthologous to G196
tgcgagcgtcagagagagagagagagagaggaggtggtggtggtggtcagatcatcatgtgtgattacttcttgcaacggatagagggggagcaggccgccggagacctcgccgacatcgtcctccgcgccggcggggctgctgctgctgctgttgcgggcggcggcatcccgtcgacggagtggcagctaccaccggcggaggaggaggaggaagagccgggtctcttcccgctgccgccgtcgtcgtcggatggctccggcatgagcggcgcggatgcgttcggcgacccgttcgctggcctccccgaccccttcggtggcgactacccctcctctggcggagcggcggcggccgccgacttctttgacgccgtcgtggccaaggccgggttcgtcgacgtcggtgtcctcggtggcggcggcggcggtggctgcgatggaggtggcgttgatggtggtggaggagggtcgtcgctgctgggcatgagcaagcctatcttgcctagggccgccatgcagttgccgtcggtgtcgccgagggcgatacggccgtaccccgtgatggcctgtgacacggtgaagctcggcgcgccgatggccggcgggccgtgcgcgttcgacggcgccgccgcggcagggctgcacatgtcgtcgtcgccgcgtggcgccgtcggcgggatcaagcgcaggaagaaccaggctaggaaggtggtgtgcatcccagcgcctgcagcagcaggagggaggaccagtggggaggttgttccttccgatctctgggcttggaggaagtatggccagaagcctatcaaaggctctccttacccaagagggtactacagatgcagcagctcgaaaggatgctcggcgcgcaagcaggtggagcgcagccggaccgaccccaacatgctcgtcatcacctacacgtcggagcacaaccacccgtggccgacgcagcgcaacgcgctcgccggctccacgcggtctcatcacgccaagaacagcagcagcaacagcagcagcagcggcgcctcctcagcctccaagaacaactcctcccacagcggttaccaccaccaccaccaccagaagccactcgtcaaggcggaacccaacgatcaatccgccgccgccacgaccgccgccacggtgccggtgaaagaggaggccgccatggtagggacgtcgtcggaagcattggcgaagacgacgcagaaatccatggaggatgctgctgctgctgcttcagccacggcggcggcggtggagcacagtgatctcatgcagcagatgttcagccagagctaccggccgatgataccggaggcagcggccggcggccaccacgacgacttcttcgccgacctcgccgagttggagtcagatcccatgagcctgatcttctccaaggagtacatggcgaccaattacaagccagcaggtgacccagcaggcaaggagatgaatgcagtagacaagggcttggatccagcgtacatgctggattggtcttctaccactgttgttactagagctggtgggagctcatttatgcaaggggagggaggtttatgacattttaatcactttgaaacaaaaggcaaaagctagtatatgcgaatgcaaacacc

SEQ ID NO: 5326 - DNA, 900 bp, Oryza sativa
  Predicted polypeptide sequence is orthologous to G196
atgtgtgacagcttgttttggcagtcgtcggccgaccaaggggacctctcggatgtggtgagggccagccttcagctgcagacggcgcctcgccatcaggctgcatcgccgccgtatgtgcacctcttaggaggaggaggaggaggaggagaagaccagcttgcagcagtgagccaacacgctgagcagcagcagcagagcatggtggatgcttctgcagcttgcgaccttctccatgcgctgttgccaccaccaccagtagtgcaggtgcagcagcagggagcgtcgaggacgaggacgacgattgaggaggacaccaccggcgacggcgaggagttatttgctggtgctcattatgtcgttccgcccatcaagcgaaggaagagccagacgaagaaggtggtgtgcatcccggcgggggcgagtggcggcggcggcggcgaggtggtgccgtcggacctgtgggcgtggaggaagtacgggcagaagcccatcaaggggtcgccctaccctcgcgggtactaccgctgcagcagctccaaaggttgctccgcccggaagcaggtggagcgcagccgcgccgaccccacaatgctcgtcgtcacctacacctccgaccacaaccatccatggccaacccaccgcaacgccctcgccggctccacccgcccctcctcctccaactcatccaacatacgcctccaagacagtactccagttcatcatcagagtcagactggccacgatcgtcttacgaccactcacctcaagcaggaggacgtgatcatctccccctccctgctgcagcccgaccaccatcagctgtgtaccattattgacaccaagcaccacctcttgtttcatcaagactatcctcacagcttcggcttgttcgactag

SEQ ID NO: 5327 - DNA, 1545 bp, Oryza sativa
  Predicted polypeptide sequence is orthologous to G196
atgccgccttgcgtgtggggatcgcacacacctctctctcttctctcccccccggccgcttgggcgggcgagaggatggagggcgaccaggccggcggcgacctcaccgacatcgtccgcgccgggggaggggccatgccggggagcgtcgtcgtcgacctcccgtcgacggccgccgagtggcagctcccggctgagccgatgctcttcccgccgccgccgtcgttgtcgtcgacgacggacggctgtggcgccgggggagcggcaggcgccgacatcttcggcggtggcggcggcgaccttttctccggcctcgtggacccgttcagcagcgactactcgtccggcgcggacttcttggacgccatgccggacgcgatggcgaaggtcggcttcgacacagctgtcggcggcggctgcggcggcggcggcggaggtggtggtgggagcggtggacacctgttagacatgagcaggaagcctctcttgcccagagggatgccgatggcggccgtcggtgggctggcggcgccgagggtgatgccatcgccgctgtcgccgcgagccatacggccgtacccgccgatctccgcaggcgacatgatgaagctcggcatcacggcagggcaggcggccgggtgcgccatcgacgccgccgtcgccggcatgcagatgtcgtcgccgcgctccggcgggatcaagcgcaggaagaaccaggcgaggaaggtggtgtgcatcccggcgccgacggcggcgggaggaagacccagtggtgaggtggtgccttctgatctctgggcttggaggaagtacggccagaagcctatcaagggctcaccctacccaagaggctattatagatgcagcagttcaaaaggttgctctgcaaggaagcaagtagagcgcagccgtactgacccaaacatgctcgtcatcacctacacctcggagcacaaccacccatggccgacccagcgcaacgccctcgccggctcaacccggtctcaccacagcaagaacagcggcggcggcggcggctcgggttccaagggctctcagaacgacaagtcacagcagcagccaagcgttaaagaagagcagaaggatcaggcgacgacggcgacgacgacgaccaccagcacaatcactaccacgaatagtgcttctcctgtggttgtgaaggaggaagaggcggcactggcaggatcgtcggaagcattggagttggagagagtcatggacactactgcagctggagtagtagaccacagtgagctcatggatcatgttttcagtgagagctacaagccgatgataccggagactggccagccggatgatttcttcgcagacctcgccgagttggagtcagatcccatgagcttaatcttctcgaaggagtacatggaagccaagccaagtggtggcgatcatgcccaggagaaggcaatggccaaggaattggatccattcgacatgctagactggtctactactactaactcttcggcagggagctcatttgagcaagggaagagaggctaa

SEQ ID NO: 5328 - DNA, 1176 bp, Oryza sativa
  Predicted polypeptide sequence is orthologous to G197, G255, G664
ccgccgcggctcacctggaaactgggcagattggacaatcgctcgagcgagctagcgagagagagcgcgagagagcgaggcggcgcgcgcggtggttgcggatttgtagcttagagcgcggggccatggggaggtcgccgtgctgcgagaaggcgcacacgaacaagggggcgtggacgaaggaggaggaccagcggctcatcgcgtacatcagggcgcatggcgaaggctgctggcgctcgctgcccaaggcggcgggcctccttcgctgcggcaagagctgccgcctccggtggatgaactacctccgccccgacctcaagcgcggcaacttcaccgacgacgaggacgagctcatcatccgcctccacagcctcctcggcaacaagtggtctctgatcgccgggcagctgccggggaggacggacaacgagatcaagaactactggaacacgcacatcaagcgcaagctcctcgcccgcggcatcgacccgcagacgcaccgcccgctgctcagcggcggtgacggcatcgcggcgagcaacaagcggcaccaccgccgccgcatcccatatccgtcccggcgaaggcggcggccgcggcgatcttcgccgtgcgaagccgccgccgccgccgcgcccggtcgactcctcggacgacggctgccgcagcagcagcggcacaacgagcacgggggagccgcggtgccccgacctcaacctcgagctctcggtcgggccgacgccgagctcgccgccggcggagacgcccaccagcgcgcggccggtctgcctctgctaccacctcggcttccgcggcggggaggcgtgcagctgtcaggctgacagcaagggcccacacgagtttagatatttcaggccgttggaacaaggccagtacatatgagatatgaccatgagatgtgagatggcttaattagcttcaattcccaacatgtgtaacacagggagtttttctagtggacgacaatactgtttaatttcagaaaaaaaagggaaagaaaaaggttctaatctgttcatatttcttactattatccaatcttcatgatctcaatctctctctctctttattatttttctttgtagtaattaacttcatgttggttcctctaaaaaagattggtcgatgttattcagtgataaatattcctag

SEQ ID NO: 5329 - DNA, 1069 bp, Oryza sativa
  Predicted polypeptide sequence is orthologous to G197, G255, G664
cgccatggcgccaccatgcatataaactcgagctccctctcctcctcttcttcctcctctccactctccaccatcgtcttcgtcgtcgtcttcctcagctcggagcgatggggaggtcgccgtgctgcgagaaggcgcacacgaacaagggcgcgtggaccaaggaggaggaccagcgcctcatcgcccacatcaaccagcacggcgagggctgctggaggtcgctccccaaggccgccgggttgctgcgttgcgggaagagctgccgcctccggtggatcaactacctccgccccgacctcaagcgcggcaacttcaccgacgaggaagacgagctcatcatcaagctccacgagctcctcggcaacaagtggtcgctgatcgccgggaggctgccggggaggacggacaacgagatcaagaactactggaacacccacatcaagcgcaagctcctcgcccgcggcctcgacccgttacgcaccgcccgctcaatgccgccgccgccgtcgccggccaccaccacctcgcgccggcggctccagctgctcgcccgacgcaacaagcggccacagcagctgcagcgacggcgacgagtaccgcggcggcatcgacctcaacctgtccataagcccgccgtcgtcgtcgtcccagccgtcttccccgccgccgccgccgcacgaagcagaggcgagacgcgccggagcgacggcgagctacacctaccaccaccactactcggagacgagggagaagatatgcctgtgcttgaaccacctcgggctgcacggcggcgacgagtgcagctgcggcggctcgtcggcctcttcctcctcctcgccgccgccggcgacggcgagctcgcgagcgttcacattcgccaatgcatcgtcgtcaacagtgtaaaacacagagaaattcagcgattttcagactaagagaattaatgagaggtagagcacatgcatgctgaattaattgaattaactcaatccaagcttgagctaggcatctagctaactttgtgatttgatcatgatcagctagcaaaatcatcataatcatcatc

SEQ ID NO: 5330 - DNA, 600 bp, Oryza sativa
  Predicted polypeptide sequence is orthologous to G197, G255, G664
gccaacgcgaagctctcgtcgcgcacaaccaactcgacaccgcggcgaggccaaccaacgcgcggcgtgggcatggggaggtcgccatgctgcgagaaggcgcacacgaacaagggggcgtggacgaaggaggaggaccagcggctgatcgcctacatcaaggcgcacggcgagggttgctggcggtcgctgcccaaggcggcggggctcctccgctgcggcaagagctgccgcctccgctggatgaactacctccgccccgacctcaagcgcggcaacttcaccgacgacgacgacgagctcatcatcaagctccacgcccttctcggcaacaagtggtcgttgattgcggggcagctgccgggaggacggacacgagatcaagaactactggaacacgcacatcaagcgcaagctctgagccggggcattgacccgcagacgcaccggccggtcacgccggaacacgcccccccgggaaaacgggcttacacgacggcaacaccgcgcttttcgtccttggcccggggccgccgccgaagaagacaggctaaaacccgggcacgcccgggggccaacattgcagctttccaggtccgg

SEQ ID NO: 5331 - DNA, 1054 bp, Oryza sativa
  Predicted polypeptide sequence is orthologous to G197, G255, G664
aacagcagcagcagcagcagcagcaacttccactgaaacaacccaccgaggcagcagaagaaaggaaagaatcaagaaagcttcatcgtcttcatggggaggtcaccgtgctgcgagaaggcacacaccaacaagggagcatggaccaaggaggaagatgaccggctcattgcctacatcaaggcgcacggcgaaggttgctggcgatcgctgcccaaggccgccggcctcctccgctgtggcaagagctgccgcctccggtggatcaactacctccggcctgacctcaagcgcggcaacttcaccgaggaggaggatgagctgatcatcaagcttcacagccttttaggcaacaaatggtctctgatagccgggaggttgccaggaagaacggacaacgagatcaagaactactggaacacgcacatcaggaggaagctgctgagccgtggcatcgacccggtgacacaccggccgatcaacgacagcgcgtccaacatcaccatatcattcgaggcggccgcggcggcggcgagggacgacaaggccgccgtgttccggcgagaggaccatcctcatcagccgaaggcggtgacagtggcacaggagcagcaggcagccgccgattggggccatgggaagccactcaagtgccctgacctcaatctggacctctgcatcagcctcccttcccaagaagagcccatgatgatgaagccggtgaagagggagaccggcgtctgcttcagctgcagcctggggctccccaagagcacagactgcaagtgcagcagcttcctgggactcaggacagccatgctcgacttcagaagcttggaaatgaaatgagcacctcctcctctgtagtttcttctttcgttttgtcacttggatattggttagcttttcttctaggtgaaaacacacagagagagagagagagagagagagagagagagataacatctcctctgctgctcttgctgctccattttgtctctgttgtaattaccatatattgactaatcatgacaaataatacttgatgctaagt

SEQ ID NO: 5332 - DNA, 1037 bp, Oryza sativa; identical to SEQ ID NO: 1965
  Predicted polypeptide sequence is orthologous to G197, G255, G664

SEQ ID NO: 5333 - DNA, 2930 bp, Oryza sativa
  Predicted polypeptide sequence is orthologous to G197, G255, G664
attttcaaaatctctcggggggcaatggagctcaccgccgccaccgcgggagcgacccgtgccaccggaggattcctcgggaccagccgtcgccggccgcaatcgtgggcttttcagttctgcagggatatacatcagcactgctcaaatgaagcatcaatgcgtaccacagatagattagaagtacatatataaaagagattactgttggctggagcaaatgcatctgtgtgatacgatagtggtaaggcactctggttcaggatgacctgagcagttagcatcttttggacacacctctttagaaaacacaacctctcccagaatctgagtttcctgcttctgctgtacagtatttatcttcatcaaatatttgagaaatattgtcctagcaaggtagcacccgtgatgcaatggcaaagattcatagaagcttccaatccatatcgagcctaccatatcttcaagcttttatcataccagagtggcttggtcactatgacctggtgtttgcgcgtcttgtagtccctgtggtttcctttttcaaggtacatcaaaattaaaggaatggtaatcaatagatttgtcaaagaccatgactttggaaagtttatggtacttggacgagcaccttcagatgctcctgcaaggttatatatgcttgcacgcatgtggtgatacttcctttccatacccccaggcatgcaccatgcttcgtacattttctgaagactccaacactcctacataaccagctcagttcctctatcatcttacgtctgcatagagaggcttacactacacctggaaacaaatgaggatggccggcatggaggcttacttgttgcctagaagctcatggagcttgatgatgaactcgtcctcctcctcggtgaaattacctcgcttgaggtccggtctcaggtagttgatccatcgcagccggcagcttttcccgcaccgcagcaaccctacacacaggaagggacacgagctagcccaaggttttcaattggtccaagggattgctgttgcttgatggaagaaaaagtctgagttggaaacaaacttcaatggctcaacacccacttccacgttagtagattttttggggcacacatcagcagcacatggcgatgcttaatgggctcacccaccgacatttttctagcaccccacgctagctccccctcctttctgagattctagaaaacccagcagcatgtctttgtgtgtgtgattgtgcaagaaagaaagcaaagaaagggaaagggtgaagcaagaaaggggagaatctgatcaatttggtgagctaccccctccttccttcccgctcctaattcccctccctcttgatatggaggaagttgtgcacttgtttaacccgttactttattcttggttggtgtacatgttgtaaggttagggtaggccgagtattccatgtactcatgcttgctgcatcggaattcacacatccagctgttgcgacaacagtatcatcacgagtgtattacgtcaattttatggctattttgtttgttgtttggttaagtttgtatagtgaaatggtcatgatggtggcaggactgttcgaactagtcttgctgcaatatttgaattctaaagaggaaggttccttttttttaaaaaaaaaacccgaatatagaggaaggttggactgtttccatttccatgaggacatcctggagtcttgagtcttgagaggacaaaatacaggtaatcctagtagagtaagctcagctgttcatgttcaaacaaaagaaatattttaatggtttaatctccaacgagtatccttaagaattgtaaactcattcggggtttggtggtgacattgattacagtgctaaagaatatttttcgtggtactccggtccagtcagctgccccccttttggtgccatgaaacctcactctttgcattctttctgttgcatgagtccaaagataataccaccagatctactacagttaaaagtgcttatctgctccatcaaaaagagaactagtactacaagcatggtatccaaagcgatcaattgagacaataacaatcctgaaagattgttttcatagcagataagaaatgctccaaaacatgatgcagatctactgatgagaagaagaggaggcaaggcaaattgatggagattggagaggaggtgtatggagctgtggatgtagacctggtgtactcatggggcattcctaggaagggaagggaagccaagagaaggaaagggaagagaagagatgcagcaggcagcaggcagcagcagcagcaatggtggtgtaataataaaggtgtgtcaatgaatgagatgagatgctgctgagctactaccctccctccatgcaccttgggccaaatccaacaagagaaagaataacctgaaggaacgacttggccattcactcgttcaggccggtcaatgcagcatcacattaacaagacgaggcaacagtaacaaaagagcagttggtgcacaacttttcaagcgatgtccccattccaccggaaagttttccctagcggacacaacaaaagacaaacatttactctgccccttttttcctcttcgttgtcagacacgtcaccagtgaaaattaaattataaacatcgaaccttgttgttcatgcatggtacagtatggaggtgagtcaagagatggactagccgtagagactgtaggagaaaaaggaagaacagtgattgggaccaagatgactcgttcacccttatatttaattaatcagcaccgtttcttttatgaatcatgatgtaatggcgtcattagctacccttatttacccgccaggaatcgtgcacgcacatgtaagcgaggagggaatttgtggtactacactactactttgttcaatggaaaaagcttttattcgaatg

SEQ ID NO: 5334 - DNA, 1680 bp, Oryza sativa
  Predicted polypeptide sequence is orthologous to G200
aaaaacaccgagccaggctaggacaggttgagacttcatcagcttaattgttcatgcaatgccaggttcactaggcagaagcagaggattctgcaggttagcataaaagggacgtgtaacagagagagacacgacacaggccatgtcataatcagggtaggtccggcattaaacgaaagattagggcactgtttatctttgcactcaatgaatgagaacagggcaagaaaaaaaagttgggagctgatttcgtttgcactgaatgtgatcgggggaccaacacagttgccgacagcaaccgtcggagaggtccatgaggtcggcgacctgctccgccgccgcctcgtcgaacagccacttctcgatcgatgacagcggcggcgctgcctggttcatcagctgctgcttgctctcgtcgccgtagccgccgccatagccgccgtactccatgaacgacgccggctgctgctgctggtgctgctgatgaacgtcgaagcagcagtccaggtcggcgccggacatgcagtcgaaggacgacagcaaggggttgccgccgacatcgacggcgggcttgacgtcgtcgtaatagccgctgtcatagtgctgcagcggtggcggcggcggcgacggggagttggtcttcatgaagccgtcgagcagcttggagatgttgtccatgctggaggcgtatgaggaggatgggcagtcggcgaagggggagcgcctagcaatggctgccatctgggtgacatcggagttgctgctcaccgtgtagctaccgccggcggcggaggggaaggtggcgtcggcgaagatggggtggcggttggaggatgaagtggagttggcggcggcggcgagcttcttcttgaggtgggtgttccagtagttcttgatgtcgttgtcggtgcgctgggggaggtaggaggcgatggcggcccagcggttgccgagaagcgactggaggtggacgatgatcccctcctcgtgcgccgtgaagttgccgcgctttatccccggccgcaggtagttcgtccaccgcagcctgcagctcttgctgcacctcatcagccctgcatccatccatccacccacagcttcagcttcttctcagttcatcatcgatcaccatggctacttggctagctatagttcatctacaaaagaaagtaagaaactacacagaattggggaattaggacgtaccagtgttgatgggaaccgatctccagttgccggggccgtgttcttggatgtaggagacgaggatgatgtcctcctcgggcgtccatggccccttcttgatcccctccttgtcgcagcacggcggccggcccatggctacaattcctcactcactaattaactctgatccttcccggatcgatcgatcgagctaactactctttctggaagctgcagctagctgatcgatcgatcggtcgtctctctctgtgctacctgagcttccgacagtgtgcttgagtgtagagatatatatagctaggagactggggactttgggagtgagtgagctccttttcacttgctatctctgatgtaagccactttctgatcgatcgatgtgatgatttactttcactttctagcaagtcagttgatctggttatcgatcgatcgatcgatctgtctgtatgtaggatgctttctctttctgtc

SEQ ID NO: 5335 - DNA, 838 bp, Oryza sativa; identical to SEQ ID NO: 2299
  Predicted polypeptide sequence is orthologous to G207, G227, G230, G242

SEQ ID NO: 5336 - DNA, 1591 bp, Oryza sativa
  Predicted polypeptide sequence is orthologous to G207, G227, G230, G242
gctactgacttaatttagctccgcctccattcacgcattcacactagcatagcatataagatagcacttgtagagaggagatactagtacacatagagaagaggagaggagattgatcggtgagggaggatgatggcgtcttgtcggagaggagggggaggggatgtggataggataaaggggccgtggagtccggaggaggacgaggcgctgcagcggctggtggggcggcacggggcgcgcaactggtcgctgataagcaagtccatcccggggaggtcggggaagtcgtgccggctgcggtggtgcaaccagctgtcgccgcaggtggagcaccggcccttcactcccgaggaggacgacaccatcctccgcgcccacgcccgcttcggcaacaagtgggccaccatcgccaggctcctcgccggccgcaccgacaacgccatcaagaaccactggaactccaccctcaagcgcaagcaccactcttctctcctcgccgacgacctccgccctctcaagcggacaaccagcgacggccacccgacgctctcctccgccgccgcccccgggagcccctccggctccgacctcagcgactccagccaccatagcctcccctcccagatgccctcctcacccccacacctcctcctccctcagcacgtctaccgcccggtcgcgagggccggcggggtcgtcgtccctcctcctcctcccccgccgcctccggcgacctcgctctccctctctctctcccttcccggcctggatcacccacaccccgatccctccaccccgtcggagcctgcggtacagttgcagccgcctccaccgtctcagatgccgccaccaacaccatcttgtgtacgccaagagccgcctcagatgccgttccagctgcagcccccaccgccgccgcgcccatcggcgccgttcagcgcggagttcttggccatgatgcaggagatgatccggatcgaggtccggaattacatgtccggctccgccgccgtggatcctcggtcgtcgcccgacaacggcgtgcgcgccgccagccgcatcatgggcatggccaagatcgagtaatcaaccagccgcagcagcatacggaatgatcgagtaatcaagctcagattgatgcactgcaagcaagaaagcagagcaagaagcagaggcgccggcgcggcaagtgaagagacgacgaccatcaacgtttggatcctccttttctattctgctatagtcttcttcttccccaataattccttgtctagttttaatttttttttctcttcaatttttactcctccaatccaagttgaagttgtcactagtagagttctccagagagagaggagatgaagcaacaacaaggagctgtgtctgcctgtctggaggaactaataccaaaccaaaataagcagagtgtgtgctgctgtgccacaatcagcaccaccaccgtggcaccacccactagcttagcttagctagctagttcaaagttctttttgtatatacttataagaggaaaaagaaaaaagagagctgatcagtgaaaattcagaatgcatcagtgaagagaattgcc

SEQ ID NO: 5337 - DNA, 525 bp, Oryza sativa
  Predicted polypeptide sequence is orthologous to G207, G227, G230, G242
atgaggatcatcctccgcattaggctctcgccggcgtggacgcccgaagaggacgcgtgcctggagcgcctcgccagggggtacggcttccgccactggcgccgcgtcgccgaggagatgcagccgagggagcggcgccgctcgcccaagcagtgccgcgacaggtggcgggaccacctcgcccgcgacgtctaccaccgccccttcaccgccgacgacgacgccgagctcgcccacctccgcctccgcggcggcggcggcgaccggtggaaggacatcagcagggccgcccactgccgcacctcgcgcgccatgaggcgccggtggagggagctccgcaagagcgacgcgttcctcagggcgctgtactggcatcccgaccagccggtgccaccgctacttgacgacgcgttgtcgtgcagcgacgtcctcgactccagcgtggcctcctaccgtggtggctgcgacgccgtggccggcggcggcacgatcgttgcaccagggttcgcctgcttcgccgcatag

SEQ ID NO: 5338 - DNA, 1369 bp, Oryza sativa; identical to SEQ ID NO: 2295
  Predicted polypeptide sequence is orthologous to G207, G227, G230, G242

SEQ ID NO: 5339 - DNA, 402 bp, Oryza sativa
  misc_feature (195)..(195): n is a, c, g, or t
  Predicted polypeptide sequence is orthologous to G207
tggagtcacgcactattctccgactccatccttcgatttcctctcagctcgcccccagtctccctctcggcttcttcattcaccaccctccacaactacaaccatgcgagcacggagagcagggtgctagcgaacatgactgcagtgacggcgaccatcgattaggagcggcctccggcgatttaggatggcggngaggatggcatcgaaataaggaccaaatcccatcgacgagcaaacccgctgcttgattgctccatccgtcactggccatcagctcagccacctctctgcctcgccccctccctctctcaccctccacatccagccactgcagagctctgagacatcccctgaagccgagagatggccggctcgagcggaggcgcaagggggcatcca

SEQ ID NO: 5340 - DNA, 616 bp, Oryza sativa
  misc_feature (424)..(424): n is a, c, g, or t
  misc_feature (450)..(450): n is a, c, g, or t
  Predicted polypeptide sequence is orthologous to G211
ctgatcgccgggaggctgccggggaggacggacaacgagatcaagaactactggaacacgcacatcaagcgcaagctcctcgcccgcggcgtcgacccgcagacgcaccgcccgctcaatgccgccgccgaccaccaccagcagcagcagctccaggcgccacggcggttcgccgccgcgccagccggccaccaccaccaccaccctgaccatttcgccgtcctctccaactcgccggaggcctgcagccacagcagcgacgacgagcccagctccgccacgccgccgccgccgccgcgtcacctcggcatcgacctcaacctttccatcagcctagctccttaccagccgcaggatcagaccagcgagccgatgaagcaggaggaggacgacgaagcgtcagcgacggcgaacggcgccggcnatgcagcgatgacgacgacggcaacnacggcggcggtgtgcctgtgcttgaaccgcctcgggctccacggcggcaaggtgtgcagctgcggaagcggcggcgccccctccatgcaggccagcacacacatgtttagattcatcacgccgcctggaggaagccaccacaacagtagtagcacaaccatgacct

SEQ ID NO: 5341 - DNA, 1031 bp, Oryza sativa
  Predicted polypeptide sequence is orthologous to G211
aagctagctcgcgcgcaaattaatcgccgatcgatcctacgatgaagcggaagcggccggcggcgctgcgcggcggggaggaggcggcggcggcggcgctgaagcgtgggccgtggacgcccgaggaggacgaggtgctggcgcggttcgtggcgcgggaggggtgcgaccggtggcgcacgctgccgcggcgcgcgggcctgctgcgctgcggcaagagctgccgcctccggtggatgaactacctccgccccgacatcaagcgctgccccatcgccgacgacgaggaggacctcatcctccgcctccaccgcctcctcggcaaccggtggtcgctgatcgccgggaggttgccggggcgcacggacaacgagatcaagaactactggaactcgcatctcagcaagaagctcatcgcgcagggcatcgacccgcggacgcacaagccgctgacggccgccgccgatcactccaacgccgccgctgccgtcgccgccacttcttacaagaaggcggtgccggccaagccgccgaggacggcatcctcgccggccgctggcattgagtgcagcgacgatcgtgcccgaccggccgacggtggcggtgacttcgcagcgatggtgagcgccgccgatgccgagggattcgaaggaggatttggcgatcagttctgtgccgaggatgcagttcatggtggcttcgacatgggttccgcttccgccatggtgggtgacgacgacttctcctcgtttcttgattctctgatcaacgacgagcagttaggcgatctcttcgtcgtcgagggcaacgatcacgagcatggcaatggtgagattggtcatggagacgtcatggaatccaaacagtaatctttcgggagattgatcagggaataagttgaccatgagaaaacatgtaagaacagcttgtctgctgagtcatgaccggtgatgtgtatgtgatggaagaaaacgtatgtacgacttaatgcttgcacctatactactgctgtgtgcattattcgagtgatc

SEQ ID NO: 5342 - DNA, 3237 bp, Oryza sativa
  Predicted polypeptide sequence is orthologous to G214, G680
ggagagcgacccccacctctctctcctctctcctcttccccctcgcggccgcgcagcagcagcagcagcggaagcatccaggtagcagcagccgcgagcgagcagcgaaccgagccccccacatccatccatctcgcttggtttggtttggtttgcagtgttagtggcagcgagatccctttgctgttgttgtagcttcgggaggaggaggaggaggagttgtgacggcggcggaggagagagaaggaggaggggcttgtggtggtggtggtggtggtgatcgatgcagctgctgagccggcggcggcgaggccggtgacgcccgccgtggcggtcgcctgaggccgccgtgtggagggctggggcttgcaggcggagcgaggcggcgagcttggttgggattgctttgcttgctctcgagggcgacggcgcggttgggcattcgttcggtggtggtggtgctcggttgcttcgctgaggatcaaggaagtgtttggccttcgtagaactgcgagttttaatctgattctagagttgaagataacgaaaggagcaagggtgaactctgctgacttggtttttgtgtgcacagaccaactgcagctgaggatttagtagattgactgcaattggatcaattcaagtagaggtctaggaggaggtatgaggtactacttgcgtcaggtccagcgtttggttggagatatggaaggaggagtgcttttgtttgtggaagacctcaactctaactgacaaagcgaccaattgccaacacttctgttatatttcttctttttcttgaattgggaatggagattaattcctctggtgaggaagcggtggtaaaggtgaggaagccatacacaatcacaaagcagagggagcgttggactgaggcagagcacaacaggttccttgaagccttgaaactgtatgggagagcctggcagcgcatagaagagcatgttgggacaaagacagctgtgcagatcagaagtcatgctcaaaagttcttcaccaagttggaaaaggaagctatcaacaatggcacttctccaggacaagctcatgacatcgacatacctccaccacgaccaaaaagaaaacctaacagtccatatcctcgaaaaagttgtctcagctctgagacatccaccagggaagttcaaaatgataaggcaacaatatcaaatatgacgaacaatagcactgcacaaatggcaggtgatgcagctcttgagaaacttcaaagaaaggagatatctgaaaaaggaagttgctccgaagttcttaatctctttcgagaagtcccatcggcatcattttcttcagttaacaaaagctcttcaaatcatggtgcatccagggggctggaaccgactaaaacagaagtcaaagatgtggtcatcttggaaagggattctatttccaatggtgcagggaaggatgcaaaagatatcaatgatcaagaaatggaaaggctcgatgggatacacatcagctcgaagcctgatcattctcatgaaaactgtttggatacctcaagccaacaatttaagccaaaatcaaactctgtggagacaacatatgtggattggtctgctgcaaaagcttcacactaccaaatggacagaaatggggttactggctttcaagccactggaactgaaggaagccatcctgatcaaacaagtgatcaaatgggaggagccagcggaactatgaatcaatgcatccatccaacacttcctgtggatccaaaattcgacggcaatgccgcagcacagccctttcctcacaactatgcagcctttgcaccaatgatgcaatgccactgcaaccaagatgcctacagatcttttgccaatatgtcatccaccttctccagcatgcttgtctccacattgttgtcaaaccctgcaatccatgcagctgccaggcttgcagcatcgtactggcctacagtagacggcaatactcctgatccaaatcaagaaaatctttctgagagtgctcaaggaagccacgctggctctcctcccaacatggcatctattgtcacagctacagttgctgcagcatcagcatggtgggcaacacaaggtcttctccctctttttcctccacctatagcttttccatttgttccagctcctagtgctcccttttccacagcagatgttcagcgagctcaagagaaagatatagactgcccaatggataatgcacagaaggaattgcaagaaactcggaaacaagataattttgaagctatgaaggtcatagtgtcttcagagactgatgagagtggagaaggagaagtgtcgctccacactgagttaaagatatctccagcagataaggccgacaccaaacctgccgcaggagctgaaacaagtgacgtttttggaaataagaaaaagcaggatcgctcttcatgtggttccaacacaccgtcaagtagtgatatagaagcagataatgctcctgagaatcaagaaaaggctaacgacaaggcaaagcaagcatcttgcagtaactcttcagccggtgacaataaccaccgtagatttaggagcagtgcaagcacaagtgattcatggaaggaagtttctgaagggggtcgtctggcttttgatgcactgttcagtagagaaaggcttccccaaagcttttctcctccgcaagtagaaggatcaaaggagatcagcaaggaggaagaagatgaagtaaccacggtgacggttgacctcaacaagaatgccgctattattgatcaagaactcgacacagcggatgagccaagagcttcctttcctaatgaattgtcaaacctgaagctgaaatctcgcaggaccggtttcaaaccatacaagaggtgctcagtggaagcgaaggagaacagggtaccggctagcgatgaggttggtaccaagaggattcgtcttgagagcgaagcatcgacatgatttgctttccacctggttgctggcctctaccaagtcagaagttaaatttacatccgagctaccataggacttcagaccttccaatgcattacctcacaaactcaatttattgtgtgttgtatcttaatgcttgccaagcagctcctatagactgcttttaaaccgtatctcatagacttttgattagcatttaagcgactgctaaactttcttcataaaagggtattatccttattatgcattatagtctggggaaggtaataagtgg

SEQ ID NO: 5343 - DNA, 3483 bp, Oryza sativa
  Predicted polypeptide sequence is orthologous to G217
gccactccccctccccctccgccgccgccgccgccgccgcccatccccgcccgcatccgcatccacatccgcatccttcccccacctcgatccccgccctccacttagccctagaacccactctgcccgccgccccggcgaaaccctagcagcctcgtccgggcggggcggggggtgggggtgggggaggggagaagcatcgggggccctccggcgaggaggagaaaaccagcttcggggaggtgagcgaaggagaggggaggcaagatgaggatcatgataaagggcggggtgtggaagaacacggaggacgagatcctcaaggccgccgtgatgaagtacggcaagaaccagtgggcgcgcatctcgtccctcctcgtccgcaagtccgccaagcagtgcaaggcccgctggtacgagtggctcgacccctccatcaagaagactgaatggacaagggaagaggatgagaagttactgcatcttgctaaactcatgcctacgcagtggaggacaattgcacctattgttggtcgaacaccatctcagtgccttgagcgttatgagaaacttcttgatgctgcctgtgcaaaggatgagaattatgagcctaatgatgatccaaggaagttacggcctggtgagattgacccgaaccccgagtcaaaacctgcacgtcctgatcctgttgatatggatgaagatgaaaaggagatgctttctgaggcaagggctcgcttagctaacaccaggggtaaaaaggcaaagcggaaggcaagagagaaacaacttgaagaggcaaggcgacttgcctcactgcagaaaaggagagaattaaaggcggctggtattgatacacggcagaggaagagaaagagaaagggtatcgattataatgctgagattccttttgaaaagaggccgcctccaggtttttatgatactgttggtgaggacaggccacttgagcatgtacagttcccaaccactattgaggagcttgaaggtaagagaagagtagacatagaggcacaattaagaaaacaagacattgccaggaacaagattctccagaggcaggatgctcctgctgcaattatgcaggcaaatagactcaacgatccagaagctgtcacaaagaggtccaaattaatgcttccaccaccccaaatctctgatcatgagctagaagagatagcaaagatgggtaatgctggtgatccttctttagttgaggaacttggcgaaggtagtactgccacaagagcattgctttctagttattcccaaactccaagacttggaatgacaccattgcggacgccacaacgaactccagctgggaagggtgatgctattatgatggaggcagaaaatctagcgcgtctaagggagtctcagacccctcttttaggaggggataacccggagcttcacccatcagatttctctggtgttacaccacgtaagaaggaaatgcagactccaaatccaatggcaacacctttggcaagccctggccctggtgctactccaagaattggaatgacaccctccagagatggaagttcttttggtttaactccaaaaagtactcctttccgagatgagcttcgcataaatgaagaggtggatatgcaagatactgctaaacttgagcttcgtaggcaagctgaattgagaaaaagcctacgatctgggtttgcttctattccacagcctaagaatgagtaccagatagttatgccacctatcacggaggaggagaaggaagaagctgaagagaaaattgaggatatgtcagacaggcttgcacgagagagggctgaggaacaagcaaggcaggaagccttgctcagaaagagatccaaagttttgcagaggagcttgccaaggccaccggcagcttctatagaaattctccgacaaactctaattaagggtggtgaaagcagaagcaggagcaccttcgtgcctcctacatcacttgaacaagctgacgaactaataaatgaggagcttcttcggctccttgagcatgataatgctaaatatcctctagatgagaaaactcaaaaggataaaaagaaaggaagcaagcgccaggcgaatgggactccttctgtacctgagattgaagattttgatgaagacgaattaaaagaggccaattctatgcttgaggaggaggttcaataccttcgtgtcgccatgggacatgaaagtgaatctttggaagattttgtgaaagcacatgatgcatgccaagaggaccttatgttttttccaaataacaacagctatggtcttgccagcgttgctggaaattctgataagatagctgctttgcaatatgagtttgaaattgtgaagaagagaatggatgatgaagctaagtaggcttcgcggcttgagcagaaaatcaagcttctgacacaaggataccaggtacgagctggtaaactctggtcacaggttcaagatacattcaagcagatggacacttcagcaacagagcttgaatgctttcaagagctgcagaagcaggaacagatggctgcatcttatcgtataagaaatttgactgaagaagtaaacaaacagaaagcattagaacggactctccaaagccgctatggtgatctgttaactagttacaagaggatccaagagcagcttgaggagcataagaggcaactgatgatacaggaggaaatggaagcacagaagcgtgctcaggaggaggaggaaatggaagcacagaagcgtacgcaggcagaggaagaaaaagaagcggcgaaagctgaagaggaagcaagaaagatggatagggctgctgatgaagaagcggcaggaagcaaacaagtcaatgaggatcagatggatgttgacaactctaatgctgatggtgatgaattcgtaggtccgattcccccaggaccaggtactcaaggtgacgacaatgtggtggcggtcgaagagaactctagctcgcagagcggtgatactgctaccacggaagatggatcttgtggcatgatcgacgcatcaaaatcaggaggtcaggatcacatcgacagcaaggatgaacttcccactgttggtgccagtctagatgatggaagtgctgctgcatcttctgatcaagatgtctcaactgaggtgaatgccactgtccctgaatagaatgtcatttcttgtacttcatcttcgagggcggcacagagaaagctaagagggacggataccttgagagaaaaaaaagaagaggcaaattgaatgtccaaagctgtgcactgaatttttattcgctgcttgattgttagtgaacgacaaaatgcgggactaagcttgttgtacaatgttaattttgtcaattcccatcgaggactctcagctcttagaattgctacgaaagaatgttagttcgatgtactatctgagaaattgaacttgaaaaaagaaaaaagaaacaatgccgat

SEQ ID NO: 5344 - DNA, 1074 bp, Oryza sativa
  Predicted polypeptide sequence is orthologous to G222
atgggaagagagtcggcggcggcgtgctcgccgaagccgaagctgaggagggggctgtggtcgccggaggaggacgagaagctgttcaaccacatcagccgctatggcgtcggctgctggagctccgtcccaaagctcgccggattggagaggtgtggcaagagttgcaggctgagatggatcaactacctgaggcctgatctcaagagaggcagcttctcccagcaggaggaggagctcatcatcagcctccataaaatccttggcaacaggtggtcccagattgcggcgcagctgcccggccggacggacaacgagatcaagaacttctggaactcgtgcctcaagaagaagctccggcagcgcggcatcgatccggccacccacaagccgctcaacgacggcggcgccggcgccggagaagagcaccacgacgacggcgacaagcagcagctaatggacgacgtcgacgactgcttcgccatcggcggcggcgggagcagcgactccctggcgccgccgcactcgccggccgtcagcttcgacccgctgtccgtgaccaacgtgccgacgacgatgatgcagtcgtcgtcgtctccctacggcgccgccggcggcgagcactcgtcgttccggtcggacaccctctgcgactacggcgggagcggcggcggcgtcgacgtcgtgtccgacgccggcacgtacagcgcctacaccggcgacagctccagcaacagcaacagcacggcgtggacatgcggcagcgtcgtcgtcggcggcgcgggcgagctgccgccgccgccgctgctgccgcacatggacatgttcggccgggtcgacgccgagccgccgccgtacccgccgttcgacgtccaggccaggttcagcccctggcaccaccaccaccaccaccaccacgagccgacgctgccgacgccgccgcaaaggctggacggcggcggcggcgccgcggcgagcttcccgatccggtcgctgtcgcgggacatgccggagtcctgcttcgacctcggccgcggcgcgctcgacgacgagttcggcgtcgacttcctctga

SEQ ID NO: 5345 - DNA, 1514 bp, Oryza sativa
  Predicted polypeptide sequence is orthologous to G222
gacacagagaagaggagtactaggtagagagacgcttggctccgtggctcgttggttgattgcttaaaggccacttgatcgctgctcgatctgctgcctccctcgcgcgcgcgcaccgtacgtgtgtgtgtgcagtagttctcggcacgcttccccatatataccccctggatcgggcgcccagccggccgcctcgatcgacagagagatcgatagacagatacacgccggcaagggcaacgaacccagcggcaggtagctgctcgcgtgtcgggcgggaatgggacggcacgcgtgctctgccgccggtgtccagcagaagctgcgcaaggggctctggtctcccgaggaagacgagaagctctacaatcacatctaccgctacggcgtcggttgctggagctccgttcccaagctcgcagggctccagaggtgcggcaagagctgcaggctgcggtggatcaactacctgcgccccgacctgaagcggggcagcttctcgcagcaggaggaggacgccatcgtcggcctgcatgagatcctaggcaacaggtggtcgcaaatcgcgtcgcacttgccggggaggacggacaacgagatcaagaacttctggaacagctgcctcaagaagaagctgaggcagcgcggcatcgaccccagcacccaccagcccatctccacggctgctgctgctgcggcggcggcattggacacgtcgacgcaggaccagaagccgccggccaccgccgacggcttcgccctgaagcagcagcagcaggtgttcgacccgttcccggtgatcgacagcttcggcagcgggttcgacgccacgggcatgccattgtacggccacctcggcggcaaggacgcggccgggttcgtggactacagcagcgtgcttgacgtgtcggagaacctgggctacggcgagagctccagcaacagcagcaactggaactgcggcgtgggcgcgccggaggtgaacaatgcgctcgagagcgagccgctgcattgggccaccgagagcaaggtcgagcctttcgtgggctacggcgagggggacgccatggagcacaagttcgggctgccctgccatgggcagcaagagcagggcatgacacatttcgacttcgacgtcagccggagcatggtggtcggcgacttcaacttcgagtacttccgatgaggttcttgtgaattaagccattatcgtatatacaatattcttccaaggcattttacacagagggcatgaccaaccgggagagtagagactgtactctgttaattttcactagtccatactccttaattaacacctttttatgatttctgcatgggtaaaaatataaataaagggtatagaaatgtgaacactgtgtagttaattactactatgagattttgtaagaataattaagtttcttacacttgtactctgtaagttgctgccactgggaggactgtgtaacgtgtattcctctcctgaagaaggaacaatcaaggttctcact

SEQ ID NO: 5346 - DNA, 2638 bp, Oryza sativa
  Predicted polypeptide sequence is orthologous to G224, G1466
gggagaaattccccaagccgccgccactaaccctagcttccgccagcacgggtgcagatcaagttccaaatcaacctgattggtcctcaactttgagggtaacatgatgcgagacagcaagaggacgaggtccgcaccacccagagaaccactggaaatgacagaggacatgaccccaagaagcaagaggaggaaatttgtaccattcggagaaggtgcggtgctacctgaggagatgctgacggaggtgttcctacgactgcccattaaatccatccttcgtttccgggctgcctgccactccagcaaatttcaactccactgcggtgtacacgtgctcgccatcgaagcccattgatgacctactgttcacactcgatgatgcgcgtggaaactatgtggaagtggcaccttcaccatgccatggcctcaccctcctgtataatgctgttgcgccagcttactacgtcttcaatgcaactacacgggcaatcacacggttgccaccttaccaagatgtgattcatgccactgctggcgttgggtttgatgcccggacgaaggagttcaaggtggtgaggctttttcgaggaaaatcgcatgagatccattctgtaaagtgtgagatattcattcttgggggtgaggaaggggatcattggaggcctaccgctggtggagtacctttcaggttctgtagttttgctctttctgctatccgcaatgcagtggcgaacaaacttcagccagtttttgttaacggatttctccactggttgatcaacccctcgtttttactcaaagcaccaagagctgctatcatatcattttctctcactgatgaaaccttcagatggatccgatcaccaccctttgaggtatccagagtgcacttggctgagcttgatgatcagttgtgtatggtccgagaccttcgtaatggcttgcctactggtagcatgtttgaaatttggaggctgaatgactataactctggtgattggtcgcttgattaccgaattggtttgacagggaatttgccaagagatttacttgagccacgaattgtgaaagttattggttcctttggtagctacagatcaagcaagaagataatcatcgctacatctaagcacaaggtgtgtgcctatgatccagtttctagaactcttgaaaccattgtctcaatcatggtgacctgcagtgcctatcaaaacgagaaatctgatattagattcagttcatttacaaagagttttaccccagtgcataggacgaggaaagagatagggttctctactcccttgtctaaggctactaaggagatcctactccgattaccagctgaatcaatcttgaaattggaacttgtttgtaagcaatggcgtggattgataaagaatgaaggttttgttcatgcatactttgagcataagaacatggacaggaggccaaagatcatgcttgtgggtaagggctctgaaaaatcagttttcaactttattcccttgagtaaatggctccaagaggcaaatctaggcacaatgtttctggacaaaaaggtggtttgctccaagccttgccatgggttgaatctggtgagcattgagatgaaagactatctgttcaacccgtgtacaggttaccgcatgatctactagaacagagaccatcagctgtaccaggaatggtccaatttgtctagtgatcgctgcaaagactacaatccttttgtagttggcaataagaatgttggtatggggttttgccaggtgactcagagtcatgccgttgtgggaattttctattactggaaaaactacgaatctcatcagtattacttaacatgcattatatggagttgtagctcccaaggccagccactccccgatccacctctgcctgtgaatgacatgccacctgtttctctggatggtgtgctgtactggatgagtgaaccaaggttgggtcagagttatgagcgggccattgtcttttttaacattgccgctaagatttttgatgttatcccttgcccttcatgcattgcaatctgggacagcagaaatccatgtcacgcatttgtggtcgagcttcagggaatgttgtgtgctgtcctttcaaatccagttgcagataagttagatatatggaagtgggatcatggtctgtggagtatagcatatgcaatcaatttaaaattctggccagattattcccttgcgacaaatgttgtagtgcctctcgcagttgacccaatagatggaaaggttctactgaatactgggaggaagcttggtttatataatccatgtgagcaaacaatcgaaaacttgcacttgatcaggcgtcgcagcaacagaaccctggagttaacagaaatttccacattgccagatgccaagatgttcctaagaagttctctcagtggaaactattattggctccgtgcgagaagtttgctaacccttcaagtgcttcatcagggaagaatccattttactccagagaccaatctaaggagctaaatagtgtgagtcaaaaaattatgcctctggttcctatgttgtacgaggagggtttagcttactatcctacaactactaaattgagagtattgtgcgattgaagtgttgcc

SEQ ID NO: 5347 - DNA, 1645 bp, Oryza sativa
  Predicted polypeptide sequence is orthologous to G224, G1466
agacacatcccggcgagagacgagagacggcgccaccaccgccgccgccgccgccgtgctggactccggctggccaccgcgctccgctcgaggcgtccgcgatggcgtccccagagccgtgcgccgccgccgccgcaccgggaagcgggttcggagccgtggacggcgtcctgcccccggagctgctgctcgaggtcctgctgcgcctccccgccaagccgatctgccgcctccgcgccgtctgccgctcgtggctgtccttcaccacggaccggctcttcctcgccgcctacgccgccgtccaccctcacccgctcctcgccgtcttggttgacagcttccccagtcgatgctgcgttgatctcgtggacctgtccggcaacgtcgtcgaggagatcctcggcgtgggcggcgagtgcagggtgctgacggcgagctacgaccgtgtcctcgtcgccggggagcaccaccgcgtcagcgtgctcgaccccgccacaggatccgtctccgccttgcccttcggcattgcagaggatatggtgcgtcgcaacgggatgaggccagcctggtttgcatttggtcagacgaattccacaggagagtacaaactactccggattctagaggacttggaggatggatatgaggctgatccagtgtgtgaggttttcgcaatcggcgacatgaatggacggtggaggaagatggagagtccaccggggtatcttgatccgagctgcaccaatggagttgtcttcgaaggggctgcttacttcttcttggatcactggcaaatggatccctcctactattttgctacgggctgcataccttccttcgaccttgcgacggagcagtggagcacggctctccaagggccagtaaacagaattcttgaggaagcgaatggcacactcaactatgctgaccttaccgatcgtcttatgttagcccaacttgaaggaactttgtgtacagcacatttcaatgatcaaatttctgcggtggacttatggtttctagttgattttgagaatggtatgtggtccaaagaatataggataaatgttgaatttgcttttgatggttttggagatggtgtgcaacctttgcttgtgacggatgagggaaatgtggtactttgggtgcagataggatcaaaagggatggtctggatttataatccagtaaccaacacttcctcagagatagttcagacaaaggctagtatctttactggagtaggtgtatatactggaaatcaattatgtccacagagtatgtgacaagaaatggaagaagtgccaaaagaagaggagcaaaaccgatgtcaggactggtgtgattgcatactggagaatttgaggccgctcctgaaaactataacactcttggacaggctactgtcgtgcaagctactggggtgttatttttcttggttctgcagatggttcagttatgcagctagtgaatagtttttggacctgtgggttgttccatggtattttctacctaaaactggaatccacagtatgctgcttttaattattgtttgtgaatctctaaagaaatccctgtccccgtgttggctttctttcaaagacggatcataatgatatcggttccaaaaaaatgttttcggttc

SEQ ID NO: 5348 - DNA, 1262 bp, Oryza sativa
  Predicted polypeptide sequence is orthologous to G225, G226, G682, G1816, G2718, G3930
agagaagggccctagaaaacataaggtcataacaagggtctgaggatcttagctagcacaagatctcaactcggcatttcattggagtttttcacgcctaatggatagcagcagtggtagccagggaaagaattccaaaaccagtgatggttgtgaaacaaaaggtttgcatatcttgaatttctgtttgtttcctgttagccttttcacctttgcttctcttaacaataggtatatagctttttcatttcctaattcctatcatcatgttcaataaggaaacaaatgaagaagtgtcatttagttaatacctagcgacatttaacctgtatattgtcatattctgcatcttgatgctttacttgattatgtcaatggagaaaacaaagagaaacgagaagtcaggaagtaatagtcagagcatactcgcaaagtagcaaggaactttgtaactacataaactgcaagaaagtatacatgcaaacttgataatcagttgcctatcatcagtcctgatagctaataggaacagattaacataatgaataaggcatattccagctttgtttacttccaggcttccagcataagaataaatccccaccagggcagattgcaaattctaatggaggctagtagtttgcaaaatatttgagatggttggctactgagttattttgcttattttggtgaccagtttttttaataaattttgcagaagttaataacactgcacagaattttgttcatttcacggaagaagaggaagatctcgttttcagaatgcacaggcttgttgggaacaggtatcctaatacacatattacatatctgtaatgtgcatcaagtgaaaatgaagacaaattgtatttttacattattagcttgtactatgattgtttcagaagtttggcaaattcatgaaacccatatgtctgtttcaaaaaaatacattatttgcagttccctaactttgctccttgtatggagttatgcaggtgggaacttatagctggaagaatccctggaagaacagcaaaagaggtagaaatgttctgggcagtaaagcaccagaatacataaggggggaaaaagggtgtatgccctaaaagtagcgtacaatttagaagcaaacttttttagaaaaggatttaggccctaaaagtaggctataatttagataaattgtgttgcctcagtcttatgcctgatgcaaaaggggaggaaaaactgaatgcaaaattaatgtgtttattccatag

SEQ ID NO: 5349 - DNA, 410 bp, Oryza sativa
  misc_feature (241)..(241): n is a, c, g, or t
  Predicted polypeptide sequence is orthologous to G226
tacgcagttcgatgcaaacgatgctcattttgacccgaaaagcgacaaaaacaaccctaagtggttcatggtagatgtgaaatacgaacgcgatttgaaacggtttatcccgttgtctgagctaaaacattattatatggagcacaagaaagacggacaaaaaggcccacttgctaatttgtcgctctttactcgttcacggctttctgtgcagtcgattagccagaaagaatgggatttnatcatcgaacttgagaataaacctccgattaaatagctttacttatcctttaatgatatattttgtacttaagattcaatgtttctgaatttatattaaatattttttatctttatttaatttttttcaaataaataaataatacaatttgtaaaaaaaaaaaataaag

SEQ ID NO: 5350 - DNA, 1217 bp, Oryza sativa
  Predicted polypeptide sequence is orthologous to G229
ccagatcgctcagtctcacaccgcacagagacagagaagagctctagagagaacgagagagagagacagagagagagagagagagggagaatggggaggagagcttgctgcgcaaaggaagggatgaagagaggggcatggacgagcaaggaggacgacgtgcttgcctcctacatcaagtcccatggcgaaggcaagtggcgcgaggtcccccaacgagctggtttgaggcggtgcggcaagagctgcaggctccggtggctcaactatctccggcctaacatcaagcgcggcaacatcgacgacgacgaggaggagctcatcgtcaggctccacaccctcctcggcaacaggtggtctctcattgcaggcaggctgccgggccgaacagacaatgaaatcaagaactactggaacagcacgctcagccgcaagatcggcaccgccgccaccgccgccgccggcagccgcggtggcagcacgccggacaccgccagagcgacggacgcggcgtcgtccagctccgtcgtgccgccgggccagcagcagcagccagcctcccgcgccgacaccgacacagcaacggcagcggcggcggcggcggcgacgacgaccaccgtgtgggcgcccaaggccgtgcggtgcacgcgcgggttcttcttccacgaccgtgaaacggcgccgctcgccgcggcggcgccggcgccggcaggggaattaggagacggcgatgacgtcgactgcgactactactgcagcggcagcagctcggcggcgacgacgacgtcgtcgagctcattaccggcggtcgtcgagccgtgcttctccgccggcgacgactggatggacgacgtgagagccttggcgtcgtttcttgacaccgacgacgcctggaacttgtgtgcgtgacattagttcgtcgtccgtacgtacctacgtatatgcatgtgtgcgtctcatagaatgaatataaaataatattttctccatctattttaagtgcagttgcgggtttccgtatataaaattaacgattttgctatatatttgtcgataaattttctcctaaaaatttgacagatgtaattacagtacaatcgtagtataattacactgtaactttcatgtaattacactgtaactatagtgtaacttgtatgtaactttcaaaaatctctttgtaatatgttatttcggtaaaaaaaaaaaaaaaaaaa

SEQ ID NO: 5351 - DNA, 795 bp, Oryza sativa
  misc_feature (102)..(102): n is a, c, g, or t
  Predicted polypeptide sequence is orthologous to G229
gacaaagctgggtaccgggccccccctcgagtttttttttccttttaagttagacttgcagtgtaagctctggacagcttccctacttacgatgttaatacnctttgtccacaaattacaagacgacattactgaactgtcagctatgggtcaagataagatgagtttcacattgcctactatatttaccaattatatttgagcagctgaaccaaggctctataaacagtaatccatcagcagagactatgggttgctattgatggggtaaaagtaagaaccattagccagatttctgcgctatcagactataaggatccaggctcacctccagataagaacttatgggcccaagcttcaaggtactccctacccatgttcatgaaaaagcttcgatgcacttcaaactctggtttacaaaggcaaattccaactgagagtctatcagcaggtgtcagtgggatttctttcagcatgttccatagaggagcatttgggtccgatgatgtcggtgctgctcgtattggttttgcaggggtgtcatggatcccagctaaggtactctttaccatatccgccttcctgccatcatgtggcacgggtgcctgcggttttgggtttggggttgtttttgttctgctgactactttgcacttcttcaatccaggcttgagagcagccattgtgctctcagcaaaggatccagatggctgggcagatggtgcactagtgtcagacatcacttcacaaggcactgcatcactacttgctgccacctcatgacagtcatcttca

SEQ ID NO: 5352 - DNA, 1372 bp, Oryza sativa
  Predicted polypeptide sequence is orthologous to G229
ttgcatccctatagttgttgtgccgggccaacccaccgtgcctagggtgcagcccaggcatggcccggttgttggatctggctagtacgggcacgaccccagtcgggtcatgccatgtttgggctgggccaaaatggcgtgccttgggccgggccatgggcctcgggccatatggccatctatacttaaaacttgtttactgctgtagatctgcaatacgtagcgaaccaaaacttttgtgttgttcttttctttttcaaatttggtcgaaattgcttcaattttaaaaacttggtaagacttgtatggaactatggatgcagatggtcgctgatagccgggaggctgccggggcgaacagacaatgaaatcaagaactactggaacagcaccctcagcaagcgggtcgccatgcaacggaccgccgccgccaccagcatgccggcggcggccaccaccagcagcaatgccgacgccgccggcgctgctgcacgacgccggcgatcgccggagccccgcacggtcgtcgtcagcccaatccggaccaaggcgctgcggtgcaacaacaacagcagcagcgggatagtggtggtgcagcaggcaggcgcctgcagccacggcggccgtccgccggagagcggcgcgccgggagacgcggcggctgataaggtggccacgccgcaggcggtgcagcagcagcagcagcaagagctggccggagcggaggatgacgacgacctgccggtgccggccgtctgtatcgaccttgacttggacgacatcgagctgggaggactcgacggcttcctgatcagcccgtggcgcggcggcggccacgacgacggtaacgccgccgccggagcggtgccgaatctgccgatgccgattggctatgagctcggcggcgccggtggcggtggcgaggctggagctgttgacctggaggcgttgctggggcagctggaagcagaggaagacgacgacggtgaccaccaccaccaccaccaccaccaccaccaccagtaggaggaggaggtgccttcttcgcttggggacgaagacgacgactacttggagttcgcgccatggctcctctgatagcggcatccatccatggatcattgtggaatcgaatcagtcgagctgagagttgagagttgagaaagatcgatgattgctttgctggtcgtgtgttcctgcgagtcggatcatcggcacgaagagagatctcatcgattaagtaggcgcggaaggcgtacgttgaagcttagctgctgaagaattactgacgtagtcagatgaccatttccttatatattgtacagattataatggagcagattaaataaatctaaacacaccgcatttgatc

SEQ ID NO: 5353 - DNA, 954 bp, Oryza sativa
  Predicted polypeptide sequence is orthologous to G229
atggggagggcgccgtgctgcgagaaggtggggttgaggagggggaggtggacgaaggaggaggacgagaagctggcgaggtacatacgggagaacggggaaggggcgtggaggtcgatgcccaagaatgccggcctgctgcgctgcggcaagagctgcaggcttcggtggatcaactacctccgggccgacctcaagagggggaacatctcgccccaggaggaggacatcatcctcaacctccacgccacactcggcaacaggtggtccctgatcgccggccacttgcccgggcggacggacaatgagatcaagaactactggaactcgcacctgagccggaagggatacgagttcctccgcggcggcggcggcggcgccgtcgtcgacgtcgacctcagcaagttgcccggcggcgggaagcggcgcggcggccggacgggccgcagcagcagcgggaaggagaagacgaggacgaaggagaaggacaaggcccccgctccagaagctgcgcacaatgacgacggcggcggcggcggcggcggcggcattgacaacgtctcggcagctagccacagccacagggaggagcaggcacaggcgagcgccagtggtctcacatcagatgggctcgaggagggcccactgggcctaagcgaggagatggtgagtgggcccgtgggaccggtgagcccaaagcctgaggtgggccaggatgggtcttctgcagagagtggctgctgtgggcctagtggatccagtggcccaaccgaggctgtgggccaggacatgggcgacaagtccatggactgggacctggtgggcctggacgatggcttcgccaacgatgacatgtggggctcactctcctgggactacggggagttggtgggcccggatggagttcatcagggcgaggtgctatccgacttgttcttcttgggcaacctgtag

SEQ ID NO: 5354 - DNA, 4669 bp, Oryza sativa
  Predicted polypeptide sequence is orthologous to G231, G2007
ggtcttcctcctcactcacctcgcgtcccttgcccccacggggtcggtgatcacagcgccaagacgagagcaaaattctcatccgggagggacgcatcggggaggggacaggtcacaggttgaggttgcaatcggggggcgctcgtgcgcggggcagcattttgggttcactgtcgcgtccatccccatgctgttccccccttcaggcgcagcagccgcgtggaaggtcgctcgctggtggccacgggggaatcccctgatgcgaggtcgtcgtcatggagacatccgctgctggtcagttctgttcctcaccaaggcggagcaagctggaccaacccgattaattggctcgtgtagaattaacttgacaatttgactgacatggatgatagccatagtggtgtcccatttaagccaaattattggttaggacagggccaagtaaggttttgggtgttttatgagtgagatctgacctggctgggtttagatcatcctcttttagttcgaacgcccaacaggcaacaacaaaggcgtgatgtagcagcatataggaactactaataagcaaactaacaagttcagatgataacggcgattggctaattttggacccacggtatgtagtcattgcttgagaaatcgaacttactcggccccaaaatcctggacattagtttaagatcttatggtctaagcgtcgtggaatgacatacgatgcttgattgaaaaggaagatatgaatccactcggtcttgctagctaccaatgatttcctagatcccaatatcctgtggcagtgaaattaattggtcatatatacatacatatatatatttctactgtatcatcgtacaacttgcaggggtagttagaactcgtggtaaattattccattgtctcatcatcgtagcttgttgttttgaaagagttagcctagttagattagaacctttctggatataacttctcaccattcatggtcatatttcagaatcaaaccccatgaaggcataggagtagtgcgccaacttctgtatgattcctgcagagacaaatgaattgaattgttccaatagaatacgctctgtctgtcaaagaaaaatactcatgaataatttagtaggcactagaagttacattttcctggcagttcaatattccagttgattgctgcagtctgtgcctttacgtgaacttgcgataagtcactaagtctgtgcctttatagggatgtcttactgagggaacctgtattcaagatgcaagaagctaggagtggagaactagatgaaacttgaccttttcctacctaatccattacgctataatcaaactcagattggattacgcgttttccagctgcaaagttgataatccaggttgttattcagtggatttagctgattggaaatgtcggacctgtttcaattatatttgttgaatttttctaactgatcatgaactgaatccgtttggtccgatattaacctgaagctttaggaaattgctgtacttagctgctcgatattgtattttaatcttattactcttgttggtaagtacataagcactagatagtagttgctgctatgttatccatatgagcatatacattgactggcagaaccttctagagttgtagggattaaacccctgacaattgagagcatgaacgtaatatggtttgaaattcaaaagataggactgaacatatttttatataacatggttcaggaaattagttacatgaagacacctcgttaaagtacagtttttcctttcaaatgaccgctgaaaataaaacagtaaaatacgtatgttaaaagacacgaatattagggaaggacataatgtcaaataattagaagaggtgaagcttcgaacccaggtcgtctagcccaccatcttgtgacgctagccggaagaccccggggtgtttttcaaaaaaaaaaaaaaaactgtgttaaagtacagtttttcctgtcaagtgaccactgaaaatagaacagtattatcaattgattattgcctttcattcatgcaatcaacatagatgtggggttgcaaggaattaaacatatttgaaatgcacaccttgcttgtctatgtcttagatcttgtggtgtaagtcttggaagacaggatggaattgacctaccacctagaagaatctcattcttatagtgccatcagtactgaaagtaatgtttccttctcattattcttttttgtaaatttgattgtgcaccacatgtaaaaatgcatgatgattttggccggttattcatgctcttaagtttgttgtctttacccttcaaaagagtatgcagtaggatcgtcaatcttaaattcaaaatggaaaatctcgttcagatttccagtgcttcattatctctgcgaatcactagtttgtgttaaaattgctaatttattatatataattctatattattaaagggtgtctcactctgccactctctgtttgcttcttctgttccttgggtgaaattttgaattttagtcattagtctggacaagtggaaactctcatgtctctatttttttcccacaaacactcatctgtctatttgatttacatttggtatattcatattttcactatgctcaagtacctttctcatactaagaggtccactgttattcattgactacggatcttgacaaagcaaatttatacactgtatagtctacgcaggctaatccagcaaaacccatattatatggtggcaaaataacactgtttctttctcactccagatcagttctattagctgaaagaatctattaaaacgtccatcaatgcaaatagcattctagcagtccagcatttcattgccaacatcagataccttattaccattagtatctaaataggttcgtatcctacacaagattacatattcctgggatttgccaagatatgatttagactagctcatgatctgccacattagttgacacatttggcacaaaatatttgttgagagttaattcccacttcaattttctgaagcgcagaacactgatttgacgttactttttttgttacagagaacggtcatttcattaccttgtcggagaatcagttatatacctgcagatggttacttttgtctgttgacgtcattcctgagcagaaataagcacatggatgtctggcattggttggattgccaattttaggatgtcaattagtactacagtatgcaggttctatggaggtgttcgctaagtatggctgatatgtcaccttgtttctccgtggttcttcgcaccttccaacttcgcatcaagtaaatttgaacaacggttggccggctgtcttgcctgttaattacagcaagtcaatcagtcagtaactacaggccggaggaaggtgacactctgacggatcgtatcggtatggctgacacgagacgtctggctgcagctgtggttcgtcgagtcttctttcccgggccagaggtcgccgtcgtacaaagcatgtacccgttccggccatctggacacacggctgagcgaggttgcttgctcatggcgaccgtctacgacgtcgacgacgatgccacttgctccgaggaggttggctgggctgcatgctgagcgctgcgagttgcaggcttgcattgcatctaccactttgcatgcctgttctgccggggccgtggttttttgtggctgacggaatggttgatgggatcattgcgtaagggcgcaaccacggcaaggtgggcgggcaggcagacatgcaaccgtggggaacggaagtggcaaagccttcagcgacaccggactgtagcttttgtgtggtggaggagagcgtcgatcgaggaacagtctccaggccgggcggggtgcatgcagcactgcaagtggtggtggtgtttagccttgtgggcgcagctaagtcagcgagctgcctccgtcgccgccgtcgccatcaccggagattaaaaagagcttggagaaggagggcctacctatatatacgcccttgcacccgcaggctccggttgcagccgcgagcggatcgggctcgccgaggtcgacttccccggaggcgatcaccggcagaggaggaggagcagtacgtgtgtatatataaaggatggggaggcagccgtgctgcgacaagctgggggtgaagagggggccgtggacggcggaggaggacaagaagctgatgagcttcatcctgaccaacggccattgctgctggcgcgccgtgccgaagctcgccgggctgctccgctgcggcaagagctgccgcctccggtggacaaactacctccgccccgacctcaagcgcggcctcctcaccgacgccgaggagcagctcgtcatcgacctccacgccaagctcggcaacagatggtccaagattgctgccaagctaccgggcaggacggacaacgagatcaagaaccactggaacacgcacatcaagaagaagctcatcaagatgggcatcgacccggtgacgcacgagcccctcgaccggaagcaggagagcccggccaccacctcgcagtccaccgtcacggcggagtcgtccaagtccggcgaggcgaccaggcagcaaagccggcagcttgacgacgccgtcgtcagggacatgtccgtgtctgccggtggcgacagcccg

SEQ ID NO: 5355 - DNA, 1326 bp, Oryza sativa
  Predicted polypeptide sequence is orthologous to G233, G241
gcagtcgcgtctcacccccatttgccgcacgttgcccaactcctcctcctcctcgtcatcgtctccgttccgatccgcgcccataaatacgcgccaccccgcccccaacctcgccgtccttgtcccccccaagaaccccccgtgcgccaccaccaccaccaccaccaccaccaccaccaccgaggaattctcgctgtcgccgccgccgacgacgacgaggagaaggagtatcgctcacaatcttccgggccgatggggagggcgccgtgctgcgagaaggaggggctgaggagaggggcgtggagccccgaggaggacgaccgcctcgtcgcctacatccgccgccacggccaccccaactggcgcgcgctccccaagcaagccgggcttctccgctgcgggaagagctgcaggctgcggtggatcaactacctccggccggacatcaagcgggggaacttcaccgccgacgaggaggacctcatcgtccgcctccacaactccctcggcaacaggtggtcagccatcgccgcccagatgccgggtcgcactgacaacgagatcaagaacgtgtggcacactcacctcaagaagaggctggacgacgaacggaagctcgccgccgccggcggtggcggtggccgccggccgcatacgcgcaagcagcccaaggcggcaaagagcgccgccgccgtcaagcgcgaggcgacgccgtccgtcagcgtcgacaccagtagcggcgtgacgtgctccacggtgaccgagtcgtcgccgtcgtcggccgacggcgaccaccggcggcagcagcagcaaacgcagcatgccgctgtcaaggaggagagcttcagctcgggcggcgagctgccggcggcggcggcggcgcccacggcagcggccgacatggacgagagcttctggtcgtcgacggaggtgaccgggatgatggccggcctcggcgacatggacgaggagctggccatcgccggcacgtcgtcggcggcggcggcgaggagcgacgacatggagttctggctcaagatgctcctcgagtccggcgacatgagggatttggccgtcttgtaatctatttaatttaatcatggcagaattaagcttgattaaattaattaactaccgggaagaattgatagtatctcttctctgttgtttttttttaccttcttttttcatcttttttttcccagtttccagtgagaaaacgatgggaaattcaggtgatattttcacctttgttagaaaaaggaatactgtagtagtagcaaaaatttctttggttcgttatcagctggcttcagaattagatgc

SEQ ID NO: 5356 - DNA, 1038 bp, Oryza sativa
  Predicted polypeptide sequence is orthologous to G233, G241
gcatcacacagacgacgcagcatcagcaacacacacacacaccgagcaatcaatccatcacacacaaacacaaacaaacgcacagggcgcgagagctcgaacgagaggaggaaaggtcggcaatggggagggcgccgtgctgcgagaagatggggctgaagagggggccgtggacggcggaggaggacaggatcctggtggcgcacatcgagcggcacgggcacagcaactggcgcgcgctgccgaggcaggccggccttctccgctgcggcaagagctgccgcctccggtggatcaactacctccgccccgacatcaagcgcggcaacttcacccgcgaggaggaggacgccatcatccacctccacgaccttctcggcaaccgatggtccgcgattgcagcgaggctgccggggaggacggacaacgagatcaagaatgtgtggcacactcacctcaagaagcggctggagccgaagccgtcgtccggccgggaagccgccgcgcccaagcgaaaggcgaccaagaaggctgcggcggtggcggtggcgatcgacgttccgaccaccgtgccggtgtcgccggagcagtcgctctcgaccacgacgacgtcggccgccaccaccgaggagtactcgtactcgatggcctcctccgcggatcacaacaccacggacagtttcacctcggaggaggagttccagatcgacgacagcttctggtcggagacgctggcaatgacggtggacagcaccgactccgggatggagatgagcggcggcgatcctctcggcgcgggcggtgcctcgccgtcgtcgagcaacgacgacgacatggacgacttctggctcaagctgttcatccaggccggtggcatgcagaatttgccccagatttaatttaggcagagaattggcctcttgggtcgatctcttgttcatttttcttaccaccactattctttgaatctttggagctgtgtaaatctttacaaagcggagagattgatgggaaacgaaagaaggcaatattatcttt

SEQ ID NO: 5357 - DNA, 1836 bp, Oryza sativa
  Predicted polypeptide sequence is orthologous to G233, G241
gactctgcagcctcggagcagccgcctcccttccaagaacacacaacgcaagaggagcagagcagttcagatcagagcagggaaggagcaagcacaatggggagggctccgtgctgcgagaagatggggctcaagaagggtccatggacgccggaggaggacaaggtcctcgtcgcccacatccagcgccacggccacggcaactggcgcgccctgcccaagcaagccggtgagtgacagcggctcgtgttcggttcaggtcgtgtacctttggcggcgccggtgaagcaaagctaaaatgggttttgatgtcgcagggctgctgcgttgcggcaagagctgccggctccggtggatcaactacctgcggccggacatcaagcggggcaacttctccaaggaggaggaggacaccatcatccatctccacgagctgcttggcaacaggtacacacgctgctctgctcctccttaattgcagacttatctgatctgatccccccaaatttcgctgctcctggtttggagcaatgattgttgcttgcttatgtgcttcaaatgctatgagagggaggtttattccttttttatttatttagttattattagttatttattaccattgtggaggggcatatactgatatgttatcctcctgggccacctgctctcgatgcaaatagagagaaaatatattgctagtcgtaggccacttttctgtagctaattacatcactgatgatgcgcgagatgtgctaaaagattccatcttgtttggctcttccggtgaccccccttgaattcagcgctgcaaaaacatgcgctttgcattaaacaaccgcatgtgatcccgacgagggaatcaaatcacgcgatgatagcaaagctctaaatcaaaatgaagtcatctgaaatagccaaacaattttttttttttgacaaaatgaaacatgaacttgggcactgatccgctctgaattctgtgctacgcaggtggtccgcaattgccgccaggttgcccgggaggacggacaacgagatcaagaacgtgtggcacacccacctcaagaagcgcctcgatgcgccggctcagggcggtcatgtcgcggcgagcggcggcaagaagcacaagaagccgaagagcgcgaagaagccagccgccgccgccgccgcgccgccggcgtcgcccgagcggtccgcctcgtcgtcggtgacggagtcctcgatggcctcgtcggtggcggaggagcacggcaacgccgggatcagctcggcgtccgcgtccgtgtgcgccaaggaggagagctccttcacctcggcttccgaggagttccagatcgacgacagcttctggtcggagacgctgtcgatgccgctggacgggtacgacgtgtccatggagcccggcgacgcgttcgtcgcgccgccatccgccgacgacatggactactggctcggagtgttcatggagtccggcgaagcgcaagacttgccgcagatctagagaaagagagagaattttaccgtttcttcggttaattgatttgttttttctctctctgccgccatcttgcaccggagggacatagctaacagacaagagtgtccatgagcgaatcatcaagcaggaagaacgcgaatcatgcgatgcgatgcgatgagatgcacccagtagctttgatagttaattttctttttttacctccttcctgtatgtatagaaacagaagagatcagtgatcgaaacctgagatcctttctcacaatgtgcaaactggatcatcagaaaacgggctctgcgtttctcatttgattaattaaattcaacttgcacgc

SEQ ID NO: 5358 - DNA, 1367 bp, Oryza sativa
  Predicted polypeptide sequence is orthologous to G234
ctaaccaagtttaggccctaatcaacgctttgctctgcacacctcgcaagagatcagagcccctgaaagctagaagaggagatagaggataacccacacgccatggggagagcgccgtgctgcgacaaggcgagcgtgaagaaggggccatggtcaccggaggaggacgcgaagctcaaatcctacatcgagcagaacggcaccggcggcaactggatcgccctgccccagaagatcggtttgaaaaggtgcggcaagagctgccgcctccggtggctgaactacctccggccgaacatcaagcacggcgggttctcggaggaggaagacaggatcatcctcagcctctacatcagcataggaagcaggtggtcgataatagcagcgcagctgccggggcggacggacaatgacatcaagaactattggaacacgaggctcaagaagaagctctttggcaagcagtcgcgcaaggatcagaggcagcagcagcacctggcgcgccaggcggcagcagctgccagcgacttgcagatcaaacaagaagcgagcaggggtgcaaacgaagccgatggcttggctgccggtgccaattacacttggcatcaccaccacgccatggccgtgcctgtgcacccgatgtcggcaccaatggtggtggaaggaggccgtgtgggagacgatgtcgatgagtcgatccggaagcttctgttcaagctcggagggaacccattcgcggcctcgccggcaccgccatgcatacctccaccaccaatgtacgaggaagccccaagcttcgtgccaccattggcgcacggcgtgccgctcaacgaaggcggcatgcagtgctccagcgtgctgccggcgctggagctggacgagaacttccacttcaaccatgtcaagctggacgggctcgagtgcctcttcgggatgggagatcaccaaaacatgagatggaatgaggtgagcccgttggtttgccctaataacgctgtggcgtccagctcccaagggatgcagcagtactgcctagttgaagaaccagctgacctcgggatgcagtagcaatttggttgtgtttccgtgtacatgcatgattgtgtggtgtaaatctgtagcattcatggggaaattaatggggaaagatgagatcaaacttctttgaactaagagcaataaggtcgagctctcaccactcctagatgagagataggtgcatgcctgattttccaggtgtcttcatgtgagtctagtctttaaatggtattttcctctactctcttactgccctacagaaacattttacattagactgtacgtgttgcatttatctgtcgcttaatttggtgtgttttggcgtattt

SEQ ID NO: 5359 - DNA, 1726 bp, Oryza sativa
  Predicted polypeptide sequence is orthologous to G237, G1309
acaactcatggcttcgaagtccaaactcaacactacaagccagtaagtttaactactacacatgcacggcacgatttacacctctgaaaaagagggggaaaaaaaagaaactgacgaatttacacttcggcgacgaactgtacggaagaaagagcgtacgctcccgcctagttgatgccgaggaactcgctcatggagagcaggtcgcagagccctcctcctccctgcatgtgatcggccgcgtcgtcgaagtcccagcagaagccgccgtcgcccagcccgtgcagggagtccacggcgccgccgcacgggacgtcgacctgcaccgacgacgagccctggtagctcaggcccggcgccgtcccggcgaggctagtcccgtagtccatgtcgaaccagtcggcgaacatgaccttggggatcacgggcgcgtgcggccggacggcggcgagccccgccgcgggctcggtgaggctgctcgagtcgtcggccgacgacgactcgaccggcccggaagactcggagctcgccggccggtcagcggcgacgcgttcttggccggtctcgctgcggttcgggctgccggtgacgacgtcggccggctcggcggattttctggccgcagcctccgcgccttcgactcgcttcttgagcgtgcaggttcatgacggtttcttcttcctctcgggaaaacatgccgtgcttcagccccggcctcaggtaattgatccatctcagcctgcaactcttgccgttacgctgcagccctgcatgaaaggcaaattcagaagagaattcagctcaccagacaaggtacatttgacgaaaaaacacaaaagctcaaacaggcttcatctatcgtcctgaagctgaacaacactttgcaaatagtaggaaacaaaaaaaatcccttctccccttcccttaaatcaaggtgcatttgaaaaaaaaaagaaaaaaacgagagcagcaacaagcaaacaggggggttttgaagcaggacacaggtgcaatgcattcaggcgtacagcagttgcaaaattcgcggtgaattccccggcgaaatcgtcgcaggcggagctcggaaccgtggtcttaccggccttcacggggacggcgctccagcagccgtggccgtagcggaggatgaagtcgcggagcttctggtcctcctccggcgaccacaggcccttccggtagtgcaccttgggcttctggcacgccttgcaccccatcaatggcggacgagaagagagcaagaggagactctagagtctagactctagagagacaatgccaaaccgcgagcagcacgaggggaaaagaaagcagaagaagactttggcttggtaaggaggaggaggaggcggcttgcttggacggccgtgattgctttgcggcctgcactgttgtgtcggtctgcgttggcgtgagagatgggcgcaggggctttataggcctcgcccaatcatcaccgttggccctgtggcccctcacgggaataagcaagtggttaggtcgccgattgtttttccttcttttagttccgaggaaaaaataaatggttttttttatctgtccgaccaaaaccatatatgtacatggcactagtatcattacatcggacggagtacataccttcgctttctgtaattctcagaggctgcagtagtctgaaagcagatgcaatttttagcgaaataaaattacaaggtttggcacttgc

SEQ ID NO: 5360 - DNA, 954 bp, Oryza sativa
  Predicted polypeptide sequence is orthologous to G237, G1309
atggggtgcaagtcgtgcgagaagcccaggccgaactaccggaagggcctgtggtcaccggaggaggaccagaagctccgcgactacattctccgccatggccacggctgctggagcgcgctccctgcgaatgccgggctccagaggaacgggaagagctgccggctgcggtggatcaactacctgcggccggggctgaagcacggcgtgttctcgccggaggaggaggagacggtgatgagcctccacgccgcgctcggcaacaagtggtctaggatagcacggcatctacctgggagaacagacaacgaggtgaagaactactggaattcttacctgaagaagcgagtggagagcggcggcggcaagacgagccaagggccaccaaccacgcctgcgtcagccgcgagctctcccgccgattcagacgactcgcacagcctgcagcagaagccgcacgagccggccaactccgactcgtcggagccggcgcacgagtcgtcgtcggcgtcggccgactcgagctgcctgacggtgaccacggaccacccgcccgtctcgaggccccacgcggcagtgacacccaaggtcatgttcgcggactggctcgacatggagtacatctgtgggcaggtcgcggcagcacctggtctggacgctgccggattcgcggtggttggtggtgctgcaggcgatcagcagcagcagcagcagcaggtgatgagccaggacggatcggttcatcaggccgatgggccatcgtgcggcgtggacgattcttccctgcagcagcagcagcaggaggggttcggtggcaacggcggctgctgggattttcaggagcagttcgacagcatcgaccagatgcaggcgagcggcggcggcggcggcttctgcgacctgctctccatgagcgacttcgacctctgggccgagctggaacgtaccgcgtga

SEQ ID NO: 5361 - DNA, 411 bp, Oryza sativa
  Predicted polypeptide sequence is orthologous to G237, G1309
ggttgaaacggcacaaagctccatccgttctgaaggctttgtggccgagttctcctcccccacctcctcctcctcctcctcctctgtagccgagctgaggccaacgcgagtagtgacattctcctgcaatggggtgcaagtcgtgcgagaagcccaggccgaactaccggaagggcctgtggtcaccggaggaggaccagaagctccgcgactacattctccgccatggccacggctgctggagcgcgctccctgcgaatgccgggctccagaggaacgggaagagctgccggctgcggtggatcaactacctgcggccggggctgaagcacggcgtgttctcgccggaggaggaggagacggtgatgagcctccacgccgcgctcggcaacaagtggtctaggatagcac

SEQ ID NO: 5362 - DNA, 2294 bp, Oryza sativa
  Predicted polypeptide sequence is orthologous to G249, G1322
gaccaatccatctctcttctctctctctctctctctacaacttctcagctaagctaagccaagctagagccatctagctacttttgctgctttctctctcctcctgcaacacacgacctagctgagagctgagctgagttgcgccggccatggcagcatcgcagaggagcaggagcacggcggcgcagctcgacgtcgacgaccaggcggcggccgatcagctgatgacgatgatgcggcggccagcggcggtactacaggatgaggccgccgccgaggaggaggcctccgcggcggcagcggacctgcagctggagctccggcgagggccgtggaccgtcgacgaggacctcaccctcgtcaactacatcgccgaccacggcgagggacgctggaactccctcgcccgcgccgccggtaatctaatcaaatcaagttgtagtcaatcgattcgatgtcgatttgattcgaattatatatggaatcgatgaaaatcgatttgatgtttgtgatcgatcgatcgatgaagggttgaagaggacggggaagagctgcaggctgcggtggctgaactacctccggcccgacgtgaagcgcggcaacttcaccgccgacgagcagctgctcatcctcgacctccactcccgatggggcaaccggtaattaattaattattaactcacccattattccgctcgctagttaattattacccgcttcgctcataaatatttgacgtttaggacatgatctgttgaaccaattcgaaaccttttatggttcgattgacacaacaaaaaaaaccctccaaataaattggaggaaattaaattaggaggcttggaaaagaggcatgtaattataattgattaattaaaatagtttatttgtgggcatgtaaatcactatatcaggtgtaatttaatttgtaggctcattagctagctcttgatggtatatatatggccatcaattgtggaccatacatggtatgtgtgcacacgtcgcatgtcacgtgctgtatttaatatgtacacatatacatgtggccacacacacttggatgccacacaaaaacatactttgacaatattagctttagatatgacacaatagttcaagatactagcacagttcatattgtacaagtcttctatcgctacagaggaatattaattattatgcatgcattattggttttaattaattgatttgcaaacatatatatggagaaaaagatagatacaatgatatatacatcaagctaaagcttctagctaggccggctagctaagcatgtacaaccaagatgcctctcactttcacataaacagagtgcatgaaagctgcacgggttttaaagctgcacgtctctcttccttccctccctctctctctttctctctctctacatatatctccactagtctagtgccacacaacttagcttatattgtactctttttcttgtgtgttccctaccatcaatttttttctaattacatttcgatcccattgggggtgtgttgattatctgcaggtggtcaaagatagcgcagcatttgccagggaggaccgacaacgagatcaagaactactggaggacccgagtgcaaaagcatgccaagcagctgaactgcgatgccaacagtgctaggttcaaggatgctatgagatatctatggatgcctcgcctcgccgatgcaagccagctcggtgatcaccatgggtataatagtaccactgccatgggcgatgctcatgggatgccagtgatgacatcgtcgtcgtcggactcgttcgcgacatcagagtcatacgatgggggcctttatgcaaatgtgcaggacaatgagatggtgaatggtggggactactggatgcagggagcaaataaagggttttgtagtaattatgagtcagagcaacttcatcctcatgagcatagccagtttcaggatccagatcttgttggttgggttcaaggcttttctgagggcatttccgagaatttttggagcttggaggacatttggaagatgtagtgaattttgcattaatttgtattgtggctatatatacacatacgtacaggagtatacattttataatattgattgataactcgtggaacaaagattagagtcagcttattctaacttcaaaagttactacgagagaaaaaaagtaaatttcttctttgattttcctttttttttgtatggatgtcgattgacacatatgtatatgttgtcccaacaatgtaaaacatataagaagacgtgattgttacc

SEQ ID NO: 5363 - DNA, 675 bp, Oryza sativa
  Predicted polypeptide sequence is orthologous to G249, G1322
atgtgcggccgcgccggcgagccggcggtgcgcaagggcccgtggacgctggaggaggacctcatcctcgtcagctacatctcgcaaaacggcgaaggatcctgggacaacctcgcgcgctctgccgggctgaaccggaacgggaagagctgcaggctgcggtggctcaactacctgaggcccggtgtgcggcggggcagcatcacgccggaggaggacatggtcatccgggagctccactcccggtgggggaacaggtggtccaagatcgccaagcacctccccggccggaccgacaacgagatcaagaactactggaggaccaagatacacaggaagccgcgcggcaggagccagctgctgcaggagccgtgcgaggacgccatgggcatgggcatgtccaccaccaccagcgaggcggcgtcgacgtcggcgtcgagcggccagagccaggccagccccggcgtctgggatgagtacatgcaggcgagcagcttccctcacccggagcttgtctccttcgccgccgaccaccacctcgaaatggccggcgtgggcgaggtcgccgccgccgccgccgcgcagttcgtcccgactgagttcggtttcaatgacggcttctggaacttcgtggacaacttctgggagacgatgccggtttcagacgtggtgtga

SEQ ID NO: 5364 - DNA, 447 bp, Oryza sativa
  Predicted polypeptide sequence is orthologous to G249, G1322
atggaagatcgaggcgggccgcagcggttcagcgagccgatgtcgagaattaggcccacaagaacgtatggaaactggaccgtcgatattgggccctcaaagattatttcggccgctcctgctccatgcagacgagaagacttgggctgttacctacggcccaacgctggacggacaagcaaaacagttgaacacaacataagaaaactaatcctgcacatgcaattgcttctgctcctgggcactgctgcccagcacttgcaacgatcgacattcaatatactgtttaacttctggcgcaattcacttgatgtgcccataaagacgatcgagcgaagcttcgccgtgagaaagacatccgagctgtccaacgtcgacaaacggacggcccagatcgagttgtatgtggtgctcgctcttctgtcacatcatcgccatcccccttga

SEQ ID NO: 5365 - DNA, 1464 bp, Oryza sativa
  Predicted polypeptide sequence is orthologous to G256, G666, G668, G932
agtttcagtttcagagagaggagtcagtggctgtatgctgccatggctctcaaggtggctagatagacagacatgttgcccatcaacttaagaagcaactagctgctgctgctgctaagggagagctataggcttagctgtggtaggctatagatattactattaggtagctactagcctataggcagacatggggagacctccatgctgcgacaatggcgtcggcgtcaagaaagggccatggacgccagaggaggacatcatcctcgtctcctacatccagcagcatggccccgggaactggcgctccgtgcccgagaacaccggattgatgaggtgcagcaagagctgcaggctgcggtggacgaactacttgagaccggggatcaagcgtggcaacttcacccctcatgaggaggggatcatcatccacctccaggcattgcttggcaacaagtgggcagcaatagcctcctacctcccccaaagaacagacaacgacatcaagaactactggaacacacacctcaagaagaaggtgaagaggctgcaacaacaacaacaatcacaccctgatcatcatcaccaccattccttccaaaccaccccttcttcctccaatgcagcagcagtagcaacaaccagcccaaactactacaaccctaacaacagcaacagcaacagcagcaattacctccataacaacaaccacaatcttgaatccatgcaatccatggccactgcacctagcaatgaggccaccaccatccccaagctcttccagttccagacatggatgaagccatcaccagcaacaacatcatcagcagcaacagctgctgcaggtagctgctacaagcaggccatggccatgcaggagctccaagaggagcaagagggctctgctgctgctgctgcaatggcttcttccattgatggcgtctccaaggaccaggattatcacatgtgtgctgtgatcagtggtgatgacaagtcgtcgtcgtcggagatgatgacggctgcggcaatggccggccatggcgaggcggccacgacgaccttctcgctgctcgagaactggctgctcgacgacatgccggggcaggcggccatgagcgccgccatggatgggttcttggagatctctgctggatactgctgtgcagaccctatcatgttctgaactttctgaacttctgatgatcatctcagccttaatttcccatatgagtctctctttgctataggtttcttaatttcactgagttaatttgcacttgtactagctgtttgatgctctctctctctcgatgatcttgtgtttccggtaataaaccgttggtttaatttcctcaagaaaaagcaatccacctggaaataatctggttggtttggagaaatattgtcagttctcaaggatgtaataaaaggattaaagctgccataattcgttgcctgatatgc

SEQ ID NO: 5366 - DNA, 2407 bp, Oryza sativa
  Predicted polypeptide sequence is orthologous to G256, G666, G668, G932
gagatatctctgaaatctccacttctgacagacggtccaccgccggaccgcgacgatgcaccaccgcaccgcccgaccagcgccgaggcactaccgcactgctgcccacggccaggcgcgggtccagccgcctccgaccgccaccacagcgcctccactgcctgcagggacgccaccgctacccgcccggctacctccgttgccgccgccaacacgcgagtctcctcctccctgatcgagatcgagtcgacacacatacaccaccaaccaccggccggccgccgcgcgccggtgagcaggatggggaggccgccgtgctgcgacaaggttggggtgaagagaggggccatggacgccggaggaggacctgatgctggtctcctacatccaggagcacggcgccggcaactggcgcgccgtgccgaccaacaccgggctgatgcgttgcagcaagagctgccggctccggtggacgaactacctccggccggggatcaagcgggggaacttcaccgagcaggaggagaagctcatcgtccacctccaggctctcctcggcaaccgttctctaccataatcgtggtccacaacatagccatgctttctgaatactttcaatggataatcaacgaagctctacactacaaatttctgcaatgacaggtactattattttttgtctgaattttgctttgcttgctacctttattttacctgcagacaatttatatttggcctgtgataatactctattgtagtgtatgtactaaaaggtgtttttattctatttaattaggagggatcatatggaggttagtttatcaacattctaaagtatcaatattgatgctcatgattttgttaactattgtttatcactgattctctttcatgcccaataggtgatttcaccaatgaaagatggaacatttattgattgggatattgttgacaatatatggaatcatgctttcaagcagcggctattgatcaatcctgaggagcatcctatgttgatagttgaaccatctacaaacacagggcagcaaagagagaagtatgtccatatatattctgtatttaaattaattgtgttgcttacttgtatagaaaaacatcgcgtataagaactagctgatttatagcacaattttcttctatggctcttatcagttatgactgaactgtattggtaccaggatttactgcatgatcagacatcctaggtagtatattgtagataaaattcaattacatgggaaattttcaggctgtagttgctctgtttgttgctaacgaataattcagtcctatattcgtcttctagggttttacattcttcctctcgggtcctatattcattttctgggctcctgtatttgttctccgagtctttctctcgattcctatattcgtcctctagggtcctatatctaaatttaacaattctcaaatcctttttatcatttttgtatcgtgggttgtcaaaataagcaactatagtatttctacgtaaaacacccataaagggtatttcaatcgaaatcccaaaaacaggatattggttctttcgcttgctcttgatgatactgtttcttcgcattttggctaacaaatctgaattattttgaagaatagaaggatagacaaaattcaaatgaccattggacatgattcgatccggcgttgaataatcaagaatttccctatcttttttaacaaaagtatccattcagtcgttctttttatcatgccatttttgttatttatcagtttttttggaacaaaaacatggtattttcttagttgatgctttatgcaggtatctactgactttaaagatcatgaaggcataatgcatatatcagggctttgacatggtcttcgtgcaagaataaaatgccattttgtgtttgtcaacaagtgttatttattttttaatcaacaattgtttgtcttacttcaggttcactgatctaatgttttagtcttgcacctatcacttgctaataatgttgtaaccttgccttgcacctatcacttgctaataatgttgtaaccttgctcctgtcacttgatagtatttcaaataatttccaatattatttgtgcagattatataaggtcgctttaagattaccttgttcagattcttcggccggccctattctttacattatgcattggactattgagcctggttgtttttggaggaccagggagcatggctggagtatcatctggaggataacctgatgtggattattcacttggctttgtcttgacaaataatatatgagttattgcttgtaagagaggtcaagagaggtcttattttctgatcttatcctagattgtattaaggacaattcatgtggattaaggagaattcagaaacaaaatttgg

SEQ ID NO: 5367 - DNA, 2327 bp, Oryza sativa
  Predicted polypeptide sequence is orthologous to G256, G666, G668, G932
ggctcgctccgcgcctctctctccccgctcgcgtcctcgctctgcgcctcctctcctcgcgacggtccaccgccggaccagcgacctcgcctcctcgctccgcctcaatgccggaccagcgccgaggcactaccgcactgctgcccacggccaggcacggtccagccgcctctgaccggcaccacagcgcctccgctgctcgcagggacgccgccgctacccgcccggctacctccgttgccgccgccaacacgctagtctcctcctccctgatcgagatcgagtcgacacatacaccaccaaccaccggccggccgccgcgcaccggcgagcaggatggggaggccgccgtgctgcgacaaggttgggtgaagaaggggccatggacgccggaggaggacctgatgctggcctcctacatccaggagcacggctccggcaactggcgcgccgtgccgaccaacaccggggtgatgcgttgcagcaagagctgccggctccggtggacgaactacctccggccggggatcaagcgggggaacttcactgagcaggaggagaagctcatcgtccacctccaggctctcctcggcaaccgttctctaccataatcgtggtccacaacatagccgtgctttctgaatactttcaatggatagtcaacgaagctctacactacaaatttctgcaataacatgtgatttcaccaatgaaagatggaacatttattgattgggatattgttgacaatatatggaatcatgctttcaggtgagttgctttatctatttgatgcagatctgagtaattttgtgccaaaagtgcacgcccaaaaagctggccacacttgtggcaaaacttgtctgaaaaataaatctatgacatgagaggcactggagtaaccaggtttggcacgctgcttatgtggttcgccaaacacttgcccgttgccgcaaaaggccgaacgtgcctaacttgtttctggggaagtttgggatgaaccaaactctatctttaacatagtttctttagaatcagcaacaaagttaatcttctatgcctctatggaatcttttggatgtcagcatggttactgctttatgcccaccatcttttcaccttacatatttatttatgctcttcaaatatactaatagtgaaatcccttcttatgtgtacaaccggataaagttgattaaatactaggatttcctttgtatggcatggagatgcaactactgaagttttttgctttgttagcttttatcctgaggagcatcctatgttgatagttgaaccatctacaaacacagggcagcaaagagagaagtatgtccatatgttctgtatttaaattaattgtgttgcttatgtggtcctatatctaaatttaacaattctcaaaacctttttatcttttttgtatcgtgggttgtcaaaataagcaactatagtatttctacgtaaaacacccataaagggtatttcaatcgaaatcccaaaacaggatattggttctttcgcttgctcttgatgatactgtaatggaatggcaaacctatttcttcgcattttggctaacaaatctgaattattttgaagaatagaaggatagacaaaattccaatgaccattggacatgattcgatctggcgttgaataatcaagaatttccctatcttttttaacaaaagtatccattaaggtgtttcttttatcatgccatttttgttatttatcagtttttttggaacaaaaacaatgtattttcttagttgatgctttatgcaggtatctattgactttaaagatcatgaaggcataatgcatatatcaaggctttgacatggtcttcgtgcaagaataaaatgccattttgtgttcgtcaacaagtgttatttatttttaatcaacaattgtttgtcttacttcaggttcactgatctaatgttttagtcttgcacctgtcacttgctaataatgttgtaaccttgctcctgtcacttgatagtatttcaaataatttccaatattatttgtgcagattatataaggtcgctttaagattaccatgttcagattcttctgccggccctgttatttacattatgcattggactattgagcctggttgtttttggaggaccagggagcatggctggagtatcatctagaggataacctgatgtggattatgcacttggctttgtcttgacaaataatatatgcggtattgcttgtaagagaggtcttgttttctgatcttatcctggattgtattaaggacaattcatgtggattaaggagaattcagaaacaaaatttgg

SEQ ID NO: 5368 - DNA, 1223 bp, Oryza sativa
  Predicted polypeptide sequence is orthologous to G256, G666, G668, G932
ccacgcgtccgctcctctcttgcaacatcaaactcatccatccatccatcgatctgagaaatccagctttccagttcttggatctccatcgaccatggtgaggccgccgtgctgcgacaaggacggcgtcaagaagggcccgtggacgccggaggaggacctcgtcctcgtctcctacgtccaggagcacggccccggcaactggcgcgccgtcccgaccagaacagggctgatgcggtgcagcaagagctgtaggctccggtggaccaactacctgaggcccgggatcaagcggggaaacttcaccgaccaggaggagaagctcatcgtccacctccaggcgctcctcggcaaccgctgggcggccatcgcgtcgtacctccccgagcgcacggacaacgacatcaagaactactggaacacccacctcaagcgcaagctgcagggcggcggcgccggcggtgacggagacggtggcgccgccggcgacgcggtctccccgaagcccgccgcgcagaggcccgcgtcgtcgtccaaggggcagtgggagcggcgcctgcagaccgacatcgacatggcgcgccgcgcgctccgcgaggcgctcacgtcgctcgacgacgtcaagccaccgcatcagcccgacgccgccaacgccgccgcggggggaggcggcgccaccaccggagcagcagcgtccgccggcgccgatagccccgccgcgtcgagcacgtcgggggcgtcgcagtgctccccgtcatccgccggctacgtcctcaccaccgagaacatctcccggatgctcgacgggtgggcccggaagaagggcggcggcggcggcaggcgcgccgccggcagcgggccggccacccccggcgccaccgagagcgcgtccggctcgtcggaagcctccgaggtgtcctacggcggcacggccttgtccgcagcggcggcgcccgcgtccgccttcgagtacgagacaaagccgaccgtcaccgccgccgccgccgccgacgccggcgacgagacgcagctctccgccatcgagtcgtggctgttcgccgacgccgacggcatcgagagtggcagcttgctcgacgcggccatggattacaccttctaatccacaccaccaccaaaccatgcaagaatcgtaggcagcgagagtgagcagcgcgagttcatcactagcccaacctgaaaaaagaaaaatcgaaaaaaaaaaa

SEQ ID NO: 5369 - DNA, 933 bp, Oryza sativa
  Predicted polypeptide sequence is orthologous to G256, G666, G668, G932
atggggaggccgccgtgctgcgtgaaggcggaggtgaagaaggggccgtggacgccggaggaggacctcatgctcgtcgcctacgtccaggagcacggcccgggcaactggcgcgccgtgcccaccaacaccgggctgatgcggtgcagcaagagctgccggctccggtggaccaactacctccggccggggatcaagcgggggaacttcaccgaccaggaggagaagctcatcgtccacctccaggccctcctcggcaacaggtgggcggcgatcgcgtcctacttgccggagaggacggacaacgacatcaagaactactggaacacgcacctcaagaagaagctcaagaagatgagcgccaccggcggcggcggcgacgacggcgagggaggtggcgccggcgaggtgaagaccagggcggctgcgccgaaggggcagtgggagcggcgcctgcagacggacatccacaccgcgcgccaggcgctccgcgacgcgctctcgctggacccctcgccgccggccaagccgctggactcgtcgtcgggcgccacggcgccgccgtcgtcgcaggcggcgacgtcgtacgcatccagcgccgagaacatcgcgcggctcctggagggctggatgcgccccggcggcggcggcggcaagacgacgacgacgccgtcctccgggtcgaggtcgtcggcggcgtcggtgctgtccggggaggccagccacagcggcggcgccacggcgccgacgcccgacggctcgacggtcaccagcaagacgaaggacgaggagaccgccggcgcgccgccgccgccgccgccgccggcgttctccatgctggagagctggctgctcgacgacggcatgggccacggcgaggtggggctcatggacgtggtggtgccattgggggacccgagtgagttcttttag

SEQ ID NO: 5370 - DNA, 1203 bp, Oryza sativa
  Predicted polypeptide sequence is orthologous to G258
atggggcaccactgctgcagcaagcagaaggtgaagcgagggctgtggtcgccggaggaggacgagaagctcgtccggtacatctccgagcacggccacagctgctggagctccgtccccaagcacgccgggttgcagcggtgcggcaagagctgccggctccggtggatcaactacctccggcccgacctcaagcgcggcaccttctccgagcaggaggagcgcaccatcatcgacgtccaccgcatcctcggcaaccggtgggcgcagatcgccaagcacctgccagggcgcacggacaacgaggtgaagaatttctggaactcgtgcatcaagaagaagctcatcgcgcaggggctcgaccccaagacgcacaacctcctgccggcgtcgaagacgctcctccatggcggtggcggtggcggcgctgcaaaccctagcggcaacggcctcgcgcagttccagtctaacaacggcgcggcggcggcgggcaccacgccgttcaccatcagctctccggccaaggcggccgcctacgatgtcgcgccgccggcgttgtacgacgtcgtcctccctgctaaccccgccggtggaatgctgatggcgcatgatcaccaccatcatcaccaggtcgccgcggcggcggcgccggtgggatacccctacgccgaccacggcggcaacggcggaggcgtgctgatgagcttcagggatcagaacgccggcgtccacggcgccgcctccatggacttcatgaacggctcctcctcgtcctcttccatggagcagctcggcggcggcggcggcatgtcgtcgaacggcaacggcagcttcagcgcgagcatggcggcgttcatggacgaggaggcggcaatgtgggccaccgccgtcgcgccgccgggcatgggcggcctcgccgggatggatcaggtggcgcagcagcagcagcagcagcaagtgctggtgcaggatgcggccgtgggcgttgcgccgacgacgctgatgatgcacggcggcggcgccgccaccgccggtgcaatggtggtggacaagagcgtggagatggtggacgtctcgtcggcggtgtacggcggcgcgacggcgacggcgttcgatctagacctgatggtggagtcgtgcgggatgttctgcggcggcggcggcgccggcaacgccatggagcagctgcagtgggactgctaa

SEQ ID NO: 5371 - DNA, 1983 bp, Oryza sativa
  Predicted polypeptide sequence is orthologous to G261
cgccctgcacccgttgccaccaccaccgccttctccgccgcgccgcctcctctcgcgtctcccgctcgtgcagggcgcgcgtcgtcgggcgagctgctgccgtctccgtggccgtggctgatcagaactagttggcgttcgatcggaaagtcgctgtcttttggcgactcggtgagaatttgcgccgcggttcaatgtgaaaaattttggcccgtggcgagttggatttggcgccgagtccattcaggtggttaagacttgttcgtgggagagcgaagctgcgcgcgttaagaccgggctccgttcttgcatcgtgcagagcagctgctggtttgagaattgagaggcgcggttgacatggagagttccaacctgggcggcggcggcggcggaggcggcggcggtgggccgccgccgttcttgatcaagacgtacgagatggtggaggacgcggcgaccaaccacgtcgtgtcgtgtggccccggcggcgccagcttcgtcgtgtggaacccgctcgacttctcccgtgacctgttgcccaagtacttcaagcacaacaacttctccagcttcatcaggcagctcaacacctacggtttccgaaaaatcgatcctgagagatgggagttcgcaaacgaggatttcataagagggcacacgcaccttctgaagaacatccatcgacgcaagcccgtgcacagccactccctccagaaccagataaacggaccactcgccgaatcggagaggcgcgagctcgaagaagagatcaaccggctcaagtacgagaagagcatcctcgtcgcggacctccagaggcagaaccagcagcagtacgtgatcaactggcagatgcaggcgatggaaggcaggctagtggcgatggagcaacggcagaagaacatcgtggcctccctgtgcgagatgctgcagagacgcggtggcgccgtgtcgagctcgctgctggagtccgaccatttcagcaagaagaggagggtcccgaagatggatctcttcgtcgacgattgcgcggcgggcgaagaacagaaggtgttccagttccagggaattgggacggatgcaccggccatgcctcccgtgcttcctgtgaccaatggtgaggcttttgacagggttgagctgagcctggtctccctggagaaactcttccagagagcaaatgatgcttgcacagctgctgaagaaatgtactcccatggtcatggtggtactgaacccagcactgctatatgtcctgaagagatgaacactgctccaatggagacaggcatcgatcttcagttaccagctagcctccatcccagctcacccaacacagggaatgcccatctccatttatccactgaactcacagagtctccaggttttgtgcagagtccagagctgccaatggcagagattcgtgaagatatccatgtgacaagatacccaacacaagctgatgtaaattctgagattgcctcctccactgatacttcacaagatggcacgtcagaaactgaagcttcgcatggaccgaccaacgatgtgttttgggagcggttcctcacagagactccacggtcatgtttggatgagtcagaaagacaagagtctcccaaggacgatgtaaaagcagaattaggctgcaatggcttccatcaccgggagaaggttgatcagatcaccgagcaaatggggcaccttgcttcagccgagcagactctgcatacctgatgcagtaataccatttgcgcggattcatagttcgtgtgtaaattagcgaagatgtaaattatagcttagatcggattagaggcttgcgtgttactttacagatttcaaccttttattagattacaataggtctttcacaatttatgattctgttctatccgctgactactgtgcataaattttttttagtagaccatatccatttttgtactccattgcccttctaagattcctcgttaaaatctc

SEQ ID NO: 5372 - DNA, 3008 bp, Oryza sativa
  Predicted polypeptide sequence is orthologous to G261
accatcgcatcttcgcttcgcatcgcatcgctcacatgcgctgccttcgtcacgctccttagcaatctcgcccgccatcatgtccaatcatcccgcttggcacgaccagcagccacagtacccaccccctccaccgcaaccaacgcgacatcactcgggcatggatgcctaccaaggaccatcgccctcgtcctctacacagcagccatcaccgtacaacagcgcgccccaacacactgcatcctatccgcacgcgcatcttccacccccagcagccagacataccccgcagcagcagcagcagcagcagcagcagcagcagcagcagcagcagcagcagcagcagcagcagcagcagcagcagcagcagcatccacaacaaccgcaatgggcgtccggcacgagtcaagactttggcggtcctagccccgccaactcggcgccgcgttccaacagcggatacacaggcttcgaccctccgtccgcgtccaacaacagcccgatgcgccaacatggaggctcgcacagctccgcttatacctcacactcgccctacgcaccctcacagtcgcacgctcccgacgccgccatgcatccccagcgctcctccatgccctcgcactacgactaccaaaacaactatccgcatccgcaccatccgcaaaacccacagatgccaccacaacaccatccgcatccgcatccgcatccgcatccgcatccgcatccgcatccgcatccgcatccgtctcaacaacaacaccaccaacaggcgcactggaacactggcccgctcccttcggtgcttcagccccagtccgcaccgctctcctcgacgcccagcagcaatcgcgggcccagcgctccgccgcctccgcagcaccacaccatggaccgtgcctaccccaacatcaagcacgacgacgacatggacgacgacgacactggcaactacgacgactttgaccccaagggcaaggcgcgcgccgctgccgatgccatgcaggccgccaacaagggcaccagcgatttcgtcaagaagctcttcagcatgctcgacgacaaggcgtacgacagtgtcgtcgcctggtcgccatccggcgagagcttcatcgtcaaggacatgaacgactttacaaaacacgtcctcccgcgcaactttcgccactccaactttgccagcttcgtgcgccagctcaacaagtacgacttccacaaggtcaagaatcccgaggacggcgccgccaccgtcggcgagcacgtgtgggagtttcagcatccagactttgtgcgtggccgcgacgacctgctcgaaaacgtcaaacgcaagatccccgcaaagaagaagcccgccaagcccggcctggtcgatgccgaccgcgacgacagccccgccatgcccgcgcccgtgcagatggaagcaccggaacgggcagagtcgaatgcagaactcagggcgcaggtggcccatctcaccgccgcgcaggaccagatgcagaaccacatcctcgcactcacaaaacagtaccagggcgtcatcggcgaaatgctcaccttccagcgcaacacgatccagcaggaccagctcatgcagaacctcatccaatacctcatcaacctcgaccaggaccgccgcgtggatggcgcacccgccccaccctccgcatccagcttcctcgcccacatgggcgccaatcagggcttcctcgccacacccgctcccgccagtgcgggcccgcatacggtgggggtgcccgcgcccgtgagcggtgccgacgctgggccatccagccatgctggggcggcgccgccgctgtcgcccaagagcgtcgcgtctccgctcgacgccacaggcagcacgcccgagatctcggcgcagctggcgtcgctgcgacagagcaatccgctggcgcccatgatgctgcatccgccccacctcgatgcggacccggccgatagctcgttggtgaatgcagcggcgagcgcggcgcgcaacccgagtctgtcgtcgttcgaaaaggcgggtctgcgcgtgtttaccgtgggaacgctgcagccgcgcgactcgcctggcgatcccacacccgccccgccacaggagcttgcgccggccgggctgcgcaacgggtcggcggggtcgtcgttcgacgtgcatgccaatggcaaaggcaaggaggctgctgacgacaagaagcgcacgcctacgcccggcgagggtcacccgagcaagcatctgcgcgtgcgccgatccacactggttcccggctgggcggtgcccccgcgtgtcctgctggtggatgatgacgaggtgtgtcggcgtctctcgagcaagttcctgcaggtgttcgggtgcagtatcgactatgcggtggatggcatgtcggcggtgaacaagatgaatctcgaaaagtacgatctggtgcttatggacattgtcatgcccaacctcgacggcatgccggcgacgtcgttgatccgacagtttgatccgcgcacgcccatcatcagcatgacgagcaacagtgggccttcggagctggtcaactacatgtcgagcggtatgacgggtatcctgcccaagccgtttaccaaggaggggctgttgaatatgctcgagaagcatctgttgcatctcaaggcggcgaggggtacggggcaggaatggcccaagggtgtttcacctgcgccggcggcgacgcccagtgggacagcgcagacgggtgcggatgatgggacgcttaacccgttggcggggatgggctttacggatgaagagtacgtcgccatgctgcagaacttgatcgctgcgggtactcaggatgacgaggcgtttggcatcgacctcaaggacggcaagaggatggcagacgagagtggcggcgagaacaagagacagcgctttgtcgattcgtagcatggttgtaccatcccacacaagtgtatagtagtctgggaccgtgcacatgtgcacacgcaagtgggaacacggataccattgtcagaatgcg

SEQ ID NO: 5373 - DNA, 1735 bp, Oryza sativa
  Predicted polypeptide sequence is orthologous to G261
aatccgagagggatttttcctcgcaaccaaccaaaccaaccaaacccccaaccaagcgagcaagccgccttcgccgggggggcccccaccctgacggcaaccctagccctccgatcaccggcgctgagactgatcccgccgccgtaggaggaggaggaggaggtggtggtggtggtggtgatggaggggggcggcgggggcgggtcgctgccgccgttcctgagcaagacgtacgagatggtggacgacccgtcgacggacgcggtggtggggtggacgcccgccggcaccagcttcgtcgtcgccaaccagcccgagttctgccgggatctgctccccaagtacttcaagcacaacaacttctccagcttcgtgcgacagctcaacacctatggctttaggaaagtagatccagaacaatgggaatttgcaaatgaggatttcataaaaggacagcggcaccggttgaaaaatatacatagacgcaaacctatattcagccattcatcacacagtcagggtgctggaccattaacagataatgaaaggaaagactatgaggaagaaatcgagaggctcaaatccgataatgcagcactgtcctcagagcttcaaaataatacgttgaagaaacttaatatggagaaacgaatgcaggctttggaagagaagctatttgttgtggaagatcagcagaggagtctgatatcatacgtcagagagattgtaaaggcaccaggatttctttctagctttgtacagcaacaagatcatcacaggaagaagaggagactgccaataccaatctccttccatgaggatgcaaatactcaggagaaccagatcatgccttgtgacttgaccaactcaccagctcagacattttacagagaatcatttgacaagatggaatcatccttgaactcattagaaaatttccttcgagaagcaagtgaagaatttggtaatgatatttcatatgatgatggtgtcccaggcccttcttcaactgttgttctcacagagctccattcacctggtgaaagtgatccccgtgtttcatcacctccaacaaggatgcgtacttcgtcagctggtgcaggagattcgcactcctctcgtgatgtagcagagtctaccagctgtgcagaaagtcctcctattcctcaaatgcattctcgtgtagatacacgagcgaaggtttctgaaatagatgttaattcagaacctgctgttacagaaactggtccatcaagagatcaacctgctgaagagcctcctgctgtcacacctggtgcaaacgatggcttctggcagcagtttcttaccgagcagcctggatcatcagatgcacatcaggaggctcaatcagaacggcgagatggaggaaacaaggtggatgagatgaaatcaggagatcgacaacatctttggtggggcaaaaggaacgttgagcagataacagaaaaacttggacttctcacctcaacggagaaaacctgacataattttgtttttctttttgtagatgaaaaactattaattcaggaacgctgacattggtgccttcctcagtgagatatgttgactaacatctatttcgcagtgtaccgtattttttccatcatgtaccgtaatgtatcatagtgccatacattcatctttggtccattgacactttctgatatcattgtgcgtgatttctaaaatattctcaagtttggttaaatgttac

SEQ ID NO: 5374 - DNA, 1567 bp, Oryza sativa
  Predicted polypeptide sequence is orthologous to G263
ggtaggtccggaggaggaagcggcgagagaagctcagctaggcagggcgacgggcagaaacgcgaccacggcaacaaaccccgccgcgcgcgcccaccgtgccggttacatgggagtagaggcgggcggcggctgcggtgggagggcggtagtcaccggattctacgtctggggctgggagttcctcaccgccctcctgctcttctcggccaccacctcctactagctatacacacccatctcaccataacacacatacatagatagatagatagatagatacatacacacaaacataagtagctaggtagagaaagagatcatagcgttaggtgatcgatcgatggctgctgctgaggcggcggcggcggtggggaagcagcagcagaagggcggcgggggaaggggaggaggcggcggtgggccggcgccgttcctgacgaagacgaaccagatggtggaggagagcgcgacggacgaggtgatctcgtggggaagggaggggcggtcgttcgtggtgtggaagccggtggagttcgcccgcgacctcctcccgctccacttcaagcactgcaacttctcctccttcgtccgccagctcaacacctacggtttccggagggtggtgcccgatcggtgggagttcgccaacggcaacttccggcgaggagagcaaggcctcctctccggcatccgccgccgcaaggcgacgacgcctcagtcctccaaatcctgcggcagcggcgtcaacgtcgcgttccctccgccgctgccccctctgcccccggagccgtcggcgaccacgtccagcggcaacgaccgcagctcctcctccgcgtcctcgccgccgcgggcggacatcaccagcgagaacgagcagctcaggaaggacaaccaaacgctgacgatggagctggcgcgggctcggcggcactgcgaggagcttctgggcttcctgtcgcgcttcctcgacgtccggcagctcgatctccggctgctcatgcaggaagacatgcgagcggcggccggcggcgtcggcggcgagcagcgcgtgcaagagcacgcccgggaggagaagtgcgtggagctgttcggcgtgctcctcgacgacacccatggcgccgccacgaggaagagggcgcggtgcgaggaggcggctgccagcgagcggccgatcaagatgatcaggatcggcgagccgtgggtcagcgttccatcgtcggggccggcgcggtgtggcggcgacaactgaagtccaaacttgtgcatgccacggccatgacctgatcgaccaggcgaacggcaagcagaaggcatgcatggtgaggttggtggcaagaatggtccgatcaaccaagtcattaggtaaaacgagacgaattaagcacgccaaatacgtgcggccctgtgttaatcacgggttgctaccatgctagtagtaaggtaggaacagtacgaggagtcaaggctgaccgaagcgaagcagccggctcttgtgtctggacgttgtttcagttaacactgaaagcttcaccttactatggattatacattttttagataatgg

SEQ ID NO: 5375 - DNA, 1846 bp, Oryza sativa
  Predicted polypeptide sequence is orthologous to G264
gtacctacaacgaccacgacgactcctctcctccctttctctctcttcacccgcagcacgcgcgccgccgtctccggcgatggaagttgccgccggcgcccgcggcggcggggccggcggaggagggggaggccccgcgccgttcctgctcaagacgtacgagatggtggacgacccgtcgacggacgcggtggtgtcgtggagcgacgcctccgacgcgagcttcgtcgtctggaaccacccggagttcgccgcccgcctgctgcccgcctacttcaagcacagcaacttctccagtttcatccgccagctcaacacctacggattccgtaaaatagatccagagcgatgggaatttgccaatgagtacttcatcaagggacaaaagcacctgctgaagaatatccacaggcgtaagcctatccacagccacagccatccaccaggtgctctgcccgataatgagcgtgcaatatttgaggatgagatcgaacggctttcacgagagaaatccaacctccaggctgacctctggaaatccaagcagcagcagtcgggaacgatgaaccagattgaagatcttgagcgacgagtgcttggcatggagcagcgacagaccaagatgattgccttcttgcagcaagctagtaagaaccctcagtttgtcaacaagcttgttaagatggcagaagcatcttcgattttcacggatgctttcaataagaagagaaggttacctggtttggattacagtatcgagaacacagaaaccacaagctcttatgatgaccatagcagcacttctaagcaagaaacaggcaatcttttaaatcagcacttctctgataagcttaggttggggctttgtcctgccatgacagagagcaatatcatcacgctaagcacgcaaagctcaaacgaagataacagaagccctcatggtaaacatccagagtgtgacatgatggggagggaatgtctcccgttggtgccgcagatgatggaactctccgataccggcacatctatctgcccctccaagagctcttgctttgcaccacctataagtgatgaaggcctcttaacatgccatctgagtctaactcttgcatcatgctcgatggatgttgacaaaagccaaggcctcaatgcaaatgggaccactatagacaacccaactgaggcagcaacagctaccatggaaaaggatgacaccattgacagaagcttcgatgacaaccaaaagaaatcagctgattctcgtacagcagatgccacaacaccacgagcggatgcacgagtagccagtgaggctcctgcagccccggctgcagtggtgaatgacaagttctgggagcagttcctaacagagcgacctggctgctctgaaactgaagaagcaagctctggcctaagaacagatacttccagggagcaaatggagaacaggcaggcatatgatcactcacggaatgacagagaagacgtggaacaactgaaactctgaatttactatagaattatacaatttacaagaagggatacaggcgtacagtgtaagatgtttagaatcaggaacctgctgttaaacatgacagatcaatgggtgtacaacatcacacaggtgtacatattttttttccctgaatgtttcggagggttaagattaatagttcgattaaccacaccagttgttgtaaaatcgatgtgtctgtctgtctggcatggtttctcatcttgttggtagtgatttatgttatgcagtgtcaagctgccacagcggagaatcaaaattagcatgtacattacccttaaatatccttttcgtaaaaatatttttacgatc

SEQ ID NO: 5376 - DNA, 1846 bp, Oryza sativa
  Predicted polypeptide sequence is orthologous to G264
caacctacaacgaccacgacgactcctctcctccctttctctctcttcacccgcagcacgcgcgccgccgtctccggcgatggaagttgccgccggcgcccgcggcggcggggccggcggaggagggggaggccccgcgccgttcctgctcaagacgtacgagatggtggacgacccgtcgacggacgcggtggtgtcgtggagcgacgcctccgacgcgagcttcgtcgtctggaaccacccggagttcgccgcccgcctgctgcccgcctacttcaagcacagcaacttctccagtttcatccgccagctcaacacctacggattccgtaaaatagatccagagcgatgggaatttgccaatgagtacttcatcaagggacaaaagcacctgctgaagaatatccacaggcgtaagcctatccacagccacagccatccaccaggtgctctgcccgataatgagcgtgcaatatttgaggatgagatcgaacggctttcacgagagaaatccaacctccaggctgacctctggaaatccaagcagcagcagtcgggaacgatgaaccagattgaagatcttgagcgacgagtgcttggcatggagcagcgacagaccaagatgattgccttcttgcagcaagctagtaagaaccctcagtttgtcaacaagcttgttaagatggcagaagcatcttcgattttcacggatgctttcaataagaagagaaggttacctggtttggattacagtatcgagaacacagaaaccacaagcttttatgatgaccatagcagcacttctaagcaagaaacaggcaatcttttaaatcagcacttctctgataagcttaggttgggactttgtcctgccatgacagagagcaatatcatcacgctaagcacgcaaagctcaaacgaagataacagaagccctcatggtaaacatccagagtgtgacatgatggggagggaatgtctcccgttggtgccgcagatgatggaactctccgataccggcacatctatctgcccctccaagagctcttgctttgcaccacctataagtgatgaaggcctcttaacatgccatctgagtctaactcttgcatcatgctcgatggatgttgacaaaagccaaggcctcaatgcaaatgggaccactatagacaacccaactgaggcagcaacagctaccatggaaaaggatgacaccattgacagaagcttcgatgacaaccaaaagaaatcagctgattctcgtacagcagatgccacaacaccacgagcggatgcacgagtagccagtgaggctcctgcagccccggctgcagtggtgaatgacaagttctgggagcagttcctaacagagcgacctggctgctctgaaactgaagaagcaagctctggcctaagaacagatacttccagggagcaaatggagaacaggcaggcatatgatcactcacggaatgacagagaagacgtggaacaactgaaactctgaatttactatagaattatacaatttacaagaagggatacaggcgtacagtgtaagatgtttagaatcaggaacctgctgttaaacatgacagatcaatgggtgtacaacatcacacaggtgtacatattttttttccctgaatgtttcggagggttaagattaatagttcgattaaccacaccagttgttgtaaaatcgatgtgtctgtctgtctggcatggtttctcatcttgttggtagtgatttatgttatgcagtgtcaagctgccacagcggagaatcaaaattagcatgtacattacccttaaatatccttttcgtaaaaatatttttacgatc

SEQ ID NO: 5377 - DNA, 2437 bp, Oryza sativa
  Predicted polypeptide sequence is orthologous to G268
gagtccccggcagtgcacgatcccatccctcccgcatcggcaaggcaccgccgcgccgaccgctctccgcaccgcgacgcgacgcgacgcgaggcgaggcgaggcgagcatgaagcccctgggcgcgcacggcgccgacctgctctgcggcccgcgcgtcctccgcgctgcggccctcgccttcgcctgcgccgccgccttcctcgtcggctaccactggtccgactcctccccgcgcctgctcttcttctcctccaccgcctcctcctcctcctcgccgctcctctccaccggctccccttccgtcgccgtctcccccaacgccaacctctccttcgacccctccctgatccccacccctgccgcctccacgccgcctgcttctcctactgccaatgcctcgcccccaccttcgctgccgccgcctcctcctcccctccgcccccctccccctcccgcccgcctcggcatcgtcggcgaggacggcgcgatgcgcgacgacttcgacgtcgtcgtcggcggcgccaacgacaccgatctggccgccaccgacgaggccctgccgcaggagccgaccgacgcgggccccgccgtcgggagcagggttcggattgggaggttcccggtttgtcctgagagcatgagggagtacataccctgcctcgacaacgaggaagagatcaggaggctgccctcgacggagcgtggcgagcggttcgagcggcactgccctgccaaggacaagggtctgagctgcctcgtgccggcacccaaggggtataaggcacccattccttggcctcggagcagagatgaggtatggtttagcaatgtacctcacacgcggttggttgatgacaaaggagggcagaattggattagtaaagctaaggataaatttagatttcctggaggaggaactcaatttatccatggagcaaatcaatacctggatcagatttctcaaatggtaccagatattgcatttggctctcacactagagttgccctggatgttggctgtggagtagcaagttttggtgcatacttactttcacgtgatgtgttgacattatccatagctcccaaagacgttcatgagaatcagatacagtttgctcttgagcgtggtgtgcctgcaatggcagcagcatttgcgacacaccgattactatatcccagtcaagcatttgacttaatccattgttcacgctgccgaataaattggacccacgatgatggaatcctgcttctggaggttaatagaatgctcagagccggcggttattttgcttgggcagcacagcctgtttataagcatgaagaggctcagcaagaagcatggaaagagatggaagacttcactgcaagactctgttgggagcttgtgaagaaagagggatatattgctatgtggaggaaaccattaaataactcatgctacatgaaccgtgaccctggggtcaaacctgcactttgtgatcctgatgataatccagatgatgtctggtatgtcaatctgaaagcatgtatcagccggcttcctgaaaacggtgatgggctgactccctttccatggcctgcacgtttaatggagccaccaaaaaggcttgaaggtgttgaaatggatgcacactcatcaaagaaggagcttttcaaagcagaaaccaaattttgggatgacattgttgaaggttatattcgtgtttttaagtggagaaagttcaaactccggaatgtattggacatgagggctggatttggagggtttgcagctgcattgattaatcgtaaacttgattgctgggtgatgaatgttgttcctgttagtgagccaaacacactgcctgtaatctatgaccggggacttcttggagtggctcatgactggtgtgaaccatttgatacatatccaaggacatatgatctgctccatgcgtttagcctattctcgaaggaacagaaaagatgtaacatctcaagtatcttgctggagatggatcgaatactcagaccaggcggtagggcttacattcgtgacctaaaacaagttgtacaggatgtcaaagagataacaaccgccatgggatggcgatccatcatgcgtgacaccgcagaaggcccgtatgctagcaggaaggttttgatgtgcgacaagccgatggtgcgttagccgatcaggctggtccagagcaatgatgcgagccctggttttgttttccggagccttttgaactgactaccacagctactacggactggagattgacatctgtttcaatacatagggataggtgaatgccaaagttgtaactaatcaatttgattcgtcattcgtttgtacaacgactgatgtagcccctaacgattggcttgtttttgttgtatcatccacacaacagtaattatgaataggagttaggaaggtttttgagcg

SEQ ID NO: 5378 - DNA, 853 bp, Oryza sativa
  Predicted polypeptide sequence is orthologous to G270
ctttttttatagttgtataacttgtatacgtagtatttctcccgtgggtccaattaatggtccatatgttaggtctcgactttgattttcaagcaccaatgcccacggagtgcacagtatatatcaattatatgcatgcagaaacttacaggattgcatggacggggtgcagcattcagcattctcatgcctgctaattgctgttccagcaatccttttttagggcagtgccattgctgctccagtaatcggacatcaccattcatacatgtttgtaacacgtcgtgcagaaagtacgaaattacctcttaagattatacagcattgatatcatggaactttggccttccaattatcatgggcataccacaacctgttgattcccttcaaggagcaacctctatcttgaaccagaagtgattagatcatgcactggagaaaacagagttgcctcccaacagctcagtatctttcaataaactttaataaatttgacagtgtcatataccatccaagtgctgaactgggtcatgttgctttggtagacgaaagctcttgagtaatttgataagttcatacgtccttgcatgatgacccaaccggaggcataactccaaaggggtaaatccatcttgagttttcaaagttctatcaacaccctttattaagagtagcttaacgatatcagttctctgtgtttgcacagctagatgcaaaggtgtccatccataatcatctggccgattaatgtcaacattgtacagcaagagagtctttatggtctgactgcatgctgtttggacggcataatgcattagggttgcaccatctttatcgtggatgaatggatttg

SEQ ID NO: 5379 - DNA, 786 bp, Oryza sativa
  Predicted polypeptide sequence is orthologous to G270
tttttaccacttcacatgtggggagaaaacttttatctgttctgccgatgcagtgagaatttacactaacaatcgggacgtgaaggagaaacaaaataattcttgattaatatttgtatccaagatgctaggaatatctaagattaatggggtagaaagagaaaataatactactggaaatgtaaaagtatgcaggtcacgctaaacttatatttggcattaataatttgggtatcttgagttttttatggctaacctcttaagattatacagcattgatatcatggaactttggccttccaattatcatgggcataccacaacctgttgattcccttcaaggagcaacctctatcttgaaccagaagtgattagatcatgcactggagaaaacagagttgcctcccaacagctcagtatctttcaataaactttaataaatttgacagtgtcatataccatccaagtgctgaactgggtcatgttgctttggtagacgaaagctcttgagtaatttgataagttcatacgtccttgcatgatgacccaaccggaggcataactccaaaggggtaaatccatcttgagttttcaaagttctatcagcaccctttattaagagtagcttaacgatatcagttctctgtgtttgcacagctagatgcaaaggtgtccatccataatcatctggccgattaatgtcaacattgtacagcaagagagtctttatggtctgactgcatgctgtttggactgcataatgcattaaggttgcaccatctttat

SEQ ID NO: 5380 - DNA, 1392 bp, Oryza sativa
  Predicted polypeptide sequence is orthologous to G270
atgcctccttccctctccctccaccaccacctcctcctcttccccttcccttcccatgtccaaaccctaaacccgctctccgcctctcctcgcctccacccacatagcaaatctctcctccccaggcgccgcccgctcgttacctctccctcctccttcgccgtcgccgccgtcgatgaattcgacgaggatttcgccatcggcgactgcgtcgtgttcgaggacgacgccttcgaggagcccgatgtcgacctcccctctccggcgccatcgaccacctcgcgccccaggcggaagccggccgcggaggccggcggcggaggggggagtagcctggtgccggagaggtggagggacgcggcggaggagataaacctgacgaagaaggagaagcgccgcatcgcgcacggcttgcgcttcgggagccgcctcgagcggcgggcgccccccgccgtggccgcgcccgatgagtaccgcgcgtaccgcgaggggaggctggacgcggagctcggacgcgtcgcgcgcgactacgccgagccgatcgagaggtcacccgtaccggatagagtggaggctccgccgcctcctgagcctggtgctcgtgtggcacctaggaatccgaggttggggctgggtgtgagaagcctcgacgacatcacggagctgtttaacagtacggagtatgtgccaggcgagatggaggatggcaacaatccgaaaagccgacggaagctgttcacagatgaggagaaggttcttctgaacaagagagtacctgatcttgaagctgctacttctagcaagtggcttccacttcacacaattgcagcatcaggagatttctatctgttggacaatcttctaaaacataatattaatgtgaatgcccttgataaggatggtttaccagctattcataaagcaattctttccaagaagcatgccattatcaactatctcctaaggaattcagcaaatccattcatccacgataaagatggtgcaaccctaatgcattatgcagtccaaacagcatgcagtcagaccataaagactctcttgctgtacaatgttgacattaatcggccagatgattatggatggacacctttgcatctagctgtgcaaacacagagaactgatatcgttaagctactcttaataaagggtgctgatagaactttgaaaactcaagatggatttacccctttggagttatgcctccggttgggtcatcatgcaaggacgtatgaacttatcaaattactcaagagctttcgtctaccaaagcaacatgacccagttcagcacttggatgatagaggttgctccttgaagggaatcaacaggttgtggtatgcccatgataattggaaggccaaagttccatga

SEQ ID NO: 5381 - DNA, 2371 bp, Oryza sativa
  Predicted polypeptide sequence is orthologous to G274
gggcgaaatattttccgcggcgccgcgcgtaccgttcgtccgtcgtcggtggagtggaggctgccgaactgtaaagctcacgggttgggcgaatctccactcctcactcgccccccactgaaatcgccaaaaacccaactgaaaaacccccccaccggaatcctcacgcacacacctcgccgcggaagctgtggcgtccgcgtaggagcagctgtttcttttttggatccaatccaatcggataagcagccatggctgtgaaggcgagttctgcagataacaggaccagaagcaccgtgtcactatgcatagtgattggcatgtgctgcttcttctacatccttggggcatggcagaagagcggatttggaaagggggacagcattgcgctggagatcacgaagcgaacggactgcacaatcttgcctaaccttagcttcgacacgcacctcgctaagcaggcaaggcctcgcgatctcgtttcgccggcgaagaagtttaagccgtgcccggatcgctacacggattataccccttgccaagatcagaacagagcgatgaagttccctcgggagaatatgaattacagggagcggcattgcccaccgcagaaagagaagctgcactgcctgataccgccacctaagggatatgttgctccattcccatggccgaaaagtcgggactatgttcctttcgcgaattgtccctataagagcttgacagtcgagaaagcgatccagaattgggttcagttcgaaggcaacgtcttcagattccctggtggaggaacacaattccctcaaggagctgataagtacatcgatcaacttgcatcagttgttccaatcgccaatggaactgtcaggactgcattggacactggctgtggggtggctagttggggagcttacttattaaagagaaatgtcttggcgatgtcatttgcgccaagagattcacacgaggcacaagtgcagtttgctctggagaggggtgtcccagctgttatcggtgttcttgggacgataaaactcccttacccatcaagagcctttgacatggcccattgttccaggtgtttgattccatggggagcaaatggtggaatatacatgatggaagttgatagggttctaagacctggtggatactgggtgctttcagggcctccgattaattggaaagtgaactacaagggttggcagcgtacaaagaaagatcttgaggcggagcagaatgaaatagaggaaattgctgaccttctttgttgggaaaaagtcaaagagattggtgagatggcaatatggaggaaaagattaaacactgagtcttgtccctctaggcaagatgaatcaagtgtgcagatgtgtgactcaacaaatgcagatgatgtctggtacaagaagatgaagccttgtgtgacacctattcctgatgtaaatgatccaagtgaagttgctggaggtgcaatcaagcccttcccaagcaggctcaatgcagttcctccaaggattgctaatggcctgattccaggtgtttcatctcaggcctaccagaaagacatcaaaatgtggaagaagcatgtcaaggcttatagcagtgtgaacaagtacctcctcactggaagatacagaaacattatggacatgaatgcaggttttggaggatttgctgctgccattgagtccccaaaatcttgggtgatgaatgccgtgcctacgatttcaaagatgtcaactctaggggctatttacgagcgaggattgattggcatataccacgactggtgcgaagctttctctacttacccaagaacgtatgatcttatccacgctagtggccttttcaccctgtacaaaaacaagtgcaacatggaagacatcctactggagatggaccgcgtcctgaggccagaaggcgccgtcataatgagggacgatgtcgatatcctgacgaaggtgaacaggctcgccctcggcatgaaatggaacacgaggctggtcgatcacgaggacggccccatggtgcgtgagaaggtgctgtatgctgtgaagcagtactgggtaggcggaaaccagactgcagcagctgcagcatgaagcaggcgtaaatcctaacacaaaagatggaagaactctgcaatccatcctgaactgacttccaggaaaggtaagatacgggagtcatttagtgagaggccaggtgatcttgtcggagtggcgatgaagaagcaacccgggctttcttggttgctctgatgatcggctggcgtatattgttgtaacaattttgtaatttcatttgtcactctctagtgttaactggttacgatgcttaattcaaggtttgcttgtcagttgtcacggtg

SEQ ID NO: 5382 - DNA, 2722 bp, Oryza sativa
  Predicted polypeptide sequence is orthologous to G274
ggcgggtgtagtatggccaccatggcggcatatggccccctttcacacgcacatcctcctctcctttatttatgaaaggggggttgggttagctgggaagaggaaggaagccgctgctgacatgtgacaccgtgtttggcatcacaccacttcactccactggctcagtggctgcctcactcactcaccaattcaccattgctagtgcaagagctcgcataaataggcagagctgctgctcctctcctctccctctcagcctctggaggaggaagagaagaggaggggtctctgcttcatctttcttcctgagctggcttctttactacagcagccatggctaaagagtatcctgcctcccccaaagctcagcagctgcaagaatccaagaagcagcggctcacctacatcctcgtggtgagcgcgctctgcgtcgccttctacgtcctcggtgcgtggcagaacaccacagtgcccaagccggcggcgagctcggcgatcaccaaggttggctgcgacccggcggcggcggggcagtcctccgccgtgccgtcgttcgggtcggcctcgcaggagtcactcgacttcgaggcgcaccaccagctcagcctcgacgacacgggcgccgaggcggcggtgcagccgttcccggcgtgcccgctcaacttcagcgagtacacgccgtgcgaagacaggaagcgcggccggcggttcgagcgcgcgatgctggtgtaccgggagcggcattgccccggcaaggacgaggagatccggtgcctcatcccggcaccgcccaagtacaggacgccgttcaagtggccgcagagcagggacttcgcctggttcaacaacatcccccacaaggagctcagcatcgagaaggccgtgcagaactggatccaggtggacggccagaggttccggttccccggtggcggcaccatgttcccgcgaggcgccgacgcctacattgacgacattggcaagctcatctcgttgacggacgggaagatcaggacggcgatcgacacaggttgcggggttgctagctggggtgcttacttgctgaagaggaacatccttgcaatgtcgtttgcaccgagggacacccatgaagctcaggtgcaattcgcgctggagcggggtgtgccggccatcatcggcgtgatgggaaagcaacggctgccttacccatctaggtcatttgatatggcacattgttcacgctgcttgattccttggcatgagtttgatggaatatacctagctgaagtcgacagaattctaaggcccgggggatactggattctctcgggtcctccgatcaattggaagacacactacaaggggtgggagaggactaaggaagacctcaaggaagagcaagacaatattgaggatgtcgcgaggagcctttgctggaacaaggtggttgagaagggggatctctccatctggcaaaagcctaagaaccaccttgaatgtgccaacatcaagaagaagtataagacaccccatatatgcaagagtgacaatcctgatgctgcctggtacaagcagatggaagcatgtgttactccattgcctgaagtaagcaaccagggtgagatcgcaggtggagctttggagagatggccacagagggcattcgcggtccctccaagggtgaagaggggtatgattccagggatagatgcgagtaaatttgaggaggacaagaagttgtgggaaaagagggtggcgtactacaagcgcaccctacccatagccgatgggagatacaaaaatgtcatggacatgatcgcaaacttgggcggatttgctgcttctttagtgaagtaccctgtgtgggtgatgaacgtcgttcccgtaaattcagaccgggacacgcttggagcaatttatgagcgaggattcattggcacgtaccaggactggtgtgaagctttctcgacgtatcccagaacctacgacctgttgcatgctgataatttgtttagcatctatcaggacaggtgtgacataaccaacatcctcttggagatggacaggatcctgaggcccgagggcacggcgatcatccgcgacacggtcgacgtcctcaccaaggtccaggcgatagcgaagcggatgcggtgggagagccgcatcttggaccatgaggacgggcccttcaacccggagaaggtccttgtggcggtcaagacatactggactgctgatgaatcagagcagcactagcacactgcacacagcacagaacacaggctcggctacctctctgaagactgaagaagtctgaacccccgattgttttcagagctgtgatgatggcatcggagttttgccatttcggtgtaacataacagaagatatcatctggtcacttgttttcttcctcctttcgctaattctttctatatcaaaggaaaagttatggatggtttttggggtgagattgggcatggttggatgatacatgagtttgttagcaaggggaagaaatgcaaatcttgcataggttcctgccccagtttcacgcatggagcagacagcagaggataggttttttagcttgtaatatgatggcgtccaagtatccaacagacactgttaatctatattgaggttaactaagataggtatttatctagtttatctgtgttagctcttggaattatcagtttattagttaattaagttcttgatgctccttaaaacg

SEQ ID NO: 5383 - DNA, 2438 bp, Oryza sativa
  Predicted polypeptide sequence is orthologous to G274
ggcgtcctctcttcttccgccgtggactcatcgtctccaacgccacacgacacgacgcgacgcgacgcgacgcgagaaaaagtcaaaagcagcagcagcggcggagcaaccaagcctacctccaccaaaatcttctccccccctctcctctcctctccacccgccggtgacccgagcccccccaccgcctcacgccgccgccgccgccgccgcggggagttccattccaccgggtcgccttccggccgtctcctgcagagaggttcatgaggggctcgaggatgaatccaggtgaccgtagaacgcggagcacgatgtccatcgtaattgtgatgagtttgtgctgcttcttttatatactaggagcttggcagaaaagtgggaccggaaggggggatagtattgcattgagggtgacaaaagagaccgactgtacaatcttgccaaacttgcactttgagacccatcatagcttaggtggtgttaatcctttggtcatgaccgataaagtctttgagccatgccatattcgatacagtgactatactccttgtcaggatcagaaccgagcaatgaactttcctagagaaaatatgaactaccgagagaggcattgtcctacagagactaagaaactgcgctgtctaatcccagcacccaaaggctatgtcaccccttttccttggcccaagagccgtgactatgttccatatgcaaatgcaccatataagaatttgacagttgagaaggctgttcagaactgggtccagtttgagggagatgtgtttagatttccaggaggggggacaatgtttcccaatggagcaaatgcctacattgatgagcttgcatccgtcattccatttactgatggcaccattaggactgcacttgatactggatgcggggttgccagctggggtgcttacctaatggacagaaatgtattaaccatgtcatttgcacctcgagactcacatgaagctcaggttcaatttgcattggagcgaggtgttcctgcagtaattggagtgcttggaactataaaactaccatacccctctggatcttttgatatggcccattgctcacgctgcttaatctcctggaagtcaaatgatgcgatgtacatgtttgaagtagatcgggttctgaggcctggtggctattggatattgtctggtcctcccatcaattggaagacaaatcaccaagcatggaaaagatccaaggaagacttagaggcagaacaaaatgtaatcgaaaaaattgctgaaatgttgtgctggggtaagattcatgagaagggagatactgttatttggcgcaaaaaggcagattcaaatgaatgtcataataaggatgaccatcctagcaagatgtgcaaaattcaagatgcagatgatgtctggtataagaaaatggaaggttgtataacacctttcccggaagaagcacagctacggaaattcccagagagactatttgctgcccctcccagaattctacagggtcgcaccccaggtgttacagaagaaatttttgaggaggataataagttgtggaagaagtatgtcagtacttacaagaggataaacaagctgataggttctttgaggtataggaatattatggacatgaacgcagggcttggaagttttgcggcaattattgattctccaatatcttgggtaatgaatgttgtgcccacaatatctgagaagaacactcttggtatcatttacgagcgaggtcttattggcatataccatgattggtgtgaagccttctctacatatcctaggacatacgacttgatacatgccaatggtctcttcagcttataccagaataagtgcaacatggaagacattcttctggagatggataggattttacgtcctgagggcgcagtcatactgcgggacaatgttgaggtgctgaacaaggttaggaggacagtgatggggatgcggtggaaatccaagttgcttgatcatgaagatgggcctcatatacctgagaagattttggtttcagtgaaaaagtattgggttggcaatgaagaagaaaacagttcatagataccctttttttatgttgtacctgttcatagatccggttcatacttcataggtacaggcctcaccattcccaatcaagatgacatacaggtagagtattttttatgtcctgcatattggttgtgcatatacagaagcagggcattaagggcaaacgttggtgatttgccaacacattttgtaggtaaagaggaagatagtttgtgctgagatgaacgtacccattgtattacagatccacacaggaacattttccgagtgaacaagtgttgccccatgtattttgtttgtgctgcttgtacaacatggaacattagcagtacatgtacaagtaacaaggagacaaggagttgt

SEQ ID NO: 5384 - DNA, 3063 bp, Oryza sativa
  Predicted polypeptide sequence is orthologous to G274
gagaaaggcgaatcgccccaatcccacaagaggcgaggggagagaggagagcgcgcagcgggagcagcagaagccgccagccagccatggcggtgggcgcgaccgccacgaagctgcacatgccgtccgcgggcggccgccgcccgtccctgttccacctcgcggccgtcgcggtgctctgcacggtgtcctacctcatcggcatctggcaccacggcggcttctccgcctccccggccggcggcgtcgcctcctccgtctccatcgccaccaccgcctccgtctcctgcgtctcccccaccccgacgctccttggcggcggcggcggcggcggcgactcctcgtcgtccgcgccgctcgacttcgcggcgcaccataccgcggaggggatggaggtggcgtcgggccaggtgcaccgcacgtacgaggcgtgcccggccaagtactccgagtacacgccgtgcgaggacgtcgagcgctcgctgcggttcccgcgggaccggctcgtgtaccgggagcggcactgcccgtcggagggcgagcggctccggtgcctcgtgccggcgccccaggggtaccgcaacccgttcccgtggccgaccagccgcgacgtcgcgtggttcgccaacgtgccgcacaaggagctcaccgtcgagaaggcggtgcagaactggatccgcgtcgaaggcgaaaagttccggttccccggcggcggcaccatgttcccccacggcgccggcgcgtacatcgacgacatcggcaagatcatccccctccacgatggatccatccgcaccgccctcgacaccggttgtggggtagcgagctggggcgcatacttgctgtcacgcaacatcctggccatgtccttcgcgccacgtgactctcacgaggcacaggttcaatttgcactggaacgtggtgtgccggcgatgatcggtgttctttcatccaaccggctcacctatccagctcgtgcctttgacatggcacattgctcccgctgcctcattccctggcagctctacgatgggctgtacttggctgaggtggatcgcattctgcggccaggagggtattggattttgtctggacctccaatcaactggaagaagcactggaaggggtggcagagaaccaaggaggacctgaatgcagagcagcaagcgattgaggcagtggccaagagtctttgctggaagaagatcacgctcaaggaggttggtgacattgccatctggcagaaacctactaaccacattcactgcaaggcctcccgcaaagtcgtcaagtccccacccttctgctcaaataaaaatccagatgctgcatggtacgataagatggaggcttgcataactcctctcccagaggttagtgacataaaagagattgcgggtggccagttgaagaaatggccagagaggctcactgcagtgccacccagaattgccagtggtagcattgagggtgtcactgatgaaatgttcgtggaagacaccaaactatggcagaagagggtcgggcactacaagtccgtgataagtcaatttggacagaaaggacggtaccgcaacttgcttgatatgaatgcgcgctttggcggcttcgctgcggcattggtggatgaccctgtgtgggtcatgaatatggtcccaactgttggcaattcaacaactcttggggttatatacgagcgtgggctcatcggaagctaccaagactggtgtgagggcatgtccacgtaccctcggacctacgacctcattcatgccgattcagtgttcacgctatacaaggacagatgccagatggacaacattctgctggaaatggacagaatactgaggcctgagggtacagtgattataagagatgatgttgatatgttggtgaaaataaagagcattaccgacggtatgagatggaacagccaaatcgttgatcacgaagatggcccgctcgtccgggagaagctcctccttgttgtaaagacatactggacactcggggaagaaaaggaatagcaataacgtgaaataaagtgttagaaaaaattgacatattgggcaaatatcgtaatcggcttaccatttgccttgtggatttgaagtttctttttccatttcattctttgggtggaatagttcacatatggagttcagccctcgatgtttaggtgtaaaagaggtgctgagaaggaaaccctgcaaagttttttacattaaaggacaaccaaagtattccaggtctggtttctacggtcagtagcattcttcatgcgctgtcatcaggcattttagtacggagtaccagtgtaccaccatagtacgcctactctccctagaacagtagaactaccgtggaatgtttacatggctagacgcaaattgtctgaactgcctttacgtttgctcgcacatgctactggagtgctgaactcaactactatgcctgtgaggtttgactctggattcagctgaaaatttggtggcccacactgagcgtaccatatgcattcgtctacactaactccagatcttgcaagtaatggactaacggctaattaaagagttcatcaccattggcatgcatgcaatgcgacggcaacagaacgcactggtccccgacaggaggagcagaagaaacaattcacttttgggcgatcggtgcatgtattgaaatgatgaggacacttgacagaccacgaggtccccctgtcacaaggattcatctgagatatcccccattatccaccggaagaacagtgatgcataccaccttacagctaaccaaagtgtcaatctcacctaacgctgcaataacagagctcttaacagtggcatctctgtatacaataggagggctactggttactggttagctcgcaacagtggttacttgttagctgttgagctagcaatggcaatcagtctatataggatgctagtggtagtggttaagaatcttctgtcaaggacatgcacggagaaaaaataattgacatttagtttgtggtaatgccataggccagagcaaataatacagtaaattttcatgtcc

SEQ ID NO: 5385 - DNA, 2289 bp, Oryza sativa
  Predicted polypeptide sequence is orthologous to G274
ggggcagcgtgacagtgtgtcccccccgcctcgccacctaaaaccccacaccacagagcgcagtgcacgactgcacggcccgcgccatagacagcacacgctccggggagctgaagcggagctgaggctgtctgtcggcatgggggtccgcccggcggccaccaagctgaacatctcccccgccgccgcgcggcgcccctcctccttcctgcccatcgccaccgtggcgctcctctgctccgcgtcctacttcctcggcgcgtggcagcacggtggcttctcctccccctccgcctccccatcctccgtctccgtcgccaccgctgtcgcctgcaccaccaccaccaccgccaccacccgctccgccacgcggccgcggaagcggacgcccgcggggcaggggcaggcgctcgacttctcggcgcaccacgcggcggccgcggacggcgccgtgctcagctcgtccggggattcggcggcgacgcggaggtaccaggcgtgcccggccaggtactcggagtacaccccgtgcgaggacgtgaagcggtcgctgcggtacccgcgggagtggctggtgtaccgggagcggcactgccccacggggcgggagcggctgcgctgcctcgtgccggcgccttccgggtaccgcaacccgttcccgtggcccgccagccgcgacgtcgcgtggttcgccaatgtgccgcacaaggagctcaccgtcgagaaggcggtgcagaactggattcgcgtcgacggcgacaagttcaggttcccaggcggcgggaccatgttcccccacggcgccgacgcgtacatcgacgacattgggaagctcatcccgctccacgacggctccgtccgcaccgcgctcgacaccggctgcggggtggcgagctggggcgcgtatctgctgtcccgcgacatcctggccatgtccttcgcgccgcgggactcccacgaggcgcaggtgcagttcgcgctggagcgcggcgtgccggccatgatcggcgtgctcgcctccaaccgcctcacctacccggcccgcgccttcgacatggcgcactgctcccgctgcctcatcccctggcacctctacgatgggttgtatctgatcgaggttgaccgtgttctgcggccgggagggtactggatcctgtccgggccgccgatcaactggaagaagtactggaaagggtgggagaggaccaaggaggacctgaacgccgagcagcaggctatcgaagccgtcgccaggagcctctgctggaagaagatcaaggaggctggcgacatcgctgtctggcagaagcctgccaaccacgccagctgcaaggcctcccgcaagtccccgcctttctgctcccacaaaaaccccgacgcggcatggtatgacaagatggaggcctgcgtgacgccgctcccggaggtctcagacgccagcgaggtcgctggtggcgcgctgaagaaatggccgcagcggctcaccgccgtgccgcccaggatatctagaggtagcatcaagggcgtgacatcgaaagcgtttgtgcaggacaccgagctgtggaggaagcggattcagcactacaagggggtgatcaatcagttcgagcagaaaggacgataccgcaatgtgctcgacatgaacgccggcctcggcggtttcgccgcggcattggccagcgaccccttgtgggtcatgaacatggtccctaccgttggtaactcctccacgcttggggtggtctacgagcgtgggctcattggaagctaccaggactggtgcgagggcatgtccacttatccacggacgtacgatctcatccatgcggactcggtcttcaccttgtacaagaacaggtgcgagatggatatcatcctgctggagatggacaggatcctgaggcccgagggcacggtgatcatcagagacgacgtggacatgctggtgaaggtgaagagcgccgcggacgggatgaggtgggacagccagatcgtcgaccatgaagatggcccgctcgtccgggagaagatcctcctggtcgtcaagacgtactggacagccaaggagcaagaccaatagcagcagtagtgtgaagaattgaattactgcaagccagcagcaacaacattgttgagaagttcccgtaatcgggtcgccatttctagctcgtttcttcagttaaggtttttttatgttcttttggactgtagcactatagaagatttgtactgcctggtaggtgtaatacagggcagaatatgggaaggggtggatattacaaagatttt

SEQ ID NO: 5386 - DNA, 1857 bp, Oryza sativa
  Predicted polypeptide sequence is orthologous to G274
atgctgctgcgtaccatgaagctcccgctccccgccatggccgccgtcgtggcgctctgcgccgcctcctacctcctcgccgtgtggacgcaccctgccccgccgctccccgcctcctccctcgccgccgtcccgtgcaacacgcggcagccaccggcgcccgcggcctcgaagaacgacaccgccctcgacttctcgatccaccacggcgcgtccgaggaggacgcggccgaggcgggggcgccgccatcgcgccgcgtcccggcgtgcgacgcggggtactcggagcacaccccgtgcgaggggcagcggtggtcgctgcgccagccgcggcggcggttcgcgtacagggagaggcactgccccccgccggccgagcggcggcggtgcctcgtcccggcgccgcggggctaccgcgcgccgctccggtggccgcggagccgcgacgcggcgtggtacgcgaacgcgccgcacgaggagctggtgacggagaagggcgtgcagaactggatcaggcgggacggcgacgtgctccgcttccccggcggcgggaccatgttcccgcacggcgccgaccggtacatcgacgacatcgccgcggcggccggcatcacgctgggcggcggcggcgcggtcaggacggcgctggacaccggctgcggggtcgcgagctggggagcgtacctgctgtcgcgcgacgtgctgacgatgtcgttcgcgcccaaggacacgcacgaggcgcaggtgctcttcgccctggagcgcggcgtcccggccatgctcggcatcatggccaccaagcgccttccttacccggctcgcgccttcgacatggcgcactgctcccgctgcctcatcccctggagcaagtacaacgggctctacatgattgaggtggaccgggttctccggcccggcgggtactgggtcctgtcagggccgccggtgaactgggagagacatttcaaggggtggaagaggacgccggaggacttgagctccgagcaatcggccattgaggccattgccaagagcctttgctggaccaaggtgcagcagatgggtgacattgctgtttggcagaaacaaatcaaccatgtcagctgcaaggctagcagaaatgagcttggtggtcttggtttctgcaattccaaccaagatcctgatgctggctggtatgtgaacatggaagagtgcatcactcccctaccggaggtgtccgggcccggagacgtcgccggaggggaggtcaagagatggccggagaggcttacatcgccgccgccgaggatcgccggcggcagccttggaagcagcgtcacggtggacacctttatcaaggattctgagatgtggaggagacgagtcgatcgctacaagggcgtcagcggcgggctggccgagaaaggccggtaccggaatctgctggacatgaacgccggcctcggcggcttcgcggcggcgctcgtcgacgatcctgtctgggtgatgaacgtcgtgccgacggccgccgttgccaacacgctcggcgtgatctacgagcgagggctcatcggaacgtaccaagattggtgtgaggcgatgtcaacttatcctaggacgtatgatctgatccatgcgtactccctgttcacaatgtacaaagacagatgtgaaatggaggacattttgctggagatggaccgtgtgctgaggccagaaggcacggtaatattcagagacgatgttgatgtcctggtgaagatcaagaacatcgcagacgggatgagatgggagagcaggatcgttgatcatgaggatgggccgatgcagagggagaagatccttgtgtctgtcaagtcttactggacagcctaa

SEQ ID NO: 5387 - DNA, 2310 bp, Oryza sativa
  Predicted polypeptide sequence is orthologous to G274
gatgaatccaagatccgcttctttctcctgcggttgctctgcgctctcagcaccaaccaaatccccctccaattcctcatctttcttgaccaattcttgaaatcaatcagacgcaataatcaaccactattcttattatagttggatcataattaatcaaggtttgaggtggatccatggcgatcaagggcggcggcgggtcggcggagaacagggggcggagcccgctcgccatggtggtcgccgtcggcctctgctgcttcttctacctgctcggcgcgtggcagcgcagcggctacggcaagggcgacagcatcgccatggccgtgaaccggcagacggcggcctgcggcggcgtggggctgagcttcgagacgcaccacggcggcgccggcgtggagaacgagaccatggcggcgccggcgccggagttcgcggcgtgcgcggcggcgatggcggaccacacgccgtgccacgaccaggagcgcgcgatgaggttcccgagggagaacatggtgtaccgggagcggcactgccccggcgacggcgagctggctgcggtgcctggtgccggcgccgccggggtacgtgacgccgttcccgtggccgcggagccgcgactacgtgccgttcgcgaacgcgccgtacaagagcctcaccgtggagaaggcggtgcagaactgggtgcgacacgagggccgcctcctccgcttccccggcggcggcacccagttccccggcggcgccgacaagtacatcgaccagctcgccaccgtcgtccccttcgccgacggctccgtccgcaccgtcctcgacaccggctgcggcgtggcgagcctgggcgcgtacctggacgcgaggggggtgatcgccatgtcgttcgcgccgcgggactcgcacgaggcgcaggtgcagttcgcgctggagcgcggcgtcccggcgttcatcggcgtcctcggctccatcaagctccccttccctccccgctccttcgacatggcgcactgctcccgctgcctcatcccctggtccgccaacggtgggatgtacatgatggagatcgaccgggtgctccgggcggatggctactgggtgctctccggcccgccgatcaactggcggaccaaccacaaggcgtgggagcgcacggaggcggacctcgctgccgagcagcagctgatcgaggagtacgccgcgatgctgtgctgggagaaactcgccgagatgggcgaggccgccgtgtggcgcaagcgccccgacgccgctgttgtgtcttgccccacggccacgccggcgccgccgaggacgtgcgacgccgccgccgccagccccgacgacgtctggtacaagaagatggagccgtgcatcacgccgccccaagcggccggcgaggtgatgctgcggccgttcccggagaggctgacggcggtgccaccgagggtggccgccggcgaggtgccggggctcaccggcgagtcgtacgcggaggagaacgcgcggtgggagaggcatgtggcggcgtacaggaaggtgaactaccggctcgacgccggcccggtaccggaacatcatggatatgaatgccggcgtcggcgggttcgccgccgccgtcttctcgcccaagtcgtgggtcatgaacgtcgtccccaccgccgccgagctctccacccttggcgtcgtctacgagaggggcctcatcggcatcttccatgactggtgtgaggcattctccacttacccaagaacatatgacctcatacatggcaatggtgtcttcactctctacaaggacaagtgcaagatggaggacatcctgctggagatggatcggatcctgcggccggagggcacggtgatcctccgggacgacattgaggtcctcctcaaggttcagaggatcgcgagcgggatgcggtggaagatgatcatggcgaaccacgaggacagcccccacataccggagaaggtgctctacgccgtcaagcggtactggaccgccgacgacaagagctcggagccggagccagagccggagaagatgaagaagaaggcggggagctcttcacaagagaggagctccgaggaggaggaggagagtacagcaagttcttcagaagagaagggttcagaggagtaagaggtgctgatcatgtgtgattattttcagttgttggggagttcaattcttttcagtgtgataggggagatcaggagttgtgttctttcgatttgatgattgtcttaggatgaacaatatgatgttcggtagcaggacttagcatttccatagattcaagaagcatatacttt

SEQ ID NO: 5388 - DNA, 2538 bp, Oryza sativa
  Predicted polypeptide sequence is orthologous to G274
tcgatcctggggggtctgagctaatgcgcgccgccccgatctcccgatccggtccgcgcgcgctcgatccccgcgcctgatttctcctccccgcccgtcgccgaggagagctccgtccagtgaggtatggcgcggagttcaactgagagcaggaccaggaccactgtatctgtagttgttttatttggcctttgttccttcttctatctcttgggtgtgtggcagagaagtggtttcggaagaggagacagcatagcagctgtggtgaacgaacagactaaatgcgtggttcttccaaacctgaattttgaaacccatcatagtgcttcagaccttcctaatgatactgggagtactgaggttaaaactttcgagccatgtgatgcacagtacacagattacactccctgtgaggagcaaaagcgtgcaatgaccttccctagggataatatgatatatcgggagaggcattgcccacctgaaaaggataagctctattgtctggttccagcaccaaagggttatgctgctccttttcattggccaaagagccgtgattatgttcattatgcaaatatccctcacaagagcctcacggttgagaaggctatccagaattgggttcactacgagggtaaagtgttcaggtttcctggtggtggaacacagtttcctcagggtgcagacaagtatatagaccatcttgcttctgttatcccaatagccaatgggaaagtgagaacagcactcgacactggttgtggggttgctagtctaggtgcttacctgttgaagaaaaatgttttgaccatgtcatttgcaccaagggataatcatgaggctcaagtacagtttgcactggagagaggtgttcccgcatatataggtgttctcggatcaatgaaactgtcattcccatcacgtgtctttgacatggcccactgctcaaggtgtttaattccatggagtggaaatgatggaatgtacatgatggaagttgatagggtactaaggcctggagggtattgggtactctcaggcccaccaattggctgaagattcactataagggatggcaatgaacaaaggatgatcttcaaagtgagcagagaagaatagaacaatttgcagaacttctttgttggaataagatttctgagaaggatggtattgctatatggagaaagagaataaacgacaaatcctgccccatgaaacaagaaaatccaaaagttgacaagtgtgagttggcatatgacaatgatgtatggtataagaaaatggaggtctgtgtaactccccttcccgaggttaaaaccatgacagaggttgctggtggtcaattagagccatttccccagagactcgatgcagtacctcccaggattacccatggttttgtacctgggttctcagtccagtcatatcaagatgacaataaactttggcagaaacatattaacgcttacaaaaagatcaataacttgcttgatactggaagataccgtaacataatggacatgaatgctggccttggtagttttgctgctgcattggagtccacgaagctgtgggtcatgaatgttgttccaaccattgcagatacttctacattaggtgtaatctacgagcggggattaataggaatgtatcatgattggtgtgaaggattttctacatatccaaggacatatgatctcatacatgctaacgctgtgttcagcttatatgagaataagtgtaaatttgaagatatactattggaaatggaccggatcttacgaccagagggcgcagttataatccgtgacaaggttgatgttcttgtaaaggtggagaaaatagctaacgccatgaggtggcagacaagattgactgatcatgagagtggccctcatgtgcctgagaagatactctttgcggttaaacaatactgggttgttgaaagcaagagcagctaattacatatgctgggttgtttttttccactgagctcccaacaagacctaagacatgacttaattacatatgaagggtatgcatcatctacctcctctgtaaacttatagccactgtagtcaggaatgaactcttggcagcttgagttttccgaaaagttagcacccttgcaatgtggccttgccagttcttttcaaggtaaattgcactgcaggtataaatctttttcaaaaccggctgcctcagtcttgacaatctcaaccacaggtttcatcttttgatgtaaatggcttggatttgaaagttcatgtatgcaaggcttgtcatgaccgtatttcttttagccagttttgtctagccttagctggtgcgacaatttgagaatgctcaaactggcctctaatcttgcttgtttggtgcatttgtgttctaaggaggtgtcgcactgtaatgaaactgagatccataagattctagtattctgatcgtctgaaccgaggtgaccaataatcaaatttagctacgtatgtaatagttttttttctgttggtaacagacgaacgatttatttttagtgct

SEQ ID NO: 5389 - DNA, 2322 bp, Oryza sativa
  Predicted polypeptide sequence is orthologous to G274
gggagtacccttcattcccttgcggcgtaaaagaaagagaaaaatctcccggggcgtctcgtcgtctcctccgctcctcgcgcaggacgagtcgcggctgccgatctccatctgcgccaggggaatcctggtgtaatggcaaaagagcagagtggatcccctaagcccaggcagccagtgttccaaaggatgcgagtaacgttaaccataggtgttattggcctctgtgttgcatcatacattcttggtgcttggcaaggcacttcaactactagtatacacccatccataatctacactaaaagccaatgtggtgaatccattttgcgcacctccagcaattcgtctggacggtcatcatcagacgctcgtcttgatttccaagcccaccatcaggtgagcttcaatgaatcttcacttgtcgccgaaaaattcccaccttgtcagctgaaatacagcgagtataccccttgccaagatccaaggagagccaggaaattcccaaagacaatgatgcagtacagggagagacactgccctcggaaagaagagcttttccggtgcttgattcctgcaccaccaaagtataagaatcccttcaagtggccacaatgtcgggattttgcttggtacgataacattcctcatcgggagcttagtatcgagaaagctgtccagaactggattcaagttgaggggaaacggtttagattccctggaggcggcacaatgttcccacatggtgctgatgcctatatcgatgacatcaacgctctcatatcattaacggacggcaacatcagaactgcgcttgatactggatgtggggtggcaagttggggcgcttatcttattaagaggaacatcatcactatgtcatttgcacctagagattcacatgaggcacaagtgcagtttgcattggagcggggagtgccggccatgattggagtgatatccacggaaagaatcccataccctgctagatcatttgacatggcacactgctctagatgtttgatcccatggaataagtttgatggtatctatctaattgaagtagacagagtaattagaccaggaggctactggatcctctctgggcctccaatccattggaagaagtacttcaagggctgggaaagaacagaagaagacctgaagcaagagcaagatgagattgaggatttggcaaagcgtctctgctggaagaaggtggtagagaaagatgatcttgctatatggcagaaacctatcaaccacatagagtgtgttaatagtcggaagatctatgaagcccctcagatttgcaagagcaatgatgttgactctgcttggtacaagaagatggagacatgcatatcacctcttccggatgtgaatagtgaagacgaggttgctggtggagctcttgagaaatggccaaaaagagcatttgctgtgcctccaagaataagtcgtggatcagtttcaggcctcaccacggagaaattccaagaagataataaggtgtgggcagagagagcggattactacaagaaattgattcctccactaaccaaggggcgatataggaacgtgatggatatgaatgcagggatggggggattcgcagctgcattgatgaagtatccactttgggtgatgaacgtggtaccttcaggctctgctcatgacacccttggtattatctatgagaggggattcattggaacctaccaagactggtgtgaggctttctcaacgtatccgaggacatatgacttcatccatgctgataaaatattcagcttttatcaggacaggtgtgacgtaacatacattctcctggagatggaccggattctaaggcctgaagggacagtgattttcagggacacggtggaggtgttagtgaagatacaatcaattacagaaggcatgcggtggaagagccaaataatggatcacgaatctggtccattcaaccctgagaagatacttgtggctgtcaagacttactggactggacaacccactcaaaagcagtagtggcttttcttttcagcagcagatgttcccttttggtttttccaattttcgtttagctccaggttcaggttgtgtgtaaatatgaggcgatgtgattgggatagtatcaccacgatcttgtggccttggttcattggctgcattgcattcttgtgagttgtgatgcttacatttctataataggcagataaaatgttctttttcttcagtaaaaagaacagggcaagcctgaccttgttattttccttgccaaagtttattgacaaaaaaaaagggtgctatggtacaacg

SEQ ID NO: 5390 - DNA, 410 bp, Oryza sativa
  Predicted polypeptide sequence is orthologous to G274
tttttaaccagagaaaatgattcatcgtaggtaattcgagccctcaaacagatttcataaagcttgagtatcttacttttttttgtacagggtgaaaaggccactagcgtggataagatcatactttcttgggcctgagatgaaacacctggaatcagcccattaacaatccttggaggaactgcattgagcctgcttgggaagggcttgattccacctccagcaacttcacttggatcatttacatcaggaatagttgtcacacaaggcttcatcttcttgtacctagtattacagtggtaagaaaaaaaaataggatgagaaagagattatacaatgtttaaaccagatcagtatgtttgtaatctattagtggacgtaattctacaaatgttatactatcataaatc

SEQ ID NO: 5391 - DNA, 3015 bp, Oryza sativa
  Predicted polypeptide sequence is orthologous to G275, G837
actttcttctgaacaaacaagatcaatcgatacccaatggagatggatggctgcttgctgtcaccagaggacaccccttgattaacaacactccatctccctcagagaagaagaaattctgaattttgaacaagcatatatatatatatatatttgcagagaaagagagaagagatagctgcattgcatgagctgaagggaagaatggcgctgtttgatcggaatcagaagcagcggtcgtcgctgtgctcgacggcgaccgtcgtcgtgttcgtggcgctctgcctcgtcggcctctggatgatctcctcgccggagaccatcccggcggcggcggccaacgtcagcaagaagcccgacgtcgtcgccgtcaaggaggaggacagctcgctcgacgccaccaacaatgtcaaacagaacagcgccaacgtcgtcgccgagaccgccgccgccgacgaggccgccgccgcagacgaggacgacaaccccgcgaagccggccgccggcgagaaggcggcggcggcggcggcgtcgtccaaggaccagacgttcgacgacgagaacggcaggacggagggcggcgcgctcgtcaagccggagagcggcggcggcgacgaggcggcctccgacgtgaaggagatcggcagcctcgagcaggcggcgatcgacatgaaggacaccaccgagcactcggtgggtgacaccaccaaggagccaggcgtcgtccaggacaagagctccgaggagatcacgatggcggcgagcgacgcgagggagagcagcgatggcggcggcggcggcggcgcggccaagaacaagcagacgttcgacgacgagaacggcaagctcgacggcgtcaacctggtgaaggacgtcgagaacaagacgatgtcggaggagggcgccaagccattgccggaggagacgacgaccgtgagcagcaagaactcgatcgtcgcggcggccgccatgtccgacgagaagctcaccgacaacaatggcgagcaagcgcagccggtggaggcgctgccgaacgggcaggccgagctgctgacggagcgcgcggcgcagaatgggtcgttcacgacgcaggcggcggagtcgatcaaggagaagaagaagcgcgccgagaagaagaaaaagaagaagaagaaggtgaaggcggcgtcggtggcggcggcggcggaggaggagggcggcggcggcggcgcggcgtcgttgggctggaggctctgcaacacgagcgccggcgccgactacatcccgtgcctggacaacgaggccgccatcaagaagctcaagacgaccgcgcactacgagcaccgcgagcgccactgccccgcctcgccgccgacgtgcctcgtcccgtcgccggaggggtaccgggacccgatccggtggccgcggagccgcgacaagatctggtaccacaacgtgccgcactcggagctcgcggcgtacaaggggcaccagaactgggtgaaggtctccggcgagtacctcaccttccccggcggcggcacgcagttcaagcacggcgcgctccactacatcgagctgatccagtcgtcgttcccggaggtggcgtgggggcggcgcagccgcgtcgcgctcgacgtgggatgcggcgtggcgagcttcggcggttacctgttcgaccacgacgtgctgaccatgtccctggcgcccaaggacgagcacgaggcgcaggtgcagttcgcgctggagcgcggcatcccggcgatctccgccgtcatggggacgcggcggctgccgttcccgagcaacgtgttcgacgcggtgcactgcgcgcggtgccgggtgccgtggcacatcgagggcgggatgctgctgctggagctcaaccggctgctccggcccggcgggttcttcgtctggtcggccacgccggtgtaccaggagctgccggaggacgtcgagatctggggagagatggtgaagctgacgaaggcgatgtgctgggagatggtgtcgaagacgagcgacacgatggaccaggtggggctcgtcacgttccggaagccggcggacaacgcgtgctatatgaagcgccgccagaaggagccgccgctctgcgagccctccgacgaccccaatgctgcttggaacataactttgcgggcgtgcatgcactgggtgcctacggacccatcggtgcgggggtcgtggtggccggagcggtggccggagaggatggagaagacgccctactggctgaacagcagccaggtcggggtgtacggcaagccggcgccggaggacttcgtggcggaccaggagcactggcggaaggtggtccggaactcgtacctcaccggcatgggcatcgactggaagacggtgaggaacgtcatggacatgagagccgtctacggagggttcgcggcggcgctgcgggacatgagcgtgtgggtgatgaacgtggtgacgatcaactcgccggacacgctgccggtgatctacgagagggggctgttcggcatctaccatgactggtgtgagtcattcagcacctacccgagatcctacgacctcctccatgccgaccatctcttctccaagctcaaatccaggtgcgaggtgttgccggtgatcgtggaggtggaccggatcctccggccgaacgggaagctcatcgtgagggacgacaaggagacggtggacgagatcaagggggtggtgaggtcgctgcaatgggaggtcaggatgaccgtctccaagaacagggaagcgatgctctgcgcgaggaagacgacgtggcggcccacggaagccgaggcaagatgacctcgccgtcaccggccggcgatccatgtagtagagtcttttggtcggttgatccggtggtagctgcaatacttagcacgtacagggtgatctacactacactgggtgctgcagcattgcaataactgagctagatattactggagcttgtagctttttttttgggggggttttgttcttcagatttttttttatagttttatactg

SEQ ID NO: 5392 - DNA, 2988 bp, Oryza sativa
  Predicted polypeptide sequence is orthologous to G275, G837
ggttggttgtttccatgtttgttcagacaaggggagatttgcttgctagggaagatggaaataatcgatttttgcgtgcaatggaatgcatataattttttccttttttttggggcattgttcaattggtgtcactgatgggcagatccagtgtttccttgtttggatctactgatcgggtttaatcttttatacacttcgagtttctgatgatatgttgtggtttgctgtgctctaggtgtgagagttcttgatcgggtcggcataggggttttgttctgcagtacatgcgagagtgtgattgatggcatttggccgaggctcgaagatggacggcaggcggtcgtcgccgtcgtcgtcgctctgcacgacgaccaccgtcgtcgtgttcgtggcgctctgcctggtcggcgcctggatgatgacgtcatccaccatcttcccgctggagataacctcgaataagaaggcggcggtgaaggagcagccggcgagagttaactacggcgcgtccgaggaggcagcggcggcatccggcaacagtgctgaaggtgtggacaggtttggggacacggacaacaacgataatgcggttccggaggagccgaataacacggtcccttctgaagaagagaagttcagtgagaacacagtggagaagccagtggagagcagtgaagagaaggcgccaccgaaagaaaaggaggagagtaaggatacatttgatgatgcaaatgggaaaacagaacagtcgagcgccaaggaggatggggattctgaatcaggatctgggcagtcggatggttcaaagaatggcgacgacgaggagaagagtgaggagaagaaagatgatgagcaatctgatggtgagaggaaagatgatcaagaagagaaggctgaaggcagtggctcaaaggacacgactgaccagccacaaattgaggagacagtggatgaaagtggggagaagggtcagggtgcaaagtccaatgaggtattccctgatggggctcaatcagagcttctaaaggagtcaaacaccgagaacgggtcatttaaaacacaggatgcagagtcaaagaatgagaaggaatctcaagcagcatcaaattcttcagatgatgaaaccacatataactggaagttatgcaataacaatgctggaacagattacataccttgcctcgacaatgagaaggctatcaagaagcttcgaaccaccaaacattatgagcaccgtgagaggcattgccctgtggagcctcctacctgtgttgttccacttcctgaaggatataaacgcccagttgagtggcccacgagcagggacaaggtgtggtacagcaatgtcccccacactaagcttgctgagtacaaggggcaccaaaactgggttaaagtttctggggatcatctcctatttcccgggggtggcactcagttcaagaatggtgcacttcactacattgatactattcagcaggcattacctgatattgcatggggcaaacgaagccgtgtcattctagatgttggctgtggagttgctagctttggagggtacatgtttgagagagatgtactcacgatgtcatttgccccaaaagacgagcatgaagctcaagtacagtttgcacttgagagaggtattccagcaatatcagctgtcatgggcaccaaaaggctcccataccccagcagggtctttgatgtcattcattgcgctcgctgcagggtcccttggcacattgaaggtggcatgctattgctggaactgaaccgcctattacgccctggtggttacttcgtctggtctgccactcctgtttaccagaagctccctgaagatgtcgagatttggaatgccatgtcttctctaacaaaggccatgtgctggaaaatggttaacaagactaaggataagttaaatcaagttggtatggccatatatcagaagccaatggacaacagttgctatgagaaaagaccagaaaacagcccaccgttatgcaaggaaactgatgatgctgatgctgcatggaatgtacctttgcaagcatgtatgcacaaattgcctgctggccaatcagtccgagggtcaaaatggccagagacatggccacaaaggcttgagaagaccccctactggatagatgactctcatgttggaatctatggaaaaccaggaaacgaagattttgaggctgattatgctcattggaaacgagtcgtaagtaaatcttatgtgaatggcatgggaatcgactggtctaaagtaagaaacgtcatggacatgagagctgtatatggaggtttcgctgcagctttgagggaccaaaaagtctgggttatgaatattgtgccaacggattcagcagacacgctgcccattatttatgagcgtggcttgtttggtatgtaccatgactggtgtgaatctttcagcacttacccgagaacatacgaccttctgcatgcagaccatctcttctcaaagctaaaaaagagatgcaaattgttgccggtgtttgcggaggtcgacagaatattgaggccagaaggaaagctgattgtgagggataatgcagagacaataaacgaactgcaaggcatggtaaagtcgcttcagtgggaggttcgcatgacctacaccaagggtaacgagggtcttctatgtgtccaaaagtccatgtggcggcccaaggagatcgaggcaagcatgtgaaatatacagatgttcaagagaactgttactggttagtggtacattagactgaattttggctctagatatgcatactattcttgttgattctgaaaaggcataagccttgatgtaattgtagaatcattttttttctttcttgccaaacaaatgcactctatattctcttcttgctgtgctcttgctccattgctgtaaggttgtattggaacctggaagtgtcacaagtgtgacaagtgtcacaggcaaattatgttcaatcc

SEQ ID NO: 5393 - DNA, 2475 bp, Oryza sativa
  Predicted polypeptide sequence is orthologous to G275, G837
ggatttcactccgcttcttcttcttcttcctcctccttgattgagttgtttgctcgatcgatggattgattgtcactgtctgtttagcaatcaagctagctacgaacaggagtgtagtactaatctgcatcgatcagtgcctctaatcttcttcttcttctcttgtaaccagcagcagaagcaagcaatccccctctcctctctgagagagatggcgtttggcagccacacgcgcctggatgtgaggcgggcgcagcagcactcctcattctgctccccctcctccgccgccgccgtcttggtggcgctggccttggtcgccgtctggatggcctcttccacgctcgtcacccccgcggatttctcccccttccgccccacaaccacaaccacaaccacaaccgctcgacctcggaatcggatggatcctgtgactgttgaagaggacgccgacgaccctcctccactcacactcagacagactgagaccggacccggaggggataatggctcccactcccactccccctccctggagaccgctacagaggcagaccctcaagctgcacagtccaacagcaacaccaaggacactccccacaataagcagcagcagcagcagactgcgtcgcccacccccagcagctatgcttggaagctctgcaatactgaggctggtccagattacatcccatgcctcgacaatctccaagccatccgcaaccttcggacgaccaagcactatgaacaccgagaaaggcattgcccccaacaccctcctacctgccttgtccctcttccaaagggctacacaaatccaattaggtggcctaacagcagagatcagatatggtacaacaatgtcccgcatactaagctggtagaatacaagggtcatcagaactgggttaaggtctccggggagtacctcaccttccgggaggaggaactcagttcaaacatggcgcattgcactacattgatttcattcaggaggcaaagaaggatatagcatgggggaaacaaactcgtgtggttttagatgttggttgcggagttgccagctttggaggatatttatttgatagagatgttcttactatgtcgtttgcacctaaagatgagcatgaagcccaggtgcagtttgctcttgagagaggaatccctgctatgtcagcagttatgggtacaaaaaggcttccattccccggcagggtcttcgacgttgttcattgtgcacgctgtagggtaccatggcatattgaaggtggtaagctcttgctagaactggatagactgttgcgtcctggtggctactttgtgtggtctgccactcctgtgtaccagaagctgccagaagatgttgaaatatgggaagcaatgtctactctaacaaggtcgatgtgttgggaaatggtcaataaagtgaaggatagggtaaatagagtgggtatagcaattttcagaaagccaacggataatagctgttatgaggcaagatcagcagcaaaccctccaatctgtggagagtatgatgatcctgatgctgcctggaacatatcattgcagtcatgcgtgcataggttgcccactgatcctgccatccgtggttcacagtggccggtggaatggccattgaggttggagaaaccaccttactggctgaaaaactctgaggctggtgtctatgggaagcctgccactgaggattttcaagcagactatgagcactggaagcaggtcataagcaattcatatatgaatgacttgggcattgattggtcagctgttagaaatgttatggacatgaaagccgcatatggagggtttgcggcagctttgcgagatctgaagctgtgggttatgaatgttattccaattgattcacctgacacacttccaattatatatgagcgtgggttgtttggaatctaccatgattggtgtgagtcatttagcacctaccccagaacctatgatcttctgcacgcgaaccatcttttctccaagattaaaaagagtgacaggtgtaaactagtggcagtgatggtggaggtggatcgaatactgaggccaggaggcagggtaattgttagagatagtatggagacaatgcatgaagtggagtctatggcaaaatcgctacactgggaggtccgcaagtcttactcccaggacaatgaaggtttgctgtttgttgagaagacgatgtggcgaccaaatgaagttgaagctaagctatgacgtaccataccagcaccaccgttatgatagctctgacactgaaacccttggaagaggaaaacaaaagtagccaagtgggggatgcacagtaagctatatatatagtgggtttttgtaggggtatacttggattttgggagaagctgtaatgtgtttttttttttttgcgtgggatgatacattagcaactaatgcatggtgatgatccatgttgaggctggcaagtttaac

SEQ ID NO: 5394 - DNA, 700 bp, Oryza sativa
  Predicted polypeptide sequence is orthologous to G275, G837
acgaggagcactggaaccacgtcgtcaacagctcgtacctcgccggcgtcggcatcgactggagcaacgtcaggaacgtcatggacatgcgagccgtgtatggcgggttcgcggcggcattgaaggacatgaatgtgtgggtgatgaacgtggtgccagtggactcggcggacacgctgccgatcatctatgagcgagggctgtttggcatgtaccacgactggtgcgagtccttcagcacctaccctcgatcatacgacctcctccacgccgaccatctcttctccaagctcaagaaaaggtgcaagctgttgccggtgatggtcgaggtggaccggatcctgcggccggaggggaagctgatcgtgcgggacggccgcgacacggcggcggaggtggagagcatcctgaggtcgttgcactgggaggtgaggatgacggtgtccaagcagggagaggtgatgctctgcgccgagaagacgatgtggcggcccaaggaagtcgagaaggcggcgacgacggcgagctagtagggaagaagttgatgatcatggctagtagtgcttagcaccagaaaaagagttttggcaaatattgtggcacgttgtaataaaaaaatgatggtagatttgagtagaaattagacatgtcataattgagttttgtatacagttttacaaaagagagatggtaattcaaa

SEQ ID NO: 5395 - DNA, 2119 bp, Oryza sativa
  Predicted polypeptide sequence is orthologous to G278, G1290
cctcgcctcgcctcgccacgccgcgccgcgacgcgacgcgccgtggtcagctggtcgccggtgcgggtgcgggtgcgcaatggagccgccgaccagccacgtcaccaacgcgttctccgactcggacagcgcgtccgtggaggagggggacgccgacgcggacgccgacgtggaggcgctccgccgcctctccgacaacctcgccgcggcgttccgctcgcccgaggacttcgcgttcctcgccgacgcgcgcatcgccgtcccgggcggcggcggcggcggcggcgacctgcgggtgcaccgctgcgtgctctccgcgcggagccccttcctgcgcggcgtcttcgcgcgccgcgccgccgccgccgcaggcggcggcggcgaggatggcagcgagaggctggagctccgggagctcctcggcggcggcggcgaggaggtggaggtcgggtacgaggcgctgcggctggtgctcgactacctctacagcggccgcgtcggcgacctgcccaaggcggcgtgcctctgcgtcgacgaggactgcgcccacgtcgggtgccaccccgccgtcgcgttcatggcgcaggtcctcttcgccgcctccaccttccaggtcgccgagctcaccaacctcttccagcggcgtctccttgatgtccttgataaggttgaagtagataaccttctattgatcttatctgttgccaacttatgcaacaaatcttgcatgaaactgcttgaaagatgccttgatatggtagtccggtcaaaccttgacatgattactcttgagaagtcattgcctccagatgttatcaagcagattattgatgcacgcctaagcctcggattaatttcaccagaaaacaagggatttcctaacaaacatgtgaggaggatacacagagcccttgactctgacgatgtagagctagtcaggatgctgctcactgaaggacagacaaatcttgatgatgcgtttgcactgcactacgccgtcgaacattgtgactccaaaattacaaccgagcttttggatctcgcacttgcagatgttaatcatagaaacccaagaggttatactgttcttcacattgctgcgaggcgaagagagcctaaaatcattgtctcccttttaaccaagggggctcgaccagcagatgttacattcgatgggagaaaagcggttcaaatctcaaaaagactaacaaaacaaggggattactttggggttaccgaagaaggaaaaccttctccaaaagataggttatgtattgaaatactggagcaagctgaaagaagggacccacaactcggagaagcatcagtttctcttgcaatggcaggtgagagtctacgaggaaggttgctgtatcttgaaaaccgagttgctttggcaaggattatgtttccgatggaggcaagagtagcaatggatattgctcaagtggatggaactttggaatttaacctgggttctggtgcaaatccacctcctgaaagacaacggacaactgttgatctaaatgaaagtcctttcataatgaaagaagaacacttagctcggatgacagcactctccaaaacagtggagctcgggaaacgctttttcccgcgatgttcgaacgtgctcgacaagatcatggatgatgaaactgatccggtttccctcggaagagacacgtccgcggagaagaggaagaggtttcatgacctgcaggatgttcttcagaaggcattccacgaggacaaggaggagaatgacaggtcggggctctcgtcgtcgtcgtcatcgacatcgatcggggccattcgaccaaggagatgaacaccattgctcccaaatagttgccatattgatagctaactgtcctcctggagctactcacctgatggttgccttctgtcaattgccccccaaatatattctcaatggtttaggcttgtacagtattagttcttacagctattgccccgtcaattgtgaaacgcagaagtttcactagtgcttgtactcgaggtgtaatacaagtgcttgaattttgagttgtacttggaatttccagtggtttgctcgtaaaaatgagatgatttcttggcaaaaaaaaaaaaaaaaaaa

SEQ ID NO: 5396 - DNA, 1049 bp, Oryza sativa
  Predicted polypeptide sequence is orthologous to G280
gtctagtcgtcttcttccctggatccaaatcgaaaatttctctccccctgttcacaccacgcctcactcccatggcgaccgaggaggacgcgtcgaccatggcggcggccgaggcggaccccaagcccgccgccaccccgtcttacccggagatgatactggcggcgatcgaggcgctggacgacaggaacgggtcgaacaagacggcgatctcgcagcacatcgaggggaagtacgaggggctcctcccccccgcgcacccgtcgctcctcacagcgcacctcgcccgcatgaagcagaccggcgagctcgccttctccaagaacaactacttccgcggcgacgacccgtccctcccgcccaagcgcggccgcggcaggccgcccaagcccaaggacgccgccgccgccgccgccgcaccggcgcccgcgcccgcggcgccggcggcctcctcgccgcgcccccgtggccgcccgcctaagcccaaggaccccctcgccgaggcggtcgcgaaggccaccagtggcatgccccgcgcgcgcggccgcccgcccaagaaggccaaggtcgaacaggaagaccccattggcgctcccgccgcagcttcggctcccgccgcggcggctgaggccgcgccgcctgtcaagcgcggccgtgggcgcccgcccaaggtgagacccgccgcgccggtcggggagccagccgctgcttgattagctccgattctccgcatcgccgcgatggcgacgatggtaagctcctttaggttgtaacgtagtcttcagattatgtctcgtactgattggaggcgcggctcgggttgctgcttattgtaagttaatcggatggtgggaggtttaggtgtgctggatggatcatccgttgctgagagttgtgattgaattcgtgttatcgcgtgctgattattatggtaatgttggtgactttcgtgtcgtttgtgttaattctagattggtggctgcatttagtgttatcaaatgatgttgaattgttctatgccatgccggacaaaaaaataagtctgattt

SEQ ID NO: 5397 - DNA, 763 bp, Oryza sativa
  Predicted polypeptide sequence is orthologous to G280
tgacgctgcaggtacggtcggaattccgggtcgaccacagcgtcgcacaaccccttctctctcagatcgcgtgcggcggcccaaatccacacgcgcacagcgcagcaccaacgccggaaggagacagcgcccctcgcccccgccaccccaaccctacgagagggagggagccagccagccagccagccaggcatggccacctccacttccactggccaccgcgccgccgacctcgtcctcccctcctaccccgagatgatcgtggaggcgatcgcgtcgctggcggaggagaacgggtctagccaggccgccatcgcgcgccgcatcgaggcggcccgcggcggcggcggcctcctcccgccgtcgcaccccgcgctcgtcgcggcgcacctctcccggatgtcagccgccggggagctcgtcgccgtcgcgggtgggaagtacgcgctccgcccgactcctccgccggcgccgccggcggatccggcggcggcggcggcggtggcggaggaagacgacgacgacgacgagttcttcggcgatgatgactcggccgacgacttacggccggctactcggccaagcgaagccggggcggccccgaaggtgcgcccccgagagtacagacgatccgccacgaaggaacgaacagacacagaagagaagaacgagaaacagcacaaacacggacagaagaaaaacggcgaggcaccacaaacagaaacaaggagaaacaacaaaaaaaagaacaagaaagccacga

SEQ ID NO: 5398 - DNA, 1537 bp, Oryza sativa
  Predicted polypeptide sequence is orthologous to G291
gaaacccctcctcttctcttccccttcctcctgcgttctagggttttgcctcccagcggcgactcggcgagcgagaccaccggcaagctcgtcggcgatggagcccacctcgtcggcggcgatggcgaggcagacgtgggagctggagaacaacatcccggcggcggcctccgacccggacgccctggacgcgatctaccgctacgacgaggcggcgcaggcgcgggtgcagcaggagaagccctgggcgaacgacccccaccccttccgccgcgccaagatctccgccctcgcgctcctcaagatggtcgtccacgcccgcgccggcggcactatcgaggtcatgggcctcatgcagggcaagtgcgagggcgacgccatcgtcgtcatggacgccttcgcgctccccgtcgagggcaccgagaccagggtcaacgcccaggccgacgcctacgagtatatggtcgagtactccactatcaacaagcaggctggaaggttggagaatgtggttggctggtatcactcacaccctggttatggatgctggttatcaggcattgatgtgtctactcagatgcttaatcagcaatttcaagagccattcttggctgttgtgatagaccctacaaggactgtttctgctggtaaagtggaaattggagcttttaggacatatccaaaagattacaagccaccagatgaacctgtgtcagagtatcagacgataccactcaacaagatagaagattttggtgtccactgcaaacagtactatgctctggatataacttatttcaaatcatccctggattctcatctccttgatctactttggaataagtactgggtcaatacgttatcttcatcacctctcctgggcaacagggattatgttgctggccagatatttgatttagctgataaactagagcaagctgagggtcaactggcacacagtcgatatggcatgcttatgccatcgcaacgaaagaaagagcaagaggagtctccactggctaaggtaactcgggatagctcaaaaattactgctgaacaggtccatggtctcatgtcacaggtcattaaggatatcctcttcaactctgtgcacccgtcaaacaaggcaagcacaagcgcaccagattcatccgggcctgagcctatggttgaagcatgagtgttctacagaattccttcattagttagccttttgttgatgctggattcacatacactgggtgcctagttgtttcatgactaaaagctgtgtccagcataactacccgattcaaaatgcgttagctgcgttttatcgtcaaatcataactgatatgtaattatgagttgccttctgaatctttcggctgccattgtgaaggtgcgtggtctacgttaagataaccaattaccttggcccaacttaccatgttctctcaacaatgaatggtcccaacgtcgctaggcacagtgtatgttgatttggatgatctttctggtatttatcctccgattttggtttctatatttccagttc

SEQ ID NO: 5399 - DNA, 2500 bp, Oryza sativa
  Predicted polypeptide sequence is orthologous to G307, G308, G309
actagttgcttgcctcttcccacctcacctcgcattgcaatctcgcatcgcctcttccttctctttttccccttcttctccccttctcatccaacctcgcttcccaaccctggatccaaatcccaacctatcccaaagccgaaaccgaggagaggaaaaaggttacgcgcaattattactagctatagctaggtaggtttgggggaggcgagatcatgaagcgcgagtaccaagaagccggcgggagcagcggcggcgggagcagcgccgatatggggtcgtgcaaggacaaggtgatggcgggggcggcgggggaggaggaggacgtcgacgagctgctggcggcgctcgggtacaaggtgcggtcgtccgacatggccgacgtcgcgcagaagctggagcagctggagatggccatggggatgggcggcgtgagcgcccccggcgccgcggatgacgggttcgtgtcgcacctggccacggacaccgtgcactacaacccctcggacctctcctcctgggtcgagagcatgctttccgagctcaacgcgccgctgccccctatcccgccagcgccgccggctgcccgccatgcttccacctcgtccactgtcaccggcggcggtggtagcggcttctttgaactcccagccgctgccgactcgtcgagtagcacctacgccctcaggccgatctccttaccggtggtggcgacggctgacccgtcggctgctgactcggcgagggacaccaagcggatgcgcactggcggcggcagcacgtcgtcgtcctcatcgtcgtcttcctctctgggcggtggggcctcgcggggctctgtggtggaggctgctccgccggcgacgcaaggggccgcggcggcgaatgcgcccgccgtgccggttgtggtggttgacacgcaggaggctgggatccggctggtgcacgcgttgctggcgtgcgcggaggccgtgcagcaggagaacttcgcggccgcggaggcgctggtcaagcagatccccacgctggccgcgtcccagggcggcgccatgcgcaaggtcgctgcctacttcggcgaggccctcgcccgccgcgtgtaccgcttccgccccgcggacagcaccctcctcgacgccgccttcgccgaccttctgcacgcccacttctacgagtcctgcccctacctcaagttcgcccacttcaccgcaaatcaagccatcctcgaggctttcgccggctgccaccgcgtccacgtcgtcgacttcggcatcaagcaggggatgcaatggccagctctcctccaggccctcgcccttcgtcccggcggccccccatcgttccgcctcaccggcgtcggccccccgcagccggacgagaccgacgccttgcagcaggtgggttggaagcttgcccagttcgcgcacaccattcgcgtcgacttccagtaccggggactcgtcgccgccactctcgcggacttggagccgttcatgctgcagccggagggcgaggcggacgcgaacgaggagcctgaggtgatcgccgtcaactcggtgttcgagctgcaccggctgctcgcgcagcccggcgcgctggagaaggtcctgggcacggtgcacgcggtgcggccaaggatcgtcaccgtggtagagcaggaggccaaccacaactccggctcattcctcgaccggttcaccgagtcgctgcactactactccaccatgttcgattccctcgagggcggcagctccggccaggccgagctctctccgccggctgccgggggcggcggtggcacggaccaggtcatgtccgaggtgtacctcggccggcagatctgcaacgtcgtggcgtgcgagggcgcggagcgcacggagcgccacgagacgctggggcagtggcgcaaccgcctcggccgcgccggcttcgagcccgtgcacctgggctccaatgcctacaaacaggcgagcacgctcctcgcgcttttcgccggcggcgacggctaccgggtggaggagaaggagggctgcctcacgctgggctggcacacgcgcccgctcatcgccacctcggcatggcgcgtcgccgcggcgtgatcgcaaagtttttgggacgctgcaccacgtgtttgccgccgatcacggcgcgacccccccccccccccctctctctctccccggctcaccggcggcacaattgaagcttgacgtcaacgaacgctcaattgcagcgaccgatcgggcttacggttctcgccggcgtgaagagatcgacgactggactccgaccagaccgacggcttgttcgttctcctttcccaattaccccgttccttggtcctcctagcccatctattatgtttaaatgtcaattattatgtgtaatttctccaatcgctcatattaaataaggacgaaccgaactggatttcattagctccaatgagaattttgtatacaaggcaccgatctaaaaattgagctatatgttcatgagttaaaaa

SEQ ID NO: 5400 - DNA, 1727 bp, Oryza sativa
  Predicted polypeptide sequence is orthologous to G307, G308, G309
cattccaccaaaccaagccaagcaagcctcacaccctcgcccgcgtcgtcttcctcctagccgccgtcgcgcatggctcagttcggcggcttcggtggctggtccgccatggacgttgccgctgccgccgccgctgctctgggcaacgtcagcggcgcggtgtaccacgccgatcctgctgctgccgtgtacgcgtctctagtccctggcatggctgtggtccccgggcgtgctccgccgtccgccgtgcagatcgaggcggcgaggcggtggaaggagctggagaagatggccctgcggtcggtgaatctcatggtgacgtgcgccggcgccatccaggcgggcgactacgcggcggcggccgggagcctgtccgacgcgcgcgagatcttcgccaagatgcccaccacccgcaccgggatcggccgcgtcctcacccacttcgccgacgcgctcgccgagcgcctgttcccggcgttcccgcagtccgcgccgccgccgcccccgccacgcggggagcagcgcgagctcttccgcgggttctacgaggcggggccgtacctcaagttcgcccacctcgcggcgaaccaggccatcctcgaggcgttcgaggggtgcaacagcgtgcacgtgatcgacttcgccctcaccgatggcatccagtggccgtcgctcatccaggccttggccgtccgccccggcggcccgccgttcctccgcatcaccgggatcggcccccacgccgccggcaaccgcgacgagctccgcgacgtgggcctccgcctcgccgagttcgcgagatcttgcagcgtccccttcgccttccgcgggatcgccgcggaccagctcgacgggctccgcccgtggatgttccaggtcgcgcccggcgaggccgtcgccatcaactccgtgctccagctccaccgcctcctggtcgaccaggacgccgccgccgcggcgtcgttcccggcgcccatcgacggcgtgctcgactgggtcgcgtccatgaaccccagggtcttcacggtggtcgagcaggaggcggatcacaacaagtcgtcgctgctcgagaggttcactaactccctcttctactacgcctccatgttcgactcgctcgaggctatcagccgccatggcggcggcgacggggcgggcaacccgctcgccgaggcgtacctgcagggggagatcgccgacatcgtgagccgcgaggggagcagccgggtggagcgccacgagcagatgccgcggtgggtggagaggctgcggcgcggggggatgacgcagctgccgctcggcgccaccggcctctggcaggcggcgatgcagctccgcgagttctccggcgccggcttcggcgtccaggagaacggcggcttcctcacgctcacctggcatagccagaggctgtactcggcgtcggcgtggcgcgcgaccgcggggaagaagatgacgatgatggctagcggcgccgccgacgccatggaggagagtcagaacagcaacaccaacggcggcggcggcggaagcagtggtggtggccatggtgctctcaaccaaatcatgcagtgaagaagagggatgtttgggtttcgaagtttatgtgggggaaacaatgtgatcgattttgatgaaccagattaaaaagttgtaataatattgcatttagtctgagagagcaacatgttggttttcgaattaataataaaatgtcgtttctagct

SEQ ID NO: 5401 - DNA, 1482 bp, Oryza sativa
  Predicted polypeptide sequence is orthologous to G307, G308, G309
atggataccttcccgttccagtggcccatggatccagccgcgtcatccggcctcgacgctgggtttctgccgcctccagcggctgtggcgcccgacgacggcgtggggtactacgacccgcctgcgggggcggatgtggacgccgctgctctgccggagttcgccgcggccttcccgccgtgcgcgcctgatgctgccgctgctgtgttggccatgcggcgggaggaggaggaggtcgcgggcatccgcttggttcatcttctgatgagctgcgcgggcgccatcgaggctggtgaccacgcgctcgcgtccgcgcagctcgccgactcgcacgccgcgcttgcggccgtctcggccgcctccggcatcggccgcgttgccgtccacttcaccaccgcgctctcccggagattgttcccttcgcccgtcgctccgcctaccaccgacgccgagcacgccttcctctaccatcacttctacgaggcgtgtccctacctcaagttcgcgcacttcacggcgaaccaggccatcctcgaggccttccatgggtgcgaccacgtccatgtcatcgacttcagcctcatgcagggcctgcagtggccggccttgatccaagccctcgccctccgaccaggcggcccgccgttcctccggatcaccggcattggcccgccctcacctaccggccgcgacgagctgcgcgatgtcggcctccgactcgccgacctcgcgcgctccgtccgcgtccgcttctccttccgcggggtcgctgcgaacagcctcgacgaggtccgcccgtggatgctccagatcgcgcccggggaggccgtcgcgttcaactccgtgctgcagctccaccgcctcctcggcgacccggccgatcaggcgcccatcgacgccgttctcgactgtgtcgcctccgtccggcccaagatcttcacggtcatcgagcaagaggccgaccacaacaagacgggcttcctcgacaggttcacggaggcgctgttctactactccgcggtgttcgactcgctggacgcggcgagcgccagcggcggcgcgggcaacgcgatggcggaggcgtacctccagagggagatctgcgacatcgtgtgcggggagggcgccgcccggagggaacggcacgagccgctgtctcggtggcgggacaggctcacgcgcgccggcctgagcgccgtgccgctcggttcgaacgcgctgcggcaggcgaggatgctggtcgggctgttctccggcgaggggcacagcgtcgaggaggccgacgggtgcctcaccctcggctggcacgggcggccgctgttctcggcgtccgcctgggaagccgccggggacggcggcggcgacaataacaacaacagtaacagcaacgttagcggtagcagcggcagtgacagtaacaacagcggcagcagcaatggtaaaagcagtggggctcgggatggtagcagcgtgtgtttgtaa

SEQ ID NO: 5402 - DNA, 894 bp, Oryza sativa
  Predicted polypeptide sequence is orthologous to G307, G308, G309
atggagatggacaaattcagctcgtcgtatcagccgtcgtggccaccagcgcaggccaccgtcgacgtcgtcgggtcggtggagaccttctggtcgcctgcgctgaggcggtggcgccgtgctaagaccgcgtgcaggcggcaacgctgcaggccggcgcgccgggcgttccagcgcgtcgcgtcgttcttcgtgcaggagctcctggaccggcgagcatccgccggcgctgggccctgcgagcacggcgttctgcatcccgcagtcgtcgtgcgcgaggcgtacgcggaggggttagggatgtacctcgagttcagaggaatcaaccgtggcctcgagagcctccacatcgacgacctcggcgtcgacgccgacgaggccgtcgccatcaacagtgtcctggagctccactccgtggtgaaggagagccgcggggcgctcaactcggtgctccagaccatccgcaagctgtcgcccagggcgttcgtgctcgtcgagcaggacgccggccacaacgcgccattcttcctcggccggttcatggaggcgctgcactactacgccgcgctgttcgacgcgctcgacgcggcgctcccgcgctacgacgcgcggcgggcgcgcgtcgagcagttccacttcggcgcggagatccgcaacgtggtcgggtgcgagggcgcggcgcgcgtggagcggcacgagcgcgcggaccagtggcgccgccgcatgagccgcgcggggttccagtcggtgccgatcaagatggcggccaaggcgcgggagtggctggacgagaacgccggtggcgacgggtacacggtggcggacgagaaggtctgcctggttcttggctggaaggggaagccggtcatcgccgcctcgtgctggaaatgctag

SEQ ID NO: 5403 - DNA, 1599 bp, Oryza sativa
  Predicted polypeptide sequence is orthologous to G307, G308, G309
atgggcatgtcccctgagccatgcaactccatctcagactgttcccagcagcagagccatcatctgactctgacacagcaacaagattcaacgattatttgtactaatcaagaacttgattattactaccgattctacgacgtggacgaagcggcgtttgatggcaacgaggtagagctcgtctccaggttctccaaggtcaccaggatggaccacatgatcagctcgccgtatcagccgacgtggtcgccggcacaggccgccgtcgacgtcgtcgggtcgtcggagacgtcgcgcgtcaggaagaagaggttctgggacgttcttgagagttgcaagcagaaggtcgaggccatggaggctatggacacaccggcgacggcgacgttccgggtcggtgccggtgatggcggcggcggcggcgggggtggcgcaggaggaggaggaggaggagctgacgggatgcgtctcgtgcagctgctggtcgcctgcgccgaggcggtggcgtgccgcgaccgcgcgcaggcggcggcgctgctgcgcgagctgcaggccggcgcgcccgtgcacggcacggcgttccagcgcgtcgcgtcgtgcttcgtgcaggggctcgcggaccggctgccgctggcgcacccgccggcgctggggccagcgagcatggcgttctgcatcccgccgtcgtcgtgcgcggggcgcgacggcgcgcgcggcgaggcgctcgcgctggcctacgagctgtgcccgtacctgcggttcgcgcacttcgtggcgaacgcgtgcatgctggaagccttcgagggagagagcaacgtccacgtggtcgatctcggcatgacgctgggcctcgaccgtggccaccagtggcgcggcctcctcgacggcctcgccgcccgcgccagcggcaagccggcgcgcgtgcgggtcaccggcgtcggcgcgcgcatggacaccatgagagcgatcgggcgggagctcgaggcgtacgcggaggggttagggatgtacctcgagttcagaggcatcaaccgtggcctcgagagcctccacatcgacgacctcggcgtcgacgccgacgaggccgtcgccatcaacagtgtcctggagctccactccgtggtgaaggagagccgcggggcgctcaactcggtgctccagaccatccgcaagctgtcgcccagggcgttcgtgctcgtcgagcaggacgccggccacaacgggccattcttcctcggccggttcatggaggcgctgcactactacgccgcgctgttcgacgcgctcgacgcggcgctcccgcgctacgacgcgcggcgggcgcgcgtcgagcagttccacttcggcgcggagatccgcaacgtggtcgggtgcgagggcgcggcgcgcgtggagcggcacgagcgcgccgaccagtggcgccgccgcatgagccgcgcggggttccagtcggtgccgatcaagatggcggccaaggcgcgggagtggctggacgagaacgccggcggcggcgggtacacggtggcggaggagaaaggctgcctcgtgctcggctggaaggggaagccggtcatcgccgcctcgtgctggaaatgctag

SEQ ID NO: 5404 - DNA, 522 bp, Oryza sativa
  Predicted polypeptide sequence is orthologous to G308
atgttcgtctgcggcatgtgcatgtgcgtgctgcgcccgtatcggccggtacaagttaactctggcaaaaacgggttaggtttagcgtacgtgcctggtatctttttcttggcggtaatgatcatgacgtcgaggtccaacgtatttggcgccaacgacactagtgccgacatcctcgtccctctcagcggcggtggcaatgatactaacactgaggatctatttgctactgtatacaccttttgtactgaactactgaagggctctgaagtagcctggctgctctgtttcaaggctttccaggaaacaacaacccatggcgctgaagaaacactgctgcttgccgacctggaatgggagagcaggaatggtcttcgtcttattcatgttactctcggttgccggggggagcgcgcaacgaagtccgaagtcggcgatgcgtttggacatgtaggaatattcggctgtcgtacgcgactacccgttaatgcttactgtttcgataggaatcgagttgtttga

SEQ ID NO: 5405 - DNA, 2171 bp, Oryza sativa
  Predicted polypeptide sequence is orthologous to G312
ggttcatcactccctccccattttaccgttgaggtcggcgacctccgcggacggtacggcgggacactagcccgtcccgaggggcaatcccgtaattttcgcgcagtacagtgcctcccagcgcagtggcttcgccccacgccctactgttttaaatccccctgccgctctcctccgccgtcttcttcccccccttcctctccaccacccccgattcgtcgtccaccaccgttcgacgagtttctcgcagatcgggcgggggcgcgccgggatggcgtacatgtgcgcggacagcggcaacctcatggccatcgcgcagcaggtgatccagcagcagcagcagcagcaacagcagcagcagaggcaccaccaccaccaccatctgccgccgccgccgccgccgcagtcgatggcgccgcaccaccaccagcagaagcaccaccaccaccaccagcagatgccggcgatgccgcaggcgccgccctcgtcgcacggccagatcccgggccagctcgcgtacggtggcggcgcggcgtggcccgccggggagcacttcttcgcggacgcgttcggggcgtccgccggcgacgcggtgttctccgacctcgcggcggccgcggacttcgactctgatgggtggatggagagccttattggggacgcccccttccaggactccgacctggaacgcctcatcttcaccaccccgccgccgcccgtgccgtccccaccccccacgcatgccgccgccaccgccaccgccaccgccgccaccgccgctcctcgacctgaggctgcaccggctttgctcccccagcctgctgctgcgaccccggtggcgtgttcgtctccgagtccgagttccgcggacgcctcctgctccgctcccatcctccagtccctcctgtcctgctcccgcgcggcggcgaccgaccctggcctcgccgccgcggagctcgccagcgtccgcgccgccgcgactgacgccggggacccatctgagcgcttggccttctacttcgctgacgcgcttagtcgccgccttgcgtgcggcaccggagctccgccctccgcggagccggacgcgcggttcgcctccgacgagctcacgctctgctacaagacgctcaacgacgcctgcccctactccaagttcgcgcacctcaccgccaaccaggccatcctggaggccacaggcgcggcgaccaagatccacatagttgacttcgggatcgtgcagggcatccagtgggcggcgctgcttcaggcgctcgccacccggcccgaggggaagccaacgcggatacggatcaccggcgtcccctcgccgctcctggggccgcagcccgcggcgtccctcgccgccaccaatacccgtctccgtgacttcgccaagctcctcggggtggacttcgagttcgtcccattgctccggcctgtgcacgagctcaacaagtcggatttcttggttgaacctgacgaggccgtggccgtcaatttcatgctgcagctgtaccaccttcttggcgactcggacgagctagtgagaagagtgcttcgtcttgccaaatcgctcagtccagcagtggtcacacttggagagtacgaggtcagcctgaaccgagctgggttcgtcgaccggttcgccaatgcgttgagctattaccggtcattgttcgagtcgctggatgtggcaatgacccgggactcaccggagagggtgagggtggagcgttggatgttcggggagcgaattcagagggccgtcgggccggaggaaggcgcagaccggacggagaggatggccggcagcagcgagtggcagaccctgatggagtggtgcggcttcgagcccgtgccgctcagcaactatgccaggagccaggctgatcttttgctctggaactatgattccaagtacaagtattcacttgttgagttgccaccggcgttcttgtccttggcatgggagaaacggccattgcttactgtgtctgcttggaggtgagggtagtttttttgggagtatttgggggaatgtgtggcgttgtgatagaacctgggaggaaatagttaggagaaatcattttgcagcttttgttgtagtttcctccaaaactgtgtttaggatgattggtataattgggaaattttagctgaattatcttgct

SEQ ID NO: 5406 - DNA, 1545 bp, Oryza sativa
  Predicted polypeptide sequence is orthologous to G314, G2699
gaatttgattggctcttgatcagcctccggatcgtgtagcgcagtggtggctagcacgtaggtagcaacaaagccatggacatggagcatgagctcaggggcggcggcgtcggggcggcggcgcatgggcatggctccatctgcttctccggcgggccggtgctcgtcgacgggcgacgcatccagcagctgctcctccactgcgccgccgcgctcgagtccaacgacgtgacgctggcgcagcaggccatgtgggtgctcaacaacatcgcctcctcgcagggggaccccagccagcggctcacgtcgtggctgctccgcgcgctcgtcgcccgcgcgtgccgtctctgcgcggcggcgccggcgggcgccgccgtggagtttctggagagaggccgggcaccgccgtgggggagggccatgtcggtgacggagctcgccgactacgtcgacctcaccccgtggcaccggttcggcttcacggcgtccaacgccgccatcctccgcgccgtggccggcgcatccgccgtgcacgtcgtcgacctcagcgtcacgcactgcatgcagtggccgacgctcatcgacgtgctgtccaagcggcccggtggcgcgccggcgatccggatcaccgtgccgtccgtgcgccccgccgtcccgccgcttctcgccgtgtcgagctcggagctcggagcccggctcgccatcttcgccaagtccaaaggcgtgcagctggagttcaacgtcgtcgagagcgcgacgacgacgtctccgaagaagacgtcgacgacgctgtgccaagaactcgcgtccgtgctgtccgacccgccgtcgctggggctaagggacggcgaggcggtcgtcgtgaactgccagagctggctccggcacgtcgcgccggacacgagggacctcttcctcgacacggtccgggcgctgaacccctgcctgctcaccgtcaccgacgaggacgccgacctgggctccccgagcctcgcgtcgcgcatggcgggctgcttcgacttccactggatcctgctcgacgcgctcgacatgtcggcgcccaaggacagcccgcggcggctggagcaggaggcggccgtcgggcggaagatcgagagcgtcatcggcgaggaagacggcgccgagcgctcggagcccggcgcgaggctcgccgagaggatgagccggaaagggttcgccggcgtcgtgttcgacgaggaggcggcggcggaggtgcgacgattgctgagcgagcacgccacggggtggggcgtgaagcgggaagacgacatgctggtgctgacgtggaaggggcacgccgccgtgttcaccggcgcttggacgcccaactagttgagcctagcttagcaatctacagtatacatcaagtgattaaagcttaagctggtgttagactgtctattagctcagaagtgacaacggagaatcaactgaggaggaatttctggttggatttagtggatcgttttaaacttctacttccatgacaagatatttcagttgaattcttgatgttttactccc

SEQ ID NO: 5407 - DNA, 1419 bp, Oryza sativa
  Predicted polypeptide sequence is orthologous to G314, G2699
atgcagttcacgcacaccgcgccacctccaccgcctctgcaccctaatgggcatggactagggttagggttgtaccttgacgtcggcgcgacgaggggaggaggaggagcgcggccgtggtcgtcgtcgtcgtcgacgacgacgttgggtgggagcggctacttcccgtcgtcggcggcggcgtcgaagatctcgttggggaacctcaacagcacgggctgcatggagcagctgctggtgcactgcgccaacgccatcgaggccaacgacgccacgctgacgcagcagatcctgtgggtgctcaacaacatcgcgccggcggacggggactccaaccagcggctcacagcggcgttcctgtgcgcgctcgtgtcgcgggcgtccaggaccggggcgtgcaaggcggtgaccgcggcggtagcggacgccgtcgagtcggcggcgctccacgtgcaccggttcacggccgtcgagctcgccagcttcatcgacctcacgccgtggcaccggttcgggtacacggcggccaacgccgccatcgtcgaggccgtcgaggggttccccgtcgtgcacatcgtcgacctcagcacgacgcactgcatgcagatcccgacgctcatcgacatgctcgccggccgcgccgaggggcccccgatcctccgcctcaccgtcgccgacgtcgcgcccagcgcgccgccgccggcgctcgacatgccctacgaggagctgggcgcgaagctggtcaacttcgcgcggtcccgcaacatgtccatggacttccgggtggtgcccacctcgccggccgacgcgctcacgtccctcgtcgaccagctccgggtgcagcagctcgtctccgacggcggcgaggcgctggtcgtgaactgccacatgctcctccacaccgtcccggacgagacggccggctcggtcagcctgacgacggcgcagccgccggtgtccctccgtaccatgctcctcaaatctctccgggcgctcgacccgacgctggtggtggtggtggacgaggacgccgacttcaccgcgggcgacgtggtggggcggctgcgtgcggcgttcaacttcctgtggatcccgtacgacgccgtggacacgttcctccccaaggggagcgagcagcggcggtggtatgaggcggaggtggggtggaaggtggagaacgtgctggcgcaggaaggggtggagagggtggagcggcaggaggacaggacgaggtggggccagcggatgcgcgccgccgggttccgcgcggcggcgttcggcgaggaggccgccggcgaggtgaaggcgatgctgaacgaccacgcggccgggtgggggatgaagcgggaggacgacgacctcgtgctcacgtggaaggggcacaacgtcgtgttcgcctcggcatgggcgccgtcctga

SEQ ID NO: 5408 - DNA, 395 bp, Oryza sativa
  Predicted polypeptide sequence is orthologous to G314
ggttgcttcttccatctgctcttttgttgcgccctgattctgcaggcaccatgcgaatcgcggcaatgacaccaagagatagagagattcgcgggaatggcagccaccaccaccatccaccaccaacaaatcatcgcgccaacaacaaaaaaaacccaaaaaaaaaacaacaaaagaaattcaggcgtggcagttcgttaattcggataacaccaaccaacgagtccacgtcgtctcgtctcccaatcaatcaattgctgatcgtctgacttatataagagggagaggagaggaggagtgtggagtgtggagtctctgataataagtgtcgatttttgttgttccgggagaaattccgggagatttggggcggcggcggcgatgaggattcgggg

SEQ ID NO: 5409 - DNA, 2671 bp, Oryza sativa
  Predicted polypeptide sequence is orthologous to G324
tggccgccgccaccgccgcccgccacctcgccgccgaccagacgagccgccgtttgacccaacaccgagctcccgcgcggagttgatgtccatctccccttccgaatccaccagaggatcccagccgctcgcgccgcgccattccaaccctagccccggaccccgccatggcaacagctccgccccaccgcgccgccgcggccgacgctcccctacggctcccgtctcaccgccctcagccgccggcgggagcggcggcccgagctccgtctcggtggttccagctatcagagaatatgttgatacttcccaaaaggtagttggattcagaatctctagagaagagaatgatgattcatatacccaagaagttggcaatttttctgaatgccactcttctgaacatgggaattcaggtttttcagccaataatggcacctcaggccaggcaactcctcagagacctgaattgatggaatccctgaagattgatctatccactacaaattctagtgggaatggtactcaggtgactgctagaaagaatcagtctgtaaatgccaattatctgctgaatttccactatgatccaatttctcggccacagcctagaggccccagaacatatcctacaagaagacagaggaagatcagaccatacaacaaagatttgttcctacaagcaaattttaagtttgttgtgttggatactggaagctatgaaatagaattaatggatccagataagatgctccagtgggaagatattgtatgtgtaagatattatagcccttgtgaggtgcaatgccctatttgcttggagagcccattgtgcccacagattacatcatgtggtcatatatattgctttccatgcattttacgttatttacttatgggaaaagaagattacaaaggtgaaagctggaagaagtgcccactgtgtttcatgatgatctcaacaaaggagttgtatacaatctatattactcaagtccagcattttcatgttggtgacaatgtgacatttacacttttgagccgctcaaaaaattcactcactccttctattaagaacctcactgatgaatctactatagacgaagatccttgcagtgcattctccaagttcattttgacgtctgatgtggaactttctgttagagaggcaaaaacagatcttgttaattggttgcatatggcagatttaggccttgtgggtgacttggagaaacttccatacgtttctaccgctttggagcagctagaagaacggatgaaatattggagtgagtacagaaattttagtgtcagccctcccctaaaagacagcttctcacctgtaactagttccaaatcaaggaaccctaataatgcacaatcttcacgccagaacagtgaacacaagctatctcctctatcagatgaagatatgattgctggtgtttcggagctctgtatttcacctgaatcaaataaaatctttaataaaggaatgccatcgaaaacagaagagagatgtatggctcccatagattcaaatgagaatgatacttataatttttaccaggtatctgatggccaacacctaattcttcatccgctaaacatgaaatgccttataaaccattatggaagttctgatatgctcccaccaagaatacatggaaaaatcttggagctagaaactgtaacacaatccgaagctacaagaaagcgctatcgttatctaagtcacttctcattgacaacaacgttccagttctgtgaaattgacctgggtgatatgctgcctcctagctcattagctccattcatggatgaaatcaagaagcgagagaaacagaggaaacgaactgccaagaaggaagaaagcgatagagtgaaagccgaagttgctgctgctgcacaggcatctgcaatgctgtttgaacatacaagcttctctcccagtagtgggccacatggcgattttatgttctctctggatgactttgaagctcttggaaacaatgctggaccctccacgagtccaccagccagcgaaagaaagcttttctccgatgttgcacggcttggctttgcgtctgcccaagactcgcctcctctaagagttgaatctggggatttgactggcaaaagtgaaagcacgggggaacaagggccagccgcaacacccgcattatcctttgccagcatcatttcctccactagagcgtcagacaatagcctggacacgcacaaaccaaatgtagtcgggaagaaaggcaagaaacccaccaaagtgctcttgtccactggcggtggccgccgatactgaaggaagagtgacactggaatggaagcagttgccagttggctgtttcctataagcagtgtgtatagtgcataacctggacttcacatctgtaacactcccaagtcccaagtagcagctttttctcccatgtggtttgatctaaatcgcctgactgttttagaaggttttttactgtgtatctacatcctgacccatgctaagggagtaagggtgactgccctgtcgcaaaatgagaagagctatgtaaaatttgataaataatgatgctaaggatcatgcgcaatactttgctcaatgtacgtcgacgagttgatccgtcataggctgatacagcctgctgtttaaatcgtg

SEQ ID NO: 5410 - DNA, 437 bp, Oryza sativa
  Predicted polypeptide sequence is orthologous to G326
gcacttatttttgggacggatgaaataatgtgttttttagagaaaagaatcgagcgtcagtatgcttcgctgacaaggggatggcccacgtgtcagtgaatcgaggagtatggtaccacgtgatagatatactgatatacatatatagaggcgtatgagaagagagaagtaaaaaaatacaataaatactggaaacattattgtaaatatacactttgttttattctttttatatttcttgtttggtcatggatttgtttcatttttgtaaaatgtagaacggtgctatgtgatgtgtagtttcccatagtttgtaatgttgaactactggatggttgaagctgttgtattttgtcccactttcacatgaagcctggttaaataataaataaagaaaagggtaacaaacatttttcatgccaaaaaaaaaaaaaaaa

SEQ ID NO: 5411 - DNA, 1892 bp, Oryza sativa
  Predicted polypeptide sequence is orthologous to G326, G1337
gcctcctcattcctgcattgcattgcttccgagctcaaaagtcgtcgtagacccccgcctccttcctcctcctcctcgcgcttcgatttggtttggtttgattcggtttgcgagatgaaggatggtggtggaggaggagggagggggcagcagcagcagtggccttgcgactactgcggggaggcggcggcggcgctgcactgcagggcggacgccgcgaggctgtgcgtcgcctgcgaccgccacgtgcacgccgccaacgcgctctcgcggaagcacgtccgcgccccgctctgcgccgcctgcgccgccaggccggccgccgcgcgcgtcgcctccgcctcggcgccggcgttcctgtgcgcggactgcgacaccgggtgcggcggcgacgacggcgcggccttgcgggtgcccgtcgaggggttctccgggtgccccgccgccgccgagctcgccgcgtcgtgggggctcgacctccccggcggctgcggcggcgaggaggaggaggccgacgacgcgttcttctcggcgctcgactactccatgctcgccgtcgaccccgtgctgcgcgacctctacgtgccatgcgacccgcccgaggtggtggtggccggcggcgggcggcgactcaagggggaggcgctcggccaccagctcgccgagatggcgcgccgggaggccgagacggcgcacccgcacacgcagccgcactcggatctgagcccccgcacgcctcgccggacctccgccgcggcgagcggccgcctgcaggaaaagcaagctcccccgccgttgcctcatgctgctgcgacggcggcgccgctgccgtacacttcactgctcatgatggcgccggccaactgcaccgagctcatggaaaacaaccgtgttggagacgaagatgaaaatgttctgtgggagagcaccgcgccatcagtgccaccaacccagatatgggattttaatttgggaaaatcaagggatcacaatgagaactctgcacttgaagttggatttggctcaaacaatggaggctttatgattaagagttataatgacatgctcaaggagatttcttctgggacaacgaaggatctggaagatatttatgactcaagatattttgcagctgccgaagatatcatgtcgactaatgtctgtcagctgtcatcgaaaaatccaagcaccaggagcaacaaacggaaggcgagctcatgcgcttcgacgatcgatggaccgacaacttccacaagccatgtacctgctgcttcaggggcattggggggctcttcgaacgacagaggatcggctctccccaaggagatttccttctgtgatcagaccgtcgtccctaccggagccgatcagaggccatgtaccatcaagatcgacagcgagacgctcgcgcagaacagggacagcgcgatgcagcggtacagggagaagaagaagaaccgcaggtatgagaagcacatcaggtacgagtcgaggaagctgagagcggacacgaggaagagggtgaaaggccggtttatgaagtcgaacggagcacctgatgatgtcagcaatggcgggtgatctcatccctgcaatccctgatagctagctgcaatgtacgtagcctggctttttgacgttgcagagatcgatgtggccatatatatgctgagagctaagtctgaaatatgttgcgtatgttgttacaacctatgcacgctctgcttaagtctgtctgctgctgcatgtattgttcagctaaaatttttgcgtccaagagtcgatcttgataattaagtacccctactacaaatctacactacatactgtaatagaccttagattttttttctcatctcctcgtagaaatatatggcattttatatatacgt

SEQ ID NO: 5412 - DNA, 1817 bp, Oryza sativa
  Predicted polypeptide sequence is orthologous to G326, G1337
tgatgcccacacgcacccacccaccgcgccggcggcgaggccatcacctcctcctcctgcacgtgcgccgtgggcgtggtcgccggagccggaggggtggatgacgtggcggagctgcgactactgcggggaggcggcggcggcgctgcactgcagggcggacgcggcgaggctgtgcgtggcgtgcgaccgccacgtgcacggcgcgaacgcgctgtcgcggcgccacgtgcgggcgccgctctgcgcccggtgcgaggcgcgccccgcggcggcgcgtgtcgccgccgtcgctggagctggaggatgcggcggcggcggggaggccaggttcctttgcgccgggtgcgccgacgacgacggtgcggaggcggcgagggtgcccgtggtggggttctccggatgccccggggccgccgagctcgccgcgtcgtgggggctcgacctcggcggcggcggcggaagagatgaattcgaggaggatccgttcttccccgaggccggttacccaatgctggcggcggatcgcgtgctgcgggacatgtacgtgccctgcgacccgccgccggaggtcgccgccggcggacgcggacggcggctcaaaggggactcgctctgccaccagctcgccgagctggcgcggcgtgagatggaatccgcgccggcgcaggcgaactcgggatcgatctccccatcagctcgccggggctctgccgctgcaatccgccatgaggctgcggcagcggcggcggcgcaaagggccacattgccgtacaagtccacgccggtgacggaggcggcgggctgcggcgatgtcggcaacggcgagcagttcaccgacgacaacgaactcgtgtggcagcgcaccgcgccctccgatccgccatgccagatatgggattttaatctaggaaaatcaagggaccatgatgagcactctgcacttgaacttcatttcggcccaaaagatggaggctttatgatcaaaagttataatgacatgattgaggaagtttcctctagctcaaggtaagatcttcaatatatttatgactcgacatactcttttgccacggaagatattgtgtcggccaatatctaccagttgactccaaaacagctgagcactgccacatccggcaacaggcgacacaaggacgagcaacacggattgacaaatgacgggccatcatcttcgaggatcgacagcaaaacgatcgccatgaacagggacaacgcgatgcaacggtatagagaaaagagaaagactcgcaggtatgacaagcacatcaggtacgagtcgaggaagatgagagccgacacgaggacgcgggtgaaagggcgcttcgtcagggccactgacatcttcaacgtcggtggcggcgacggcggctgaaaatgtgcttgcgatgtctgaaatccagcgacatcctcaacaacgtcagttcagtggggattattgctgggggaatggagatgctgcatcaccaacactttttgtgaatagcctgaactgaaacttgtttcctggagtagtagaatacatacgatatcacatccatgatcttgtattgttgtatttttttttttgagggattgtttttttttaatgacaagttttttttgaatgactttttgagggattgttgtatggttattattccactcagaagtttttgcagcccctgaaaatgtggcaagttatgtaggacctgtttgtaattttgttgccactttcaaccccactaaactttagtagggtagcaaactaaacattatcttataaatacaattgtattaatatttggtagttacgg

SEQ ID NO: 5413 - DNA, 1361 bp, Oryza sativa
  Predicted polypeptide sequence is orthologous to G328, G2436, G2443
attgacgtcttcgcacaggcacccagccatgctgaagttggagccggagttccccggcctgccgcagcggtgcgactcgtgccggtcggcgccgtgcgcgttctattgcctcgccgattcggcggcgctctgtgccacgtgcgacgctgacgtgcactccgtcaacccgctggcacgccgccaccgccgcgtaccaatgggcgtggtggctgcccccggcgccgggggagccttcgtcgtccgccctgcaggcggtgtcaactcctcctggccaatccgagagggcaggaggtgcgactacgacgatgacgacgccgacgccgctggggaggaagacgaagaggcgacgtcgtggcttctgttcgacccgctcaaggactcctcggatcaggggctgccgccgttcggcgacgcgctggtggccgacttcctcaacctcggcgggggcgccggggagaaggaggacgcgtcgtcgagcaaggactgcagcagcagccacgggaagagcagcgagggcagccacgagttcgccgtgcccggcgagcccgtaccggagcgccagggcttcggggcggtgagtatggacattaccgactacgacgcctccaatttcaggcgcgggtacagctttggcgcatcgctcggccacagcgtttcgatgtcatcgctggagaacatgagcacggtcccagactgcggtgtgccagacatcaccacctcctacttgaggtcatccaagagcaccatcgacctcttcacggcagcagctggctcccctgtggcggcgcacagcataatgtcgccaccgcagttcatgggcgccattgacagggaggccagggtgcaccggtacagggagaagaggaagacgaggcggttcgagaagaccatcaggtacgcgtcgcggaaggcgtatgccgagacccggccgaggatcaagggacgcttcgccaagcgcagcgacaccgaccttgaggtcgaccagtacttctccaccaccgccgactccagctgcggcgtcgtgcccacgttctagcgagcagcttggccgcacgcctggaagacaatcaaagaagctcaggaatgaatatattctcccactgtatagtacatcttggttgcttagctatatatatatatatatatatatatatatatgtataattcgccgaatcgcctctaaatttgtgggaggtatgaggcttcagctgtaggtatatatagatgctagaaagatgctccttgtaaaattgtgcaggagtaaatgtaatcatgtagtcatccctccttctccaatcctttacaatacatttctgtttttttattcagcttaaaaactacgttttgttttttctcccgat

SEQ ID NO: 5414 - DNA, 1557 bp, Oryza sativa
  Predicted polypeptide sequence is orthologous to G328, G2436, G2443
caaaattccacaagagccatgcgaggtagaggaacaggagaagacgcatacacacacgacacatagagagagaggacaaacacaatagcttggatcgatagacttgtccatgtggtgcaagctaaagctactactaccacaagcaaggctacttcgttcatgaattataattttggtggcaacgtgttcgaccaggaggttggagttggaggcgaaggaggaggaggaggagaggggagcggctgcccatgggcgcggccgtgcgacgggtgccgcgcggcgccgagcgtggtgtactgccgcgcggacgcggcgtacctgtgcgcgtcgtgcgacgcgcgggtgcacgcggccaaccgcgtggcgtcccgccacgagcgcgtgcgggtgtgcgaggcctgcgagcgcgccccggccgcgctcgcgtgccgcgccgacgccgccgcgctgtgcgtggcgtgcgacgtgcaggtgcactccgcgaacccgctcccggccatcaccatcccggccacctccgtcctcgctgaggcggtggtggccaccgccaccgtcctcggcgacaaggacgaggaggtggactcttggcttctcctctccaaagattccgacaacaacaacaacaataacaacaacaacgacaacgacaataacgacaacaacaacagcaacagcagcaacaacggcatgtattttggtgaagtcgatgagtactttgatcttgtcgggtacaattcgtactacgacaaccgcatcgaaaacaaccaagatcggcagtatgggatgcatgaacagcaagagcagcagcagcagcagcaggagatgcaaaaggagtttgcagagaaggaagggagcgagtgtgtggtaccttcacagatcacaatgctgagtgagcagcagcatagtggttatggagttgtgggagcagaccaggccgcctccatgaccgccggcgtcagtgcttacacagattccatcagcaacagcatatctttctcatcaatggaggcgggtatagtaccagacagcacggtgatagatatgccaaattccagaatcctgacacctgctggagcaatcaatctcttctcaggtccctcgcttcagatgtcccttcacttcagctccatggacagggaggccagggtgctcaggtacagggagaagaagaaggccaggaagtttgagaagacaatacgttatgaaacaagaaaggcgtatgcagaggcacgaccccggatcaagggccgtttcgccaagagatcagatgtgcagatcgaagtggaccagatgttctccactgcagctctatctgacggtagctatggtactgttccatggttctgatgggactcatgagacgctatcttataggcatatatatggggacttactgagtagcaataacatcgatccagtgggagtagttctagacaatctgtgttatgaataatagtgtgttgtttgcgacttaaaattgatcaagtaccttagctttttaaagttttgctttgtaatttccggatagcagatatatattgttggtacttgctcagt

SEQ ID NO: 5415 - DNA, 776 bp, Oryza sativa
  Predicted polypeptide sequence is orthologous to G328, G2436
ctagaaagattatcagtttattcatgggtcttgactaaagcagtaacagaatttacaaagtgaaaaatagggtgttaattctacaccgagatatatggagaaaatatcaagaatctacaggatctcctacaaataaaataaactgtaaagaaagcactagctaaaactcaaaaacaaatggtaaaactgtttagagatttcatacatggtgaatgatgatcctggtgtaaaattgttgatgcttgcagggagaccttgctgtcacagggtggatatgaacaggagttccataattttatcccctgatgcatgatcacatagtcattctgcaaatggtccccactggaacaagtccaaaccactgctggtcccaattcacggcattaatgtgcacatgccaataacctgcatgtcgatgcaccgttaaaagattcagacgtgatctagtatcagtggacccaagatcaaaccagtgctctaaccatacgaaagcctccgtaatgtatgctgttgccagtgtgtcacagacaccatcatgagctcaattcaacatgacatgttttctgcatgtgacaacaattcaaacgatgcatacgggcatgaacctgcgctgagccaacttgtgaccggggtgctaagatcaagaacagctccagatggtccctagcaatcctcaaccatgtcgtttcagtcttgtcatcgatggcaacgatatccctcttttcacggtcataagagagcccatcagtggtaaggaaacaacgatctgctccgga

SEQ ID NO: 5416 - DNA, 447 bp, Oryza sativa
  Predicted polypeptide sequence is orthologous to G328, G2436, G2443
atggtggctgccgccgtcctgagcccatcccgacgcgcccatggccgtcgctattatcctgagtccatcccgacgtgcccgagaaacccagcacacgccgaggccgctactatcctggcgagccccaggatcgagaggatcatatgctatccctcggcgctcctgcgcctatcgctgtcgcctccaccgtctccacgccatccgcgagctctgcgccgtatttggtggtggtgtaggagctctaggactgcttggtgcgccgacgccgacactgacaccgacgccgaggttgaggttgaggttgagcgcgccgtgctgctatcgctgctaccgaacatcacggcctcggctgccacagcagctgaaccgatgggcgtgacagggacgcgcgtggcgccgggccagcgggttggcgtcgtggatgttggcatcgcaggcagcacatag

SEQ ID NO: 5417 - DNA, 1452 bp, Oryza sativa
  Predicted polypeptide sequence is orthologous to G343
gtcggaaacctaccccctcttcttcctccgcttctctctctctctctctctctctctctttctctctcctcaaccgtgcggctgcctcctcctcgtcgctgggcatggatgtgcacccgccgaatgcggccgcctcctcgctggaggagttgttcccgcaccagcccgccacggaaagtgatagaagtggcatagagtggctctctgtctatgtagaggactgcttgtcaacctctgcatcctgcacaaaccctgtctctgcagaactaccgcctattacaatggcaagtcaaggtgctgcaaaaccaaagttaccaccacgctcatctaccaatgcaagaaaaaagaaaaggagcctggcatctgtcataagcgacactgatgaccaacattgtatcacgctgtttgtcgagccaccgctactcctgctcgatcataaggactggctagcagagagtgagcttatcctccccaagaaggacaaagatgaagaacttgtccaagagcaagaacaagaggaggaagagaattacaaaatgagtgcaggaatgcaattccagcaggagcaactggtgatcacttgtagctattgtttgtccagccaatcaccacagtggtgggatggtccatcagggcctacctgcgatgcttgtcgtctgaggattgaggcgaggaatgggcacaccaccagttccaagaagcgctatggccaagagattgacaaagaacaggacataggaaagcggcgagataagaagaagatcaagaaggctgtttatgtgaatgatgagctgctatcggaggagccaatgaagaggtgcacccattgcttgtcctacaagacgccacagtggaggaccggtcccttggggcctaagacgctatgcaatgcttgcggtgtgaggttcaagtctggcaggctgctgccggaatacaggcctgctaatagtccaacttttgtgagtgacatacactccaattctcataagaaggtcatgcagctgaggaattctgttccacacccaaggaagtgaactggtggtcgggaacgtctcgatctgttgcgtttagttttaggaactcttcagttgtagaagtaagctgatagtgaagaacatcttaatctgtctcattgaattttaggcgggctccttggtcgtagaagtgagctgataatcacatctcaatctgctgcattgagcttttaggggctctcagccttagatgctgagaaaacgaaagcagaatctagttaggcgtcatgaactctttgttagctctagccgttttttaacttgagaaattaatctgctagttgttggagatcatcagtttaataccaatgggtggttgctacccttgttatcccaccattgtcttgcagcatgcttgttctgtgatactcgctgaatatgtttgcaagatggaaatcagaattcagagcagcctctt

SEQ ID NO: 5418 - DNA, 1612 bp, Oryza sativa
  Predicted polypeptide sequence is orthologous to G343
ttgacggaagaaggaaaaaaaaaaaaaagctcccctctttccctctcctgctgacgcgccccgtcgccgccgctcgcttgccgcgcgcggccaaagcaagcaagctcgccgccggccatccatggcggcggtggagggcggaataggagagccgcccggattagccagggaaaggcgcctacggctccggcgatctgtggcggcgaccggcgacatggacggcgacggcgacgttggcggcggcggcggcggtggtggtggtggtggtgttaggtacgtcctcgcgctcccggccatggcgtcgctggccgtcctcatcgcccacctcgacgccgccgtgcccgtgccccgtaggcctcgcagctacctcccccgcgccgtgcccatggcgtggtgggccttccggctccccgtcttccgccccccgcctccgcctccgccaccgccggccaagaatccggtcaaggaggaggagggggtggcgcgcgtggtggtggtggtggcgccgccgccgcccgtcgatcccggcgaggaggaggcgggcaagagggcggcgaagagggcgaggaggtgcctgaactgcgacgcggtggagacgccacagtggaggtcgggcccgatggggaggagcacgctctgcaacgcctgcggcgtccgcctcagggcggtcggctcgctgcctgaacaccgcgcgccggcggcgaggacgacgacggccgcccccgcgtcgccgcccgatagcccgatctggacgcccggccacaagccgccctcgtcgtcgcccgacatctacctcgtcaggaggacaccgaagctgccggtgacgcggcctccccgtaccaagcaagctccgcccacagcgcccgcgcccgcgcctccgccgccgccgccgcagccggcgtcgccgaagacgaagacgaaggcgaaggcgaagaagccgaagaggaagagaagctgcgtgcactgcggctcgacggagacgccgcagtggcgggaggggccgacggggcgcggcacgctgtgcaacgcgtgcggcgtgcggtacaggcaagggaggctgctgccggagtaccgccccaaggggagccccaccttctcgccgtccgtgcacgccgccaaccaccgccaggtgctcgagctccgccgccagcagcggcagagcaccaacccctccactccaccgccgccgccggtgtccgccgccgagccaatccccgacgagcaaaaagaagaggtggtaagcgtgccagtcgccgccgccgcgcccgccaccgacggcggcgcggcgagctcgctggacgcgctgctgctcgacgggccgtcggcgccgctcatcgtggacggcgacgatttcttggttagttaggtagccagaaaaaaaaaaagaggaataatttcagctgagaatgagatgaggaataccaatttttcgtttgatttttcaggaaaaacagttttaccacctgacattgtgaatactcgtcgatcctggggaaaatctttgcgtgaaatttagctagttttgctgcccagatgaactagttctggtgcttggtagctgatgaagttgaaaccggttttaatggatcaagggggatggatgttcaatgcc

SEQ ID NO: 5419 - DNA, 1358 bp, Oryza sativa
  Predicted polypeptide sequence is orthologous to G343
gagctcctcctctcatcagtcatcactacactcacttagctagtggcaaaaagatagatagctctagctcgtactgcatcaaacgggcggtagttgcactgcccgtttcaagggaactccagtgacaaccagcttcttgccaattcagaacgtgaccgtgtggtacgtacggccaaggcagtggctagctcgcgatggcgtcggagtgggaaatggccatgggcgtcgacctcggcatggggatgagcacgtaccacaacgcctccggtggcatcgccgccgcgccgatgatgggccaccacggcggaggaggcggcggcggcgggtactccgccgcgcaccaccaccaccaccattactacgggatgcctcatcaggcggcgatgggcgacgccatgcgcgtcgacgacctcctcgacctctccaacactcccggcgcccacgacttcttcccggcctccgctgccgccgccgccgcaggtgaccacgggcaccaccaccaccaccacatcggcggcatgggcgagccgtcgggcgccacgccgtcggccacgtcgtcagatcaccagacgtcgatgctctccttcgccgacgacttctacatacccaccgaggacgctgccgagctggagtggctatccaagttcgtcgacgactcctactccgacatgccgaattaccagtcgtccgcgcacgccgcaatggcggcggcggctgcttccgcggccaacaacggcggcggcagctcggccggccaagacagctgcctcacggcggcgcctggccgcggcgcccgtagcaagaggtcgcgcgcgacggccgcggccgccgccgcgtggcactccctcgtcccgcgcccgccgtcccagtcgtcgccgtcgtcgtcgtgctcgtcgtccgacttcccgtcctcgaacaagccatcgggcaccgcgaggccgaacggctcaggaggcggcagccgcggcaagaagagccccggccccgcgggggcggaggtgggcatggaggccggcgtgcggcggtgcacgcactgcgcgtcggagaagacgccgcagtggcggacggggcccctgggccccaagaccctgtgcaacgcgtgcggcgtgaggttcaagtccgggcggctgatgccggagtacaggccggcggcgagccccacgttcgtgctgacgcagcactccaactcccaccgcaaggtcatggagctgcgccgccagaaggagctcctcatcatccgcggcagccaccgcgacgccgccgcggccgcagcagcagccgccgccgccgccgccgcgggatccgccgcggcgaccgggaggccggagctcatgttccgcgactacggcgtgtgctga

SEQ ID NO: 5420 - DNA, 242 bp, Oryza sativa
  Predicted polypeptide sequence is orthologous to G344
gaatgtctgccttccttccacggtagagccacccactgcgctttcgccggcggcggaggaggagggaggtgcgtttatggttgattgtgtcagttgttccctcgccggctaagaatacgacttcttccggacggctcaggtcggtaattcaaaacttggacgtggtatataacagtgatcttacctcgtttggaccaccctctatatgcgctctatgctttacatgaaactgataatggaaa

SEQ ID NO: 5421 - DNA, 860 bp, Oryza sativa
  Predicted polypeptide sequence is orthologous to G346
ccttttaactcatcaaactcagatcgatagaagagatcgattcgtttctatcgaaagcgagcaaactagcgttagctactactcgaaggcaaaatggacgtgatggagaagtctcggcgagctcacttcttgttcgacgacgacgaccaaacgccgcccaagcagaacggcccccggaacgacgacgaccagcacaacaacgacgacggcagcggctgcctctgcgtgtcgtgctacggcggcggcgtcgcaaagccaaaggccaagtcgtcgtcgtcgacggcgaaggacgtcgtcgccggcggccgtcctgctgcaggctccaactgtacctgatctaattactctaaccatatatagcttgctagcgatcgagctcgatctcatctcgcacctagcttgatcatgtcgagcaaccatgtacgtgttgatcgacatgatcactctagctagctagctagctacttcatatggatgttgaataagggatcatattggaggaaaacatgcatgaatgcttatgcaactatgcaagcatgcccgtctccaattactggtacagactacagagtgatgtatgttaattacgagaaatgtactctctttacgaaatactatgaacatatattatgatcaattacatgacagttgtattattaattagcagcgttctgaattcattctgaaagggtgtgtccggcctttcgaatggacaaccagctgctgtaattaagctgttcattgttcgatctcttgccgaatagtataactttttttttggggggaatgggcactcatttattctttacaaatgaatatatctccgtaggagtataaaaaaaaaaaaaaaaaaaaaaaaa

SEQ ID NO: 5422 - DNA, 1587 bp, Oryza sativa
  Predicted polypeptide sequence is orthologous to G346
atggtggtggtcgacgggctccacgacggcggcggcggtgacctccaggccttgctggatgacgcgggggtggatgatgtcgcggcaaggggcggcggcgaggtagaggaggaggtggagcggccgtcgaacgaggacgcgttcccggcggtggagaagatggcgacggcagcggcggcgaaggggttgcagtgccggcactgcgggacgacggagacgccgcagtggcgccatggcccggagggccaccgcacgctgtgcaacgcgtgcagcatgcgctaccggagcggcaagctggtgccggagtaccggccgctgaggagcccgacgttctcgccggagcttcactccaacaggcaccaccgcgtcctccagctgcgccgccgaccggggccccagtcagccgccccgtcccccgcggcggtggcgaggtacggcggcgaggcgaaggaggaggaagaggagctggcatgggtgtcgaacaaggacgcgttcgcgacggtggagaccaccatggcgccgtcgccgcgggtggtggagacaccaccggaacacgaccaccggccggcgaacaccccgaccacctctccagagccgcactccgacagaccccgccgcgtcgtccagctacctcgccgcctgcaggagccatccgcatcagccaacctcgcccatgcagtggcggcgacggcgagggcggggcgagagtgcgcgcactgcgggacgacgaagacgccggcgtggcgccttggcccggacagccgccgcaagctgtgcaacgcgtgcggcaacaagtaccggagcggccagctgaacagcacgaccttctcccagaattcccaagaacagaagaagaagagcaagagctcggcgtgttccagggagaggaagcgatcggcggtggcggcgacggtggtggtgggtggtggtctccgtgacgacgcggcggcgatcgcggacgaacacctcgacggcggcgacctccaggccttgttggatgacgtggcgttggatgacgtcgcggcgaggggtggcggcgacgccggcgaggcgaaggaggaagaagaggagctggagtggctgtcgaacaaggacgcgttcccgacggtggagacgatgtcgccggcgccgccggagaaccgaacgaaggcgcccgtgccgccggcggggtggcagtgccggcactgcgggtcgacggagacgccgctgtggcgcgagcgcgacggcccggcggaggcggagcacgtgaggaaggaggagacaccaccgaacatcaccccggcaaccaaacaccgccgcatcgtcgacctcctccgctgctccactgctcttaacacggcggcgaaggcggtggagcggcggtgcacgcactgcgggacgacgaagacgccggcgtggctgagtggtccggacagccgcggcaagctgtgcaacgcgtgcgggaagcagtacaggaaaggtcggctggtgccggagtaccggcctctcaactgtccgaccttctcgccggagctgcactccaacgcacacgcacaccgccgtcgccgagagtcgccggtcgccatcgccatcgccggcgagaagtga

SEQ ID NO: 5423 - DNA, 870 bp, Oryza sativa
  Predicted polypeptide sequence is orthologous to G347
agaaccagaccgtggagcactcgatctccaagctcatctagctcttcttgcttcagcttcttcctctctctcacagttcatcacacttggctttttgagtcaggtgcttgttcttcctgctgttcttgccttggcatatgcaggaccagctgatctgcagcggctgcaggcgcgtcgtccagtacaggagaggggtcgccggcgtctgctgcccgggctgcaacacgctcaccgccgtcaacccgtcagcggtggccgacatgtcggagctcatctgcagcggctgccccacgctgctgttctacaaccgcggcgcctccaacatccgctgccccagctgcaacaggctcaactccaccagatcagccaaccagattgcacacctgacatgcgggcagtgccggacgactctgatgcacccacctggagcctcaactgtgcagtgtgcaacctgcagatatgttaaccatgtcagggatgctcggcctcaaactgtccttgtagagaatcctaagacactggatgataagggcaagctggtgagcaatgtggttgttggtgtcacctcatggaaaagatgatgaacaggggctcatctagggtttaatcccaagggtctatggatgattgatacccttggtggatttgtatcattactacaaagctattgttaaatcaagtgtgttttgaagcttgatataaacaagagaaaaacaatagggcaaaaaatgaagaaaaaaatatatccgaaatgtgccatgtttgtgcttcttttgtgagaaaaaaaatgtaaatatgctggctatggtgctagcctatgtgctttttagcaaaaaggaatggaaatgagatgagcagcattgtgtcctg

SEQ ID NO: 5424 - DNA, 1182 bp, Oryza sativa
  Predicted polypeptide sequence is orthologous to G347
ggtcctcctcctcctcgtcctcgtcgtcgtcatctccaacgcgagctcgacgaagccaaggagaggaggagagagagagagggagagagggaggagggagaccgacgcgaaggcctccgcccccccgaatccggccaccgccattccgctagatcgttggcgcctcagcttcccttcctcccgcggtttcttttgttggagggatttctcgaggcatgcagagccagatcgtgtgccatgggtgcaggaacattctgctctacccgagaggggcaccgagcgtttgctgcgcggtgtgccatgccgtgtccagcacagcaccgtctccaggaatggatatagctcatcttatatgtggtggatgccgaactttattgatgtatactcgcaatgcgacatctgttagatgttcgtgctgcgatacagtcaatcttgtcagaccagtgagtagtatagctcacttgaactgtggccagtgccagacagtgttgatgtatccatacggagcaccttctgtcaagtgtgctatctgcaattttattacaaatactgggatgaatacaatgagacatttgccaccaaatggaacttcatatactgccccatcaacctctgctccaaccactcaatcacagaatgttactgttgttgttgaaaatcctatgacggtagatgcaaagggaaagttggtgagcaacgttgtagttggggttacaactggtggtaaaaagtaacatattggcacacagtgcaccttgttttatgttccatatatggagttggaaatactttgtattatacacaaatgtttgtgatcaattgctggaaggaaccctgaagagcataggggcactcgcaatgtgcacaattacaatcaagctaaaaaaacaaactgcaggtgtgaatactgagatactgtagtttgttacccctgattcttttgtatgtaatatgagagctctgttggattttattgtgtgatcaaatcatctccagatggcactagctgccttctcaatgaataataacagattgcgttcaacatagcgcatgttttgtatacaacctgaatgagctgattttgtaaaatgcatggttttactactatttctggaactagactgagcatgccatctcatcgttcatgtgttaaaatttatttgcatattgtttctgtaagcc

SEQ ID NO: 5425 - DNA, 1089 bp, Oryza sativa
  Predicted polypeptide sequence is orthologous to G347
gctcctccccaaccccaccctcctcgcgattcctcctcctcgtcgtcgtcgccggcgagaggagccgccgccctgttgctggtgctcggtcgatcgccgcgcagttggtgcgcttcccttccctggagccaccaccaccaccactcactgcaggcgaggggtgggtggtctacgctgcggtggtctcgtctccttcctgctgctgctgctgctgcgccgggtatgcagagccagatcgtgtgccatggctgccggagcgtgctgcggtacccgagcggggcgcccagcgtgtgctgcgcgctctgccaggccatcaccaccgtgccgccccctgccccagtaatggaaatggctcatctaatatgtggtggttgccgaacattgctgatgtatactcgcaatgcggacactgtgagatgttcatgttgcagtacagtcaatcttgttagaccagtgaataatatagcacatgtgagctgtggccagtgccggacgactttgatgtatccatatggcgcaccttctgtcaaatgtgccatatgccattatatcacaaacaccggaatgaatactgtggcacccacgccatctccaatgcctacatcaagtggatcttcatataatgcccccccaagtggatcttcatataatgcccccccaccaacttcagctcccacatctcgaccccagaatgtaaccgttgttgtcgagaaccctatgactgttgatgaaaagggtaaactggttagcaatgttgtagttggagttacaactgggaaatagcagcgtattgtctgtaccttgttacatccttgatttgtaccactaaatacgtgaagatgggaataccatgtattacactggtgtttggttgaccattgaagaacaaaaatacaaatgttttttggaatcttgcaaaggaaagtatgaacgcctaaagttgtattttgtatctgttgattcttttctttgtatatgagctctattagactatattgtgatagaagaatgatggaatgacaaagcagtgtcacgtagttatacgtaccgtgcaacatgattgattttttagtttgtatttctcttgcc

SEQ ID NO: 5426 - DNA, 811 bp, Oryza sativa
  Predicted polypeptide sequence is orthologous to G351, G545
ttggccatatatatgttcgatcactcccacacaattctccaaaccaagagcacataacgtatccagggcagagcagcatatcgatcttagaattagctttcagttcacgcgcatcatacaaaaatggtgaccaacatgacccacgatgactacgtctccctctgcctcatggcgctcgcccaggcgggcgtcgggggtcagtggccggcgcagaaacagcagatcgacatggcaccgccggcaccggaacgcgagcttcttcggttccggtgctccgtctgcggcaaggccttcccgtcgcaccaagcgctcggcgggcacaaggccagccaccgcaagccgccgacggccgcgttgcccatgcacgtaatcgacgcgccgccgccgccgtcggccgaggacacagcctcgtcgtcgacgacgacaacaacgtcgggcggcggcaggcacaggtgctcggtttgccaccgtaccttcgcgacggggcaggcgctcggagggcacaagaggtgccattactgggacgggctgtcggtggtgtcggtcacggcttcggcgtcaggttccgggtcgtcgagcgtgaggaactttgacctcaacctgaaaccggtgccggagacggtggccgctggcgtcagaaggtggggagaggaggaggaggtgcagagccctttgccgttcaagaagcgccggctgtcaagcccatcattggagcttaatttatagtagcatcttaattcatcctaattccttactgtccagaaattcattcgtttacttttttttcttgttaaagctatcctttgtgatt

SEQ ID NO: 5427 - DNA, 1097 bp, Oryza sativa
  Predicted polypeptide sequence is orthologous to G351, G545
atcatccatccatctccctgcagctacgtactgtacttgttagcaatcaatcccatcaaatcatccaccgctcgctgctgctgctacgtactatacagcttgattaattaggttttacgacgacggcaacggggacagatatgacggccgccctgcaagcgctgctcgacccgacggcgctgtccttgggcctgcccacgccggcgatcaacaaggaggagtacctcgccatctgcctcgccgcgctcgcctgcacgcgggcggggaaggccctggtgggagtgggaggccagcagcaggtgcaggcctgcaataagtggctgtgcccagcgcccgcggcgcctgaggagctccgcttccggtgcaccgtctgcgggaaggccttcgcctcgtaccaggcgctcggcggacacaagtccagccaccggaagccgccttccccgggagaccactacggcgccgccgccgcggcgcagcagctggcatccgctggtgactcgaaggaggactcggcgtcgtcagcggccgggagcactggcccgcaccggtgcaccatctgcaggaggagcttcgcgacggggcaggcgctcggcggccacaagcgctgccactactgggacggcacgtcggtgtccgtctccgtctcggcgtccgcgtcggccgcctcgtcggccgtcaggaacttcgacctcaacctgatgccgctgccggagagcacagccgccgccgggatcaagaggtgggcggaggaggaggaggtgcagagtccactgccggtcaagaagctcaggatgtccaactaattcatcatacgccatcttgtaaaaacaagagatctgcccattgatcgactctattgaacagagtctattctttgattttttttttcttttcaactcactaattgtttggtttctgtcatcgagtatgcaacaagctaagctggtgaccatggatcttccaagattgattgtcgccaagggacatatatggttctaggagtgttgattcatttgattctttgtatatttgttcaatctaaaaattaatgtactcaatctgctcaatatatatagacgctatattattacgactcc

SEQ ID NO: 5428 - DNA, 712 bp, Oryza sativa
  Predicted polypeptide sequence is orthologous to G351, G545
gtcgatttcataccactatggggctaaacgagaagccattggtgcctccgttgtctccaacgccggtggacttccgagcccatcaggtgttcccatccaagcaccacgattttgacactagcaagagtcgtaacatctctggtagtgtcgccatcggcagtgattctgaggaggagtacttggcgacttctctcttgatgctcgcacatggcattcgggacgagaccaaggacatccgagggatgggagacgtaaaaggtgtgggtgttgacactttggagctggtgaaaccaagccaacgggcttatgagtgctcggtgtgtggcaaggtgtactggtgttaccaggcgttgggtgggcacatgacgtgccaccgcaacctatttgcacaagtggtggccggtgatgagttgtcctccgataggaccatggtggttaaggggcacaagtgctctatctgtcgccttgagttcccatctgggcaggcgctaggaggacacatgcgggtgcactatgtgggtggtgttgaaggaggctctgtcaaggagaagaacgttgtgaagaccaaggttacaggagcactgaagctagtgttgaaagactttgacctgaacgtgcctgttgtggcaacgatggtgggagacgaggctgagagctcacattcagaggccaaagcgcggatgatgacactcccctaaccagcgcaatactt

SEQ ID NO: 5429 - DNA, 894 bp, Oryza sativa
  Predicted polypeptide sequence is orthologous to G351, G545
aatcgcatgcaaacgtatcgccttcaattttcacgacacgagctgtgtgtgttggatagcgtgacgtgatggagcaaggcggcggcgccgccgacggcggcgacctcatctccctgtgcctcatggcgctcgccgccgcggcgcgcggggagagcaccgcgctggcgctggcgctggcgccgccgccgccggagctccacttccggtgctcgctctgcggcaaggcgttcgcgtcgtaccaggcgctcggcggacacaaggcgagccaccgcaagccatcggcggcggcggcggcgccgcccgcgcacagagacgtcgtcgttgctgctgctccggcatcatcaggccgcgtcgccgccgacgccgacgccgcctcggaggcggacgggcggcggcggcggcacgtctgctcgctgtgccggcgaggattcgccaccgggcaggcgctgggcgggcacaagaggttccactacttgcatggcccatcggtgtcggcgacggtctccagtgcagcgacggcggcgagcgtgggcgccgctttcgacctaaacgtggcgcccatcaaggaaatcgccggcgagcaacgacggtgcggcgaggaggccgacgacgacgatgaggcggagagcccttcaccggccaagaagccacgacgccggccaggatgagatcctccacgttagtatatatgaagtactaaccatccaattatatacatatagctcgttgagcatgtatgtatacaaccggtagagaaagcagaggctgctcacgtcgtcacgcgtgtgctccgatcgataactttagggtgtgcaattgtaaataaaaaaagggagattcggagggaaagacgtcctccagacagagattaaacacgggctcgatgttaaaatt

SEQ ID NO: 5430 - DNA, 883 bp, Oryza sativa
  Predicted polypeptide sequence is orthologous to G353, G354, G2839
gctcgtcattaagagcgaaagaaagttacttggaattctttggtttgttgtaatgacaatcacgagagaagaagcggagagcaaggagatggagagcctacgggtgcacgccagcgcgctgctctcgctgtcgtcgcctgcagcgtcggcgtcgcagccgacgtcgtcgtcgtcgacgacggagggggtgttcgagtgcaagacgtgcagcaagcggttcccgtcgttccaggcgctgggcgggcaccggacgagccacacgcggctgcaggcgaagctgctgagcgaccccgccgcggcggcggcggcggcggccgagagggacagggcacgcgtccacgagtgcgccgtgtgcggggtcgagttctccatggggcaggcgctcggcggccacatgcgccggcacaggggcgagacgggcacgacgaccgtcgtgctcgcggacgccgacgactcgggcggcgccaccgtgccgcagccgccggagcccatgccggacctgaactacccgccgctggaggacgccggcgacggctcggagcctgagttacttaaccttcttgtataagttgcatcgatagatatacatgtgaattgaattggcgtctgtacatagatatggtggatggattctttaccaaatttgatcgaaaaaaagaactaaattttggagcgtgatgatcatagcatgtaagttgtaacaaatgattgttaactgtaagataggaattctattcatttgttctcttctgtacaaaattacaaataggttgattaattagttggtcggttgtggttgattctttgtaaaataccaatttactagtataaatatactgacagcttattgtttcaaaaaaaaaaaaaaaaaaaaaaaaaaaaa

SEQ ID NO: 5431 - DNA, 737 bp, Oryza sativa
  Predicted polypeptide sequence is orthologous to G353, G354, G2839
gacaaagctgggtaccgggccccccctcgagtttttttttcctttttattttttttttttttttctgtaacaggtggtatggcctttaattatgtgtatgtacacaaaacaaactacgcttccatcatgtgagtaaaatctctgttatctaaattattctggcatgtacatgtgtggtacatatataaatcaatatttgaaaacagggaacaatggacgtaaaacacagccgattcgatcgaacagtctgacacaaataaaattcgattggaaaattgactaatgaatgaatgaatgaattagtatatccagcgtaaagcaattcctacaatggtaaaatctctatctgaaaaaaaaaaaataatgaatgcaatagccacaatcgtgcaccaatatgtacaggcagcaatcgcacgaatctaaacgaaaagctcgagcaaaacgggcggcgcgtgcaccgccgcggcggcggcggcggcctcctcgcggtggcggcgcatgtggccgccgagcgcctggcccatctcaaagccttggccgcaaatgtggcactcgtgggtcgccgccgccgccggcttctcctgcaccttcttggtggtctccttggccgtggcggcggcaaggccaagcgcgagcccgtggcggccgcgcaggtggctggtccggtggccgcccagcgcctggaacaacgggaacgcgcggctgcacgtcttgcaaacaaagtccccactcccgga

SEQ ID NO: 5432 - DNA, 761 bp, Oryza sativa
  Predicted polypeptide sequence is orthologous to G353, G354, G2839
cagatttcgatcggcgacgttagtgatcagctgggttaattaattacgtggctaattaagctagctatagccatgagcaagaggagcaggaccatgtgggacatgcaggagttcgtcggcagcgtggacacggcccgcgtgctgatgctcctcgcgcagcagagccagcacggcctgctgggcggcggcggcttcgccgccggcgcgcagccggtggtggtgcgcggcggcgcgcacgaccgcgtgttcgagtgcaagacgtgcaaccggcagttcccaacgttccaggcgctcgggggccaccgcgccagccacaagcggccgaggcagcagcagcagcacgcgctcggcggcggcgccggcgccgacgacgtggggctatgcctcgggaggcagccgacgccgccgcggccgcagccggcgaagccgagggtgcacgagtgccccgtctgcgggctcgagttccccatcgggcaggcgctcggcgggcacatgcgtcggcaccgcgcggaggccgaggcggcggcgacaacgacgacgacgacgacgaagaacggcgacgtaggcaaggcggcggccgtgaaggcctgcgacggcggcggtgtctgcctggacttgaacctgacgccgtcggagaaccgcgcaaagtgccggaacgtggtgggtctcggcgccggcgggcagggcgtacacaaggcgctcgccatgttggattgtttcctttgagccgttcaaactgcacatattattgcatgatagct

SEQ ID NO: 5433 - DNA, 382 bp, Oryza sativa
  Predicted polypeptide sequence is orthologous to G353, G354, G2839
acgtcgatggcactgacgtcgtcgtcgacgccggcgggcagcagggcgctggcggcggagggggtgttcgagtgcaagacgtgcaacaagtcgttcccgtcgctccaggggctgggcgggcaccggacaagccacacgcggctgcaggcgaagctgctgagcgaccccgccgccgcagcggccgagagggacagggcacgcatccacgagtgcgccgcgtgcgcggggtcgagttctccatggggcaggcgctcggcggccacatgcgccggcacaggggcgagacgggcacgacgaccgtcgtgctcacggccgccgacgtcgacgactcgggcggcgccaccgtgccgcagccgccggaggccatgctggacctgaacta

SEQ ID NO: 5434 - DNA, 932 bp, Oryza sativa
  Predicted polypeptide sequence is orthologous to G353, G354, G2839
attcaaccacgctttcagccttccaagctctacggctcattatttttccatctccctccttaatttagccaagctctacactgctcgatcaatggcttacgggaagaggcctcggcagcaagccgaggaggcggcgttcagcctgttcgacagcagcgacatggcgcgcatcatgctgctcttctccggcgcccacggcggcggcggtggcgcggcggcggcgtcgccgccggagcggatgttcgagtgcaagacatgcaaccggcagttcccgtccttccaggcgctcggcggccaccgggccagccacaagaagccccgcctggcggacggcgacccggccgccgaggcgccggccaagcccaaggtgcacgggtgctccatctgcgggctcgagttcgccgtcggccaggcgctcggagggcacatgcggcgccaccgcgccgtcatggcggacggcctcgggcttggcctcagcctcggcctcggcatcggcgtcgtcgggcagagcgacgacgacggcggcaagaagaaggccgcggccgccgccgccgccgccgagctggtgttcgacctgaacgcgccggcgatagaggaggagccggatcgcgccaggccggcggggctcgccgtagagttccccgtggtggttgacttcccgtgctgacattgacacagagatttacttctccatacaagttttgaaaattaatttacagtttacatttatacgctacccgagaagtcaaccctggagacattagctagagagattccgtcatacatattttttccctggaaatgtattcggatgattataatgttttcagggcctatatattgtattggttgacttatcgtggtacttatagtcggttgtccttttccctttcggtgctacatattttattctacctgtagtggttgttttc

SEQ ID NO: 5435 - DNA, 884 bp, Oryza sativa
  Predicted polypeptide sequence is orthologous to G353, G354, G2839
attggagagtcatacatctcaagcttgcttcagatttcgatcagcttcagtcttcagacaacagagaggttggttcacaaagtttctgtaagtaaagcattcattcagatcatgaagaggtttgcattcgaggacagcgatatggcgcgcgtgctgatgctcatgtcgtcgcacgggcagcaggagcaggcgctggctctgccggtgccggtgcagctgccgctcgccgccgcgcgcggcgaccgcgccccggagcgcgcgttcgtctgcaagacgtgcaaccgcgtgttcccgtcgttccaggcgctcggcggccaccgtgccagccacaagaagccgaggctcgacggcgacggcgacctctccctgtccaagcccaagctccacggctgctccatctgcggcctcgagttcgccattggccaggctctcggcggccacatgaggcgccaccgcgccatgaccggcggcatgccgcgggcgatcgtcgtcgacaagaagcccgacgtcgtcgacgtccacgtccacggccacgacgacgacggcggcatcaagcgcggcggcctgtggctcgacctgaaccatccaccctgcgacgacgccggcgacgacgacgccgagtgcggccacaatgccgccggcgccggcatcacgttccaccagttcttggataccggagccatggccgttgactgcgtcggctactagctctctttgccggatttttgccggatactacaatacttatatgcaccgattaatcttggtgcaatttctcttttaccttttctttttcttttcatttcttcttcttcttgttgagaaatccacattttgtagcggtagaatatattagttcctaatacaacagagcatggcacacg

SEQ ID NO: 5436 - DNA, 845 bp, Oryza sativa
  Predicted polypeptide sequence is orthologous to G353, G354, G2839
atttcggtagctggtttgctattaacactttaattttgcatgcagcaattaaggtgttaattaatatatataattaagctttaagctcattagtttaccgacgatggaagtggccaccaatacggcgacacgatcgccggtgaagctaatgctggtgctgacactgtcgccggcgagcaaggtgatcgccaagggcggcggcggcgtgaagcgggtgcacctcgacggcggcgcgttccagtgccggacatgcgggcggcggttctccacgttccaggctctcggcggccaccggaccagccacaagcggccgcgggtgcgcgccgacggccttgacctcctcctcggcgcgcgccccggcaagctcggcgccggcggcgcctcgacgccggtagtgcaccggtgcgacatgtgcggcaaggtgttcgccaccggccaggcgctcggcggccacatgcgccgccaccggccgctggtgagtcgtaatggcacaatgtccacgacgtggacggcggcggcggcggcggcggcgacaatgtccggctcctcgtcggaagagcgtgacgacgacgacgacgacgacgtgcacaattataatttcatccactttttgtgagtggctaatggacaaatcaatatatgaattgaataaaaccagtgattaatgtcaataataattaagtttgttctggagtggtatacaaacacgcaacatgcttatagctagatatatatacacgtatacgccacaagatacaataccaattaagttcgtctttgattttgtaatgttcaattatattttttcaatgattaaatacacgtgattttaattgtattcgttc

SEQ ID NO: 5437 - DNA, 1013 bp, Oryza sativa
  Predicted polypeptide sequence is orthologous to G353, G354, G2839
gggagcgcaggtacggtcggaattccgggtcaccacgcgtcggtcggactcgtcggcggcggcggcgggcggcgcggcgaggaggaagagggcgcggcggaggagcgtggtggcgacgtcgggggaaggggagttcgtgtgcaagacttgcagccgcgcgttcccgaccttccaggcgctcgggggccaccggaccagccacctccgcggccggagcaacgggctcgacctcggcgccatcggcgacaaggcgatcaggctgcacagggcggccgacaaggagcacagggacaagcacgagtgccacatctgcggcctcggcttcgagatgggccaggcgctcggcggacacatgcggcgccaccgcgaggagatggccgccgccggcggtggatcctccgccgacgactgggtctggcgctgcgacgcgcggccggaggggatcgccgccgagccaccggtgttgctggagttgttcgcctagttaccgctggtctccattagtttcgtccaagttttgaactgacgcagtgtgtgtcaccattaattagttcatgtcacatgtctagaaaaaaaaaagccaggttcatcgatcttgtaactatgataggggtttaattttttttttcattaggcaaaaaaaaaaaacaaaagggagggcgtcgggaacctctagaggatcaaggtttagtacgcgttgatgcgaggtctagccttctatagtgtccccaattcatcctggggcggcgttaacgcgctggaggacacctgggttccctaatgctgggaatcccttgcggggtattaaggcgcgaggcctcaaagggggacgagagaagcccctggacagcgggggttcacacgaaagacagccagattctcacggcgacaggtgtgtgctcttgtcctcgtattcttctctgtggtgtcgtatagatcgtggaggcgacatcacaagacagttggggaagcagacgagagcacgggatactagccagcccagacgcctcgct

SEQ ID NO: 5438 - DNA, 420 bp, Oryza sativa
  Predicted polypeptide sequence is orthologous to G353, G354, G2839
cggcggccaccggaccagtcacctccggcccactaccaacaagcggcggcccggcccgtccaagcctctaatccacgcgtgcgaggtgtgtgggttgggctttcagatgggccaggccctaggtggccacatgaggaggcatcggcctagaaatattgatctgggccataagcagatcgtcatgccagaaattcggcccagttcctccctgcagctgcttgatctcttcgtttagatacactcaatatacagtggtttatgtgctgtgtgctatagtaccgtactgtcttgcagtatactacagcgaaaaaaaacttacagccatttagtacaaaaaatatttaggaatcaataaaacagatacaatgtttagcctatgacaatgtggatgcactacttaataaactttttttttctacc

SEQ ID NO: 5439 - DNA, 1907 bp, Oryza sativa
  Predicted polypeptide sequence is orthologous to G361, G362, G370, G1995, G2826, G2838
ctgccagtgctttctgctctttctattccctccctcccttctcccttcatagttccaccctccttccattcctctctgctggtcagggacgagagaaacgtaaacccagccgtgacattatattgcctagctagttgattaatttgttgcaagaactggctagctagctcgagaaattctgtgtacctggccgggtgcatgggcagcggcggcgaaggaggtggtggagcagcgagcgtacgggatcagccgccgcatgacttcgccaacgtcgcgtccttctccgagttgccgttcctgcggccggctccggcgcccagggagagccccaacaactccgccatccgcctcttcggcatcgacgtcccgcacgcgtcgtcgtcgcctgacggcaaagcctccaaggaatccgtcgtcgtctccaccgccgccgccgcggcgtccacgcatggcgctgccgctgccgccattgccgcggccgccgacagcagccgcaagttcgagtgccactactgctgcaggcacttcccgacgtcgcaggcgctcgggggccaccagaacgcgcacaagcgggagcggcagcacgcgaagcgggtgcagatgcagaccgcgatggccgctgccgccgcggcggccagcggcgcgcaccaccaccaccaccaccaccagctgctcggctacccgcagcatcatcaccgcttcggcttggcaggccccacggtggcggcattgtatcaacacccgtcgtggccgacgatgagcggcggcggcggcggtatctcctcaattggccctcagttctatagcgggatcggatcggtcacccagccgatcaacgggagcccgctgccggcggggctctggaggccgggcccgatggcggcgccgccgctgctggccggagagcggcggccggtcgcggtgtcgacgtcgtccgtgttccgaggagacgagccaagagcttcagcttctcttgtggcgtcccagacagcttcttcctctttgctgctgtctccgcaaggtcagttcgcttgtgagcagccgccggcgaccaccgcagctgagggcgtgagcttagatttgcacctataattgttcttttttcttctgttggttttagcggattactacgtacaataactgatttctcgctaccttttcttccttgcctgggaatgagattgccctttactaaattcagatgaatcgtgcgccttttttttttctcctgacacgtgcaaaagaattccatttgccaaactttgatccttttgttaatgtgcatatatacacatgacaaaataatttgggtacattgttagggtttgaattatcataaattacgtccaatacaaaacgcctatgcatttgaaaatgtttactaagtagttagttgaggaacagtcaggtttcatgctgtttctagacaataaatgtgcatattaattcctacgatgaaagagaacagaaattacaactgcatgcattaaccaatttcaatttcggattgcaaaagcaccagggacaataaaagagtaagattttaactgatcatatttttcacggaatcggtcacatataagtaagctgaaagtgcacaatactttttcaacaattgaaaaaaaaaatcataatgcatatacttttcatgcggcccagtaaactgctgcagcttgcagggccggcctgtacgtatgcacacgctaaaaaacatgaaggatatagacactaaaattctttctgaagcgggtgcagagttttttgttttttttaatcctctgtacgtgcgtacctatgggcaacagttctagcaactgctgctgcttgtatgcaatgaggctgtagctttatgtgtagctttcgcatgtcgctagggtcaggtatatgcacaactgcagatgcatgat

SEQ ID NO: 5440 - DNA, 1234 bp, Oryza sativa
  Predicted polypeptide sequence is orthologous to G361, G362, G370, G1995, G2826, G2838
gcttcttgcatggtccccctcttcgtccccctctcctccgccccagcttacaactcccatatccccttaaaaccacaccaactcgtagccaatttcttcagcgcggagacgcaagatatagcagcagctagcaagaattgccccgagttgggtggttaattcttggttttggttcacgtagaagcagatagcttggttggttggttagacggccatggcgaagccgcaggacatgcgcagcgtcgactcgttctcgcagctgccgttcatccggccggcgccgccgccgcagcagcaggcgcgggacacaatccggctgttcggctgcgaattctccaacgacctgcagctgcggcccacggaggccggtgcaggctcccccgacgcggccaacggcagcacggtcacgtcagagggcagcaacggcggcgacggcggcaccaagaacggcggcgccgcgacggcggcggcggagcgcaagttcgagtgccactactgctgccgcaacttcccgacgtcgcaggcgctgggcggccaccagaacgcgcacaagagggagcggcagcacgccaagcgagctcacctccaggcctccctcgccatgcaccgctacatgccggggcacatgtacggcctcttcaactaccaccaccacatcggcggccgcttcgaccaccacccgccgccgccgccgccgccgccaccgccggcgcactacccgatgtggacgagcgccgccccgggcgccttcgccgggccaggttccatggcgcagcccatcaacggtagccccgtgcaggccgggctgtggagcgtgccgccgccgacggagaatttcggcagcacggccggcaggcagggcgctgacaagctggctactacggtggcgggcacgccggcggcgggggaggtggcatgcaaggacgagatggtgccgatgagcttgctgtcctcgtcgccttcgttgtcgtcgtgctcgtcgacgtcgccggagatgctaggtaggtgtgaattggggcagaaggagggtgtcagcttggacctccatttgtaatccatgtctaattaggttttcttcttgtggattagcagtcgcaagaaagggtatgttaattctcatagcttaaataatctactctttttgccttgtccggatccaagtttagctagctacctagcttgtgttgccactttatttttaccaggcaaagaaaaagaaaatccttcgaattgc

SEQ ID NO: 5441 - DNA, 1236 bp, Oryza sativa
  Predicted polypeptide sequence is orthologous to G361, G362, G370, G1995, G2826, G2838
gcataaccaaaagaaagaaagaaaaatcttcaatagtggagagagagagagagagagagagagagcgcttctcctcctctcttctcttctcttctcccccttcgcttctctttccccccactcaatcaaaccctaaccctactgcgtacgccgcgccatcgacgacgacgcgctcgcgcgatgagcgttgagcgagatgggcgcgaccagcccaacatcgactcgttctcgcagctgccgttcatccgccaggcggcccgcgagaagccgccgtcgtcgtcgtccggcggctccgtcgtcgtccctcctgcgcccatccggctgttcggcttcgacgtgccgccggacgcgtccaccaccgccgatgtgctaggagagaacaaggagagcgccgccgccgtcgtcgccgctgaggggagtaaacaaacggcgtccggtctggacgcaatcggcggcggcggcgggagccggaagttcgagtgccactactgctgccggaacttcccgacgtcgcaggcgctgggcgggcaccagaacgcgcacaagcgggagcggcagcgcgcgaagcacgcgcagttccagacggccatggccatgcaccacggccacggtcagtactacccgctcccggacccctacgcggcggcgttcgcggcgtaccccggccaccaccaccaccaccgcttcgccgccaccgccgccgccgccatgcctccgccgccgcactacccgtcgtgggctgcaggctccaggtactacagcggtccaggatccatctcgcagccgatcaacgggagcccggtggcgccggccgggatgtggcggctccctgccgccgccagctgcgtcggcttggcgacgacgacgactacggcggcgccgctgcccgcgcggcgccaagagcggccggcggcgacaattccttcgctgctcggaggcggcgaggagcccgtggtgctgggaggagctggctccacctcgttctcgccgtcgacgtcctcctcctcgtcgtcggcgtcgccgcacgagcggcgcgcgcagccagcgcgtaaagagaatgtgagtttggatctgagcttgtagcagcggaggaatgatggccggtgtcagcctcataattgtttcttaattacaaaacaaaatcaagtgccttttcatttcacgtttggatttattttcagctcgttgagctaataccaatggtactagagatcagctactaattaagatagtagt

SEQ ID NO: 5442 - DNA, 804 bp, Oryza sativa
  Predicted polypeptide sequence is orthologous to G361, G362, G370, G1995, G2826, G2838
atgagcatgacgagccccaggctaaagctcttcggcttcgacgtctccgaggaggagacggcggagcacgaggagcagtactcggctgagccggagagcgcgccggtctgcgggggcaacggtggcggcggaggcggcggctcggactcgtcctcgtcgtctactacgaccaccacgacggccacggccggcggcgacgggcggaggtacgagtgccagtactgctgccgcgagttcgccaactcgcaggcgctcggcggccaccagaacgcgcacaagaaggagcggcagcagctcaagcgggcgcagctgcaggcggcggccgcggccgccggccgtgtcgcgggcggcgccgccgcgctctacccgcgcgccaacccgatggtctccgccttcgctccgaccccccacctcctcggcggcggcgaggcggggcccaccagctgggtctacttctccccgcgcgccgccgcggtggccggcggggcgcaaggccagcagttccacgtgtcccacggctgcgtcttccccgcccgcggcgccggccctgccgccgtcgccgccgcctcgccggctgtgttctcgtacactccggcgacgtctgccgccgccgtcgccgcggcctcggcaccctacgtgacgacggacgagcaccacgggcggaggatccacgcgagctcggcggccagccttgcgagatatcccggtccggcgatggtggtggcggagccggtggccaccgtgccggaggacacctgcctggggcttgacctccagctcagccttgcgcccgccggcttgtga

SEQ ID NO: 5443 - DNA, 1364 bp, Oryza sativa
  Predicted polypeptide sequence is orthologous to G361, G362, G370, G1995, G2826, G2838
gacacatggccatcagatcaccttgaacctacctagctagcgagctaatctcctgtagttcagtagctatctagctagcttgccctagctaccttgccggcgagctaggcggtggccggctggccggcgatgagcgagcacgacgcgaaacacgtcggagacgtgccggcggccgcgggcatcgagtcgttctcgcagctgccgttcgtgcgcccgaggccggcggcgatggccggctccagccccgcgtcgtccatccggctgttcgggttcgagctcccgcccgacggcgtcgtctccgccgccggattaggaggcggcggcggcggcggcgggcgcaagttcgagtgccactactgctgccgaaacttcccgacgtcgcaggcgctgggcgggcaccagaacgcgcacaagcgggagcggcagcacgcgaagcgcgcgcagttccagagcgccatggccatgcacgcgcactacccggcctaccctgcctacgccagctactacggctcgcaccgcttcggcccctagccgccgcacatggcgccgccgccgccgccgccgtacccctcgtggtccaaccaccaccacctcccgcccggcggtcccgcgcccatggtggcggcgaggtactacggcccggcgccgccaggctccgtctcgcacccgatcaacggcagcccggtggtgccggccgccgctgcgctgtggcgtgtccccgccgccgccatcgccgtggcggcggccgccgcgccgctggcgcgccaagaacggcagccgccgctgtcgctggccggtggacgcgaggaggaggacgcaatggtggaggtaaggagagggaacggggtaggcggcgccgccgccgcggtggtgcaactgcaacccggctcgcggctgtcgcggtcgtcgtcctcgtcgtcgtcggcgtcgtcgtcttcgcagcatcaccacgagcgccgccgcctgggagacctggcagagattaaccgggagaatgtgagcttggatctcaccttgtaattctccatgagaattgagagatgcgtgcgcgattaattagcgggttcttgccttcttggtaagtgcgaattaagagaaaaaaataattctttttctttagttcgtgaattcgtttagctagagatgctcacaagagagggattttctttttcttcagtgccttttttgcagtcctttttcgccgctgcactcattcaatattccaacctcgttctgtaacttgtaacttctgttcatcacattagatttctttgttagaaatagagataaattcaaggacaagacgtatggagcatgaaagattgtggtctcataattaattactatctccctaattttctact

SEQ ID NO: 5444 - DNA, 944 bp, Oryza sativa
  Predicted polypeptide sequence is orthologous to G361, G362, G370, G1995, G2826, G2838
ggggaattcggcattatggccgggggctcatcatcatttctcatcactgagctgagctcagttcagtcagttcatggaagtatatctccttcttggcttcatttgacaacttccaacacaagcagaacaaggtgatcaaatcatcctcaaggcttgtcttttttttccttctctggttatctccaatggaggctcccccttctctttccatcgtcgacgaagacggcttcgtcatcgacctctcgctgacgctgggcctgacatcgcctccgccctctccaggcggcgcgtctccttccattcctccgggaagaggcggcggcggcggcacgagtggtggtgacaacaacagaggcagcagaggtggtggcaatggtggtggtggtggtggtgtgaggctcttcccttgcctcttctgcaacaagaagtttctcaagtcgcaggcgctagggggacaccagaatgcacacacgaaggagaggagcgtcgggtggaacgcccacctctaactcccggccggcgtcgtcgccgacgacacgacgacgacgaagacggcgaaggccgacctgacatggccggatgcccacacaaaaatgtctccaaggggtgacccctcgcggctcccaatggccaatgcacagcagcagactcgcacgtaggagccagccattaacgaaaccatgcatcgcgactacagcgcggacacaccgcgggggcaaccgcaggcgccgcagccccgcgccgacacgacaacctccaatagccgacgcgggcgcacaccccggcagcgagcgcctcagctacgacacgtagacgccaacgcacgcagaggcgctgcggcgcgacagccgagccgaacagaccaagcagcagacgccactgacgcacgcagccgaccacaccgactcaacaccagtacaaacggaagtaaatgtgcagaagga

SEQ ID NO: 5445 - DNA, 650 bp, Oryza sativa
  Predicted polypeptide sequence is orthologous to G361, G362, G370, G1995, G2826, G2838
agttcttgaagtcgcaggcgctgggcgggcaccagaacgcgcacaagaaggagcggagcatcgggtggaatccctacttctacatgccgccgacgccgcaccccgccggcaatgccgccgccgccgccgcggcggcgacgcccggtgggatgtcgtccgtcacgacgccatccgggagctacggcgtcgtcggtggtgccgccgtcggggctactgctggcgttgggggcggaggtggagtgggaggggggcttctcccggcgcacgcgtacgccgggcacgggtacgccgcggtgccgacgtcgttccccatcgcgtcgcacagctcgagcgtggttggctccggtgggctgcagtactacgctggtaccgccgccgccgccgcgcaatccaagaaggcaaggtcaatcaatcgccatgttcttcttctccaagctccacctactcctcttccaattcctcctcgtgtgtgattaatccccctcttcttgctgcctgcgtacgtactccttaattaattagctcttagggacgttaattaatctcagttcttggctctcttctcctctcctctcctctcctctcatctcacttgtatgttaatgttagtactccttgtaatcgatcaatcagtcctctttttttgcatc

SEQ ID NO: 5446 - DNA, 1270 bp, Oryza sativa
  Predicted polypeptide sequence is orthologous to G363
gagtttgtcatgatcaccaccacactgacaagaagaatatagcatgttattctactcattctccacttgtgagttctgacttatctgcacattggtgagacagtcaatgagtgcagatgagactgcagagattaaccctgtcttgtccagagaataatctttgatttcagagcatcttgccactcaaatatctcgcatacatacataagattcgctcgcatgatctgagctgttttgtctgaatttctgaatgcagctgaggcagaaatcggtgagagtggtaggtgtttgttgcgatcgttgaagcatgaagagcagcagccaagaagcgggagaggaggtgtccgagatcagcagccaggcggcgtccaacaacaacgagacgtgcaactcctcctccggtaaggtcagcctcgacctgtcgctcaccgtcgccgccgccgccgcggcggctgcctccgccaccgagtcgagcaccacggacagcggcggcacgcggccggcggcgacggcgacggcgacggcgcgcgagccggcgcgggtgttcacgtgcaactactgccagaggaagttcttcagctcgcaggcgctgggcgggcaccagaacgcgcaccggcgggagcgcacgctggcccggcgcgccgtgcggctcgacgcgttcccctacggctacgccgacgtggcctcgctgccgctgtacggcgccggcctgtaccccatcggcatccaggcgcacgcgtcggtgcaccaccaccaccctggcgtggcggcgccggcggggcgcgccgagttgaggtcggcgcgcgcgctgctcggcccgatgccgttcttcgtgcaggcggcaggcgatgaggatgccagcttcgggtggccgggcagcttcaggccaccgcccaccgccgccaccaccatccccgccgccgccgccgccccggtcgccgtcaactccggctcctccaactccaaccacggcggcagcgtcgtcgtgcaggccgccgccgacgagcccgacctcacacttagactctagctgtcccatccatccatccattagtctggtgtaacattcatcaggttgctcctgatcatctcctccgtttgtgagtagaattcttgcttgcttgcttgcttcgctctcgatcctgctgcttgagcttgacatcaaccaacctgctagtaaattactattgcttcaaatgcatgcgtggaagtattgtttttgtaaatacagcttagcctatcctaatatgattgtacttgtgccctaagc

SEQ ID NO: 5447 - DNA, 692 bp, Oryza sativa
  misc_feature (125)..(125): n is a, c, g, or t
  misc_feature (286)..(286): n is a, c, g, or t
  Predicted polypeptide sequence is orthologous to G370
tttgaggccttgagtgtgaatgatgagatccaaaggtggctgtccaatattgaacagatgaagagaacccgcagcgtctgagaacgcagaacaacggccggtagtcatacccagttgccacatgnacatgaagattctgctacggtcggcaatgaagagtgccctggtcagaaaaccacgctggttctcgagcaaggtcaggtggagatgatgatatccttgatgatctcgatggagatgatgatttggcaagaagggaggaagcagttgcccaagaagggccctnaaaagcacggatgccgaagaaagatggacctgtgatgcagctgtgttgaaatgaccgtgtctggccagttgcctcgtgggaatgcatgaacgatggtttggctggtgtgtgcatgagtggcccgaaccgatgatgctgtgatgtgcatgccccgtgagaaggattgtgcaccatgtgcgccagggatttggatgcgcttggtttgatgtgtggcatacgatgctgatgcatgaccttgtgctgtgcaccagtttgttcggttggatgttgaagttggcttgcaccccttgcaccatgcctgctgggttgcatgattgcatctgcattggatggctaattatctcttgatggaaaaacacgtccagtataatgaatgagcctcagctcctattcaaaaaaaaaaaaa

SEQ ID NO: 5448 - DNA, 711 bp, Oryza sativa
  misc_feature (38)..(38): n is a, c, g, or t
  misc_feature (89)..(89): n is a, c, g, or t
  misc_feature (159)..(159): n is a, c, g, or t
  misc_feature (255)..(255): n is a, c, g, or t
  misc_feature (659)..(659): n is a, c, g, or t
  misc_feature (689)..(689): n is a, c, g, or t
  Predicted polypeptide sequence is orthologous to G372
gatcttgatggttgtgactagagatggattcctccctntgacgttctcttataggaagaagtgtgaaccagagagagcaataccatatntgtgctatggcccacctgcatatattttgatgggattggaatgccatgggggctgacctggacctatgtngcattgacatgcgcactaggaaatggtggatattgtgcgatgataaatatgcacgccatataaatgatctgctggaccgtgtggaggagctgatanagagtggccataaaactgtgggctgggtgctaggttgtgcgagtgcatggggctgggcggatgctggagaccaaactgccctgaagaaaaggaacaatgccccgtgcctggaggaccctatgcccaggcatctgcctgctgccatgttgggatggcttgcaaccgttgccgatgctgtgcacgccacatggcctgacctgaccgttgatggattgtgtcccacctgctgacacctgatgtgctggtgctgaatgtgaatgcatgactgtgccacaatttggtttgctgttgctggtgttgctgcgtgccctgtgtgctgacgggcatgtggtgacctgaatatataaataaagcgaacttacccttgtgccgatgagcagtgagtacccatcaagttcattgcngtacttctttctgataatctaatactacangaattcaaaaaaaaaaaaaaaa

SEQ ID NO: 5449 - DNA, 1882 bp, Oryza sativa
  Predicted polypeptide sequence is orthologous to G374
gtttcccttctcccttcccctcccgccgcgaagccaccagcgccaccagcttccacgcctccactgccgccacgagagccgaaccacgcagacctaagccagagagatcgcgagagggagcctccgctccttcgcttagcggcggcggagaccatggcgagctccggggaggaagggcgggtggtggtggacctccgctcggcggcggagtcggcgggcggcggcggcggcgacgaggaggcccacgccgcgccgctccacgagatcgagtccctttgcatgcgctgcggcgacaacggcaccacgaggcttctgatgaccatgattccgcacttccgggaggtggttctgatggctttcgagtgcccgcattgcggtgagaggaacaatgaggttcagtttgctggacagctccagccgaagggatgttgttaccgtttggaggtcccgcgcgggcagaacgagatactgaaccgtcaggttgtgaaatctgattcagcaactattaagattccagaactggactttgagatccctccagaagctcaacgtggatcactttcaacagtggaagggattattatgcgagctgtggatgagctgcaggcacttcaagatgaaagaaagaaagtggatcctcaaaaggccgaagctattgataaatttttagcaaaattgagatctcttggattaggagaagctgctttcacctttgttcttgatgatcctgctggaaatagcttcattgaaaaccagaatgcaccttcatcagatcctttgttatctgtgagattctatgaaaggatgcgtgagcaacaggcagcacttggttttcttgttgaaccatccacagaagaacctggggatcagcctgttaatcatgcttcaactgtggaagggaactctgaggtgttgcaggagccccacggttcggttggagctgttgcaggtcgccgtgctatagctcaaggaaaccctgatgaagttgctgcagcgctgtgcagatattcagcaccagaagaggttgatactttgccatcaacatgtggggcctgtggaactgagtgtgtcactcgtttctttgctacaaaaatcccatattttcgtgaggttattgttatggcaacaacatgcgacatgtgcggctatcgcaactcagagttgaagcctggtggtgaaatcccagccaaaggaaagaaaattacactacgtgtgcagaacggaaaagatcttacacgtgatgtcataaagtcagattcagctggcgtaaaagtacctgaactcgagttggaactagcaagtggaacattgggtggtattgttacaacagttgaaggtttaattgtgaaaatatgcgaggctctgcagagagtgcatggattccatttgggtgatagcacactggaatggaaaaagaagaaatgggaggatttcaacgatagattatccaagcttctaagtttacaagagccttggactttaattatcgatgatggattggcagcttcatttgttgctccagctaccgattctttagaagatgacaaccagctaaccattgaggagtatgtgaggagctgggagcagaatgaggagcttggcttgaatgacatggacacatcgtctgctgacgccgcctacaacaccaccaacccataatgtactcaatgttgtaacatgtgatattatcaaatatacttattgtgctccatgttgtagtaagttgcgatatttctcattttaaatcctcaagttttgtgttagccatagcttttgtttctgagacgatcgaagatattcagttgaccaaatttgctttatcagaacgtttcttgtttctttgcttaattacattgaacgccaccggcattgtagtcgtgcc

SEQ ID NO: 5450 - DNA, 2010 bp, Oryza sativa
  Predicted polypeptide sequence is orthologous to G375
atggccggctcccctcatctggccggatttgggagggagggacggaggaaggggagcggtgccgccgactctcctcctagttgtcgtgcgccgccgtgcctctggtggccgccaccttcgccctcatgccgcctccactgctactgccgccgccggccggttcccctcttccggctggatctagaagggagggaggagagcgccgctggccaccgccctccccccttcctcctcgggccagatctgggagggagggaggggagccatagccaggagcagcagccgccaccgccactgccctcccccctccctccggccaccgcgccagggtgcgccaccactgccaccggtgggaggggagaggggaggagaggtgggaggggaggggagaggagagaagaggtgggaggggacttagaaaactttggctgcgagggaagaggggagagagacacgtgtaatgtgatggaccaaaaagtgtggtcctccactttccacacctgcaccgctgctgcagcacacaccgcagcaggagggtcgggtggctgcatgcacgcatacattgttcagtccacctgcagcagcagcagctggttggggggaggaagaagaaggagagtgttcgatcggcggcggcggcggctcaccggtccgacatgcgcaggggttcaccgtggtacgactactactactcctcgtcgtcgtcgtcgtcgtcgtccccggcgcggagcaagcgcgcgcaggcgcagctcgtcgtcgtcgtctccgccgccggcaagaagctaccctggccctcgccgcggcgtcgcgggagccatgtcgtcgccgttcctgggctcttcttcctcttccgcttcgtcgcccctctcttacctgaccccgcctaggcctcctcctcctcctcctccccttctcatggtacgtcacggattagctcgatggttgactgatcttgacgatgagctgatggtgttcgacgacgatcttggcgtgcaggggcagggatacgccgctgctgccaatggcggaattggcggcggcggcgtcgaggcggtgaacgcggcggcggcgccgaggcagggtggcaggcacgccgggcacccgccgctgccgaggccgccgccgaggcagtgcccgcggtgcggctcggcgaacaccaagttctgctactacaacaactacagccgcacgcagccgcggtacctctgcaaggcgtgccgccgccactggacggagggcggcacgctccgcgacgtccccgtcggcggcggccgcaagaacagcaagcgcgccgccggcggaggcaaggccggcgccacagcctcgacggcggcttctgcccatgtcgtcgcgccggcggcggcgccgccgacgtcgtcgtcgttccccgatctcctgaggcagatgctgatggcgccggctaccgccggtggcggaggcggctacagcatcgacctgaccgcgtggcagcaaatggcggcgttcgcggctccacctcaggccgccaccggcgatgtcggcggcgcggtcggagcggcgtcgacggcggcgccggacgcgaactgcggcggcggcggcgtgcagtactggaacgggtggctgcaagatgacatgcccggtctagatgtatatagctctgaaaatgagcaacgagacacgagagcagaagcaccggtagcagggaacccacaggcaagcagaacaactggcaaaaatcctctgcaccaacagaccaacaacactttggtttcagctgtacgggctcatgccgatggtggcttcccggcgggcgtaggagacccgcgacttggagaagtagaagtagtaggctccggtgagcacgcaggtgatcagggagaaggcggcgccggcgccgaacgtgccccgccgcaccgtctcgcagtccggcgggttctcgaagaagaccttgcggtagcgggtgtggtaggcggactgcaccagcccggccagcaggcacgactccgcgatgaggaatgtcaacctgagtag

SEQ ID NO: 5451 - DNA, 1134 bp, Oryza sativa
  Predicted polypeptide sequence is orthologous to G375
atcgtccccgaggagcacgggatggggtcgtcgtcgccgtcggcggagctgatcgcgtgcccgcgggcgccgatgcaggcggcggcggcggcggccgaccgccggcttcgcccccagcacgaccagccgctcaagtgcccgcggtgcgagtcgacgcacaccaagttctgctactacaacaactacagcctctcgcagccgcgctacttctgcaagacgtgccgccgctactggaccaagggcggctcgctccggaacgtccccgtcggcggcggctgccgcaagaacaagcgcgcgccgcccaagaaggccgccgcccacgcccagcccgcggtggcggtggcggcggcgctgcaaggccgccacatggagaccggactccacctgtccttctccgggatgcagcgtcatcttgcgccgccgccgccgccggcggccaccgcggccgacccgctctgcagccttggactatttgactggaagcagtacgaccccgtcttcgccggctccggtggcggcggctcccccgtggcggcgctggagagcgctggtggctcggaggcgcagttcatgggtgctggcatgatgggcattggcggcggcggcggcggcggcgtcgcggagtaccatgcgctgagcgcgctccggtacgcggcagggctcggcgatcacctggcgctgccgttcggcgcggggcgggcggagcacgacgccgtcgaggtgaagccggtggcggcggagaggctgctgtcgctcgagtggtgcggcgaggcgagccgcacggcggcgccggagagctccattagctcgctgggactgtggagcggcatgatcggcggcgggcaccatcaccatggctcctccgctgccatctgaggcgaagcaagctagcatgcatgcaatgcgaaggacacgtgatcgaacgccgcgagccgctgcaatctgtgcaagaaggaaaggattagcggtttgctaatagcattaacaaagtatgactacgtagaattgtttggctttaatttctttgctgctgttttccatcttctcatgcatggtaatctcctgcttattttcgtttgtctttgtatttcccaactattccaagtcctggtgatgttcaaaaaaaaaaaaaaa

SEQ ID NO: 5452 - DNA, 831 bp, Oryza sativa
  Predicted polypeptide sequence is orthologous to G375
atgcaggagcagcagccggagaccggccgccggccggcgcagcagttcgccaccgtcgacctgcgccgtcccaagggctacgcggcggctcccgcgacgccacagcctggttcggctgcgactgctgctgccgccgctggcccggctgcgacggcggcagcggcggcggcgggggagggtgacccgtgcccgcggtgcgagtcgcgggacaccaaattctgctactacaacaactacaacacctcccagccccggcacttctgcaagtgttgccgccgctactggaccaagggtggcacgctccgcaacgtccccgtcggcggcggcacgcgcaagaagtcctcgtcttcgtcgtcgtcgtcttcctcgtcatccgccgccgccgcagcacccgccgccaagcgccagaagacgtcgaagaagcgccgcgtcacgactcccgagcccctcgccgccaccacccccgtcctcaccgaagccgccgctgactccgccgccaagacgacgaccgaagctacgtcggagaagaagacgacgacttccacaacgacgacgacaccgccggcgcctgacaccacgagcgagatcaccacggagctcgtcgtcccggccgtggaggaggactcgttcacggacctcctgcagccggactccgccgccgtcaccctcggcctcgacttctccgactacccgtccatcaccaagagtctggccgacccggacctgcacttcgagtggccgccgccggcgttcgacatggcgtcctactggccggccggcgccgggttcgccgacccggacccgaccgccgtgttcctcaacctcccatga

SEQ ID NO: 5453 - DNA, 900 bp, Oryza sativa
  Predicted polypeptide sequence is orthologous to G375
atggactccgactggctcaagggcatcgtccccgaggagcacgggatggggtcgtcgtcgccgtcggcggagctgatcgcgtgcccgcgggcgccgatgcaggcggcggcggcggcggccgaccgccggcttcgcccccagcacgaccagccgctcaagtgcccgcggtgcgagtcgacgcacaccaagttctgctactacaataactacagcctctcgcagccgcgctacttctgcaagacgtgccgccgctactggaccaagggcggctcgctccggaacgtccccgtcggcggcggctgccgcaagaacaagcgcgcgccgcccaagaaggccgccgcccacgcccagcccgcggtggcggtggcggcggcgctgcaaggccgccacatggagaccggactccacctgtccttctccgggatgcagcatcatcttgcgccgccgccgccggcggcggccaccgcggccgacccgctctgcagccttggactatttgactggaagcagtacgaccccgtcttcgccggctccggtggcggcggctcccccgtggcggcgctggagagcgctggtggctcggaggcgcagttcatgggtgctggcatgatgggcattggcggcggcggcgtcgcggagtaccatgcgctgagcgcgctccggttcgcggcagggctcggcgatcacctggcgctgccgttcggcgcggtgcgggcggagcacgacgccgtcgaggtgaagccggtggcggcggagaggctgctgtcgctcgagtggtgcggcgaggcgagccgcacggcggcgccggagagctccattagctcgctgggcgggctgggactgtggagcggcatgatcggcggcgggcaccatcaccatggctcctccgctgccatctga

SEQ ID NO: 5454 - DNA, 2166 bp, Oryza sativa
  Predicted polypeptide sequence is orthologous to G378
tattggctttcctcgcatcaggcatatgcagatgcagtgatactggtgttctaaacttcgaagtagactctggactgggacagctcaatgcaaaaactgtgtcagctactcagctctttgataattatccaattataatcaagctgtaatgacccagaagagcagaaatgatttaagccagtctaccaagtatatccaggagattgatatgcgatggtgtccaaggggcgatatatatttatatattatatattatacatcagatgatcagcacaagccagttcagagttttgagaggtatgttacataaggagaaaggagtgagtagatagaaatatagatatatatgtagatagttcaaccaaaaagatagagcatgtagcaatataagcagaaacaaaatgctctatagattaagggttttctatatatatagagagagagagagatgtcagtcttcttctctaagaacagcaacactgatggacaactcgatcgcagcacacagcaagaaagcagagcagcctcctcctccttctgctacaactatagcagtgatcaccatggccgtcgtcgtcgtcgatctcacagcttcctccggcacaacgggcaggatccatgcttgatcaaccagccgtcgatgcacggcacatggaacacgtgccagcaatccggcaagctcctcaccttctcacctgtctggaaatcctgcagtagtaagaggagccaaatgtttcagaattcacaggattcagtaatcagtgagaattcatgcaaagatctggcacataaatgagaagcacacggttttgatacgagacagtgataaattaaatatggatgcaatgtactctcatcaattggttgcaaggtaatgtgcaagcaataatgcagagatgttcaatttaggtacagtgagtttgagaaatggtaaaagtttcagacctggaggcaaactgaacatcccgagaggtcaccaatggcgttcctcctgtactcctcagtgatcctgacctccgggagcttgtcgatggatgcccgtggcatgccgttggtgccctcgatctcgaacaggtcaggggactccctgaagggcgatgaatccactgcattcatctgaattcagaggcaatctcgtcagacaaatctgtaactgaagctgctactgcatatttctgaatcagacgcaaccatgtatgcaggggcagattcatgagacgaccaaactgacctggctccggaccacccgctgcaccgccggatcgaccttctcgcggacaagcctgccggtcaggaggctgtagatcacattaagctgcattttgtgcagagagatttgtgttaggtttaacaagccaacaaaaaaaaattagcaaaatgtaaggctgtgagcacgtatatatgacagatgaagcagaagagatgttcagaggtcccgtttgtgcagatatttgttgcacaatctacctagggagcttcccccccccccccctaaaagtggtactgagaatacatgagcaggttaattagattgtaaagaatgcacaaattgctttggaaaacatcatctgaactattcttttttgtacgaaataatcatctgaactttcaagacagcaaggtttgacaagttgtatcatctcataaaagaggcagttagctttgaccctttgttttaaaataaacacaaacaggttatatgaattaagcaagtactagttcatataaataaattaagcaacacacactgatgactggtacagacaaggaagttcagtagttgaggtaagcaagcaagcaagcgtgcagctatgaggttgctctcctactccaaagctactactaatctactatacctgtcggcatgatgaagaagaaatgtgtgtgttcgttcttaccacatagcagatgctggagatcccggatcggcgggatcgccagacgcggatggaggagtcgacgacctcgatggagacgagggcgccggtgatggcgccgatgccggtgccgcggaagaggccgctctcggtggccagcccgatcagcccgccagtcaccgctccaagaaacagtccagctgcacacacacaaacacatccatgttaattaacattcatagctaccaccacagctttccggttcaagattcaggcttcaagattgaac

SEQ ID NO: 5455 - DNA, 1246 bp, Oryza sativa
  Predicted polypeptide sequence is orthologous to G378
atatgctaacaagattttttttagagacgtacccaacatccacaaagctagctagctagatcctcctcttctctgcactctgctagagcaagctcgatcgatcgatcagtgatatttccccttatccaaatccagcacaaaccaacaatatccatggaggccgtagcagtgcacgccagcttctcgtcctactcccctccggtggtcgccggcggccgcgacgacgccggcagcagcagcagcagcaggagcatgtcccgcctgccggctcgcgtcgccggcgccgtagctcgcggcatcgtcaccttcgtcttcgccacagtgggcacgatcctgggggcgatcaccggcgggctgatcgggctggcgacggagagcggcatggtgcggggcaccgggatcggggccatctccggcgcggtggtcgccatggaggtcgtcgactcctccgtcgccatgtggtgctcccacgactccgggatctggagcgttctctacgtccttgacgtgatctggagcctcctgacggggcggctggtgcgggagaaggtggatccggcggtgcagaacgcggtggacagccagatgaacgccgccgacgcgcccttcagggagagcgcgccgacgctggcggagatgttcgacaccggcatccccggcgtcgccgccgccgccacgggcatgccggcggacgccatcgccgcgctcccggtcaccacgttcgccgccgccgccggcggcgacgaccgcgccggctgctccgtgtgcctccaggacttggaggacggcgagcgggcgcggaggctgccggagtgcggccacacgttccacctccgctgcatcgacagctggctgctcaggcacgcgtcgtgccccctgtgccggcgcacggtggtcgccgccgccgtcgccgtcgacgacgtcgtcgtcggctgagctggcgcgagctcgcatctggttggctcgttcgtggttaattaggcttaagctagaagattagtgagaagggcgtgcagtgcacggcacgccgccggcgacggcgtgaggatcacgactgacgtgcgtgtgtgtacctactacctcaccttcttttgataccttgattcgttttggcgtagtacatatgtgtagcggatacttgcattatactagtatatacacacacacttgtatgtattgtagatttatatacttgtacatggagaccttgtgattaacataatagagagatccagattttgtctct

SEQ ID NO: 5456 - DNA, 2744 bp, Oryza sativa
  Predicted polypeptide sequence is orthologous to G380
gatcctctcatcaccaccaccaccccacctccttctctccctgtctttctccttctcctcctccttcctctcgctctctcctccttgacaaaatttcctccacccattcccttctccacccaccctgccgatctctctgaattcggtcgcctcctccgcaccatctttctctcctcctctcttctagcaatcggtcgtttcctccggttgttgtgctgattcttcgttctttctctccctctctctctctttctttcttcctctctctgccttggagaggatcaagaaacgaagggagggaggagaggagaggagaagggaaatcgagaaaagtctgttctttggtttggctcgtgtggttcttgagagctgctgtttggaaaatctctgcacctgttgctgaccacttgcttcaattgttgaaagagatgaacagcacctgagatgctattgccagacatcaattgataaagagcacatcttcagtaatgcaaggacagaagaactctgttgagcagcttgctgatgtgtttggatttgaccatgcatccagttcaggaaaccctgtcatggatcaacaaggatattggaacaacattcttggttcagtggagtcacataaccttcaaggttatcaggtgaaccgtagtgatggaactattccctatggaaacggtgtgcatcaaaatggcacttttttaggtttttgggaatcaggcgaagcaagtgcaagtggcagttcactacattttgggggctctaatgagatcaaagctgagcaacgtaatatcggtggtggcctaaggattggtgaaaggcgcttggtagctgagcgcaacctttctttggataatgttgatataggccttaacatcaatggtaatgatctatctggtgaaaattcaaatgtgaatggtgcttcacaaggctctgaactacatggtggctgctctcatactggttcaaatggtcaagcctctgagctgagattacatccatacaggacattcatattaggtgcagatcaacctgagccttttaattctttgaatggcagtgaaaatcctttaggtgatttttccttgatgccagaaggcattgatcagcgaccaggcagttccctggatggccgccggctggcatgcaagaggaaaaatatagaaggagttaatgggcagtgctcggcaggtgctagcactagtttttcccacaggaacgatagtattttccataacattgcttcttcgagtcataatccctctcctagtacaaatttaccctctcctaattgtctgttggttccaagcactcttgatgaacaactcccgcgttatggagctactacagctggattgtcatctagtagctatgatcctagtggaggcaataacaattcaggaggctcacaaagaagttttcggccaagaactagcctggctcaacatattggcccctatggtgtgtggccatcttcaagtactatcagacattccaattcatggaatcatcagccacctccctttcagagttcatttgatgaaccaccggaggtaattccagtggtcagtagcctgaactttcaataccagcatccaatgaatgtcgttcctggcattccacagatgtcacaccggttcactggtccaggggcctcatcatcaagaacaggcaatttggagaacagaattattggtagtgaggaatttagcgcgaggaatgtagtggctaccagcttccctgatgcagttcctccggccgcactagacatgaggcatttgataccagaaccatctagttggaatgtagatggcagagctactaccattccaggaaatgttccttcttcatcgagagctaataccaattcgatggttaatccaccagcaggctctccatttattgcccatcaaaacttgcatagacgtaatcctcgtaatttgtcagaggagataagtcgtttatctggagctcttcgtggccatcagcacccacgcctaaggtccggttttctgttagaacgacaaggtgatggtgtttggggtgttccgttgtcaactaggagcagggaaggaagaagattaattgagatccggaacgcgcttgaaatgattcacagaggggaaaatgtaagatttgagtccattttctatggtggagtcgacattcatgacagacacagggatatgcgccttgacatagacaacatgtcttatgaggagctattggcactggaagaaagaataggcaatgttagcactggcctcagtgaggaagaagtgacaaagctcctaaagcaaaggaaattctcatcatggaggttggaagcatctgtggaagaagagccatgctgtatctgccaggaagagtatgttgatggggatgatctcgggacactggactgtggacatgacttccatgttggatgcgtcaggcaatggctggttgtgaagaacacctgtcccatatgcaaaaatactgctctgaagtcttagaaaaagcacagggcagtaaacactgtgtgcttgttcgatcgcaagatcgtttagtgattcatattaccgtgccgttttttgattagaaattttttttgccattgacctacaaatttgattaaaaaaaaaggtaaaagaactggtccctgcaaactgccccctcctgcagtaaataatccctggaatctgtcgctctgcattcaactgaatatttatggctggtatattggatgatggctcaatatttttttc

SEQ ID NO: 5457 - DNA, 2004 bp, Oryza sativa
  Predicted polypeptide sequence is orthologous to G380
atgcaaggacagaagaactctgttgagcagcttgctgatgtgtttggatttgaccatgcatccagttcaggaaaccctgtcatggatcaacaaggatattggaacaacattcttggttcagtggagtcacataaccttcaaggttatcaggtgaaccgtagtgatggaactattccctatggaaacggtgtgcatcaaaatggcacttttttaggtttttgggaatcaggcgaagcaagtgcaagtggcagttcactacattttgggggctctaatgagatcaaagctgagcaacgtaatatcggtggtggcctaaggattggtgaaaggcgcttggtagctgagcgcaacctttctttggataatgttgatataggccttaacatcaatggtaatgatctatctggtgaaaattcaaatgtgaatggtgcttcacaaggctctgaactacatggtggctgctctcatactggttcaaatggtcaagcctctgagctgagattacatccatacaggacattcatattaggtgcagatcaacctgagccttttaattctttgaatggcagtgaaaatcctttaggtgatttttccttgatgccagaaggcattgatcagcgaccaggcagttccctggatggccgccggctggcatgcaagaggaaaaatatagaaggagttaatgggcagtgctcggcaggtgctagcactagtttttcccacaggaacgatagtattttccataacattgcttcttcgagtcataatccctctcctagtacaaatttaccctctcctaattgtctgttggttccaagcactcttgatgaacaactcccgcgttatggagctactacagctggattgtcatctagtagctatgatcctagtggaggcaataacaattcaggaggctcacaaagaagttttcggccaagaactagcctggctcaacatattggcccctatggtgtgtggccatcttcaagtactatcagacattccaattcatggaatcatcagccacctccctttcagagttcatttgatgaaccaccggaggtaattccagtggtcagtagcctgaactttcaataccagcatccaatgaatgtcgttcctggcattccacagatgtcacaccggttcactggtccaggggcctcatcatcaagaacaggcaatttggagaacagaattattggtagtgaggaatttagcgcgaggaatgtagtggctaccagcttccctgatgcagttcctccggccgcactagacatgaggcatttgataccagaaccatctagttggaatgtagatggcagagctactaccattccaggaaatgttccttcttcatcgagagctaataccaattcgatggttaatccaccagcaggctctccatttattgcccatcaaaacttgcatagacgtaatcctcgtaatttgtcagaggagataagtcgtttatctggagctcttcgtggccatcagcacccacgcctaaggtccggttttctgttagaacgacaaggtgatggtgtttggggtgttccgttgtcaactaggagcagggaaggaagaagattaattgagatccggaacgcgcttgaaatgattcacagaggggaaaatgtaagatttgagtccattttctatggtggagtcgacattcatgacagacacagggatatgcgccttgacatagacaacatgtcttatgaggagctattggcactggaagaaagaataggcaatgttagcactggcctcagtgaggaagaagtgacaaagctcctaaagcaaaggaaattctcatcatggaggttggaagcatctgtggaagaagagccatgctgtatctgccaggaagagtatgttgatggggatgatctcgggacactggactgtggacatgacttccatgttggatgcgtcaggcaatggctggttgtgaagaacacctgtcccatatgcaaaaatactgctctgaagtcttag

SEQ ID NO: 5458 - DNA, 693 bp, Oryza sativa
  Predicted polypeptide sequence is orthologous to G383, G1917
tttttttttttttttttttttttttttttttttttttttttttttcccctttcaaaaatggcgggaaaattcattcatttcaaacatttttcaggggcctatcgaaaactaacaactcacccggatggaaggaataaacccaatttattctctcccatcaccccggggttaaaaaaataaaatctataaccctaggaaaaaagggtggcaaaacaaaaacaaaattaaaaaggaaaggggagtaggaaaaaataaataaaaggaataattcccccccatccttttatattgcccgaaaatgggggcttgaacaacccttaaaaaccacggcagtagttaaccatatgggaaaaaattccccgatgggggggctggggattaccaacccaactttatttcttccaactgttcttccacctttatgggggcccccggggggcctaaacggggcccactaactcttcggggggcaccccctctttgttcaccctcctggggaaagggcccttgctttacacaacccttttggggggcgccaacccttccgccagaatgggcaacaaagatcgccgttcgctcactcgccggcaaaactgtgcgccccctcgcccttgcccccccccccaggggaacgcggaccacccccacttatccttccgaggtaaaaccccgggggagaatctggcgcacctt

SEQ ID NO: 5459 - DNA, 1149 bp, Oryza sativa
  Predicted polypeptide sequence is orthologous to G383, G1917
gtgtagagtgttgtgaatagccagttcagttcatcagttgataggagccatgcttcaccattactacagcggcggcgccggccatcatcaggacgtcgctgcagctggtagccccggcgacatggcttcctccaccttctcgctcttcttcccgatgtccaatgggcagtgttggccgccgtcgacggtggaggagtccgcggcctacgacgaccacagcaccgtcaccacctctccttcctcgccttcgtcgtcctccaccggctccgtcgactgcacgctctcgctcggcacgccgtcgtctcgccgcgccgagcccgtcgcggcggcggcgccagcggcaaaccatggggcgcccgtgccggcgcattatccgtcgctgtcagcggcgaccgtgtcctgggacgcgactgccgagtcgtactattgtggccagcaggggaggccggccaccggcgccgccaagtgcgccgccggcgccgggcacgacgcgctcctcgaccgccgctgcgccaactgcggcaccgcgtccacgccgctctggaggaacggccctcgcggacccaagtcgctgtgcaacgcgtgcgggatcaggtacaagaaggaggagcggcgcgcggcggcgacgacgacgacggccgacggcgccgccggatgcggcttcatcaccgcgcagcgtggacgcgggtcgaccgcggccaaggcggcgcccgccgtgacgacgtgcggcgaggagacgtcaccgtacgtcgtcggcggcggcggcggcggcggcgaggtcgcggacgcggcgtatctcgcctggcggctcaacgtcgtcccaccggcggcgacggcgacggcgttctcggtgtggccggagcgagctagcctctaccactacaactagctataggcgattaactagtgtagcattagcgttggggagaagggaagctgcaccgtttttttggggaacattttgtacggtcgcacgctcccggattgatcgaactgtatgcatctgctgtgctgtgttgcacgctagctagctagatgactctgatcttgaaacgaaccgtgatcatttcattcatttggaatgaacatgtagctgtgcaaggtcatcttgctcggaaaattcataatcttccaatctcttgtgctgcc

SEQ ID NO: 5460 - DNA, 2537 bp, Oryza sativa
  Predicted polypeptide sequence is orthologous to G384, G385
acggggaaatacaacagaatcgaaatacagaatactgggataacgacacactgggagtcacttgcaacctttagggttgaatctccggagatggaaatgaatcaacagcataatgagggcaacgaatctttcgtggccttgatgaacggttttgctggtgacgggacggcaacactaccgaatgatggggagcagagaatgagtattccagcaagagaattatttgcagcaattgaggccgactcaggcttgttgcctgtgaacagtagcaacactaatgaaaaaaggaagaggcgtctacagaggctcactggcaaacagtcggaggtacttgaggggtttttcagcatctgtgggcatcccgatgatggacaaaagaggcatctgagtgagacaacaggtcttggtttagatcaagtgaagttttggtttcagaataaaagaacacaagtaaagactatgtgctggaaggaagagaactataagttgtcggtggagaatgaaattctgagggatgagaacaggagagttaagatagctcactgcactgctgtatgcctcacttgctgtaattcatcagtacagaaccagcttgccgttgagatggaaaggttaatggggcagagtgagtggctgcaacaagagattgcacggtcgaatggaacacccccggctgcaaaccttgcctttcaacttaattcatcagcagactatgtattttcagggcaacatgaccaacaaatgattgctgaactagccaaaaacgcaatgcacgcattgattattttggccgaatcccatgtcgctctatggtttcccgtccctggctgttcttatgaagtattgaacaagatggcttatgaccaagcatatcctggggataacagtgcaaacgccattggattcaagacagaggctactcgtgcagtttctatggtgatgatggactacaaaagcgttgtggatttcctcatggatccttacaactaccgaactttctttcctgaagttatttccggggcagtaaccaacaggatctacacgtggcctaccagtgatggttataatggggttatacaactgatgactgtcgagatgatgttcccatcgcccctggtaccggctaggaaatgcacattcctgcgctattgtaatgtgctgaacgaaggattagtggtcgtcattgatgtgtcattggacgatggcagtatcttctccaaatgccgtaaaatgccatcagggtttctgatccaatccataaggccaaacagctgcaaggtcactgccatagagcacgtccttgcggatgacaccggtgttcatgagctctaccagcctcgtgtgaatggactcgtcttcggagctcggcgctgggtggcgaccatggcgcggcagtctgcacgcatgagagatgttcatcacaacaagacagctccgcaagtcagcacgaaggggaggaagaatctaatgaagctagcggacgacctgctcgcgagcttcgccggcggcatcgccgccactggcggaggaacgtggaccgtcgtgatcggcgccggcacggagaaggacatcagggtcgcgtacaggaggaccaccgagggcagcagcagctacaacgcgatcctgtccgtcaccgcgtccctgcgtctgccgctgcccatgaggaaaaccttcgatctgctcaggaaccttactcaccgctgcaagtgggacgtcctggtgcacggcagcgtggtgaaggaggaggtcaccatcgccagaggcgtcgggaacgacgacactgtcaccgtcctccactgcaagcgcgccggcagggaggacaggggaaggaccatgatcctgcagaacaacgggtacgacgcgtcgggctcgttcatggtctactcccagatcgacagcgagctgatgaacaccatggtcctgagccccagcgacctgccgcccgggcggggcgggccgtccctctaccccaccggcttctcccttctccctgacgtcgaggctgcccaggacagcagcggcatcgccctcggcgaggttgggggaactctcatgaccatgggcttccagattccggtgaagctcgccagtggggatcgcatgtattcccggtctgcggcatcggcaatcaggctcatgactgacaccattgccctcgtcaagaagacgctgatgaacgagcattctggtatctacggggttagcccgttccacccctagattcagaaaaacaccagagggagaaaagggaggtccgtgtgcagataaaaatcaagaacatgcgaaggggattcatcggctccgatcaccctgcatctcccagaatttgctgaattaattagaactttaaggttgtgttaacaacctgtaataatgtttttaaggccaaacttatatcgtgtctttgctgtaataatgtagtatgcgcctgatggatgtcgactgccgtgtaccgatgcagtttgcttcgcagagacgcggatacatttgctatcgtatggatgctcctttagaagcaaaaaaaaaaaaaaaaaaaa

SEQ ID NO: 5461 - DNA, 390 bp, Oryza sativa
  Predicted polypeptide sequence is orthologous to G384, G385
cgcaagaagcgctaccaccgccacacccagcaccagatccaggagctcgaggccttcttcaaggagtgcccccaccctgatgacaagcagcgcaaggagctcagccgcgagctcggcctcgagcccctccaggtcaagttctggttccagaacaagcgcacccagatgaagacgcagcatgagagacacgagaacaatgcgctgcgcgcagagaacgagaagctgcgggcagagaacatgaggtacaaggaggcgcttgccaacgcgtcctgccccaactgcggcggtccggccgccatcggcgagatgtccttcgacgagcaccacctccgcctcgagaacgcgcgcctccgcgacgagattgacaggatctccgccatcgccgccaag

SEQ ID NO: 5462 - DNA, 3063 bp, Oryza sativa
  misc_feature (3002)..(3002): n is a, c, g, or t
  Predicted polypeptide sequence is orthologous to G384, G385
ggcacgagtgatctcttgccgtgtgatctctagcttgtgtgctagatctgtttctacttgcgtttgcgttgcttggcaagcaagatatatatatatatatctatatctatctatctatcattctatctccctacatatttagagctagcactttgtgtgttctttgggtttgggacacactcatatacgcgtgttcatgagtggaaatggaaggagctgcaagggcaagaattagggtttgagatataggagtataatgatgatcccggcgaggcatatgccgtcgatgatcggccggaacggcgcagcgtacggatcctcatcggcactgtcactcagccagccaaacttgctggataatcaccagttccagcaagcgttccagcatcagcagcagcagcatcatctccttgaccagatcccggcgacgacggcggagagcggcgacaacatgatccgcagccgtgcgtccgaccctctcggcggcgacgagttcgagagcaagtccggcagcgagaacgtcgacggcgtctccgtcgacgaccaggaccccaaccagcggccgcgcaagaagcgctaccaccgccacacccagcatcagatccaggagatggaagcattcttcaaggaatgtccacacccagatgataagcagcgcaaggagctgagccgggagctcggcctggagcctctccaagtgaagttctggttccagaacaagcgcacccaaatgaagaaccagcatgagaggcacgagaactcgcagctgcggtcggataacgagaagctccgggccgagaacatgcggtacaaggaggccctgagcagcgcctcctgccccaactgcggcggccccgccgccctcggcgagatgtccttcgacgagcaccacctccgcatcgagaacgcccgcctccgcgaagagatcgataggatatcggcgatcgcggcgaagtacgtggggaagccaatggtgccgttcccggtgctgtcgaacccgatggcggcggcggcgtcgcgggcgccgctggacctccccgtggcgccgtacggcgtgccgggcgacatgttcggcggcggtggcgccggggagctgctgcgcggggtgcagtcggaggtcgacaagccgatgatcgtggagctcgccgtgccggcgatggaggagctggtccgcatggcgcagctggacgagccgctctggagcgtcgcgccgccgctcgacgccacggcggcggcgatggagacgctcagcgaggaggagtacgcgcgcatgttcccccgagggctcggccccaagcagtacgggctcaggtcggaggcgtcccgcgacagcgccgtcgtcatcatgacgcacgccaacctcgtcgagatcctcatggacgcgaatcagtacgcggcagtgttctcgaacatcgtgtcgagggccatcacgctggaggtgctgtccaccggcgtcgcggggaactacaacggtgcattgcaagtgatgtcagtggagtttcaggtgccatcgccactggtgccaacgagagagagctacttcgtgagatactgcaagcagaacgcagacgggacatgggccgtcgtcgacgtctcgctggacagcctccgccctagccccgtcctcaaatgtcgccgccgtccgtcaggctgcctcatccaagaaatgcccaatggctactccaaggtgacgtgggtggagcatgtggaggtggacgacaggtcggtgcacaacatctacaagctgctggtgaactccgggctggcgttcggcgcgcggcggtgggtcggcacgctggaccgccagtgcgagcgcctcgccagcgtcatggccagcaacatccccaccagcgacatcggcgtgattacgagctcggaggggaggaagagcatgctgaagctggcggagaggatggtggtgagcttctgcggcggcgtgacggcgtccgtggcgcatcagtggacgacgctgtccggcagcggcgccgaggacgtccgcgtcatgacgaggaagagcgtcgacgaccccgggaggccccccggcatcgtcctcaacgccgtcacctccttctggctccccgtcccttccaagcgcgtttttcacttcctccgcgacgaatcctctcgcagtgagtgggacatcctctccaatggcggtatcgttcaagaaatggcccacatcgccaatggccgggatcagggcaactgcgtctcacttcttcgcgtcaacagctcgaactcgaaccagagcaacatgctgatcctgcaggagagctgcacggacgcgtcggggtcgtacgtcatctacgcgccggtggacgtggttgcgatgaacgtcgtgctaaacggcggcgacccggactacgtcgcgctgctgccatcgggcttcgccatcctgcccgatgggccggcgcacgacggtggcgacggcgacggcggcgtcggcgtcggctccggcgggtcgctgctgacggtggcgttccagatactggtggactccgtcccgacggcgaagctctcgctggggtcggtggcgacggtgaacagcctcatcgcctgcacggtggagcgcatcaaggcggccgtctccggcgagagcaatccgcagtagcttcgtccttgaatcaaacaaaagcttcttgtgctttcaatttcaggagcagcaaaattttggagctttcatcagtgggaagtcaagaacgcacctcagactgtccttgccatgtggtgcccatatatagtttggattatttttcgctagtttttccgcaaattcgggaaatttcaaaaaaaatgtgtcaccactacgcaagggcggttggttcgggtattgacttcctcttcatgttcgcctctcggatgctgctaccttatgaatttagggttcttctggagtacaaaaaaaaccccttaatttgatctgtaatttctgttgttcagacttcccagtacctagctagctagtaggagttgcagaatagagatctgtgtccctgtcttanacttttagttctcttcagtgtttgatcagtgctgtttcaatccaaaaaaaaaaaaaaaaaa

SEQ ID NO: 5463 - DNA, 759 bp, Oryza sativa
  Predicted polypeptide sequence is orthologous to G384, G385
atgtcatcctctctttatcccttcttcctcctctctctcatcccttctctatctctccctctttctcttcgtgcgtggggagcggcgtccggatcggcggcggcgacggagggcgggggccagagcggcaggcaggatggcgggtgggcggtcgctggagttgtggacctggaggcagcggcggtggcttgtcacgtgttgcgcagccatgcacaggaggtgaacttcgtccgctactgccgacagatcgagcaggggctatgggccatcactgacatcttcgtcaacctgcagcgcgacgcctacttcggcgtgccaccgctgcgttcccgccgactcccgtcgggatgcctcatcgctaacatggccaatagctactccgaggtgaccagggtcgaacacatggaggtggaggagaagaacccgatcaacgtgctctaccgtgacctcgtgctgagcggcgatgtattcggggcgcactgctggctcgccgcgctccagcgcgcgtgcgaccgctacgcctccctcgtcgcgctcggcgtcccgcaccacatcaccggaggtatgcacacgctatgccacgcacctagcccagatccagagcttcgaatcggccacgacgggcggctagaggacgggccgcaaggaggagctgctcctgcgcctgtcgcccgaggtccgccgcctggcacccgctcgccgccgcctccactcgagcccccgcgccgccggctcatgtcaagggggagagagagataa

SEQ ID NO: 5464 - DNA, 3280 bp, Oryza sativa
  Predicted polypeptide sequence is orthologous to G384, G385
gccccccctctcgcaataactcctcctccccatctccacattcctcccccaaatcccctcttcttcttcttcttcttcttcctcctcctcccatggcgatcggcgtctgcttctagctagagagatctcgcttcgtttcgagctgtccaccggtggttttctcgcatgcgatatcacacgcttcttggaagcacatcagagttcttggtgctgaccttgccctagatctgcttctgactgttgctgttacgtggcgtgcaagctagctatagccatttctgtgtgtgtagctgtactggtggtgaagaagaagatgcaagcgaatgggtggaggagctagaggcttggctggaggaagaagaagaaggggttggtggtggctagctagctagggtgcgtgcttaattacctggcttcgttcatgacgccggcgaggcgcatgccgccggtgatcggccggaacggcgtggcgtacgaatcgccgtcggcgcagctgcccctcacccaggctgatatgctggacagccatcatctgcagcaagcactccagcagcaatacttcgatcagatcccggtgacgacgacggcggcggcggacagcggcgacaacatgctgcacggccgcgccgacgccggcgggctggttgacgagttcgagagcaagtcgtgcagcgagaacgtcgacggcgccggcgacggcctctccggcgacgaccaggaccccaaccagcggccgcgcaagaagcgttaccaccgccatacccagcaccagatccaagagatggaagctttcttcaaggagtgcccgcacccagacgacaagcagcgcaaggagctgagcagggaactgggtcttgaacctctgcaggttaaattctggtttcagaacaagcgcacacagatgaagaaccagcacgagaggcacgagaacgcgcagctgcgggcggagaacgacaagctgcgcgcggagaacatgcgatacaaggaggccctgagcagcgcgtcgtgccccaactgcggcggccccgccgcccttcgacgagcaccacctccgcgtcgagaacgcccgcctccgcgacgagatcgaccgcatctccggcatcgccgccaagcacgtcggcaagccccccatcgtctccttccccgtcctctcctccccgctcgccgtcgccgccgcccgctcccctctcgacctcgccggcgcctacggcgtcgtcacccccggcctcgacatgttcggcggcgccggcgacctcctccgcggcgtgcacccgctcgacgccgacaagcccatgatcgtggagctcgccgtcgccgccatggacgagctcgtccagatggcccagctcgacgagccgctctggtcgtcgtcgtcggagccggcggcggcgttgctcgatgaggaggagtacgcgcgcatgttcccgcgcggcctcggccccaagcagtacggcctcaagtcggaggcgtcccgccatggcgccgtcgtcatcatgacgcacagcaacctcgtcgagatcctcatggatgtgaatcaattcgcgacggtgttctcgagcatcgtgtcgagagcgtccacgcacgaggtgttgtccacaggcgtggcaggcaactacaatggtgcactgcaagtgatgtcaatggagtttcaagtgccgtcgccgctggtgccgacgagggagagctatttcgtcaggtactgcaagaacaactccgacgggacatgggccgtcgtcgatgtctctctcgacagcctccgccccagccctgtccagaaatgccggcgcaggccgtctggctgcctcatccaagaaatgcccaatggctactccaaggtgacatgggtggagcatgtggaggtggacgacagctcggtgcacaacatctacaagccattggtgaactccggcctcgcattcggcgcgaaacggtgggtcggcacgctggaccggcaatgcgagcgcctcgccagcgccatggccagcaacatccccaatggcgaccttggagtgattacaagcgtggaggggaggaagagcatgttgaagctggcggagaggatggtggcgagcttctgcggcggcgtgacggcgtcggtggcgcaccagtggacgacgctgtcgggcagcggggcggaggacgtgcgcgtcatgacgaggaagagcgtcgacgaccccggcaggccaccgggcatcgtgctcaacgccgccacctccttctggctccccgtccctcccgccgccgtcttcgacttcctccgcgacgagacctctcgcagcgagtgggacattctgtccaacggcggcgccgtccaagaaatggctcacattgccaacggccgtgaccatggcaactctgtctcgcttcttcgtgtcaatagtgcaaattcaaaccagagcaacatgctgatcctgcaagagagctgcacggacgcgtcgggctcctacgtggtgtacgcgccggtggacatcgtggcgatgaacgtggtgctcaacggcggcgacccggactacgtggcgctgctgccgtcggggttcgccatccttcccgacgggccgtcggggaacgcgcaggccgccgtcggggagaacggctccggctccggcggggggtccctcctgacggtggcgttccagatcctcgtcgactccgtgccgacggcgaagctctcgctgggctccgtcgcgacggtgaacagcctcatcgcctgcacggtggagcgcatcaaggccgccgtctgcagggacagcaaccctcagtagtagcaccggcttcaaccaaatatgatcacgaacaatgttccaaggagcagcaaaattttggagtttgattcagcagtagggagtcaagaacgcacctcaaactctccttgccatgtggtgcccttgctagtgaagaatttgcgaggaaaccgacgcgtttgcgagaaaattttcgcgaagatacatagtgtcaccactatgcaaggggggatggttcgggcattgacttccaccttttgattttcatcaaatgcatcgaagagtggatgctgctaccttgttgtttttctgaatctctatgttagggcttcttttaccatgtttaaaaagggctatgaagcctcatttttatctgtactgttgtgatgtgttgtctgtttgttcagacttcaggttcctgtcccttagctaggagttgagaatagagagattcatgtccccccttttggattttatcacatttccgatgatttgtagacttgtggttgttgcttgttggtcattaccattcttgtctc

SEQ ID NO: 5465 - DNA, 3089 bp, Oryza sativa
  Predicted polypeptide sequence is orthologous to G384, G385
agcacgcactgctgctgctgctcgctctcgctttgcttcccctaatcttctcccgggccaggggggaagaggggcggaattcgggcacgagctttggagttggagatcacttcggcgacggcgtggtccccgccggcatgcagttcccgttctccggcgctggcccgggcgtcttcacgtcatcgccggcgctctccctcgcgctggcggacgcggtggcaggccggaacagcggcggcggtgggaagatggttaccgcggcccatggcggcgtcggcggaggaggaggaggaggacgcgcgaaggcgagggacgcgttggaggtggagaacgagatgagccggtccgggagcgaccacctcgacgtcgtctcttgcggcgacgcgggcggcggcggcggcgacgacgacgatgacgaggacgccgagcacggcaacccgcccaagcgcaagaagcggtaccaccgccacacgccgcagcagatccaagagctggaagcgatgttcaaggaatgcccccacccagacgagaagcagcgcgccgagctgagcaagcggctcggcctcgaaccccggcaggtcaagttctggttccagaatcggcgaacgcagatgaagatgcaactggagcgacacgagaactcgctgctgaagcaggagaacgataagctgcggtccgagaacctgtcaatccgggaggccacgagcaacgcggtgtgcgttggctgcggcggcccggcgatgctcggggaggtgtccctggaggagcaccaccttcgcgtcgagaacgcgaggcccaaggacgagctcagccgagtgtgcgcgctcgccgccaagttccttggcaagtccatctctgtcatggcgccaccgcagatgcatcagcctcatcctgtgccaggctcgtcgctggagcttgcggttgggggtatcggttcgatgccatcagccacgatgcccatctcgacgatcactgattttgctggcgccatgtccagttcaatgggcacggtgatcacgcccatgaagtctgaggctgaaccatcggcaatggctggcattgacaagtccttgttcttggagctagcaatgagtgcaatggatgagctagtcaagatggctcagatgggggatccgctttggattccaggtgcctccgtaccttcctcgccggcaaaggagagtctaaacttcgaggagtacctaaacaccttcccaccttgcatcggggtgaagcctgaagggtatgtatcagaggcatctagagaatctggcattgtcatcattgacgatggcgccgcgcttgtggagaccctcatggatgagcgacggtggtccgatatgttctcatgcatgattgccaaggcatcaaccactgaggagatttctactggtgttgctgggagtagaaatggtgcattgcttcttatgcaggcagagctacaggtgctttctcctcttgtgcctattagagaggtgaagtttctcaggttctccagacagctggctgatggtgtatgggctgtagtggacgtttcggctgatgaattgatgagggatcagggcattacttctgcatcctcgactgcaaacatgaactgccgaaggctgccttctggttgtgtgctgcaggacactccaaatgggtttgttaaggtcacatgggttgaacatacagaatatgatgaggcatctgtgcacccgctctaccggcctcttctccggtctggtcttgcccttggtgcagggcgatggatcgcgacattacagcggcagtgcgaatgcttggcccttctcatgtcttctattgcattgccagagaacgactcatcagctatccatcctgaaggtaaacggagcatgttgaagttggcaaggaggatgacggacaacttctgtgcaggggtgagcacatcatctacccgtgagtggagcaaactggttggattgacaggcaacattggggaggatgtgcatgtaatggcgcggaagagtgtggatgaacctggaacgccgccaggtgtggtgcttagtgctgctacatctgtgtggatgcctgtgatgcctgaacggctcttcaacttcttgcacaacaaggggctgcgtgctgaatgggatatcctcagcaatggtggccctatgcaggaggtgacaagcattgccaaggggcaacagaatggcaataccgtatgtctactgaaggctagtcccaccaaagacaagcagaacagcatgctgatcctacaggagacgtgtgcagacgcatccggttcaatggttgtgtatgctcctgtagacatcccagcaatgcaccttgtcatgagtggtggggattcgtcatgcgtcgcccttcttccatcaggttttgccatcctgcctgctgggcctagcatcggcgcagatcacaagatgggcggttcattgctcaccgttgcattccagatacttgccaacagccagcccagtgctaagctcacggtggagtcagtcgagaccgtgagcaaccttatctcctgcaccatcaagaagatcaagacggcgctgcattgcgacgtgtgaacccaacaaggggggacttttggcctagtgggagcggctgtggcgatgagcctgagtcaagaacgaaccgcgacataggaagggacctttgctaggtggcaaggaccggacggggcaggtccttagcacagagcaatggtggtggttcgggtattgactcagcctctcccgcctccgttctctcctgtgactggtgcatgttgaagtgaacctgcattttggacgccatgtagcaggccatctttctttctttttcctttttctttttctttttctttttttagggagaagggagtcatctgtgttttttgttggctggctcagggtgttggtgtttctggtttctagcttttgttacagggagatgtgatacattttgtagaagctccgaattgtcgtgctggtatgtgaggttctgatcataggtctgtgtttgatagtctcgagctatcaacgcctggcaaatgcaaaccttgttatgctaaaatatgttttagatcaatctgattctgaaagctgtttacatgtccc

SEQ ID NO: 5466 - DNA, 3437 bp, Oryza sativa
  Predicted polypeptide sequence is orthologous to G384, G385
gtctggttctatttttctctcgcgtccacacgacgggggggcctcctctcctctccctcctcccctcgtctccacactagacttgccattttgaccctccgcttgctccctcctcccgttcctatctccccgccgccgtacataagtgctttctttaatcggatgcgtcccctcccctcgccaccagttcgttcgctcgctcgctcgctcgctcgccttgttaatctatccctccctctctcccgcccctccgtccgccgtggagggttagggttttgagggttcgctcgcctcggcgaggctttatctctctaccagtagtctcttactcttcttcgttgggccgtgggttaggaatcgggttgtgaggcgtgtgggaggggcggggtagatccaaggaagaggactttctcgagtttacgccgtggtgttttgcttcggcgaggaggcggcggcatgagctttgggggcctctttgacggcggcggcgggggaggcatgcagttccctttcgccagtggcttcgcgtcctcgccggcgctctccctcgcgctggacaacgccggcggtggcatcggcgggcggatgctcggcggcggcgctggcgctggttctagcgcgggcggcgcgatgacgagggacactgaggcggagaacgacagccggtcgggaagcgaccatctcgacgccatctcggccgccggcgaggacgacgtcgaggacgccgagcccagcaactcccgcaagaggaagaagcgataccaccgccacacgccgcagcagatccaagagctcgaagcgctgttcaaggagtgcccccatccggacgagaagcagcgcgccgagctcagcaggaggctctccctcgatgcgcggcaggtcaagttctggttccagaatcgccgcacgcagatgaagacgcaactggagcggcacgagaacgcgcttctcaagcaggagaacgacaagctgcgcgccgagaacatgacgatccgggaggcgatgcgcagcccaatgtgcggcagctgcgggagccccgccatgctcggggaggtgtccctagaggagcagcacctgcgcatcgagaatgcgcgcctcaaggacgagctcaaccgcgtgtgcgccctcgccaccaagttcctaggcaagcccatctccctcctgtcgccgccgcccttgctgcagccgcacctctcgctgcctatgcctaactcgtcgctggagctagcgatcggaggcatcggtggcttagggtctctcggtacactacccggctgtatgaatgagttcgccggaggcgtgtcgagcccgatgggcacggtgatcacgcctgcgcgcgcaaccggggctgctataccatcgctggtgggtaacatcgacaggtccgtgttcttagagcttgcaatcagcgcgatggacgaacttgtcaagatggcacagatggacgatccattgtgggttccggcactgcctggttctcccagcaaggaggtgctcaactttgaggagtatcttcactccttcctaccgtgcattggcatgaagcctgccggctacgtctctgaggcctcgagggaatccggtctagtcatcatcgacaacagccttgcccttgtagagaccctcatggatgagagacggtggtctgacatgttctcgtgcatgattgctaaggcaacagtgcttgaggaggtgtctaccggcattgcaggaagcagaaatggcgcgttgctgctgatgaaggctgagctacaggtgctctcacatctagtaccaattagggaggttacatttctccggttttgtaagcagctggctgagggtgcatgggcagtagttgatgtgtccattgatggtttagtgagagatcataattctggaacggcacccacaggtggaaatgtgaagtgtaggagggtaccttccggctgtgtgatgcaagacactcccaatgggtattgcaaggtcacatgggttgagcatacggaatacgatgaggcatcagtgcaccagctctaccgtccactccttcggtctggtctcgcctttggcgccaggcgttggcttgcgacgctgcagcgccaatgcgaatgccttgccatcctcatgtcctctgctacagtgacagcaaatgactcgactgctatatcgcaagagggcaagcgaagcatgctgaagctggcacgccggatgacggagaacttctgtgctggggtgagcgcatcgtctgcacgtgaatggagcaagctggatggtgcgaccggtagcatcggggaggacgtgcgcgtgatggcacggaagagcgtgagcgagcctggagagccaccgggcgtggtgctgagcgcggccacctcggtgtgggtgcccgtggctccggagaagctcttcaacttcctgcgcgatgagcagctgcgtgcggagtgggacatcctcagcaatggaggccccatgcaggagatgacccagatcgccaaggggcagcgggatgggaactcggtttcactcctcagggccagtgctgtgagtgccaaccagagcagcatgctgatacttcaggagacgtgcaccgacgcttctggctccattgttgtgtacgctccggtagacatcccggcaatgcagcttgtcatgaatggtggcgactccacctatgttgctctgcttccatccggattcgccatcctgcccgatgggcctcgcatcggcgccaccgggtacgagacgggcggctctctgctcaccgtggcgttccagattcttgtcaacaaccagcccaccgccaagctcaccgtggaatcggtcgagaccgtgaacaatctcatctcctgcaccatcaagaagatcaagacggcgctgcagtgcgacgcctgagtgtttacagtggatttatgtccgcggggatacgccggcggcgacgagcctgagtcaagaacgaaccgcgcgttgaaaaaagaaaataacctttgctaggtgataaggatcttgcttggccggtccttagcacagagcaatggtggtggttcgggtattgactctggcctctaccgtacgccgatctctccccggcagccggtgatcattggatgatacagtaccatgcattttggacatttcttcgaggggttaaacttatgctttagtttcgtcgtcttagggagtcaaacctgtatacttttggcagttggctcatcgttgctctagtgttgtttgttttttgttgtgctatggctgtatgaggtagcctgtactagtagtttctcggaaatgctgggttcatactgtactagtgtcgtccatacttcatataggttatggtacaagtgtaggatcaaattgaaggtctcagaaagtgtatcagccaataatgtctgtttgacagtggcattgctatggatcagctgaaaattgttttttgcaatacacatgggatcaaagct

SEQ ID NO: 5467 - DNA, 2487 bp, Oryza sativa
  Predicted polypeptide sequence is orthologous to G384, G385
atggaggtttgtgaaggcggcagcgacgatggcgggcgcggatctgggacctcggtggtggtggatctagtgctcgaaacctcagcgacaacggatctagtgcttgggacatcagtggcggcggagctggtgctgccggcttcgggagctgcaggacctctggcaatgatggcgaacgatgctcaggagctctgtgacaacgatgacggaggcaacaatgggctgcgggagagggagaggatgatgatccctggccggaacatgtcgccggcgatgatcggccggcccaacggcggcggcggcggcggcggcgtcgcctacgcttcttcttcctcggcgctctccctcggccaggcgacgacgacgagcgagagcgacggccgtgcccctcgcgacgagctggagatgagcaagtccggtggcagcgacaacctggagagcggcggtggcggtggcggaggtggctccggtggtgatcaggaccccaaccagcgcccccgcaagaagcgctaccaccgccacacccagcaccagatccaggagctcgaggccttcttcaaggagtgcccccaccctgatgacaagcagcgcaaggagctcagccgcgagctcggcctcgagcccctccaggtcaagttctggttccagaacaagcgcacccagatgaagacgcagcatgagagacacgagaacaatgcgctgcgcgcagagaacgagaagctgcgggcagagaacatgaggtacaaggaggcgcttgccaacgcgtcctgccccaactgcggcggtccggccgccatcggcgagatgtccttcgacgagcaccacctccgcctcgagaacgcgcgcctccgcgacgagattgacaggatctccgccatcgccgccaagtacgtcggcaagcccgccgcggccgtctcggccgcgtacccgccgctgccgccgtcgaacaggtcgccgctcgatcatatgggcattcccggcgctggcgccgacgtgttcggcgccgacttcgacaagccgctcgtcatcgagctcgccgtggccgccatggaggagctcgtcaggatggcgcagctcggcgagccgctctgggcgccggcgctcggcggcgaggcgctcggcgaggaggagtacgcgcgcacgttcccgcgcgggctagggcccaagtcgccggagctccggtcggaggcgtcgagggagacggcggtggtgatcatgaaccacgtcagcctcgtggagatgctcatggacgtcgggcagtggacggcgctcttctcgagcatcgtgtcgcgcgcggcgacgctggaggtgctctcgacgggcgtcgccggcaaccacaacggcgcgctgcagctcatgtccgccgagttccagatgccgtcgccgctggtgccgacgagggagacccagttcctgcgctactgcaagcagcaccccgacggcacgtgggccgtcgtcgacgtctccctcgacgggctccgcgccggcgccgggggcggatgccagccggcggcggcgcgcggccaccggcgccgcccctccggctgcctcatccaggagatgccgaacggctactccaaggtgacgtgggtggagcacgtggaggccgacgaccagatggtgcacaacctgtacaagccggtggtgaactccggcatggcgttcggcgctcgccggtgggtggcgacgctggagcggcagtgcgagcgcctggctagcgccatggcgagcaacgtggcgtcctcgggcgacgccggcgtgatcacgacgtcggaggggaggcggagcatgctgaagctggcggagcggatggtggcgagcttctgcggcggcgtgacggcgtcgacgacgcaccagtggacgacgctctccggcagcggcgccgaggacgtccgcgtcatgacgcgcaagagcgtcgacgaccccggccgccctcccggcatcatcctcaacgccgccacctccttctggctccccgtcccgccttcccgcgtcttcgacttcctccgcgacgactccacccgcagcgagtgggacatcctctccaatggcggcgtcgtccaagaaatggctcacatcgccaatggccgcgaccacggcaacgccgtctccctcctccgcgtcaacaacgcgaactcgaaccagagcaacatgctgatactgcaggagtgctgcacggacgcgacggggtcgtacgtgatatacgcgccggtggacgtggtggcgatgaacgtggtgctcaacggcggcgacccggactacgtggcgctgctgccgtcggggttcgccatcctccccgacgggccggacggcggcggcgggtcgctgctgacggtggcgttccagatactggtcgactccgtgcccaccgccaagctgtcgctcggctccgtcgccaccgtcaacagcctcatcgcctgcaccgtcgagcgcatcaaggccgccatcaccggcgacaacggcgtcgcgccgccatgcccacggtga

SEQ ID NO: 5468 - DNA, 2892 bp, Oryza sativa
  Predicted polypeptide sequence is orthologous to G386, G707
gatggcgcacatgcttggatgggccggcccgtcgctccacgcctcggatcaccactgtcttcgcccgcggcggcgcacgccgccgccggagcccctgccccctctcgggcggcgcggcggggaccggggctcaccgcggccatgcgctgttcttgctatccctctcgtcagtttgtgccctcaccctgatgatttccgtttcactagccttgcacttcttgtcttcttccactcaacaggttggcgctaggttttgccgattggggatgaactcgtgacgaaattgcaatgtggggctctctctcggtaatggattggagaagtgatgaacggcgagcttaaacttatggcttcctatgtgagcaagcttaagttcatcttgcaaaaagatcagcagcaggagccccatactgcgaaccttctagtcctacttgggagtagcaatcaggacaaaagaaatggcctctcacagggagaaaacagaatggacacttgtaccagaaagaagccaagaagataccaactcctcaccatgcaacaaaaagaaacgcttaatcgtgcatttcaatcatgtccgaaccctgatagaaatgacttgaagaagttggccaaggaactaaacatgactgagaccaaaatcaaatattggttccagaactgcaggacaaagatgaagaaattcaagaacaatgaggagcgcaaactactgcagaaggagaatgaggagctaaagaaggagaatgcagagttgagaaataggatgaagaactcaacatgccgcgcttgtgacctccctttgttccatatagattgccgtcattgggagaatccaatgctcaacaagggtaatcatggcgttacaagtaatctcattcctcaggcagtgtcatccttgctccccagctcaagtggttttgtagcttcaggctccaatcttagtagcaatgctgtgctcatgcccgtatctgccatgccatcatcagttttgcagcctgctccagccgtctctggtgccaattttcccatcttgcacaatctatctgccaatgcaaatgatggctatacggaaaaaaacgtacttcttgatctggcgaaccgtgcaatggaagagttctttagtctaatgaaggagaatgagtctcttcttgtcaaaaaaaaggagaatgggcctctctggctcccacacatggatattctgggagtcgaatcacttaactaccaggaataccttgcaaaatccaggacgattggacaaaaacctgttgacttcaaagtggtcgtcaccagggacactgccattgtcaatggtagctgtgttgacctcgtcaaaagccttttggatgctaaccgctggagagagttgtttccaggcatcgtggcaagtgcaaacaccaccaagatcatctctactgggccctctaacttgcacgacgggttgcttcaattgatgcgtgcagagctccaggtaatgtcacctgaagtcccagtttgcgatgtgacattcttgaggcagagtgtgcagtttggaagtggactgtggtgtgtggttgatgtgtctattgataccatccttcctggagagagtaaaacagctcagtccagtgtgcagaccagcagtacagctgccagacgcatggaagtcaggctgttgccatcaggctgtgttattgaagaaatggagaatggctattccaaggtgacctggatggtgcatgcagcttatgatgagagagcagtgccagtgctttatcattcacttctccgctctgcaaaagcccttggtgcgtgccgctgggtagcatcactccagagacacagccagttcctttccggcctgcacaaatacatcttttgtcctgacagcacaatgacagaagtggtgatgcgaagaaaagtcctgtacctggtgaagcagatgacgagcagcttcacaggcctatttgcgtcgatgtctaaggccacgctgcaagatggtgatgatactcacttcgcgcatcagatagttggtggtgcaacaggtgaacctgccggactgctgctgagcgccaccacaaccatatggctccccggcgtgaacccgaggcacgtgtatgaccacctgcgtgatgagcagtgccatggtgaatggcgctgcctcctcggtgagcagctgcatcagggcaatgccttgccgtatggtgcccccctgaatggtgagaccgtgccagagttctatcgcatggtgaacgggctgcatgaagggcatgctatctccctgatcagccccagagaaatgggtggtaacataagcaacactctgctcctgcaagaggcaagaactgatctttctggctccctcatagtttacgccaggacagatgtgaacaccgtgcattccatcatgaacagtggcctcaaccctgccaccgtcttcctcgtatcctctggatgtgccattcttcctgattgcctggaatcattccctctacacccagctgcaactgcagatcaggccggcacctccagtgccgctatcgctagcaggagcgaaaccggtgggtcattcgtcaccgtcacttaccagatgtttttcagcagccaaggtggcgcagcacctgccagctcatcaattcatcaaggccgtgatgcgctcaagaaagccaccgacattttcaaggtggtcctcgacactctcaccgtggcatagcgcaataccccaggggtagcatttgcatgcgaaagtgaaatccagatcgagttaaatttcagtgtttaagactatgttgtttctgttgttcaggggatggctttatctctgatagacccgtggatcatgctgtttaccttgtttaccattttcagactatcgatttgaaatgttgatcagacatttataataattggaactttgag

SEQ ID NO: 5469 - DNA, 2218 bp, Oryza sativa
  Predicted polypeptide sequence is orthologous to G386, G707
gattatagccattctctccagccaccctctcgcctcctcctcctctcatcatctcccatccttcctcctcctcaactcctctcctctcttcgcttcttctctcatgctagctactactactagcttctccttctcctgtcgcacggtgcggcggaagtggtagtagtagtagctttcttggtttaagcaaggatcggcgaggacggacgccggcggcgaccgagcttggggtgtgtgtgtgtaaagttgtcttctccggcggatgagctgttgtttcttggctcgcgcctccggcgtgtccggcttgttgccttccatgtccgcgacgctgcaataattcgcttccatatttgctgccgccatgccatgtatagccgcgctgctgatgcggccctccagccgttttaatgcgtgccaaatcctctccccgaggctcataaaaattattgaattgttgggatctgaggggatccgccggagttggtaggatcacggtggagtgattttggccggaggaagaagaagaaggagaaaaactggtgtttgttttgtcgtttgtagtgagctcgcgtgatgagcttcggtggcatgttcgatggcgccggctccggcgtcttctcctacgacgccggcggcggcggcggcggcggcggagtacacaactcccgcctcctccctacgccgcccgtccccaagcccggcggcgggttcgccgctcccggcctctctctcggcctgcaaactatggacggtagccagctcggcgacgtgaaccggtcgcttgccatgatgggcaacggcgggagcggcagcggcggcgacggcgactcgctccagcgacagtgccagtatctcgcatgctgaagctggcgcagcggatgacggacaacttctgcgcgggggtgtgcgcgtcggcggcgcagaagtggcggcgcctggacgagtggcgcggcgagggtgggggcggcggcggtggcggcggcggggacggggaggacaaggtgcggatgatggcgcggcacagcgtgggcgcgccgggggagccgccgggcgtcgtgctgagcgccaccacgtcggtgcggctccccggcacgctgccgcagcgcgtgttcgactacctccgcgacgagcagcggcgcggcgactgggacatccttgccaacggcgaggccatgcaggagatggaccacatcgccaagggccagcaccacggcaatgccgtctccctcctccgtccaaatgccacaagcgggaaccagaacaacatgctgatcctccaggagacgtgcaccgactcatcgggctccctcgtcgtctacgctccggtggacgtgcagtcgatgcacgtcgtcatgaacggcggcgactccgcctacgtctccctcctcccctccggcttcgccatcctccccgacggccacaacaatggcgcctcgccgtctccggcagaggtcggcagcggcgcctcgccgaactccgccgccggtggcggtggcggtagcaacaacaccgggtcgctggtgacggtggcgttccagatactcgtcaacaacctgccgacggcgaagctcaccgtggagtccgtcgacaccgtcagcaacctcctctcctgcaccatccagaagatcaagtcggcactgcaggccagcatcatctcaccatagataagtggacatttgacgtggattccgactcgaccatttttgagtcgagtcggatgccatctcaaatgtctaacttttgaaggttagaagactgagaggacttccgcggcgggcgatggccgaccgaaactggctgatggatgcaactcaatcgttgatcaggtagagttttcgagaggcgatatgcgagcgaggataaaaataaaattaagttatatatagtgtgtggagtatatttgcatagatgagcaaattaaatggggtgagttgcagagggatcaagtcaagaacgaaccttgcgctaggcttggctcaagctgatgtggtggttcgggtattgacttagtctctggtgaaaataaacccctagggctttgatctcctatatatatctagcagtttgcttaatttaaccattttgtgaagttttttttaattctccaaaatgggggaaatatagagaaacaatactgatcagatccccaagatcgttggtgtttgtttagtttgcataatgttggaatgagttgatatataaacatgtttattttggc

SEQ ID NO: 5470 - DNA, 663 bp, Oryza sativa
  Predicted polypeptide sequence is orthologous to G386, G707
gggtcgacccacgcgtcgagccgctccggctagcgacaactggacggcgcctccggcgacgaactcgacccggacaacagcaacccgcgcaagaagaagaagcgttatcaccgccacaccccggagcagatccaagaactcgaagccgtgttcaaggagtgtccacatcctgacgagaagcaacggatggagctcagccggcggctcaacctcgagagccgccaggtcaagttctggttccagaatcgccgcacccagatgaagacgcagatcgagcggcatgagaacgcgctgctgcggcaggagaacgacaagctgagggcggagaacatgacgatccgggaggcgatgaggaacccgatgtgcgcgagctgcggcggcgcggcggtgctcggcgaggtgtcgctggaggagcagcacctgcgcatcgagaacgcgcggctcaaggacgagctcgaccgcgtctgcgcgctcgccggcaagttcctcggccggccaatctcgagcatctcctccccgggcccgccgtcgctgcaggcgtgctccggcctcgagctcggcgtcggcagcaacggcgggttcgggctcggcgcgctcggggcctcggcggcgatgcagtccatccccgatctgatgggcggctcctcgggctgacgggggggc

SEQ ID NO: 5471 - DNA, 402 bp, Oryza sativa
  Predicted polypeptide sequence is orthologous to G388
aggaagaactaccacaggcacaccgccgaacaaatcaggatcatggaagcgctattcaaagagtccccacatccggatgagaggcagcggcagcaggtcagtaagcagctcggcctctctgcacgccaggtcaagttctggtttcagaaccgacgaactcagatcaaggagcgacacgagaactcgctgctcaagtccgagctggagaagctccaggacgagcaccgcgcgatgagagagctcgccaagaagccatctcgctgcctaaactgcggcgtcgtggcaacctccagcgacgccgccgccgccgccacggcggcggacacccgtgaacagcggctgcgactcgagaaagccaagctcaaagctgaggtttgtatgccgccgccgcgaagccgcgcc

SEQ ID NO: 5472 - DNA, 2340 bp, Oryza sativa
  Predicted polypeptide sequence is orthologous to G388
atggggaccaaccggccgcggccacgaaccaaggacttcttcgcagctccggcgctctccctcacactggcaggcgtgttcggccggaaaaatggacctgcggcgtcgggtggagacggggtggaggaaggcgacgaggaggtgcaggctgcaggcgaggcggcggtggagatcagcagcgagaacgcggggccggggtgtagacagtcccagtccggcggtggctccggggaagacggcggccatgacgacgacgacggagagggtagtaataagaagaggaggaggaagaactaccacaggcacaccgccgaacaaatcaggatcatggaagcgctattcaaagagtccccacatccggatgagaggcagcggcagcaggtcagtaagcagctcggcctctctgcacgccaggtcaagttctggtttcagaaccgacgaactcagatcaaggcggttcaggagcgacacgagaactcgctgctcaagtccgagctggagaagctccaggacgagcaccgcgcgatgagagagctcgccaagaagccatctcgctgcctaaactgcggcgtcgtggcaacctccagcgacgccgccgccgccgccacggcggcggacacccgtgaacagcggctgcgactcgagaaagccaagctcaaagctgagatagagaggctgcgagggacgccaggaaagtccgccgccgatggaatcgcctcgccgccgtgctccgcgtccgcgggcgccatgcagacgaacagcaggagcccgccgttgcacgaccacgacggcggcttcttacgccacgacgacgacaagccgaggatcttggagctggccacccgtgcgctggacgagctggttgggatgtgctcctccggcgagcctgtgtgggtgcggggcgtcgagaccggcagggacattctgaactacgacgagtacgtgcgcttgttccgccgcgaccacggtggttccggcgatcagatggccggctggacggttgaggcttccagggaatgtggactagtttaccttgacacgatgcatcttgtgcacactttcatggacgtggacaagtggaaggacctattccctaccatgatctcaaaggcagcgacgctggaaatgatcagcaaccgcgaagacgatggccgagacggcgtcctgcaactgatgtatgcagagcttcagacactgacaccaatggtgcccacgagggagttatacttcgcccgctactgcaagaagctggccgcggagagatgggcgatcgtcgacgtgtccttcgacgagtctgagactggcgtccacgcgtcgtcggcggtcaggtgctggaagaacccatccggctgcctcatcgaagagcagaacaacggccggtgcaagatgacctgggtggagcacaccagatgccgccggtgcacggtcgcgccgttgtaccgggcggtcaccgcgagcggcgtggcgttcggcgcgagacgctgggtggccgcgctccagctccagtgcgagaggatggtcttcgccgtggcgaccaacgttccaacgagggactcgaccggggtctccacgctcgcgggcaggaggagcgttctgaaactggcgcaccggatgacgtcgagcctctgccgcaccaccggtggatcgtgtgacatggcgtggcgcagggcgccgaaaggaggcagcggcggcggtggcgacgacgacatctggctgacgtcccgggagaacgccggcgacgaccctggcgagccgcaggggctgatcgcgtgcgccgcggcgtcgacgtggctgccggtgaatccgacggctctcctcgacttactgagggatgaatcacggcgaccagagtgggacgtgatgctacccggaaaatctgttcagagccgcgtgaatcttgcaaaggggaaggaccgtaccaactgcgccgctcgaccggaagaagaagaagagagaggcggcaagtgggtcctccaggacgtctgcaccaacccctgcgagtcgacgatcgcgtacgcggcgatcgacgccgccgcgctgcagccggtcatcgccgggcacgactcgagcggcgtgcacctcctgccgtgcggattcatctcggtgatgccggacgggctcgagtccaagccggcggtgatcacggcgtcgaggaggggaggcgaggcttcgggggccggatcgctggttaccgtggcgttccaggtcccggccagcccgtcggcggcggcggccacgctctcgccggactcggtggaggccgtgacggtcctggtctcctccactctgcgtaacatcaggaaagccttggggtgcgactcgtgcgaggaggaattctag

SEQ ID NO: 5473 - DNA, 739 bp, Oryza sativa
  Predicted polypeptide sequence is orthologous to G390, G391, G438
aaagatcaatcaaatagaagtcttgttcaagcttttaaacaacctttaataaggccagtcccttaaaaacggaaatgaaacagacatgtgaaacaatgaggatgcaaaggagccatttcaacaaaggtacaccaatgagctccttccacttcaacaaagcaaaaaaaaaaaaggaatctttcaaatagcaaagaaacaaaaaaaaactccttggaggaggatcacaacatgaactggatcagtagttcatccatttttttgtaggaagtaaacaaattcagctagagcatacaacatagttctgaattttcttacacgtcgtactatattatccccaaaattaagcatagtaagcacgtactaaacacatctatacagtaggtaggctcgggttaaagatgtaccagtggatagcaaacattctatatatgctacagagctcgcctatgtcactctttcatcctcttcttgtcaaacatttgtaggcttctgttttgggaaccaaaccttgatcttctgcttgggctcgatgttggcgaggatggataactcgcaaagtaactgctggcggcgagagaatctgggcttggggcactcggcgtacacccgctccagcgcctccacctgacccggcgtgtagtgcacgtacttgccggagtccatcccggccttgtcgtacccgctgccgtcactgccgctgccgctccgcatcgggcatcgccaccgctgccgccatcct

SEQ ID NO: 5474 - DNA, 737 bp, Oryza sativa
  Predicted polypeptide sequence is orthologous to G390, G391, G438
ctttttattacaggatacttccttgattatataaaggttgccctattatgcaagaaaggaagcaaaacaaataaatacatagacttgcaattcctaaatatagttgaagcagagtatgcacaaccaaggcaaacaattgaacactactattgctattgctccattgtcaaccaatttgtccagaacatttcacagccagacacacagaaggcaaaccagtttgatagtatatccctgcatgcttttgctcaccttctgttttgggaaccagaccttgatcttctgcttgggctcgatgttggcgactgctggcggcgacagaagctgggcttggggcactcggcgtacacccgctccagcgcctccacctgatccggcgtgtactgcacgtacttgccggagtccatcccggccttgtcgtacccgccgccgtcactgccgctgccgccatcctcctctccggccaccaccaccaccaaagtttcccccttcgccgcctcctcctctcctctccgtcaggggatgcgtcgacctcggcggcgacggtcatggtgttccgcgtagagaggagaggtcgagagttgagaggggaacagttgggaagctgcggaggagaggacggagaggcaacgcggcgacgggggaagacgtatggcagtcctgcgccggcggccggtccgacgccgccatgagggaagggcatcggcggcagacgcgcggccggctctgccgccaac

SEQ ID NO: 5475 - DNA, 3082 bp, Oryza sativa
  Predicted polypeptide sequence is orthologous to G390, G391, G438
ggcttcccctgtccaccactattaaaccaacccccaccccttctctctcctcctctaccgtccttcccttcttctctctcgctacctttcccttcccacctcctcctcctcctcctcaccaccaccacgcgcctccgctcgcaagaagcacctccgaccgccatggcgcgcgcgggagctggcggcagtctctccctggaggcatgacgcggcggcgcccgtggccgtggctcctgttgctactactgcgaccaactactgcgctcggtcggcggtggtggtggccctggtcgtcgtcgtagcgcgtcggcggaggcgggagaagaaggagaagggtcgacggggatggcggcggcgatggtggcggcggtgcatggagtggggaggcaggacaggtcgtcgcctggcggcggaggggcgccgcaagtggacacgggcaagtacgtgcgctacaccccggagcaggtggaggcgctggagcgggtctacggcgagtgccccaagcccagctcgctccgccgccagcagctcatccgcgagtgccccatactcagcaacatcgagcccaagcagatcaaggtctggttccagaaccgcaggtgccgcgagaagcagcgcaaggaggcatctcgcctgcaaactgtgaaccggaagttgactgcgatgaacaagctgttgatggaggagaatgacaggctgcagaagcaggtgtcccgcctcgtttacgagaacgggtacatgcggcagcagctccataatccttctgtggcaactacagacacgagctgtgagtctgtggttacaagtggtcaacaccaccaacagcaaaacccagcagccacgcgtccgcaaagggacgcgaacaacccagctggtctactcgctatagctgaggagaccttggcagagttcctgtcgaaagcgacgggtactgctgtcgattgggtgcaaatggttgggatgaagcctggtccggattccattggaatcatcgctgtttcgcacaattgtagtggcgtagcagcacgagcttgcggccttgtgagccttgagcccacaaaggttgctgagatccttaaggatcgcccatcttggtatcgcgattgccggtgtgtggatgtgctccatgttatccctacgggtaatggtggaactattgagcttatctacatgcagacttatgcaccgacaactttggcggcaccacgtgacttctggatactccgttacactagtggtcttgaggatggaagtcttgtgatctgtgagagatcattgactcaatccactggtggcccatcaggacctaacactccaaactttgtcagagccgaggtgcttcctagcggctatttgatccgcccatgtgaggggggtggttccatgattcacattgtggatcatgttgatttggatgcttggagtgtgcctgaggtccttagaccactttatgaatctcctaagatccttgcgcagaagatgacaattgctgcactgcgtcacattaggcaaattgcacatgaatcaagtggggaaatgccctatggagggggccgtcagccagcagttctgagaacatttagtcagaggctaagcagaggcttcaatgatgctgtcaatggattcccggatgatggctggtcactgatgagcagcgatggtgctgaggatgtgacaattgcttttaactcatctccaaacaagcttgttggatctcatgtcaactcctcccagctgttttctgcaattggaggcggcatcttgtgtgcaaaggcatctatgctgttacagaatgtaccacctgctctcctagtgcgatttttgagggagcaccgctctgaatgggctgatcctggtgttgatgcttattctgctgctgcgttgagggctagtccatatgcagttcctggtctgcgagctggtggttttatgggcagtcaggttatattgccacttgcgcacaccttagagcatgaagagttcctggaggtcattaggcttgagggacacagcctctgccatgatgaggtcgttctatcaagagatatgtaccttctgcagctgtgcagcggtgtagatgaaaatgctgcgggtgcatgtgcccagcttgtctttgcacccattgacgaatcttttgctgatgatgcaccactgctaccctcaggcttccgtgtgataccactggatggcaagacggatgcaccatctgcgacacgcacacttgacctggcatctactcttgaggttggatcgggtgggactacacgggcttctagtgacacctcgagcacctgcaacacaagatcggtcctgaccatagctttccaattctcatatgaaaaccaccttcgtgaaagcgtagcggcaatggccaggcagtatgtccggaccgtggtggcatcagtgcagagagtggccatggcaatagctccttcacgtcttggtggacagattgaaacaaagaaccctccaggatctcctgaggcccatacgcttgcaaggtggattgggaggagctaccgattccacactggagcggatctccttcgcacagactcacaaagcacggattcttccttgaaagcaatgtggcaacactctgattcaatcatgtgctgctccctgaaggctgctcctgtgttcaccttcgccaaccaagccggcctcgacatgctggagacgacgctgattgctctccaggacatctcgctcgagaagatccttgatgatgatggccggaaggcactatgtacagagttccccaagatcatgcagcagggtttcgcctacctcccgggcggcgtgtgcgtgtcgagcatggggcggccggtgtcgtacgagcaggcggtggcgtggaaggtcctgagcgacgacgacacgccgcactgcctcgccttcatgttcgtcaactggtcattcgtctgagaaccaccctagtagaatcgatcccccctcttgtttgtctgtcctaaagaccttatgtagtattgcttttgtgtatcatcaccatgaacatgtcaagaacctccccagtttctatcatcatgaacttccgtttgaatctagtactgctaaatgatct

SEQ ID NO: 5476 - DNA, 3227 bp, Oryza sativa
  Predicted polypeptide sequence is orthologous to G390, G391, G438
gctgctcctcctcctcctcctctctctctctctctctctctcccgtgctgtgattgctgcctcggggtgggcggtgcgagctacatacagcacaccggcggcggcggcggcggcggcgaggctccgggagaggtccagctaggcgtggtgggtggtggtttcttgatttcttgtgtttgggctgtgtcggcggcgggtgatggcggcggcggctccgtgcgccggagcgcggggcggctaggggcggctgtttctctgaggcgtctctcccccggcggcggcggtggaggtttgttgttgttgtgttgaaggcggagaagaggggaggctttggtggtggtggaggaggaggatggcggcggcggtggcgatgcggagcggcagcggcagcgacggcggcggcggcgggtacgacaaggccgggatggactccggcaagtacgtgcggtacacgccggagcaggtggaggcgctggagagggtgtacgccgagtgccccaagcccagctcctcccgccgccagcagctgctccgcgactgtcccatcctcgccaacatcgagcccaagcagatcaaggtctggttccagaacagaaggtgccgagataagcagcggaaggaggcatcaaggcttcaggccgtgaaccgaaaattgacggcgatgaataagcttctcatggaggagaatgagcgtcttcagaagcaggtctcccagctggtccatgagaacgcgtacatgaagcagcaacttcagaatccgtcattgggcaatgatacaagctgtgaatcaaatgtgaccactcttcagaaccctctgagagatgcaagtaacccgtctggactccttacaattgcggaggagaccctgacagagttcctctccaaggctacagggactgctgttgattgggtgccaatgcctgggatgaagcctggtccggattcgtttggtattgtggccgtttcacatggttgccgtggtgttgctgcccgtgcctgtggtttggtgaatctagaaccaacaaagatcgtggagatcttaaaagaccgcccatcttggttccgtgattgtcgaagtcttgaagtcttcacaatgtttccagctggaaatggtggcacgatcgaacttgtttacatgcagatgtatgctcctactactttggttcctgcacgagatttttggacacttagatacacaactacaatggaggatggcagccttgtggtctgtgagagatcattgagtggttctggaggtggtccaagtacagcctccgcacagcaatttgtaagagctgagatgcttactagcggctatctagtgcgcccatgcgagggtggtggctccatcgtgcatattgtggaccatctggatcttgaggcttggagtgttccagaagtgcttcggccactctacgagtcatctagggtagttgctcagaaaatgactactgcagcactacggcacatcagacaaattgctcaagagacaagcggggaggttgtatacgctttggggaggcaacctgctgttttgcggacatttagtcagaggttgagtagaggcttcaatgatgctataagtggtttcaatgatgatggttggtctgtcatgggtggggatggcattgaagatgtgatcattgcttgcaatgcaaggaaggttaggaatactagcacttcggccaatgcttttgtaactccaggaggtgttatatgtgctaaggcatccatgctactgcagagtgtcccacctgcagttttggttcgatttttgagggaacatcgttctgaatgggcggattataacttcgatgcatattcagcttcatctctgaagacaagctcatgttcacttcctgggttgcggcctatgagattttctgggagccagatcattatgccacttgctcacacggtggagaatgaggagattttagaagttgtccgtcttgaaggacaagcacttacacatgatgatggtcttatgtctagagatattcacctgcttcagctttgcactggaatagatgagaaatcaatgggatcctgcttccagcttgtctctgcaccaatcgatgagcttttccctgatgatgctcagttaatatcttcaggctttcgtgttataccgctgaacatgaaaacagatggtacacctgctggtagaacattagatttggcatctagccttgaagttggttcaactgcacagcccacaggggatgcatctatggatgactgtaatctacgatcagtgctgacaattgcctttcagttcccttatgaaatgcatctccaagacagcgttgcaactatggcccggcaatatgtccgcagtattgtttcctctgttcagagagtatcaatggctatttctccttctcggtctggcttgaatgctgggcagaagataatttcaggcttccctgaagccccaacgctagctcgttggatttgccaaagctaccagttccatttgggggtggagttacttaggcaggcagatgatgctggggaagcactattgaaaatgctatgggattacgaagacgctattttgtgctgttctttcaaggaaaagcctgtgtttacttttgccaacgagatgggactaaacatgctagaaacatctctcgtcgctctccaagatctctcactggacaagatatttgatgaagccggtaggaaggccctatacaacgagatcccgaaattgatggaacagggttacgtgtacctgcctggtggagtgtgcttgtccgggatggggcgccatgtttctttcgagcaagctgtagcatggaaggtgctcggagaagacaacaatgtgcactgcctcgccttctgcttcgtcaactggtccttcgtgtgacccaaaatccaatccaccatgctcgcagtcatcgtcgttgtcgtcagatctccattttttgcaatctctgtagaagagaggacaccaaaccaaccacaaacctgtcagctgttagctaatgattctactagcttttctagatctttgaaggcaaaatgctgccggtgcctgtaaagagtgtgtgcgtgcgtgtgtaaatttgggcgcgttttgcactaatttgatctggggtaaggaggcgctggctgctgctgtgctgtagtttggtaaaagttgagtacactaaccttggatggtctcgaactgtatgatgaaattcctagcagtaaaatttcaacttggatccgtgagg

SEQ ID NO: 5477 - DNA, 3252 bp, Oryza sativa
  Predicted polypeptide sequence is orthologous to G390, G391, G438
ctctctcccgtgctgctctcccttctcctctcctcaattaccacgccgcagccgcagccccccaaccctagctagtacggcgggcgacctgagggggtagctgcctacctctatacctgctatctccgttcgatccgggtcgggctcgtgctgctgggggcgggggcaatcaatcggcgagctcggtgatccatggccgtggctgtggggtggctgtgagggtgcccccggcggcgctcccctccgcgcctgccggcgagggggctcggactgaagggatctaggcgagctgaaaattgaagtgcaggcaaggagataagagcagcgtccaaattgtgagtacttcattagcaggaggtagtggttgtgcttgcttggctcctttgcaatttggctttggcgaggtagcaatggctgcggcagtggcaatgcgagggagtagcagtgatggaggtggctatgataaggtttccgggatggactccggtaaatatgtgcgctacacgcctgagcaggtggaggcgcttgagcgggtgtacgccgattgccccaagccaacctcctcccgcaggcagcaactgctgcgtgagtgccccatacttgctaacattgagcccaagcagatcaaggtctggttccagaacagaaggtgccgggataagcagcggaaggagtcttcacggcttcaggctgtcaacaggaaattgacggcaatgaacaagctacttatggaagagaatgagcgactccagaagcaggtctcccaattggttcatgagaatgcccacatgcgacagcagctgcagaatactccgctggcaaatgatacaagctgtgaatcaaatgtgactacccctcaaaaccctttaagggatgcaagtaacccctctgggctcctttcaattgcagaggagaccttgacagagttcctctcaaaggctactggtacagctattgattgggtccagatgcctgggatgaagcctggtccggattcggttggtattgtggccatttcacatggttgccgtggtgttgctgcccgtgcctgtggtttggtgaacctagaaccaacaaaagtggtagagatattgaaagatcgtccatcttggttccgtgattgtcgaaacctggaagtctttacaatgattccagcaggaaatggaggaacggttgaacttgtctacacacagttgtatgctccaacaactttagttcctgcacgagatttttggacgttacggtacacaaccacaatggaagatggcagtcttgtggtctgtgagagatctttaagtggttcagggggcggtccaagtgctgcctctgctcagcaatatgtgagagcggaaatgcttccaagtggatacctggttcgcccatgtgaaggtgggggatcaattgtgcacatagtggaccatctggatcttgaggcatggagtgttcctgaggtgcttcggccactctatgaatcttcaagggtagtcgctcagaaaatgactactgcggcactccggcacatcagacaaattgctcaagaaacaagtggggaagtggtgtatgccttggggaggcaaccagcagtgctacggacttttagtcaaaggctgagcagaggctttaacgatgccattagtggtttcaatgatgatgggtggtctataatgggcggagacggtgttgaagatgtagttattgcttgcaactcaactaagaaaattaggagtaacagcaatgctggcatcgcctttggagcccccggaggtattatatgtgctaaggcatcaatgttactgcagagtgttcctccagcagtactggttcgatttctgagggagcatagatctgaatgggccgattacaatattgatgcatatttggcttcaactctgaaaacaagtgcatgttcacttactgggttgcgacccatgagattttctgggagccaaatcatcattccacttgctcacacagttgagaatgaggagattcttgaagttgttcgccttgagggtcaacctcttactcatgatgaagctcttctttcaagggatatccacctgcttcagctctgcactggaatagacgagaagtctgtgggatcctcctttcagcttgtgtttgcaccgattgatgatttcccagatgaaactccattgatttcttctggcttccgtgttataccacttgatatgaaaacagatggtgcatcctctggtaggacattagatttggcatctagtcttgaagtaggttcagcaacagctcaagcctccggagatgcatctgcagatgattgtaacttgcgatctgttctgacgatcgcttttcaattcccttacgagttgcatctccaagacagtgttgcagctatggctcgccaatatgtccgtagcattgtttctgctgtgcaaagagtgtcaatggctatctctccctctcaaactggtctaaatgccggacagaggataatctctggtttccctgaagcagcaacccttgctcgatgggtttgccagagctaccattaccatctaggggtagagttacttagtcaatcagatggagatgcagaacaattgttgaagatgctatggcattaccaagatgctattttgtgctgctcattcaaggaaaaaccggtgtttacatttgccaacaaagcaggactggacatgctagaaacttcccttgtcgccttacaggacctcacattggacaggatctttgatgagcctggaaaagaagcattgttctcaaacattcccaaattgatggagcagggccatgtctacctgccatcaggcgtgtgcatgtcaggaatgggtcggcatgtttctttcgatcaggccgtggcttggaaagtgcttgccgaggatagcaatgttcactgcctggccttctgtttcgtcaactggtcctttgtgtgaccatcccacatccactgcgaagtgaagattcatttttgcttgttcaagactgttttgcactagatctagacctgagaatctagtagtatttgcgaaatttctcgcttatgtaaatgtaatctcgctcccattccatcaagtacccaagtacaaggcagtggccaagtggttttagttgtagggggatcggagcaatcctgacggttgggtacttgggttccttccagcaatgtaaaatcggatcctgtagggcgtcgaaaactgcattggcaagattcttcgaaatgcagaccaaatttagctagtacatcgtaactttggc

SEQ ID NO: 5478 - DNA, 3140 bp, Oryza sativa
  Predicted polypeptide sequence is orthologous to G390, G391, G438
ggaagaccagagagaagacgagaggcgatcgcagtggagtggagtgaagtactagcagtattaaaaccagcagcaagcgagagagaggccaccaaccacttcctcctccaagaaaccacccccaccacgagcacgagcacgagcaaccatggcggtggcagagggagctgcgactgcgagctacgggccatgactgcggcgagttcttgctgggttgttgttgtacaagcagcgacgaggaggaggggagcagaggaggaggaggcggagggatggcagcggcggcggtggggggaaggggggagaggctgtcgtcctcctccccgacggcggcggcgccgcaggtggacgccgggaagtacgtccggtacacgcccgagcaggtggaggcgctggagcgggtgtacaccgagtgccccaagcccagctcactccgccgccagcagctcatccgggagtgccccatcctcagcaacatcgagcccaagcagatcaaggtctggtttcagaatcgcagatgccgggagaagcagcgcaaggaggcctcccggctgcaaactgtgaaccggaagctgaatgcgatgaacaagctgttgatggaggaaaatgaccggctgcagaagcaggtgtcccgtctcgtctacgagaacggctacatgcggactcaactgcacaatccttctgcagccaccacagatacaagctgtgagtctgtggtgacaagtggtcagcaccatcaacagcaaaacccagcagttctgcatccgcaaagggatgcgaacaacccagcaggtcttctcgctattgctgaggagaccttggcagagttcatgtcgaaggcgacaggaactgctgtcgaatgggtgcaaatggttgggatgaagcctggtccggattccattggaatcatcactgtttcgcacaattgcagtggcgtagcagcacgagcttgcggcctggtgagccttgagcccacaaaggttgcagagatcctcaaggatcgcccctcttggtaccgtgattgccgatgcgtagatatcatccatgttatccctacgggtaacggcggaaccattgagctaatctacatgcagacacatgcaccgacaactttggcggcaccacgcgacttttggactctccgctacacaagtggacttgaagatgggagtcttgtgatctgtgaaaggtcattgactcagtccactggtggcccatctgggcctaacactctgaattttatcagagccgaggtacttcccagtggttatctgattcgaccatgtgagggaggtggctccatgatttacattgttgatcatgttgatttggatgcttggagtgtgcctgaggttcttcgaccgctctatgaatctccaaagatccttgcacagaagatgaccattgcagcattgcgacacattaggcaaattgcgcatgagtcaagcggtgaaatcccctacggtgctggtcgccagcccgctgttttcaggaccttcagtcaaaggctcagcagaggtttcaatgatgctgttagtggatttccagatgatgggtggtctttgttgagcagtgatggtagtgaggacattacaatttcagtaaactcgtctccaaacaagcttgttggatcccatgtcagcccgaaccctctgttttctactgttggaggtggcatcttgtgcgcaaaggcatcaatgctacttcagaatgtacctcctgctctacttgtgcgatttctgagggagcatcgttctgaatgggctgatcctggtgttgatgcttattctgctgcttctttgcgagccagcccatatgcagttccaggcttaaggaccagcgggtttatgggcagtcaggttatactacccctcgctcataccttagagcatgaagagttcttggaggttattaggctcgaaggacatggtttcagccatgatgaggtgcttctatcacgggatatgtaccttctacagctttgcagcggggttgatgagaatgctactagtgcatctgcacagcttgtctttgctcctattgacgaatcttttgctgatgatgcaccacttttaccctcaggattccgtgtgataccactagatacaaaaatggatgggccatctgcaacacgcacgctcgaccttgcatccgcccttgaggttggaccaggtggagcttcgcgtgcttcagttgaagcatctggcacatgtaacagatcagtcctgaccattgctttccaattctcatacgagaaccaccttcgtgagagcgtggcggcaatggctaggagttatgtcagagctgtgatggcatccgtgcagagggtggctgtggcaatagctccttctcgacttggaccccagatcggaatgaagcaccctccagcctctcctgaggcgcttacacttgctagctggattggtaggagctatagggctcacaccggagcagatatccgttggtctgataccgaagatgccgattctcccctggcgctcctgtggaagcacagcgacgcaatactgtgctgttctctgaagcctgctcctatgttcaccttcgccaacaatgccggcctcgacatccttgagacgacgctggtcaacctccaggacatctcgctcgagatgatcctggatgacgagggccggaaggcgctgtgctcggagttccccaagatcatgcagcagggtttcacctatctccctggaggcgtctgcaagtcgagcatggggcggcaggcatcgtatgagcaggcggtggcgtggaaggttcttagcgacgacgacgcgccgcactgcctcgccttcatgctcgtcaactggaccttcatgtgatccaccatccatggtttccagcttccagctagtgcttttgcttttgtgccattgtggcaaactgaacaaagacctgaataccaccaccgtattgtattaaacatatgcgtccatacatgcatggtgcttgctttatcctagctagtgctagcacctgtgtgtatggtctctccatgtttgaagcttaaaattttagaaccctggtttttttttttttctgctgctgtgtggatgaacaagtttcaggacctatgtatctctatctatctatgctaatgctatgaattgtgtgatgtgtgt

SEQ ID NO: 5479 - DNA, 2349 bp, Oryza sativa
  Predicted polypeptide sequence is orthologous to G390, G391, G438
gaacatctctctgcccaatcctcctcccggccaatccgccatccccatccccggccaatccatgcggcctcctcctcccggccgggggcaaggacggcgccggcgtttacaaagacgacggagcaaggggacgacaacattgccgccctccaccatgcctcctgtgctgccctcctctaccatgatggcctcctcgaccttgtggttgcgtccacggggggagggaggaggcggcacccgcccgagctgccgccggtgctcccctcctccttctccatccacttgtggtgacggcggcggcgggtggagggacgcccgctgaatccgccaccggttctccttccctccttgttctccctccacttaggccggcggcggcggtggtggcggggggagggcagatccggcgcccgacgccggcggatccgccgtcgtgccccctcccttcccttgtggcggcagtggcgagggtacctacgttggcggcagagccggctgcgcgtctgccgccgatgcccttccctcatggcggcgtcggaccggccgcctgcgcaggactgccgtacgtcttcccccgtcgccgcgttgcctctccgtcctctcctccgcagcttcccaaccgttcccctctcaactctcgacctctcctctctacgtggaacaccatgaccgtcgccgccgaggtcgacgcatcccctgacggagaggagaggaggaagcaagcttgcaatcgcacaaccatctatcgatttctcccttccttctctttcttctttctttctttcgtttccccctctcacatgtcaggttattttttctcctcatcctctccggatgatttcacttttgctcgaaatctctcaggttgttgttgtgttgaaggtggcgaagggggaaactttggtggtggtggtggccggagtggaggatggcggcagcggtggcgatgcccgatgcggagcggcagcggcagtgacggcagcgggtacgacaaggccgggatggactccggcaagtacgtgcactacacgccgggtcaggtggaggcgctggagcgggtgtacgccgagtgccccaagcccagattctctcgccgccagcagttactctgcgagttatccatcctcgccaacatcgagcccaagcagaagatcaaggtctggttcccaaaacagaaggtgagcaaaagcatgcagggatatactatcaaactggtttgccttttgtgtgtctggctgtgaaatgttctggacaaattggttgacaatggagcaatagcaatagtagtgttcaattgtttgccttggttgtgcatactctgcttcaactatatttaggaattgcaagtctatgtatttatttgttttgcttcctttcttgcataatggaacaacctttatataatcaaggaagaatactgtacttaccagagtatgtgccagattaagccatccattaattagatgctgaagtaaactatatgactatattgcgatgtattctaattccactacttacaaaactgtagggtataagatttgcttatttttagaagataggctaaacgagggtcatttaggtcacatggccaaactaagacacatatacataacgtattatcatgcatctgatagtaatgcaaaacaatgcagtactatttactttcactgcaggtatttaggctctatcttttatttttctcaagaggcacttaacatgatatacaaaatttgaagagttacattttttaaaaaacttctatgagttctgcctaaatgattgttatccatggtgtgcctaaataattgttcgatctagaggtgatccaaagattcgtctatattagacgtaacaataatgcagtgttttttttgtttattttttagcctacaaatgtttgacaagaagaggatgaaagagtgacataggcgagctctgtagcatatatagaatgtttgctatccactggtacatctttaacccgagcctacctactgtatagatgtgtttagtacgtgcttactatgcttaattttggggataatatagtacgacgtgtaagaaaattcagaactatgttgtatgctctagctgaatttgtttacttcctacaaaaaaatggatgaactactgatccagttcatgttgtgatcctcctccaaggagtttttttttgtttctttgctatctgaaagattccttttttttttttgctttgttgaagtggaaggagctcattggtgtacctttgttgaaatggctcctttgcatcctcattgtttcacatgtctgtttcatttccgtttttaagggactggccttattaaaggttgtttaaaagcttgaacg

SEQ ID NO: 5480 - DNA, 2914 bp, Oryza sativa
  Predicted polypeptide sequence is orthologous to G390, G391, G438
ggtccctcccgtcccccgtctcgccctctccctctccttctcccgcctcgcgtcgccgccgccgccgccgccccgcgcgccgcccctcctccctctccctcagccatcctcctcctccgccgccggtccattctccgcccttcaccgcctccgttgccggccaccactgcccccgtccacgcctcgcgtcgccgcccccatccccgtccccgccccgtcgctagggtttcgtcacgagcgacctcccgccgtggaagcttccaccttcctcctcatccttgtcctcacggccgcggcgttcgcggcgtaggcggcgggggacgggtgcagcgccggatgcgagctcgcgctggcctcctcatcctcgagcgcctccaccccaatactttcttcgtcctcgcctcgtcgcgtcgctctgtcttctcccctccctgcctcttcggttgatgtcttcatttcttcccctttcgtgcgaatgggaccaacggcggatcaagcgagggcgccgcagatcgactggcggcacagcttctccccatcctttggtgctgcattgctggtatcatcgtcgtgtttcccgctgttggtgcgtgtctcacggagaaagaatggattggagtaaatcagcagcggtgtggattgtgctctgacctcggcaggggcggatacaagaacacagcgatgagatccggtgcggtttgtggcggaccaagcatgtcggccgatggagatggttctctgcatctacgcattccccaccaacatgccgcccttcagtgattgttggggccaaacctatggtggctagtcgctgaggtggtgtcattaatggaggcaaagagtggcaagtggtgaccaaagcggaaggacctggtgtgttgcgcgtgcgccggccactggcggtgcgaggccacggcgacggtcatgctgccattatccaaggcagtgacagcatgtattgacgaacgcaatgtgcttgctggccgaatagacatgaacacatatcactgagagggagtgaaacagtgttgacgagtagcctgcttttgggtgatagaaatagcattgtagtagggtggtaatagcaagaagccgaaaggtaaggatcaggctataacgttggggcattggcaactcaattaaaaggggtagggtagttgtctggttgttcatgttctgatttaactcattagtgttgtgctaaatggaaggtcaagctgctctacatgcaggcaagaacagacaagcctgaaaatttttgtggcaaattcttagctcaacctgaaattccgaagctgaaatctgtattcagtcttcaactctatgctccgacgacgctggcgccggctcacgacttctggctgctgcggtgtgtgagagatcactcagtagcaagcaaggaggcccaagcatgccacttgtccagccttttatcagagatgagatgcttcccagtgggttcttgatccgacctagcgatggtggaggcagcgtgatacacatcgttgatcatatggacctggagccttggagcgtgcctgaagttgtgcgacctctgtatgaatcttctgccttggttgcgcagaagatatcgatggcggttgcctacaaagatacccgttctgtgatcacaggatggggaaggaagcttgcggctttgcatgctctgagccaaaaagctcaccacaggcttcaatgaagttctcaatgggcttgcggatgatggatggtccgtgatcgagagcgatggcatcgacgatgtttgcatctctgtcaattcatccaaagtgaccggttgcaatgcaacattcagcagtggactcactattgtcagtaccggtgttctttgtgccaaggcatccatgctgttgcaggatgtctctcctccatcactactgcaatttttgcgcgaacaccagtcacaatgggctgacggtgaaaccaaacttctgcaatttacccatgtctcgtcttggaggattcagtggtcaggtcatacttcctttagcacacacttttgaacctgcagagttcctggaagttatcaagctaggaaacaccagaaactaccaagatacactggtgcagatcgatcaccggcgacgagagacactctcactgaacgaagctacctagcttaattacctagctactcgatcgatcatcagtctagatatggcggctttgaacggtaaggtggtggtggcggtgatggtggtggcgatggtggtggcggcgccgggggcgtcggcggcgatcacgtgcgggcaggtggggtcggcgatcgcgccgtgcatctcgtacgtgacggggaggggcggcctcacccagggatgctgcaacggcgtcaaggggctgaacaacgccgcccgcaccaccgccgaccgccaggccgcctgccggtgcctcaagaccctcgccggcaccatcaagtctctcaacctcggcgccgccgccggcatccccggcaagtgcggcgtcaacgtcggcttccccatcagcctctccactgactgcagcaaggtcagctagatcgattaatcctgcttggaccgaccgatcgatatatcgatcgatgctggctcgcagttgatcaactagccaaaataatagctacagtaaaaataacagctggggcatatcaatgcagcgctggtcatctctctctctatctctgtatactttatgttgcacgctccgtgcgtgcatgctatcttaattttcttgactctgtacaccgctctgtgtacgtgtaatcctacgttgatgaattgcatcttgtccagacttggacctagctaactacgtactccagcttggcagcttcttgccgaggcaatctgtagtaatttccttgttacattcccctgtcccctctactccctctatcccataaaaacaaacctaatatact

SEQ ID NO: 5481 - DNA, 1149 bp, Oryza sativa
  Predicted polypeptide sequence is orthologous to G390, G391, G438
gtgctgacctcctctaccgtgatggcctcctcgaccttgtggttgcgtccacggggggagggaggaggcggcacccgcccgagctgccgccggtgctcccctcctccttctccatccacttgtggtgacggcggcggtggcggcggggggagggcagatccggcgcccgacgccggcggatccgccgtcgtgccccctcccttcccttgtggcggcagtggcgaaggtacctacgttggcggcagagccggccgcgcgtctgccgccgatgcccttccctcatggcggcgtcggaccggccgccggcgcaggactgccatacgtcttcccccgtcgccgcgttgcctctccgtcctctcctccgcagcttcccaactgttcccctctcaactctcgacctctcctctctacgcggaacaccatgaccgtcgccgccgaggtcgacgcatcccctgacggagaggagaggaggaggcaagcttgcaatcgcacaaccatctatcgatttctcccttccttctctttcttctttctttctttctttcgtttccccctctcacatgtcaggttattttttctcctcatcctctccggatgatttcacttttgctcgaaatctctcatgttgttgtgttgaaggcggcgaagggggaaactttggtggtggtggtggccggagaggaggatggcggcagcggcagtgacggcggcgggtacgacaaggccgggatggactccggcaagtacgtgcagtacacgccggatcaggtggaggcgctggagcgggtgtacgccgagtgccccaagcccagcttctgtcgccgccagcagtcgccaacatcgagcccaagcagaagatcaaggtctggttcccaaaacagaagcctacaaatgtttgacaagaagaggatgaaagagtgacataggcgagctctgtagcatatatagaatgtttgctatccactggtacatctttaacccgagcctacctactgtatagatgtgtttagtacgtgcttactatgcttaattttggggataatatagtgcgacgtgtaagaaaattcagaactatgttgtatgctctagctgaatttgtttacttcctacaaaaaaaatggatgaactactgatccagttcatgttgtg

SEQ ID NO: 5482 - DNA, 4658 bp, Oryza sativa
  Predicted polypeptide sequence is orthologous to G390, G391, G438
agtccctcccgtcccccgtctcgccctctccctctccttctcccgcctcgcgtcgccgccgccgccgccgccccgcgcgccgcccctcctccctctccctcagccatcctcctcctccgccgccggtccattctccgcctttcaccgcctccgttgccggccaccactgcccccgtccacgcctcgcgtcgccgcccccatccccgtccccgccccgtcgctagggtttcgtcacgagcgacctcccgccgtggaagcttccaccttcctcctcatccttgtcctcacggccgcggcgttcgcggcgtaggcggcgggggacgggtgcagcgccggatgcgagctcgcgctggcctcctcatcctcgagcgcctccaccccaatactttcttcgtcctcgcctcgtcgcgtcgctctgtcttctcccctccctgcctcttcggttgatgtcttcatttcttcccctttcgtgcgaatgggaccaacggcggatcaagcgagggcgccgcagatcgactggcggcacagcttctccccatcctttggtgctgcattgctggtatcatcgtcgtgtttcccgctgttggtgcgtgtctcacggagaaagaatggattggagtaaatcagcagcggtgtggattgtgctctgacctcggcaggggcggatacaagaacacagcgatgagatccggtgcggtttgtggcggaccaagcatgccggccgatggagatggttctctgcatctacgcattccccaccaacatgccgcccttcagtgattgttggggccaaacctatggtggctagtcgctgaggtggtgtcattaatggaggcaaagagtggcaagtggtgaccaaagcggaaggacctggtgtgttgcgcgtgcgccggccactggcggtgcgaggccacggcgacggtcatgctgccattatccaagtatggctgctgaccaatttcttccctgaagtaggtgagggcagtgacagcatgtattgacgaacgcaatgtgcttgctggccgaatagacatgaacacatatcactgagagggagtgaaacagtgttgacgagtagcctgcttttgggtgatagaaatagcattgtagtagggtggtaatagcaagaagccgaaaggtaaggatcaggctataacgttggggcattggcaactcaattaaaaggtaagtatctattggtcacagagcttgacaactttgaatctttgatgatcgtattgtaccattgtttcagttgtagtggccattgttcctgttaaatgcaagttgatactaataaacccattgaatagaggccttcatataattcaatgtttaagagaaaccaaccgtggactggagctctcagattagtttattcaagccacttttttctagcatgcaattatttcgtggcttattgcattccctataattttcattgacttagaggaggtttggggctttttatttttaatgaggtgcaacaatctgtccatctcactcgttggtgcaattacattttttgcttgattttcttcactgctttatgacgactgagataaaaacttatctgtgcagcttcatgtttctgatgcaggggtagggtagttgtctggttgttcatgttctgatttaactcattagtgttgtgctaaatggaaggtcaagctgctctacatgcaggcaagaacagacaagcctgaaaatttttgtggcaaattcttagctcaacctgaaattccgaagctgaaatctgtattcagtcttcaactctatgctccgacgacgctggcgccggctcacgacttctggctgctgcggtacacctccattctcggtgatggaagcttagtggtgtgtgagagatcactcagtagcaagcaaggaggcccaagcatgccacttgtccagccttttatcagagatgagatgcttcccagtgggttcttgatccgacctagcgatggtggaggcagcgtgatacacatcgttgatcatatggacctggagccttggagcgtgcctgaagttgtgcgacctctgtatgaatcttctgccttgattgcgcagaagatatcgatggcggtacagtaattatagtaccctgttcttgatgttcttgttgatttgtaaaaattattgcctaattcagtcatgcaaaattcagtctttacgctgcctgaggcaggttgcctacaaagatacccgttctgtgatcacaggatggggaaggaagcttgcggctttgcatgctctgagccaaaaagctcaccacaggcttcaatgaagttctcaatgggcttgcggatgatggatggtccgtgatcgagagcgatggcatcgacgatgtttgcatctctgtcaattcatccaaagtgaccggttgcaatgcaacattcagcagtggactcactattgtcagtaccggtgttctttgtgccaaggcatccatgctgttgcaggatgtctctcctccatcactactgcaatttttgcgcgaacaccagtcacaatgggctgacgatgaaaccaaacttctgcaatttacccatgtctcgtcttggaggattcagtggtcaggtcatacttcctttagcacacacttttgaacctgcagaggtaagtccatcttctactgtctgtcggttacaaaaaaggtcctgtccaattctgttttcctgctcgatgttttggtgcaaccatctactgtttcagttcctggaagttatcaagctaggaaacaccagaaactaccaagatacactggtgcaccgtgatctgttcctcttgcagatgtacaatggagtagaggagagcagtgcaggaacatgttcagagctaatctttgcacccatcgatgcatcgttcagtgatgattctccgctgctgccttccggtttctacatcatccctatcgattctcctctgacacatctagctcgaactgcatgctagatctcgcttccatgctcgaagcagcgacgccatggagcaggatcagcggcatcaatagcagcggcgagctccaaggcggtgatgacgatcgcgttccagttcgcgttcgagagccacctgcagggcagcgtgcccgccatggcgcagcagtacatgtgcagcatcatctcatcggtgcagaggattgccgtggtgctctcatcctcccgcctcgtccctcccggcgttgccgccgccacgcagcacgcgccggcgactcggtgctgcccagatggatttgccagagctatagatttcattttggagctgaactcatcaaatctgcagatgccaacagcagcagtgaatcggttctgaaagcagttggcatcatcccagtgccatactctactgctctctcaaggcttcttcagcctctatttttctttttctgattaagatacagattttacctagatttttataaattcgtttttttaaactgttgaactgtatatttcgaacgaaaaaaatttatatagaagctttaattataagataaatctatttttcaattttaaaataattaaaccttaattagtgagatgttaatgattttctcgttttacctgtccgaacttaatcttttatcttaaactcgaatggggccagtactcaatactgttatgcatggaggattgtttgttatctcaatttatttcagggacttttgaatcttttgtgcagcttgactgaaattttgttgacacaaattcaccttaaagttgacagtgttgcacaccattaaccatttgatttttcatgtaggtgatgccagtgttcacgtttgcaaaccgaagacggaggcggcgccaggcacaagatggcggaggaggtgaacaaatctatgatcatcaggaaaatcaatcaaatttatgttacctaatctatccaacaagtgaacaaattggaggcagctaagactacataagaaattgaaaagcacggccatactcttttgactaagtttcgaagtcaggcttgcaaggatagactaaagctcttatatcagtctttcttctcttagcaaattctcattgctagatctcagatcatcttgcaaacctcttatatcatttatatcattttccatatgcaaatctgtggttcatctctaaattgtaatgactgggtaagctctctggtcctcccatgtccttgacaataacagtaatatccttcaacttttcaacttatcttcattctcacaggtaagtcttgtaattcatcttctatttgtgctagccttgatgttaagtctgcatttataacggtactctcttgagtttctaaactaacttcatcaatggattatttgacaggtgatgcctggtaagtcttgtaattcatcacaggtaagtcttgtaattcatcttctatttgctgcactggtgatgcctacaaagagctcactgcgacgaacttcatcaactcaattctgaaggtcgaccaaaacaagcaagattatctgacgatacaaaatcattagaaagatctaaattatgtgtatttgcaatccggtgtgcgtttgtgcaggggtcaggcatgagagaggatattgtgtgtaggtgatcgatggatgctatgaactacctctgcagttagaaatgtgttagatcttgtctctgcaaagatgaacaccttttcttacttgttcaact

SEQ ID NO: 5483 - DNA, 842 bp, Oryza sativa
  Predicted polypeptide sequence is orthologous to G394
aaacaaatcaatatacattgatatataatatttctgaaacaaatcaatataatacatggatcacgtacagagtacagtatatatatgtgtgtgagctagctagctagctaggtgtcatgtcgtcgtcatctaactacaacactcttaactcccctgacaataaaattcatcaccagtaagtgaccatctatagctagatgcaagcaaaaccaacaacttgaattaaaattttgtttgatttctggatcgatcctagatgcggccggcagtgctcagtccatcctcctcacacattaattaacttgtgaaaaaatgaagctaactaattaaagcagagggggtgaacatatgcatgagagagccagctgatcgatgagctaactagctatagccatatatatttactactagatgcaagcatgcatgcaagaattaatatatgtactactataaactatatatatgtacactacacactgatatgatgattaattaattaatcatgctagcatgcatatgcagggagaggatgatgatcgagattaatttagctagcaggcggcggacttggcgaaagggctgaacaagtgcggggcggtgggcttgttggtgcggtcggcggcggcggtgggggaagctccggcggcggcggcggtggcgaggcgctcgcaggaggggcagatggagagcgtggcggcggggacggggagggtggtggccatgaagaagccggcggcggtggagtgggtcagagccctgagctgctggagctcacgatggaggcgtcggttctcctccgtcagcgtctcgcagcagcgcttcagaagctcgcaatccacctc

SEQ ID NO: 5484 - DNA, 952 bp, Oryza sativa
  Predicted polypeptide sequence is orthologous to G394
tatctaattattgactaatatattaattaatataatgtaatttatataggaggtagtataacctaggcatcccgtttgcaagcatgcatatatatacaagacagacagacatattacacatggagtagtagtagttgaagaagaatatgcatgataattaatatagagaagctcgatcggtcaagtgcaggacgaagctgaagcagacggaggtggattgcgagcttctgaagcgctgctgcgagacgctgacggaggagaaccgacgcctccatcgtgagctccagcagctcagggctctgacccactccgccgccgccgaccgcaccaacaagcccaccgccccgcacttgttcagccctttcgccaagtccgccgcctgctagctaaattaatctcgatcatcatcctctccctgcatatgcatgctagcatgattaattaattaatcatcatatcagtgtgtagtgtacatatatatagtttatagtagtacatatattaattcttgcatgcatgcttgcatctagtagtaaatatatatggctatagctagttagctcatcgatcagctggctctctcatgcatatgttcaccccctctgctttaattagttagcttcattttttcacaagttaattaatgtgtgaggaggatggactgagcactgccggccgcatctaggatcgatccagaaatcaaacaaaattttaattcaagttgttggttttgcttgcatctagctatagatggtcacttactggtgatgaattttattgtcaggggagttaagagtgttgtagttagatgacgacgacatgacacctagctagctagctagctcacacacatatatatactgtactctgtacgtgatccatgtattatattgatttgtttcagaaatattatatatcaatgtatattgatttgtttaattcttcagagatt

SEQ ID NO: 5485 - DNA, 879 bp, Oryza sativa
  Predicted polypeptide sequence is orthologous to G394
atggctcaggaggacgtcggtcacctgagcgacgccggcctggcgctgggcctgtccctcggcgggggaggaggagggacgaccgacgcggcggcggcgcaccgtggcggctgccggcggccgtcgccgtcgtcgcagtgcccgccgctggagccgtcgctgaccctgagcttgcccgacgacgcggcggccggcgcggccgcgaccgcgaccgcgaccgcgtccggcgggggcggccctgcgcacagcgtgtcgtcgctgtccgtcggcgcggcggcggcggcggccgtgaagagggagcgcgcggaggaggccgacggcgagagggtgtcgtcgacggcggccgggcgtgacgacgacgacgacgggagcacccgcaagaagctccggctgaccaaggagcagtccgcgctcctggaggaccgcttccgggagcacagcacgctcaacccgaagcagaaagtcgctttagcgaagcaactgaacctcaggccaaggcaggtggaggtctggttccaaaacagaagagcaaggacaaagctgaagcagacggaggtggactgcgagttcctgaagcgctgctgcgagacgctcaccgaggagaaccgtcggctgcagcgcgagctgcaggagctccgcgcgctcaagttcgccccgccgccgccgtcctcggcggcccaccagccgtcgccggcgccaccggcgccgttctacatgcaactcccggccgccacgctcaccatctgcccgtcctgcgagcgcgtcggcgggcccgcgtccgccgccaaggtcgtcgccgccgacgggaccaaggccggccccggccggaccaccacccaccacttcttcaaccccttcacccactccgccgcctgctga

SEQ ID NO: 5486 - DNA, 1201 bp, Oryza sativa
  Predicted polypeptide sequence is orthologous to G409
ggcacgaggctcctcgaagaggagtactaccgagcagctcccggagaagaagcggcgcctcacgccggagcaggtagatactccagctagctagctaagctgtaaagatcggcggcgcgcggtgctctgttcccgagttgtgacgtgacgactggatcgatcggcgtcggcgtgtgtgtatgtatgtgcatctgctggagaggagcttcgaggaggagaaacaagctggagccggagcggaagacggagctggcgcggaagctatggctgcagccgcggcaggtcgccgtgtggttccagaaccgccgcgcgcgctggaagaccaagcagctcgagcgcgacttcgaccgcctcaaggcgtcgttcgacgccctccgcgccgaacacgaagccctcctccaggaaaaccaccgcctccactctcaggtgagctagctacgcccgccgcccgcgccaccgcccaaccgcgcgttatcctcgatccgatttggccgggctccttgattctgactgaattcgtggtgatcttgtgccgtcaggtcatgttctttgaacgaaaaactgccagaaaaagaaacaacaaccgaaggcacccccggcgccggccgtaaacgtccccgggctgccctgcgggcgccgaattgaagttccccgtcccggaacgccggaggacaccgggcgttggaggaggcggcggcggctttcgaggagcagcaggagcagcaggtgaaggccgaggacaggctgagcacggggcagcggcgggagcgcggtggtggacacggacgcgcaactggtggtcgggtgcggccggcagcatctcgccgccgtggacagcagcggggagtcgtacttcccgggcggggacgagtaccacgactgcgtgatgggccccatggaccacgccgcggggggcatccagtcggaggaggacgacggcgccggcagcgacgagggctgcagataatacgccgaagacgccggcgtctttttcgcggaccacggccaccaccaccaccaccaacacgcggacgacgacgaggaggacgggccagcagatcagctgctggtggatgtggaactagatttctcgcgcgcgcgcgtcgtcgtgcattcaattctcgtgttaaaaaaaatcgttctctttttcatttttcaaaaaaaaggggggcccggcacccaatccctcccctcccccccc

SEQ ID NO: 5487 - DNA, 1269 bp, Oryza sativa
  Predicted polypeptide sequence is orthologous to G409
tcttggagaagggaggagaagagggggaggagagcatggatcccggccgcgtcgtgttcgactccggcgtggcgcggcgggcgtgccccggcggcgcgcagatgcttctcttcggcggcggcggcagcgccaacagcggcggcttcttccgaggtaaacagagatccaatagagatcgtcgtcgtctccgtctcaggcgagtgacgcgtgttataacgcaggcgtgccggcggcggtgctggggatggatgaatcgcggtcgtcgtcgtcggcggcgggggcgggggcgaagcggccgttcttcacgacgcacgaggaactcctggaggaggagtactacgacgagcaggcgccggagaagaagcggcggctgacggcggagcaggtgcagatgctggagcggagcttcgaggaggagaacaagctggagccggagcggaagacggagctcgcccgccgcctcggcatggccccccggcaggtcgccgtctggttccagaaccgccgcgcccgctggaagaccaagcagctcgagcacgacttcgaccgcctcaaggccgcctacgacgccctcgccgccgaccaccatgccctcctctccgacaacgaccgcctccgcgcgcaggtctcccactgatttttttcacccttctcaattaattaattaccgcagttaatttcttgtgatcgaaggaccgctcttttaaaattcgaacaagttcgggggcttcggtgcaaaatggtagtaccgtagtttaattttgtaaaaatagccccccccccccccccttttgtaaaaatacaaccgcacttgtaaaataagattccactttttggcgccttttcattggatagcgaccagcggcgacccacaactcgatgcgtttttttaagtttttttttaaatcaaactttttaaacagtggttaggaatctaacgaacatatttatgctcgtttcccaaagtctaagcaccgctaatctaagcagcacatgcatatttctcttaattttttttagaatatcctgacgactagatgtactctttgttttgttttttctcagctcgtgtaatcacgtgaattcatatggttgctccgtttcacagttggctactgcttcagccgcggtcaaattttgaaatttagagcttatttttagaattaatttagagattgtttcgtctttgtcagccttcagccttggcttttaaacgctaaaactattttttttcagcgtaggtcaagtgccttttaacttgtaacccac

SEQ ID NO: 5488 - DNA, 1854 bp, Oryza sativa
  Predicted polypeptide sequence is orthologous to G409
gagcaacaaaattcagaagtcaaaaaaatcccaaaaacaaaaaataataaaaaaaaagaaagagagagacatttcgcatctgctgccctgcctcctctcccatcacctgcccattttttcacattgaggcccctctgaagatattatatttacaactaggtccctggccgggccggccggccaccggaaggagcacctcgccggagaaggctttgtctcttctttttcttctcctcctcctcctccatcggcggcggcatggggttctcgctgtaccccatgaagacgtcgacgcgcatgctgtggagcaccagcttcttccgccataaggtcgcctcctccttctaagcccacgccctctcgggcggcggcggcgagccggcggcggagcgcgcggttggtaggtgcgcgtgcgtgcgtgaacgggagagcagcttcgagatcgggttttcttgggttcttggagaagggaggagaagagggggaggagagcatggatcccggccgcgtcgtgttcgactccggcgtggcgcggcgggcgtgccccggcggcgcgcagatgcttctcttcggcggcggcggcagcgccaacagcggcggcttcttccgaggcgtgccggcggcggtgctggggatggatgaatcgggtcgtcgtcgtcggcggcgggggcgggggcgaagcggccgttcttcacgacgcacgaggagctcctggaggaggagtactacgacgagcaggcgccggagaagaagcggcggctgacggcggagcaggtgcagatgctggagcggagcttcgaggaggagaacaagctggagccggagcggaagacggagctcgcccgccgcctcggcatggccccccggcaggtcgccgtctggttccagaaccgccgcgcccgctggaagaccaagcagctcgagcacgacttcgaccgcctcaaggccgcctacgacgccctcgccgccgaccaccatgccctcctctccgacaacgaccgcctccgcgcgcaggtaatctcattaaccgagaagctgcaagacaaggagacgtcgccgtcgtcggcgaccatcaccaccgcggcgcaggaggtcgaccagccggacgaacacacggaggccgcgtcaaccaccggcttcgccaccgtcgacggcgcattggcggcgccaccgcccggccaccagcagccgccgcataaagatgatcttgtgagcagcggcggcaccaacgacgacggcgatggcggcgcggccgtggtggtcttcgacgtcaccgagggcgccaacgaccgcctcagctgcgagtcggcgtacttcgccgacgccgcggaggcgtacgagcgcgactgcgccgggcactacgccctctcgtcggaggaggaggacggcggcgcggtcagcgacgagggctgcagcttcgacctccccgacgccgccgccgccgccgccgccatgttcggcgccgccggagttgtgcaccacgacgccgcggacgacgaggaggcgcagctcggcagctggaccgcctggttctggagctgatcgatggaagcatggagcattggagccatgctatcaatgaatgaatgaatcaaatgaccttgagaccctcctctccgtcctttcttttgccctatttttaatcgctgttatatgttaattatgtgcaattaaagtgtacgtgttttgtcgtaagttgtgtttgttcaaattgtatgttttgaaggtgtcatgtattcatacacgatatgatatatagacgggatcatgaatgatactcggaaagattggaataattccatgtagtgttgagcaataataaacattttcctccgataagatgtttttatgatt

SEQ ID NO: 5489 - DNA, 1710 bp, Oryza sativa
  Predicted polypeptide sequence is orthologous to G409
tttagcttcagagccctccaaaagaaaaaaatattataggaaataaaaaataatttcctggttagaataaacacatttttaaaaaaaccaagaaaagattttcctcttctgttacattccttcttccttctccggccaccggagccgtagccgaattgtgcctcttctccggcgaggggagagggagagagggggtgtgagttttgctccttccggcgagtggtctcctccccgcgcggctgaggagatctctcgggacatcggggttggggcggcgtgcatgatggggttctcgctcacgccgatgaagatctccacgaggcttctgtggagcaccagcttcttccgccacaagatcgccgccaccatcgcgtcctcctcctccttcttataagatcatcttctccgccacagcaatctgtaaatatatacacatcgaacgcgacaagcgcgtttgattgattggatttttctcccctctcctcacgacaagtaattaaggcgcgcgatctcgatctctagcgttgagaacttgatccgcgatggagtccggccggctcatcttcagcacggcgggctccggcgccgggcagatgctcttcttggactgcggcgctggcggcggcggcgtcggcggcggggccatgttccatcgaggggcgagaccggtgctcggcatggaggaaggagggcgcggcgtcaagcggcccttcttcaccacccccgacgagctcctcgaagaggagtactacgacgagcagctcccggagaagaagcggcgcctcacgccggagcaggtgcatctgctggagaggagcttcgaggaggagaacaagctggagccggagcggaagacggagctggcgcggaagctagggctgcagccgcggcaggtcgccgtgtggttccagaaccgccgcgcgcgctggaagaccaagcagctcgagcgcgacttcgaccgcctcaaggcgtcgttcgacgccctccgcgccgaccacgacgccctcctccaggacaaccaccgcctccactctcaggtcatgtcgttgaccgagaagctgcaagagaaggagacgacgaccgagggcagcgccggcgcggccgttgacgtcccgggcttgcctgcggcggccgacgtgaaggtcgccgtcccggacgccgaggaaccggcgctggaggaggcggcggcggcgttcgaggagcagcaggagcagcaggtgaaggccgaggacaggctgagcacgggcagcggcgggagcgcggtggtggacacggacgcgcaactggtggtcgggtgcggccggcagcatctcgccgccgtggacagcagcgtggagtcgtacttcccgggcggcgacgagtaccacgactgcgtgatgggccccatggaccacgccgcggggggcatccagtcggaggaggacgacggcgccggcagcgacgagggctgcagctactacgccgacgacgccggcgtcctcttcgccgaccacggccaccaccaccaccaccaacacgcggacgacgacgaggaggacggccagcagatcagctgctggtggatgtggaactagatttctcgcgcgcgcgcgtcgtcgtgcattcaattctcgtgttaaaaaaatcgttctctttttcatttttccgcttctttgtctgtaatgttgagtttcgatcggctatgagaaggaaggaggtgtatgcatgtgc

SEQ ID NO: 5490 - DNA, 1710 bp, Oryza sativa; identical to SEQ ID NO: 5489
  Predicted polypeptide sequence is orthologous to G409

SEQ ID NO: 5491 - DNA, 2601 bp, Oryza sativa
  Predicted polypeptide sequence is orthologous to G416
gaaggtttcccccaactcaactcccctccccttcgcttcccttcccttctctcctctcctctcctctcctcttctcccccccaaattcgccgccgcctcctctccccctctcctcctacccttccccgcggcggcggcgagaggcggcgcggtgcgtcccctcccctcccccgcactctgctggtgctggtgctgggctgccgttgggggaggcgggagatccgcccgggcccggggttccgtttcctcctcctgctcggtctcaacctgttgtaatactatccatcaccagcaatgaataccccagaaaagaaaccactgtgctatacttctagaagagcactgcaacagaggacagaatcctcttcggaattgatctctgtatcaaaaagagcaacccgccagaatactccacgcaagccggattctcctcccaaacgaacaacaagaagtagcgctaacctggcgaaatgtatagagaacaaacaccatagcagtcctctgaagcggcggcggggttcagatgcggctaccggaaagtctgcaacagggccaacaaggaggaagcataaacagaaaaggaaaaatgatgagagtgatgaggtcagtcgcatggaaaaaagagcaagatatttacttatcaaaataaaacaggagcagaatttgctagatgcatactctggagatggttggaatgggcacagtcgagagaaaataaagccagagaaggagctacagcgtgctaagaaacagatcatgaaatacaaaatcgctatccgtgacgtcattcaccaacttgatttgtgtagttccagtgggagcaaggatgactctgtgattccaccagatgggtgtcacgagtctgtcaatcctgaacatacaatatgttcaaggtgcaaatcccacgagtcatttcctgacaataacattatattctgtgaggggggctgcaaactggcgtgtcatcagaaatgtttggagcctccttttgataaaattcttccaactacccgccatgggcggctttgcaaacactgttcttccaagatgaaaattttagacgccattaatgcccatctggggacaagttttacagtgaagtgtccctccagtgatattttcaaggaagcagctgaacatttcaactctgatgatggactgggccaagattggctatctgagtattcaggtgatgaggactatgaccctgaagaaaatgaggccagcagcagtggtgaagagaataaatctgccgattccaattgttcagggagtccactttattctccaaatgatgatattccagacttcatatcagcagatttcaatgatgctgaaggattctgtcgtgaaagttcaaatctaggaatcgattttggtgaagatggtttggctgagattcttacccaccaaaggccaagaagagatgttgactatacacaacttaatgagcaaatgtttggagagcctattggcaatgacgaacagagtgaagatgaagattggggtcttaacaagagaaagaaaagaagaactggttcaactggtgttgggactaattccgtagagggtcgatcagatgtcaaatccaataagaaagcccaacctcggagaaaacttttcaggattcctcctgcggcagttgaggtgctccgtaaagcttttgctgaaaatgagcttcctgcccggagtgtcaaagaaaatctctcaacagagctgggtatttcttttgaaaagattgataagtggttcaaaaatacacggtgtgctgctctcagggataggaagggtgaaagtcgttattctggtcccagcaaaaggtcaagaacaagcatagaaaaggctgaaacttcagctaaagtggatcaaatggacaactcatgctttcttcccttatctgaaataatcaacgtgcccacacgtctgcagaaaggtcttgataagaagccaaaatcaattaacagccctccaagacctcaggacaatgaaacttgcttgtcgccaactgataaaaccaaggagggtacaccgcctacgatcaagccttccatcacagattctagtcaactgatgaataacaacatcggcactgaggagactgctgtttcttgggtggacacttgggcctctgacgctctgcatttcttggacgtgagcgatgatgaacatttcttcgatgtgatcgagaaggtgtgcggtctcgagaatcggctgcagcggttgaaggagaacatgctatcatcgtcatcgtcaactgacaacaatgtggctgctgagagtggcttgcaaaacgaagttgtgcttgtaccagctgctgagctcaaggataaagcatcttaaccttgcatctgggtcccaatgctttgcttcagttgaccatttgctcataggattttatacatcagaaaatagtacaggaggggctggagtgtagcttgccccgtttatctttgaacttatataccggtgaactggtaccattctatatagggagggacagataattcggattaggttcgtgaggatttgcaaagagttagtttaactgtaatctttcagctggaactttgttcagcgagtaataggtcatggacaattacc

SEQ ID NO: 5492 - DNA, 2342 bp, Oryza sativa
  Predicted polypeptide sequence is orthologous to G416
gtctcaacctgttgtaatactatccatcaccagcaatgaataccccagaaaagaaaccactgtgctatacttctagaagagcactgcaacagaggacagaatcctcttcggaattgatctctgtatcaaaaagagcaacccgccagaatactccacgcaagccggattctcctcccaaacgaacaacaagaagtagcgctaacctggcgaaatgtatagagaacaaacaccatagcagtcctctgaagcggcggcggggttcagatgcggctaccggaaagtctgcaacagggccaacaaggaggaagcataaacagaaaaggaaaaatgatgagagtgatgaggtcagtcgcatggaaaaaagagcaagatatttacttatcaaaataaaacaggagcagaatttgctagatgcatactctggagatggttggaatgggcacagtcgagagaaaataaagccagagaaggagctacagcgtgctaagaaacagatcatgaaatacaaaatcgctatccgtgacgtcattcaccaacttgatttgtgtagttccagtgggagcaaggatgactctgtgattccaccagatgggtgtcacgagtctgtcaatcctgaacatacaatatgttcaaggtgcaaatcccacgagtcatttcctgacaataacattatattctgtgaggggggctgcaaactggcgtgtcatcagaaatgtttggagcctccttttgataaaattcttccaactacccgccatgggcggctttgcaaacactgttcttccaagatgaaaattttagacgccattaatgcccatctggggacaagttttacagtgaagtgtccctccagtgatattttcaaggaagcagctgaacatttcaactctgatgatggactgggccaagattggctatctgagtattcaggtgatgaggactatgaccctgaagaaaatgaggccagcagcagtggtgaagagaataaatctgccgattccaattgttcagggagtccactttattctccaaatgatgatattccagacttcatatcagcagatttcaatgatgctgaaggattctgtcgtgaaagttcaaatctaggaatcgattttggtgaagatggtttggctgagattcttacccaccaaaggccaagaagagatgttgactatacacaacttaatgagcaaatgtttggagagcctattggcaatgacgaacagagtgaagatgaagattggggtcttaacaagagaaagaaaagaagaactggttcaactggtgttgggactaattccgtagagggtcgatcagatgtcaaatccaataagaaagcccaacctcggagaaaacttttcaggattcctcctgcggcagttgaggtgctccgtaaagcttttgctgaaaatgagcttcctgcccggagtgtcaaagaaaatctctcaacagagctgggtatttcttttgaaaagattgataagtggttcaaaaatacacggtgtgctgctctcagggataggaagggtgaaagtcgttattctggtcccagcaaaaggtcaagaacaagcatagaaaaggctgaaacttcagctaaagtggatcaaatggacaactcatgctttcttcccttatctgaaataatcaacgtgcccacacgtctgcagaaaggtcttgataagaagccaaaatcaattaacagccctccaagacctcaggacaatgaaacttgcttgtcgccaactgataaaaccaaggagggtacaccgcctacgatcaagccttccatcacagattctagtcaactgatgaataacaacatcggcactgaggagactgctgtttcttgggtggacacttgggcctctgacgctctgcatttcttggacgtgagcgatgatgaacatttcttcgatgtgatcgagaaggtgtgcggtctcgagaatcggctgcagcggttgaaggagaacatgctatcatcgtcatcgtcaactgacaacaatgtggctgctgagagtggcttgcaaaacgaagttgtgcttgtaccagctgctgagctcaaggataaagcatcttaaccttgcatctgggtcccaatgctttgcttcagttgaccatttgctcataggattttatacatcagaaaatagtacaggaggggctggagtgtagcttgccccgtttatctttgaacttatataccggtgaactggtaccattctatatagggagggacagataattcggattaggttcgtgaggatttgcaaagagttagtttaactgtaatctttcagctggaactttgttcagcgagtaataggtcatggacaattacc

SEQ ID NO: 5493 - DNA, 318 bp, Oryza sativa
  Predicted polypeptide sequence is orthologous to G418
ccgtgatgatggagctgccctggaaactctgtgtggcccatgatgctgacgtgcagatgccacaactgacaactgtgcatgcatgaggctggcacgaatgtgtgcctggaagtgtgctgtgtgatgatgaggagcgctgctgcatggtgtggccatgagatgccacatgaatggtgatgtgagtgatggaaggaacggaggctgatgagcggggaagacgggcaggagccggacaggaggagcccacggggagcgaagggcgcaacggagacagaaggagcgggggacgggacccggaccggaaaaaaaaaaaaaaaa

SEQ ID NO: 5494 - DNA, 800 bp, Oryza sativa
  Predicted polypeptide sequence is orthologous to G418, G965
agaaccccctcaactctcccccgccgaccgcttcgagcaccagcgcaagaaggccaagctcatctccatgctcgacgaggtggacaggaggtacaaccactactgcgaccagatgcagatggtggtgaacttcttcgactcggtgatggggttcggggcggcgacgccgtacacggcgctggcgcagaaggccatgtcgaggcacttccggtgcctcaaggacgcgatcgcggcgcagctgagggggacgtgcgaggcgctgggggagaaggacgccggcacggggtcggggctgaccaagggggagacgccgcggctgcgggccatcgaccagagcctccggcagcagcgcgccttccaccacatggggatcatggagcaggaggcgtggcgcccccagcgcggcctccccgagcgctccgtcaacatcctccgctcctggctcttcgaacacttcctccacccgtacccgagcgatgcagataagcacctgttggcgaggcagaccgggctgtccaggaaccaggtctcgaattggttcatcaacgcccgtgtccggctatggaagcccatgatcgaggagatgtaccagcaagaatgcaaggagctcgagggctcctccggcgccggcgacgacccctccggcgccgacgacacgcactcgccgacgaccaccgccgccgcgcatcatcagcacaggcacggccagctaatggtagagcacggcggcgcgtccagcggcggcggcgccgccatgtcgtcgcacaagcacgagcccggcgtcgtcgcggggccctcct

SEQ ID NO: 5495 - DNA, 2398 bp, Oryza sativa
  Predicted polypeptide sequence is orthologous to G418, G965
ggcttctcccctttattttctctccctttcctctcggtgcgcttcccttcctaggcttagctatagctcatctctcctctcctccacctcgaccttctcttgctttcctccacttttgttgctctcagcttttcgccttttcaccaatccccgcaccgccacagatcgagggagagtgagctctcgcgtgccacggctcgaggtggtcgtgcgtgatttgatcgatatccatggcgcacgatccgagcctagggtacgcggattacttcgcggcggaggtggatggcaccggcgccacggagttgtatgggttgcagcagcatcagcagggggttggggtggcggagatgttcggggtgagggggctcatgccggcagcgcacgcgcacgagcagagcaagggtgtgggcgcgctcgtcgtcggcggcggcggcgtcgatgatggaggcgcgacgacgctgccgacggtccacttcggcgggctcggcgagctgcaccaccaccaacaccggcagagccaggcgccgctgtccctctcgctccacaggccggaggcggccgcgacgtcgctgctgatgcagcagcagcagcagcacctccaccaccagccgtcgccgccggcgggcgcggcgtcgacgtggcagctgcagcagggtgcgtggcatctccgcggctcaaggttcctcctcccgacgcagcagctcctgcaggagttctgcagcctccccgtgaagagcaccaccagcccatcatcggcaagcaaggcaaccaaaccgccgcaagaagaggccgccagcggcggaggctcgtcgtcgtggaccgcgccgacgcagatccagtccatggacgcggccgagctgcagcggctcaagggcaagctctacaccatgctcgaagaggtggataggaggtacaggaggtactgcgagcagatgagggcgctcgcggcgtcgttcgaggcggtggccggggagagggcggcggcgtcgtacacgcggctggcgtcgaggacgatctcgaggcacttccggagcctgagggacggggtggtggcgcagctgcaggcggtgcggaagcagctcggggagaaggacacggcggtgcccgggatgaccaagggcgagacgccccgcctccgggtgctcgaccagtgcctccgccagcacaaggcctaccaggccggcatgctcgagagccacccatggcgcccccagcgcggcctccccgagcgcgccgtctccatcctccgtgcctggctcttcgagcacttccttcacccgtacccaagcgacgtggataagcacatcctcgcgaggcagaccgggctatcacgtagtcaagtggcgaattggttcatcaacgcgagggtgaggctgtggaagccaatggtggaggagatgtacgcggaggagatgaaggacgaggagggcagtggacagtccacgcaggcgagcaacccgcagaaccctaaccctagcagctacacgtcggaggtgcgcggcggcggcggcggcggcgaggaccgcggcgagcagaagccgtcgcgggcgcagctgctgcacgacgccggctcgctggcctccgtcgtgagcatcgggcacggcggcgcgggacggacgatggtcgatcaccaccatcaccagagccttaattttggcacgatggaccagctcgacttcgacgcgtacgaggcggccggcggcgggcaggggttcggcgccggcggcggggtgtctctgacgctggggctgcagcagcagcacgcggacccgcacgacggcgtgaacgtcgcgttcgccgccgccgcggcgccgcccaattcgtccggtgtcgccgcggagtacctattcatgggcggcggcgagcatcagcagcagctgcctcaaaccgcccagttcggcgccgtcatggaaggcgacgccgcgtcgcactaccgtggcctcagcgccaccgccgccgggttccacctcctccacgacctcgccgggtgacccgtcgcacatcaaacaggtggtagaccgatcgacacgcgcgccgtacgacggaaccaattgccggcgacccctcctgtacgcgcgtgcgtgcgtgcacaggccgatcaatgtccaatttcgcgcatgcttggggggtggggattaattgggggggagttagctagctagctctagctaggttgatgtgattgacggggacgcgccaccggcaaagctctcgctctcgcgcgcgggcgcgcgggcgacaccggcattggcgcggcgagagaggggggtgcgcgttgtgtccctctcctgtacaagtacgtatacgctgctttggatttatttttgtagtagcgattagacatctcgtcgctcgatggaattaattaattttcttggcagcgcgtctctgtctacgt

SEQ ID NO: 5496 - DNA, 2112 bp, Oryza sativa
  Predicted polypeptide sequence is orthologous to G419
gtccatggtttaattatttgtagccttatagagagagagaagagaagaagagagagagatcagtgtgaggcaccgacgaagacgaagacgaagacgacgacgacgacaagcacacaacaaatttgcacacacgcgcgcgagcatcgatgatggcggcccatcatcatcatcatgagcaccaccacctcttggacatgtcgtcgcccccaaacgccagcggcgccatcatctcctccttcgaccacgccgccggcctcctctccctccacgacgtcgccgccgccgccgaccaccaccaccaccacctacgaggaggaggagggggtttgcaattgccatcgccgtggtcgcagcagcaggtttccctctccctctacaacaacgctgccggcgcagcaggctcgccgccgtcgtcgttggttgcccatcagcagctggcggcggcgcagccattaatgttccagctgagggggtccaagtacctgggccctgtgaaggcgctgctcgccgagttctgcagcctcgacgttgaggccatggatggcgccaagcagcagagacctcccaatcccaatcccaagattggaaagtgggacgacgtggagggttcaggttcgtggggcaacctgtctctgagctccatggacctcctggatctcgagaggaggaaggccaggatcttgtccatggttgaagaggtggacagacgttaccggcgataccgtgagcagatgagggcggtggaggtgtcgttcgaggcggtggccggcggcggcgcggcgcaggtgtacacgaagctggcgatgcgagccatgtcgcggcacttccggtgcctgagggacgcgttggtggggcaggtgcgcgcgctgaggaacgccatgggggagagccagagggacgccgccggcggcgtggcggcggcggcgcccggtgccaccaagggcgacacgcctcggctgcgggtgctggaccagtgcctgaggcagcagagggcgttccagcagtccggcgccgtcgacagcttcccgtggcgcccgcagcgcggtctgccggagcacgccgtcgccgtcctccgcgcctggctcttcgagcacttcctccacccgtatccaaatgatgtggacaagcacattttggcgcgccaaacaggcttgtcaagaagccaggtttcgaattggttcatcaatgcaagggtgaggctatggaagcctatgatagaagacatgtacaaggaagaaacgaagccggaatcatctgatggcaacaacaaattaaaccctagcgcagccggcaacaaacagcagcatcgagatgatcccaagaagaattacacggcaacgacagcagaagccagcttagtacaacaaagcagctaccatctccaccttcgcagcagcggaaaccgtaactcctcctcgttgatgatccctgcagcagcatcaacatccatcgatcatcaccatgacagcagccaccagctgttgggcggccatagctattcttcagcagcaggattgcatcatggtcatggcggcgccgtgtcgcttactctagggctccagcagcagcagcagccatttgcggcgtcgatgatgcatcagcatcagcagcaccagcaccagcaccagcagcagcagtcattcatggtggaggcggcggaggaagaagaagatgacgtgctcccttacaggaacctcatggagtctcagttgctgcatgattttgcaggagctagctaaggcaggctccagcttagcatgcagctaatttatttgattgttaaaggagattattgcgctcaaaagtttaatttaattaaggagatgtaggtaattaaatattacattattgttcttttatgaccaaacatttcgttacattatttggggatttcttttgtaaaaatcagcccaccacttctgttctggcctagctagcttagcatgcagtgatgtggaacccacccttgcagtcccatctgggcccatgacaagttagttacttagagcacccgcaatggtaaagtaaggtgttatctataaaacatgtacatctcagcaatagactagattaatagtaaaccacttcaatggtatgtctacatgggtatct

SEQ ID NO: 5497 - DNA, 2583 bp, Oryza sativa
  misc_feature (693)..(693): n is a, c, g, or t
  misc_feature (719)..(719): n is a, c, g, or t
  misc_feature (734)..(734): n is a, c, g, or t
  misc_feature (765)..(765): n is a, c, g, or t
  Predicted polypeptide sequence is orthologous to G419
aagaaccacatcttgttttccttcttttccctgccctcccaggacaaagcaagattcctgtgtttctgaggcttagctgaggaaggattcggcctacctgctctcttctcctgcccggccgattgctacgacttgcaacacgcatcaccatagtaatagtatcgtcgtgttcactctccgacgacttaattgtgtgcgtgttgtatttcccaccgtcttgtcacttcatcacacatctggctacatcgatggatcactggtgctactagctagctagctcgctagttactcgattactggctgaattttcgcttctgtctccatctattttacacaaattaaagcttttggcgatcggaggaattgaaacaccgatatggcgcatgatccgaacctggggttcgcggattacttctcggcggcagatgcatcggcgtcgtcggtcacgacgctgatgccggcgatggacgaagcggcgccggagctgttcgggttgcaggccgggatggagcttctcggcgtgcgcggtctgggtatgagtatgatgcccggcgcggcaggcaaggtcgccgcgctggtggccgacgctggggacgacggcggcggcggctccaccatgcgcttcctcagcgagcagcaccaacagccgagccaggcgccgctgtcgctgtcgcgtgtgccgcccggacggcntgctgcacctcggcggcgcggcgcgnccgcagcaccaactngcgcccgcggcgccatggatgacgcaccacnacgcgtcgtcgtcggcgccgcaaggtgcacgcggcgtggcacctgcgcagctcgaggttcctcctcccgacccagcagctcctccaaggattctgcagcctccccgtggacagcaccaagcgcggcaacggcgccaaggcagcgacgcagcaagaagacggccgcggcgacgggtcgtcgtcgtcgtcggcctcgtggaccccgtcgccgcagatccaggccatgaagccctggagctgcagaggctcaaggacaagctctacatcatgctcgaagaggtggacaggaggtacaggaggtactgcgagcagatgagggcggtggccggggggttcgaggcggtggccggggagagggcggcgggggcgtacacggcggtggcggcgaggacgatatcgaggcacttccggagcctgagggatgggatcgtggcgcagctgcaggcggcgaggaaggcgctcggggagaaggacgtgagcgcggccgggacgacgcgggggcagacgccgcggctcagggtgatcgaccagtgcatcaggcaccacaagtcgctgcagggcgtcgccgccatggacagccacccgtggcgcccccagcgcggccttcccgaccgcgccgtcaccatcctccgtgcctggctcttcgagcacttcctgcacccgtatccaagcgacgtggataagcacatcctggctcgacagacgggcctctcacgtagccaggtgtccaactggttcatcaatgcgagggttcggctgtggaagccaatggtggaggagatgtacgtcgaggagatgaagggccaggacggcggcgacggcagcggtggacaggggagcctaaaccctaagcctacctgcagccacgcctccgaggcgcgcggcggccagcagctggtcgtcggcgatggcgacggcggcgaacagaagccgacgagggcgcagcttcgccacgacgccgggtcgctggcctccgtcgtcaacgtcgacgtcgcggccggcgcgggcggcgtggcccggctgcaccaggcggagaacttcggcatcatggaccacctcgacttcgacgcgtacgacgacagccaccaccagcagcagcacggcgggttcggcggcgtgtcgctgacgctcgggctgcagcagcacggctcccacggcggtggcggcgtgaacatcgcgttcggggcgccggggtccgcgcacggcggcgccgggttcttgtacccgggcgagcagatggcgcctgacgccatgcatccggggcacggccaccacgtcgtcggcggacagttcggcgtggccatggacggcgacgccgcctcgcacgcgcaagagcggtaccggagcctaagcgccggcttccacctgctccgcgacttggccggatgatccatgcggcgaactactcagttcatcgcacgtacgcatatatatgcattccgtgtactgtactagcagacgatttggatgtcgcagcggcagcggccgcggcggtggcgactaggtagggatcctcgcgcgcggccggcgctgcggcgtgcattggttgggcaaccgaattaagcgtttttgttggtggtggtccttgattttaccgacctataggtacagttcgtatatatctctcgcgatcgatcgtacaccagcaggggagtagcccagtagatcgtcgtcgatggcgctttcgtgtggttcggaagcgggcagtttattttagcctaccggcccggcatcggttgccgggggttgtgtggtcgtgtgttgtgtagtggagacagcttttatttgtactggaaatctggaatttgattgatggttc

SEQ ID NO: 5498 - DNA, 440 bp, Oryza sativa
  Predicted polypeptide sequence is orthologous to G427
gcgcaagggtatcttcaagacacgtgagcaaatgctggcggagaccaaggatatgaaggaggaggatctggaagcggacaataagtctcgatatctttccgcagagatgtacgagcaccttttggtgctgcgtcgtacctgtctgaaggtgtctcgggcaggtctgagcaccactctcaactcagtggatgcgttctgtgccctgcaagctatcgtcgctctgctgcagtacttgggtgggcctgacaaggagaagctggcggccatctcacgctttcctaccatgagcaagtctgcctccaatatgcttttctatactcgataactggcggactgatcgagtcgttgctacagtatcttcttcttttgtatgatagttttcaattgtgtttcttccacctttaaagcttattgatttcaaaaaaaaaaaaaaaaaaaaa

SEQ ID NO: 5499 - DNA, 1105 bp, Oryza sativa
  Predicted polypeptide sequence is orthologous to G427
gcagcccttcttgtggactctaacatacttctcttaattgcagacacattatgtgttgcttctttgctcattcaaggaacaacttcagcagcatgtgcgtgttcatgcaatggaagcagtgatggggtgctgggaacttgaacagtctttacaaagtctaacaggggcatctcctggtgaagggactggagcgactatgtctgatgatgaagataaccaagtggacagtgaagccaacatgtttgatggaaatgatgggtcagacggcatgggctttggtcccttaatgctgaccgagggtgaaagatccttggttgagcgtgtacggcatgagctgaagaacgagcttaagcaggggtacaaagaaaagcttgtggatattagggaagagatccttcgcaagcggagagctggtaaacttcctggtgatactgcatctatactaaaagcttggtggcaagctcattctaagtggccatacccaactgaagacgacaaggcccgcctggtgcaggaaacggggttacaactgaagcaaatcaacaattggttcattaaccaacgcaaacgaaactggcatagcaacccagcatcctctggtgaaaagaccaagaagaaaagaaacgttacaggtgatggtggtgctgagcaatcgtggtagattggttcaacatgaaactagatgtaaacagtaccttttattgtgaagagtgtagtacattctctcgtgctctggtgtgacaaaatctggagaccggcccattcacaagggaattgcgatcataggcgtaatcactgggcaaagaagtcatctgaaattgtagcataagcgcacaaaactgaggtgggtggtatttgactttcgcagtatagcatcgactgtctgctaatgtgattttgtgaaggaatgttctgtataaccgatgaacggaaggaagaattgtattgtgtatgtaattgtgtatcttatttatcatgtaatatatatatgatattaggagctttaagattcggattggatatgttctctgttttgatgcacgatgcagtgttgaggtgtaacatgttttggtaattcactgtgtataaaaaaaaaaaaaaaaaa

SEQ ID NO: 5500 - DNA, 1540 bp, Oryza sativa
  Predicted polypeptide sequence is orthologous to G427
tcttcgtcttcctcctccacctcgcgcgctgcagcagcagcagcggtgcgcgtgatggcgttccactaccaggaccacgcgctggcgatggacgccgcggctgcggcggcggagacgggcggccaccaccaccctgggttcgtcggggcgggaggagttgtggggggaggaggaggaggagggtgggagcgggagaaggccgccatcgcggcgcacccgctgtacgagcggctgctggaggcgcacgtcgcgtgcctccgcgtcgccacccccgtcgaccagctgccccgcatcgacgcgcagattgcggcgcgccccccgccgctggccgccgccacggccgcagcggcggccgcggcggccggaggggcgccgtccggcggcgaggagctcgacctcttcatgacccattatgtattgctcctttgttcgttcaaggaacaactacagcaacatgtgcgtgttcatgcaatggaagcagtaatggcttgctgggaacttgaacaaactttacagagccttacaggggcatctcctcgtgaaggttctggagcaactatgtctgatgacgaagacaatcaggttgatagtgagagcaacatgtttgatggaaatgatggatcagatggtatgggctttggccccttaatgctgacggagggcgagagatcattagttgagcgtgtacggcaagagctgaaacatgagcttaaacaggggtacagagaaaagcttgtggacattagggaagagatactccgaaagcgaagagctggaaaactcccaggagatacagcgtctactttgaaagcatggtggcaggctcactctaaatggccatacccaactgaggaggacaaggctcgcttggtgcaggaaacagggttgcaactaaaacagatcaataattggtttatcaaccaacgtaaacggaactggcacagcaatcctgcttcatcctcatcagacaaaagcaagagaaaaaggtatcgtgtcgtggacttctaacagaaattccttttacatatttttggtttccattttcctgtctctgtctgtttatgcctagaaaaagaagcaatgcaggtgatggcaaggccgagcaatcttggtagaacgtggttggagaagaagtatatatatgtaaataatgcatccattgtgaagaatgccagtatatttattgctcccaagatggcgattcggacagaagcttcctggggctaatttatacgaaagaaattatgtcatgttataattttagtcatgtgaagctatagtgcgtatatatagtgacttaccagagagtagtttttatgtttgctgttggctagtgtgcatttgtagttgggacgtgctggctgtctctctacagctcggtacaaccatgtatttataacgtgttgtgaagcatatgttgtaaaatcgtggaatgggagtgttctgcgatccccatatgttgttgtaatgttgtatattgatgaccatgctgcaacggcagcatgtttgtaactcgttaaaaaaaaaaaaaaaaaaaaaa

SEQ ID NO: 5501 - DNA, 1493 bp, Oryza sativa
  Predicted polypeptide sequence is orthologous to G427
gccttctcgctggccattagagctagctagcgagagctctagctacagctatacatacgtgtacccaacggccacggtcacccgcgcgagcgagcacgcgcaccaaccgatcgagcccaacaagctcgctcgctcttggtgcgcgcgcgcgcggcgagttcgatcgatcggtgtatacgcgtatcgtgttgtgtatgcaaggcggtgatcacggaggcatggagatgggcgtggggtcgttcaccggcggcggaggaggcggggagtgctcgtcgtcgtcggcgacggcggcggctgctgcggcggctgcggcggcggcggcggcggcggaggcggaggagcggcagctgctcaagggggagatcgcggtgcacccgctgtgcgagcagctggtggcggcgcacgtgggctgcctgcgcgtggcgacgcccatcgaccacctcccgctgatcgacgcgcagctcgcgcagtccagcggcctcctccactcctacgccgcgcaccaccgccccttcctctccccccacgacaagcaggagctcgactccttcctcgcgcagtacatgatgctgctgtgctcgttcagggagcagctgcagcagcacgtccgggtgcacgccgtggaggccgtcatggcgtgccgcgagatcgagcaatccttgcaggacctaaccggtgcaactttggaggaagggacaggggcgaccatgtcggaggacgaggatgagacggcgccgatgctggagggcccgatggatatgggctcggacgggcacgacctcatgggcttcggcccgctcatgcccaccgactccgagcgatccctcatggagcgggtcaggcaagagctcaagattgagctcaagcagggcttcaagtcaaggattgaggatgtgagagaagaaatattgaggaagaggagggcaggaaagttgcctggggacaccaccaccatactcaagcaatggtggcagcaacactccaagtggccataccccacggaggatgataaggcaaagcttgttgaagagactggcctgcagctcaagcaaatcaacaactggttcatcaatcagagaaagcgtaactggcacaacaactcacagacatcaacccttaaatcaaagcgtaaaaggtaaacaaaccgttatccaagtattttatccacagtaatacaatgttgatgtttcagtaattaacaactgaattataacacaaacttcttttttctatatgtaatacaggtaaagggcagaaaaaaatgtatacctgacgtactcgctaatcaaatcaaaagaagacatggtgactcataagtaataagatcatcttaaattgtatatctagttattaattagtcagaggtgacaaattcatgacatacatactagtctgaccactggcatatgcgttgtaatttttgagcagatatgctcaagcaaattcttcttgttggtatagtttttaaaaaaaaaaaaaaaaaaaaaaaaaaa

SEQ ID NO: 5502 - DNA, 1125 bp, Oryza sativa
  Predicted polypeptide sequence is orthologous to G427
gatactcatagctctctacctctctagctagctagctataggtagctagctagtcctcctgctacctaggggggcgacgccgccgccgccggggacgacggccgcgagctcgaccagttcatgacgcactacgtcttgctattatgttcgtttaaagagcagctacagcagcatgtccgtgttcatgctatggaagcagtaatggcatgctgggaacttgaacaaaaccttcagagtttgacaggtgcctcgcccggtgaaggcacgggagcaaccatgtcagacggtgaagatgatcaggcagatagcgaggcaaacatgtatgatccaagcttggatggagcggataacatgggtttcggccttcccacagaaagcgagcgatccctaatggagcgtgtccgtcaagagctaaagcatgaactaaagcagggttacaaagagaagctgattgacataagagaagaaattcttcgcaagcgaagagcgggaaagctaccgggagacacgacttctacgttaaaagcttggtggcagtctcatgcaaagtggccatatccaacagaggaagacaaggcacggctagtccaagaaacagggctacagctaaagcagatcaacaactggttcatcaaccaaaggaaaagaaactggcgcagtaacccatcttcctccaccagcgtcaaaaccaaacgcaagaggtgataacaattcgtagcagatgatcgccgagggctgaacactatgctgggttacagggcaggaggaattcatccaaagcaataggaggacaattgcttagatcaggaaatgttctgcaagatcaggatcaggagccgtatattagagaaccagttatattttatagacaaaactaattgcaagtaaacatatatagttctgtaagcgcttgatttgaagaaaaggggaaatttttccaaaggggttgtataaaatggcgaaatttatatttcagtttctagataccactgggtaatactgctcatagcactggtgttgatgtttttgttctccatgcgtcgtagacaagcggttgaaccgtccgcttcagacgatttttttcacacgtatatatgtatgtattgctgtgggtttatttagctt

SEQ ID NO: 5503 - DNA, 388 bp, Oryza sativa
  Predicted polypeptide sequence is orthologous to G427
ttgataatcgtaccaatcagaattattcaaaacaggactgggagaataccaatcatcaagatgcatacgtttcacaacaacaacaacaacaaccaccaccaccaccccaatcgagacaagaacatattcttcaacaattatcagctattaaagaaaatcttgttcgtcgacaacgagaattggcttcctcaatgagtgctattccagtctaataccttacacattcgccaagcgacttcgtatcatcttctttttttttctctctctctctctctctttacatcgtgtttgtttaatctttttttctttgtgtgtgtgtgtgttacatttaaatatttgaccaataatgttgatggatataaatcattatcactgactattgagaaag

SEQ ID NO: 5504 - DNA, 1273 bp, Oryza sativa
  Predicted polypeptide sequence is orthologous to G428, G1594
gaattcccccatgagcctctgcctccctgcctgcccccgtatgtagcaagaacaagaacaccagcgagtaacacaggctcgctacagtggtactagattaccgcttgtgcgggcatagtgatcgtctatagttgtgaattgcgatgcagcagcataggtggtgagctgctgcggctgctgctgctggtacgtagatggaggatctgtacagcatccacccggggatctcgcgggtcggcggcgcggcgagcgaggcgtccggcgtgggcgtcgtcgtcggcggcggcggcgggtcgtcgtcgtcggatctgacggagctcatgaaggctcagatcgccggtcacccgcgctacccgaccctcctctccgcctacatcgagtgtcgcaaggtgggagcgcctccggaggtggcgtcgctgctgaaggagatcggccgggagaggcgcgccggcggcggcggcggcggcgccgggcagatcggcgtcgaccccgagctcgacgagttcatggaggcgtactgccgggtgctggtgcgctacaaggaggagctgtcccggccgttcgacgaggcggcgtctttcctcagcagcatccagacgcagctcagcaacctctgcagcggcgccacctcgccgccggccaccaccgccacgcactccgatgaaatggtggggtcctccgacgaagaccagtgctcgggggagactgatatgctagatatagggcaagagcaaagctcccgcttagctgaccacgaactcaaggaaatgcttctgaagaagtacagtggctgcctcagccggctccggtccgagttcctgaagaagcggaagaaagggaagctaccaaaggacgcacggtcggcactgcttgaatggtggaacacacactaccgctggccatatcccacggaagaagataagctgaggcttgcagcgaggacaggtcttgacccaaagcagatcaacaattggttcatcaaccagaggaagaggcactggaagccatcggacgggatgcggttcgcgttcatggagggcgtggcgggtggatcgtccgggacgacgctctacttcgacactggcacaattggaccatgaattcatttttgagcaatgccgcctcttgagaaaattggccatttaggcagtaatagtaggacatggtatttggtggtgattgtgtctagctatgatcaatctttcagcaggtcagtgttattcagttcagggtaaagtaattgcctcattgttttggcaaaaaaaaaaaaaaa

SEQ ID NO: 5505 - DNA, 1785 bp, Oryza sativa
  Predicted polypeptide sequence is orthologous to G428, G1594
gaatctttgtttccatgtctgtctgaattctgatctcttcttctctctgcctgcagacacaagcaggtgactcctccatcctcccaaagcaaagcacccatgtatcccgctgctgccgctgctacctacaagtgcaccctgcagaagctgcttctccttctccttctgatctgaggagctgcagctgctgctccagcagcagaggctgcagtgcaatccgctgccaaattcctcttcttctccttcctactagcttttctcttcttcttcttcttcttcttggaaagctggaacttggagctgcttaagcttacacctgctgattcatctccagctgctgctgctgctgattcagtattattatgtgtggagatgtacagtagatgaggaggaaggaagtagctactggatagctagctgagctgagctaagctgagctaagcttcttggctaggtaggtagctagaggtgaggtgaggtgggggaagaggggattggacatggaggatctgtacagcatccacccgggaatctcccgcggcggcggtgggggaggaggaggtgcggccagcgaggcgtccggggtcgccggaggggggagctcgccgccgcatcccccaccgccggcgacgacggcggcggcggcggatctgacggagctgatgaaggcgcagatcgccggccacccgagctacccttccctcctctccgcctacatcgaatgccgcaaggttggtgcgccgccggaggtgaccacgctgctggaggagatcggccgggaggggcgcggcggcggcggcggcgcgacagccggcggggaaattggcctcgatccggagctcgacgagttcatggagacgtactgccgggtgctggagcggtacaaggaagaactcacacggccgttcgacgaggcggcctccttcctcaccggcatccacacccagctcgcctccctctgtggcggcgcgccgccgcccaccgacaactccgatgaaatggtggggtcttcagaggatgagccgtgctcaggagacgccgatgcagcagattttgggcaagaacacagctcccgcttggctgaccatgagctcaaagagatgttgctcaagaagtacagtggctgcctcagccgcctccggtccgagttcttgaagaagaggaagaaagggaaactaccgaaagacgcgcgatcggcacttatggactggtggaacacacattaccgttggccttaccccacggaagaggataaggtgaggctggccgcgatgactggcctcgacccgaagcagatcaacaactggttcatcaaccagaggaagaggcactggaagccatcggaggacatgcggttcgcgctcatggagggggtcaccggaggatcctcctccgggacgacactgtacttcgacaccggcacaattggtccatgatcagattgcactccaaattaaatgtagcaccttgcaacagacattggcaggtattacctgctgctacaccctctgtgaggagcaagggatgatcatatattaaaaggaaaaaaagatgaaatcaatcaataacctcatcattttgtcgaaattattgtgtatatggtgttgtaagagggagttgggatgacctgtaaaaacttgcctgcattcagctaccataacattaattaattgtttgtatccctgacaactgcatccccagttaaaaccattttagacaggaaagagtgaactatgagtaatagtaacatgtagcaataataaagatacttattttttcccttgc

SEQ ID NO: 5506 - DNA, 714 bp, Oryza sativa
  Predicted polypeptide sequence is orthologous to G438
atggtagccgagaagcgtagtgcagcgctacgagctggtccattctcgtatcctgaccggctcgatcgatcgatcgatcgaaatattatacactactgcatgcgtactagcagtacgatttttctaagccgaagctgcacttcgctgcagggcgagcattatccggtcagtccggttcacgccgcggccgcatgcatccaaccgcttataatttgcaggttcgccgccttgttttctcctcggttccgggcgcggccgtcgaacagtgcgggcatgtgtggcgacagtactacagcggtacaaccggttggccatcggcgagagtacgtaccagtctgcgtgcctgtacgtgacgtgacacggtattcgtgcgtgcgtatgcggtacacgctcgcggactcgcctgtcactcgattatcacgggccggtttggctgaattatccgtggacggtggacaaatggatctcgcaccctgcagcgcagtggtccgtccgtccgtcctctttgctgcgctggcgaagtggcaagtcagtgaagtcgcaaatggagatcctcgctgtcattggaccggttgggtgggctggcgtaccatacggccataccaggcaggagtgaaacgaagacgacaagatgtgaatcgttcacggcttcaagcgtggatcatagggaacctgtacacgaagatgctgaagcagtgtgaagatttttactag

SEQ ID NO: 5507 - DNA, 1206 bp, Oryza sativa
  Predicted polypeptide sequence is orthologous to G440, G864, G1421, G1750
cttggatgagatttggggtgacgtcctcgtagcgggcggtggatatgcgtcctccggcgatgtctccggcggactccctcgccgccggcaggagccgccgtgttggggctagcatgcctcggcccaagcgtgtccgcgtctacttcgtggacgccgacgccacggacaccgactcctccggggacgagcgctccaggccgcgcgtccgggaggtcatcgacatcgacgtcggggccgcctcgccggcgccggcgccgaagcacccgaggcggctggttccgacggcgacggcggcgctggcccggcggcgcgcggggatggcggcgagccggcggttccgcggcgtgcggcggcggccgtggggcaggttctcggcggagatccgcgacccgagcctgcagaagcggctgtggctcggcaccttcgacaccgccgaggaggccgccgccgtgtacgacgacgccgcgctccgcatcaagggctcccacgccgtcaccaacttcccctccgactccgacaccccctccgccaaggccaagcagatgaagctccaccctcgccgacacaccaccccggacaagaccccaagctcttccaccgccgccgccgccaaggcctccgtccccgatccgacgccggcgccaccggaggaggaccgcgccaacgacagctcgttcaacccgttcgcgtcgccgacctccgtgctccggtacgcggcagcggacgaggtgaccgcgccatccttcgagcacctcctcgtcgagctgggcgacctctcggcgccgccgccttccaccaaggcggcggagttcgactggctgccgtggtgggaaggggaggacttcgtgacggcggggctgacggcgagcaacgccgtcagcgtgaaatgacgccgctgcccccctccacccatttcgcgctctcggggcgggaaaagttggcgggagacggcgcatcagcagcaaccagcagcaatgttattactactagtattatattaattttattattattatttcgtggcagtaaaaaaaaacccagcggagtttgtactccctagtgaagtgagcagtagtagtaaatggtggtggcgtggggcccaaggcgggcgctcgctttgtgcgtgagctgccttgaatggcacgtctcccgcgtggaaacggaacagtgtaattgcgtggcagatatttattttttctttctttt

SEQ ID NO: 5508 - DNA, 1817 bp, Oryza sativa
  Predicted polypeptide sequence is orthologous to G440, G864, G1421, G1750
aacagcaaccaacaaacacacgcgaagaggcacacatctccgccttcgtgttcctcttcttctctcctcctccccccatccatccatctatcgcaccacctcccccgaaaaaatcccaccaatacctcatcgccttcgtccccttcctcgcttccacgccaaaagtcgttcgcttttccctcccttccttcccccccgtctccttgtgggttttgggaggggtggttcctcgaggtgtaggtgggtggcgcgctggcttcttcttggccgcgagggttttaggaggtttcttgagggttttggagtggtggtggtggaggattggagttggggtctgatgcgagtggagtgatgatgatgtggcctttggagatggaggaggggtttgtggctctcaagaggacggagcatgtcgaggtgacgtccttggcggtggcggtcgaggcgacgccgtcggcgaaggggggaaaggggaaggttgtggtgggtggtggtggcgccggcggcggcgttgggccgacgagggtgagggtgttctgtgatgacttcgacgcgacggactcgtcgagcgatgaggatgaggaggaggtgaccgcgcggcggagggtgaagcgctacgtgcaggagattcggttacagcgcgcggcggcggtggccgtgccgccggtgaaggtgaagggcgaggaggtgttcccggccgcggtgtcggcgaagatggcggaggccgcgaaggcgagggtggtgttggcggctgggaggaagaggaaggccggcggggtggacggcgccgagccgcggttccgcggcgtgcggaggcggccgtgggggaagtacgcggcggagatccgcgacccgtggaggcgggtgcgggtgtggctcggcacgttcgacaccgccgaggaggccgccaaggtgtacgacacggcggccatccagctacgcggccgcgacgccaccaccaacttcaaccagtccggggactcggcaagcctcgacgtcccacccgaggtcgccgagcgcgtcccgcagccgccgggggcgtccaagaacgcctccccggccacctcctacgactccggcgaggaatcccacgccgcggcggcctccccaacctccgtcctccgttccttccctccctccgccgtcgtcgcgaccgccgacacggccaacaagaagcagccgccgccgccgcctctcgtcgtccgcgagaccgacgagtcggtcgacgtcttcggctgctccttctccgacgacggcggcttcgccggcgagctcccacctctctacaccgacttcgacctcctcgccgacttcccggagcccccgctggacttcttgtccaacctccccgtggagcccttctccctggctcccttctccagcaacaatgggtcaccggacctccacctcgacgacgccccatcgccggcggcggcacaagtggacgacttcttccaagacatcaccgacctgttccagatccccgtcgtctagtgcagcagcaagaactgtaaaacaccggattaggagactaatccggcccaattttgtttgcgttttctctttttttttttcttctttattttttcgtttttagaggagaggagagttgagttaatgattccccgtcagtctagctgcggcagaacacccaccaccgcttcgtcaggggggaaagccttgacgaggcgagagagatgagaaagtcaaaagagaggcataaaacgagatcaatgttgttggggttatggtttttttgtaaaccatcgagaaaattaagttatcggtaattagcaaatactactactagtatcatc

SEQ ID NO: 5509 - DNA, 1089 bp, Oryza sativa
  Predicted polypeptide sequence is orthologous to G440, G864, G1421, G1750
cgagtgaagcactagctccacccatcatcttggatcgtgccatgtcccggtcgcgcacggtgcggatcttctgggacgaccccgacttgacagactcgtccggcgaggacgaggggtgcggcggccggagggtggggagcatggtgcgggagctgccgcctgcccagatgcccgtggcgcaggcagccgctgctgctgctttgccggagcagtgcagcggcggggacggtgatatgggaagaagggtcgttggtggcggatgcactgtgggtgtgggacggaggaggttgacgaaggacggagggcctggcgcgccgagcaccaagttccgcggcgtcaggcggaggccgtggggcaagttcgcggcggagatccgcgacccgtggcgcggcgtgcgcgtctggctcggcaccttcgacaccgccgaggaggccgcgcgcgtgtacgacaacgcggccatccagctccgcggccccagcgccaccaccaacttctccgcctccaccaactccgcgggtgcacaagatccggtggcagttggctacgagtccggcgcggagtcctcgccggcggtgtcgtccccgacgtctgtgctccgcaaggtcccgtccctgtgctccctggccgaggacaaggacgactatgaggccggcccctgcgagcccgcaactgccgccggttccaacctcaccgttctcgaggaggaggagctcggcgagttcgtgccgttcgaggacgcgccggtctacggcggcagcagcttctgggacttcgagcccgagtccggcttcctgtacgccgagccgtcgtcgcctgagacgccgtgggacgccggcgccacgtcctccggcgaggcccaagactacttccaggacttgcgcgacctgttcccgctcaacccgcttcccgcaattttctaaaaacgggatcggcttcttcaatcacggaactgcttttttgggtgttgttgagtattcgtgcctactgtgtgtacttcctgtacgtgctcttctggtgtctgcttgtgttgagtgagtcgatgagaaatgtattgtcctgagagtagagtttttttccgaaaaaaaaaaa

SEQ ID NO: 5510 - DNA, 3831 bp, Oryza sativa
  Predicted polypeptide sequence is orthologous to G446
gtgcgcaaagcagccgcggtcagcagcatcacacactgcagcagcagcagcagcagcagcaggagagaggctgggaagccaagaccaagagagagaaggcaaaaggcgcaaaggggaagaggggagcacgaccaccctcctccgtatcattgccatctactgcccccatcctactactactcctacacccgtctactccactccacaacctcttcttcttcctcctcgcgtgcgtccgggcctagctgtagcacgagctcgcctgcccatctctctctcttcgccgctttgcctttgctggcgttgcgcgttttgccacactcgctgcttcttttttatacttcgggtttgggcgggtgccactggagacattcgtggggtgccattgcggcgtcttctcctctctcaggaggcatttgtgacatttggtcgatggtgaagtgtggctaagctgctcgcttggcttagtactctggaattgaggttttatcagaatcttggcattcagattgcagctgttcttgggtttcttggagacatatggcgtcctcgcaggagaaggccaagacgggtgttctgagaaatgccgcagcgctgctcgacgaaatgcagctcatgggagaaacacagggtgccaagaaggtgatcaactcggagctctggcacgcttgtgccgggccgcttgtgtgcttgccgcagcgggggagcctcgtgtactacttccctcaggggcacagtgaacaggttgcagcgacaactagaaagattccaaattcccgcattccgaactacccaaacctgccatctcagttgctgtgtcaagttcacaacatcaccttgcatgccgacaaggacactgatgaagtttatgcacagatgacccttcagccagtaaactctgaaacggatgtattccctattccaactcttggtgcttataccaaaagcaagcaccccactgaatatttctgcaagaatttaaccgcaagtgatacgagtacacatggtggtttctcggtgccacgaagggctgcagagaagttgttcccacaactggattactcaatgcaacctcctaaccaggagcttattgttcgagatttgcatgataacatgtggacattccgtcacatttatcgtggacagccaaaacgacatcttctaacaactggatggagtctctttgttggggcaaagcgtctaaaagcaggggactctgtcttatttataagggatgagaagtcacaacttcttttgggtgttaggcgagccacgcgacaacaaacaatgttgtcatcttctgttctacctactgatagcatgcacattggcgttcttgctgctgcagctcatgccgcatcaagtggtagttcatttactatctactacaatcctaggacaagtccttcgccatttataattcctgtagcaaggtacaacaaggcaacatatatgcaaccatcagttggaatgagatttgcgatgatgtttgagacagaggagtcaagcaagcgcagatacacaggtacagttgtgggaataagtgactacgaccccatgagatggcccaattctaaatggcgcaacttacaggtcgaatgggatgaacatgggtatggagaaagacctgagcgtgtgagcatatgggatattgaaactccagaaaacactcttgtgttcccttcgtcgaccttgaattcaaagcggcaatgtcttcctggttatggagtttcagtgcctgggatggaaattggatcagcaaatatgtcatcatttccaagggctcagggtaatccctatggcagtttgcagcacattccagctgttggatcagaattggctatcatgcttctcaaccaatctggtcaaacccttgggagtccccttagttttcaccagtcctcatattctagtattatccaaaatgtgaagcaaaattatatccctcctctaacagttagcacttcagcttgtttgacaaagcaagaaagcctgccttcagatgatgcccagcaccagttccatatggcaaatatgcagaatggtgatcttgaaggctctgaagtccagcctgtcattgattcgatttctgagtcaaagttgaatgctacatcaagagatccaagaaacacagattcatacacaagtcgaagtacttcggagcaaaacagtaagggtgagcctagaggcaagactcgtaggagtaagaagggcttgcctcacaaaaccgtttcagagaaatctgacctttcttcagccccttcttggatctgtgacaatcagcaggttggtttagaatcgaaactggttggttgtgatgaacaagtaaactgtggaaatattgaagattcatcaggtgcacttactcaaggtaattttgttggacagccgcatggccatcaggttgaacaaaagggagtgctgtcgccacaaaaggtagaatcatcaaaatcacctgatggaggaaagtctgtcaattcgtttccaaaccaagggtgtttttcgcggttcattgatggtcttgattggatgactcagccttcctactaccaagactccaatgtaattcaaccagccggtgtgtcagagaacattttcagttcttctgcagatatacctccctcaatgattgctgatactatggagacttttcaggcttcatgtctttctgattgccttcctaattccatacaagaattcatctccagcccagatctgaattcactaacctttctttcacctgacatgcaaaatttggaggtccaactccagcatgatggaagcaatttgccaagcacgtccaactcgtttgtacagatgagtttttctgaagagagtgcaagtcagagtgcaaacttaagtggacttcacatggaatctacacacagaagcataaacaccacttcatgctctcaaccaatgtctactgggggctttgatgcagggatgtactcaaagttgccacgtttaaaagaatcccaaatcttgtctttgccagagattcataccaattccatgggaacatcagcttgcagtatggatgcaaccgagtacagccttgaccgaagtgcgaagccgatgaaaccaccagtgcggacatatacaaaggttcaaaagcaaggatcagttggaagatctatcgatgttacagggtttagaaattaccatgagttgagatctgccatcgcttgcatgtttggtctccaggggaaattggagcatcctggcagttcagagtggaagcttgtatatgtcgactacgaaaatgatgttcttcttgtcggagatgatccatgggagtaagtagacatgtcttcgaattggtgtctcctgttctttctactcctggtcagcatattaattgacactcatacctatgtgcttttgcttctacagggaattcatcaactgtgtccggtgcatccggattttgtcaccttcagaagtacaacagatgagcgagaatggcatgcatgttttgaacgactgtattcaagcagcttagtagtaccattttctggatgaagctctatatcgacatgaaggccacaagagaaatgcacatccgagaagctgtagttctctgaatgcgttgcattactgaatgttaagctgatttgttgacacttgacagtagtgtttgtggtagagacttacaggaaaaaaaaaggctcatcttttgcaagaagaccaggtaggaaagcccaagctgtggaaaatagtgtgcagtgattactcatgctttgatgcatttccaacttccactgtatgttgcgagctatgtcgaatcagaaacttatttggttccttacttcactcagtatacattcc

SEQ ID NO: 5511 - DNA, 3291 bp, Oryza sativa
  Predicted polypeptide sequence is orthologous to G447
ggggcgaccaaggtgaaccaggagctgtggtacgcgtgcgcggggccgctcgtctcgctgccgccgcaggggagcctcatcgtctacttcccccagggtcacagcgagcaggttgcagcatctatgcgaaaggacgcagatgcgcaaattccaagctatccaaatcttccatcaaagctgatatgcatcctccacagtgtcaccatgcttgctgatcctgacacagatgaggtttatgctcgaatgactctccagccagttagcaattgtgacaaggagacattgctagcatcagagcttgcgctgaagcaaaccaggccacaaacagaattcttttgcaaaacactgaccgccagtgatacaagcactcatggaggtttctctgtgccacgccgtgccgctgagaggatttttcctcgtcttgacttctccatgcagcctcctgcccaggaactgcaggcccgggatttgcatgataatgtttggacatttcgtcatatataccggggtcagcctaaaaggcatttactgactacgggctggagcctatttgtcagtggaaagagattacttgctggtgattcagtcttgtttattagggatgcaaaacagcagctcctcttggggatcagacgagcaaataggcaacctacgaacctctcatcatctgtcttatctagtgatagtatgcatattggaattcttgctgcagcagcccatgctgcagcgaataacagccaatttacaatatattataacccaagggccagtacttccgaatttgtgattccttttgccaaataccagaaggcagtgtatggtaaccaattatctcttggcatgcggttcagaatgatgtttgaaactgaagagtcaggaacaagaaggtacatgggtacaataactggtataagtgatctggatccagtaaggtggaaaacatctcattggcgcaatattcaggttgcatgggatgaagcggcaccaactgagagacgcaccagggtttccctctgggagatagagcctatcattgctccattcttcatctacccctcaccattattcaccgcaaaacgtccaaggctacctgggatgacagatgacgagactgaaatggacggtcttctcaagagggccatgccatgggttggtgaggagatttgcaagaaagatctgaatattcagaacagtgtagtgcctggtctaaatctagctcagtggatgaacatgcagcacagctcctcgcttcctggcacggttgtgcaaccagagttactaaactcattaagtggaaaacctgtacaaaatttggctgcagctgatttatcaaggcaaatcagttttcacccgcagttcttgcaacaaaacaacatccagttcaacactgcgttggtacctcaacaaaaccaacagacagaacaattagcgaaagttatccctacaccaaaccaattgggaagtgttataataccgcagaaggtggttcaggattgcaactctgaacaaaggcagcatgtggttactcaaccagtgcaaggcagccagccaaacataaacattccacagcctcagcttgttgttcaggctcagcttcagcaaccgcaagtcattctccaggcgcaactgcagcaacctcaagttgttgtccaggcccaactccagcaaacgcaaccttcggtccaaagtcacactgtcttacaaggaggtcttcaacaaatccagcttctccagcagcaacagccacatgtgcagcaccagcagataccgcaacagttacatcatcagcagcagcaaacacaacagttgcaacctgtccagcaggttcagcagtcagtacaggaacatcagcaaataaagatacaacctgttcatgtttccatggatgcaagtatgaatacgcaggtggcagatcatcaaatgaaactacaactactcaaggctttacagccacagcagcctctgatctcagagcagcagaagatgcttttggatttgcagcagcaagtgataaattcacagtcagctcctcagcagtgtgtacaggtaacaaaccaagctattagtttacataacagtaacactattcaatacccgacacagcaaaaggttcagtctcaccaagttcaagacttaactgggaatgtcattcctaattcaaaatcagacatcgctacttccatgggtgctagttctttgcatgtagctggtggacgccaattattgaagacagatgatgttccgtctacttcaacatcaccatccactaacagcaatcctgttcttctgcaatccatcccaagtagctccaagaaccaaagtttaactacagcaggaaagacatctcaatcatctgttgtgttgggtcctacgatcgaacaggacacaaagccatatcaaaatgtaaagcaaacagttatgattcccaagacgacagaacaaaggccagctactggacaagactgcataaataacaatcctcaaatggattacttggacacatcctcttcagctacttcggtttgcctttcccaggctgatggatcattgcaacaaaactttccaccttcatccttccaccagcatcacttgctaaaagacacagttccagatagcgagtttgaggttacagatccaagaaataaccttctatttggggtgaatattgatggtcaactgggtttaccacttaatgcagacctgcttgcgaatgacattggaaccgataaatacatggatcagttgccaggaaatggcatttctaacttcatttcatcaaaggattctcaacaagagttatcatcttcaatgatttcacattcatttggagttgctgatatggcattcaattctatagattctgcaatcaatgataccccattcttaaatagaaattcccggtctgcagcaggtcctgcacatcaacggatgagaacctacaccaaggtacacaagcgtggtgcggtgggaagatcaattgacatcaatcgatattctggatatgatgagctgaaacatgacgttgctcggatgtttggtattgaggggcagcttggtgatcaaaatagagttggctggaagctagtatatgaagatcacgagaaggatgttctactagttggtgatgatccatgggaggactttgtgaaatgtgtacgatgtatcaggattctttctccacaggaagaaatgcagatgagattagtcggcgactttggagacagctttctacccaaccaagcttgcagcagctctgatgggggtcatccctggaggataaccggcgactag

SEQ ID NO: 5512 - DNA, 2643 bp, Oryza sativa
  Predicted polypeptide sequence is orthologous to G447
cggtggtccaaatccaagggggactggttctccctctccatattctgcctatagaggttctggtggttcaccaagtccttatggagctccccgtggcaacccctatggaggccaagcctaccaggcaccgaatcgcaatgcttaccaacctccgactcagaaccaatatcagcaaccccagaatcagccgcagccgcaggaagaacagcctgctgaacagccgcagtaccaagaacagccgaacgattacgatcagcaattgcagcaacaacaagcgatgcagcagcaacagatgctcgctcagcaacaagcccaacagcaagccgctgagcagcagcgccaacaacagatgcagcaacagcagatgatgcaacagcagcaaatgctcgcccagcagcagcagcagcagcaagcgatgatgcaccagaaccagcccgaacaggcggcgagcgagtacgatggcggcaacgacgcgtctggcaaccaggcctacgaggacgcgcagtaccagcaggaccagcaggcgcaggacaattacgatcagcagcaacaagatcagcacctgcagaatcagcccgtcgacaaccattacgagcagcaacagcgctaatatgaccagcagcagcaaatcgctcagcagcagaatcaatacaatcagcctcagaatcaccaccagccggagccgcagtaccaagagcaaccgagtcagtacgatcagcaacaacagcagaattcgcaatacgagcaacagcagaacaaccagggcgcctatgctgatcagcagaatcagtttgaccagcagcctcaggccactcagtcgcaatacgaacagccgcagaatcaatacgaacaacagcaaccgcagaacaatcaataccagccgccaagccctcaccagcagcaaccgaacaatcagcctactcaacaacagccgcagcctgtgaacaaccagcagcaacagccgaaccaaccgacttcgcaccagggcggctaccagccaatgcatcagccaacgacgggctatggcggcggcgtgtcctcgccttcgactggcggcggctatggcggctatggcggctatggcggtggctctccgtctgcctatggtggctaccgtggtggcagcatgtacagcccgacgccgcgcccgaccgcgccgacaacgagcgcctatggcaactatggcgccccgcgtggcggcatgtcgcaccagtactccttccgcggcggaccgactggcaacgcctatggtggtggtggtggccagccgaacaactcggcgaacaacaatccgaatgccggcaatccaaatggcggcggcgcgaatccgtctggcaacaacaacatgcctgtcttgcccaaggcgccgaatatgccgcaggtgccgcagatcccgcagagcaatggctacaatagtccgcagcagaatcagtacaacgcgcaaaacaacgcgactgcgcagaacgatggatcctcgagcgacccttctcaacccacacaagaaggatctccacagagccactcgtcgaatcctcctccacgctcgatctctgtctcgcgcgagaatccaaattatgcgacgacccctaccggcaaccgtactgccacgcccagctatgcgactggaaatggcatccgaggcacgcagcctccaatgggcggcacccagacctatggcatgtacggcacggcgccgcgcccctccaccaaccagctcgtgcagcctgagccagcgcaggagccgccacaggacaaatcgaacgcctactccactgaatctgacgacaagagcaaccagccgactaagactgaaaaccgcaattctggtcctacgcttgtgagctcggcggacaaagggaacaaaatgaaaatgccgacgatgacgaagagcggtggcaacactggcagctcccagccactcgccaagccaatgaacaacaaaaacatctacaagattgtgattgttggaggcggtggcgttggaaagtcagccattactattcaattcattcaaggcttattcgtcgaagattatgatccgactattgaggactcttaccgtaaaacctgtactattgacggcctggttactgtgattgatattctcgacacggctgggcaagaggaatacgctgcgatgcgtgatacctacattgctggtggcgagagttttctgcttacctatgccatcaactctttacatagctacgaagaaaccgcaagtttttacaaacaaattttgcgaatcaaagactgtgactccttccctattgtgctggttgccaacaagtgcgatttggagaaacagcgtcaggtgcctgaagaacaagcgagacaacaagcgaagcagtggaaagttcaattttttgagacgtctgcctatatgaagatcaatatagaagagatattttttgaagccgtgcgagagattcgacgttacgacgcggccgctgagtcggcgaggaatggtggaaagcctccaaaatcgagttctggtggaaagaagccgtcctgtactttattttagaatcgacactgacacctgatgaatatctgatggtctgcacatagttcttgctcgttcccattttattgatgatatgatgtacatagtgctagtaataaatactgttcaatttccgt

SEQ ID NO: 5513 - DNA, 3086 bp, Oryza sativa
  Predicted polypeptide sequence is orthologous to G447
gacagcgccatggcttgccccaacggctactgacgcaaatcactccaacctccctctctctcgcgggtgtcgactcgtttctgcctcgctcatgctacgcccaagcctccacgtccacctgccctagtcctgccctcggcccctcgtgctctcgtgctctcgcaatcatgttgcccaacaacgcattccacatgcagccgcacatggctcagcagcagcagtcgcaacagcagcaacagcagcagcatccaggcgccatgcaaaacgccgccaactttgcaatgcagccttcggtctatgcacagcagcaatcgcagcagatgcagcctccgccatcgcaccaacagcagctccagcaacaccagcttcagcagcagcaccatcaacaccagatgcagcagcagcttcagcatcagcagcagcagcagcagcagcatcagcagcacctcgcacaacaccatcagcagcaaccgaatcatccacatcagcatcagcctcagccctcggtcgtctacgctggcggacctccttctgcggcctcggtgaaccaacccgtgcacatggcgaacccgtccgctggctcttccgcttatcaccccaccatgcagcagcaccaggcacagatggccaggatcgcacaggcgtctcagccacagctcggcaacccgcaacagcagcagcagcgtccaccccaaggctctgcactcacaccgcagcagcaccaacaccagctccaacaccagcagcagatgcagctcatgcagcagcagcagcagcaccaaatgcaaacgccgcagcaacagcaacacgccgctcagcaccaacaccagcaagtcatgttgcatcagcagcaacagcagcaacaacagcaacaacaacagcaacgccagcaacagcaacagcaacaactccatcatcctcatcagcatcccgcacagccccaaacaccgcagcctcagcagcctcagcagcagcatcagccgcagcagcacatgcccagtcactcgcaggtcacgctgcaatcccatcctcaggcgcagcaggctcagcaggctcagcaacagcaagcgcagcagcagcaagcatctctggccgcaccctcgctgcatcgtcaaaactcgctgccaccatctgcacagggacatcacagcaacaacaactcgcagcccaccaccgccaacaactcgcctctcccctcggcactcgcccatcgcgccgcacagcctggaccgcatcgtacgccgacgcccatctcgcatgccgctcatccgatgcagtccaccgcctcggccgcctcggcacctcccaacgccgcctcctccatgcccagcccacaggtcaacgctcccatgcccctccgccaagcttcggtgccgctcaatcatccaggacctcccactcccacgcacacccgccctccctcggctgcacccacgcccgcgctccagtccgccaatccaccggcgtcggccatgcccatgccgcgacccaacagcacctcgcccaacgcaagccagatgctccacaaagctgccgctcaagccttcgccacgcctgtcccggcaggcgccaacggtgcggtttcgatgggctcgtcgaacgtggatagcatggcgggcgcacccggcccgaatccgcatctccagtcgcacttcccaccgggagcgggcgtgctgaggctgctccaatactcggaagcgctagggagcggcgcgaatcggagcgacattgactactggcagacgtttgtcaacgagttctttgtgccgacgggcgtgtaccgtctgatcctctggaacgccacctcgcgcgaacaaaagggcttcgagatcccgacgtgcgtgctgccgcgcttcatgctgaccaactacgtctccggactgcgttcgtcgcagctgcagctcgagacgcctcgagagtaccagacgggctggccaccggtgaagccgctgccgcctctgccggcgtcgcacaagtttgtcaacagctttccgtcggccaacgtgacgcatcacgtggacacggagcaggcgacgtttgtgtcgagcttcgagagcggatggcaggtgcagatgtcgggacggctgcgggcgtcgtttgtgccctgggcgctcgagcagccgggcgaaccgggcaagatggatgtgcagctgcgtctggagtcgctcgacttcacggtgcatgcacatgcaggctatctgccacgcgtggccatccaaatgtccaaggtggatcacccgctgccctcgagcctggtggcgagcattcgaagcacatcggacaaggcggggagctcgcttcccaacggcaccaagaaggggcaggcgcgaggcactgcggctcgcaaggaagaggccaaggacgactcgaatcggggcgacgagggggcgccggcgatcaagctcgaggagggcacggggacgagctcggacgacgatgccaagagccagagcgggttcagcgtggcggtggaaaggacgttcgtgcccgactaccctgtcaacgagtatgggatcagcctgcgagccatgcggtgtctggagattacggagagcgtgtgccagctgcgcgatctgatcgacatgagcatgcgcgacaagctgggccccatcgatgcgctgcgcaagtttgcaggccagtatcgcgatatgcaatcgggccgagccacggcgcaagtgggagcagcgggcggcgcgctgggcgacgccaatggcaatggcaatggcaatgcagcgagtgctcagcagcagcagcagcagccagcggtcaactcggccgccacgccagggccgccgccgatgggacgatcgccaagcgcacacggccggccgctggagaacggaacgggctcgaaccatgcatctccagtggttgccaacggcgtgacgagcctgaagcgcaagggcaagacggcacccagtccgagtcccaagctggcggccaccgccaacccagccaagaggcaacggtgagccgccctccccccccaggctgtgttcgtttttgattgttctttgtacttgtatcctttgtcgatggtgtagcctgcaatttcccacgtcacctctgcccagagctgtattctc

SEQ ID NO: 5514 - DNA, 4166 bp, Oryza sativa
  Predicted polypeptide sequence is orthologous to G447
gggcttcctcctccacttgcttcgtcgtcgtcgtcctcctcctcctctctctactctctctctccgaaccatccttcccacccggcacgccgccgcgcgctgttcccgacggcggccggtggccggagtgagaggctgggtgtactgtccgctgatgctcgtgggaggcggcggcggcggcggcggcgtgtgatgagcggaggccgcgtgggcgagaacctgtcgcgtcggcacggcggcggcggcggtggcgagggctcgtcaggcttggccacgctttgctcccttcgcagtggcgctcccctggtgccgaatattatactcgccgccgcctcgtgccgcctactttaggcggaaagggggagagctctcctatcctagctgctgctgctgccactggctaagttggtaaaaggtggaggaggcggatattcgtgtatccggaggagagatttggatcgggatctcgccgggatgaaggatcagggatcatccggtgtgtctcccgccccaggggaaggggagaagaaagccatcaattcggagctatggcatgcttgtgccgggcctcttgtgtcgctgccgccggtgggcagtctcgtcgtgtacttccctcagggtcatagcgagcaggttgctgcttccatgcacaaggagctggacaacatccctggttatccctctcttccgtctaagctgatctgcaaacttctgagtctcaccttacatgcagattctgaaactgatgaagtttatgctcagatgacacttcaaccagtcaataaatatgatcgagatgcaatgctggcatctgaactgggcctgaagcaaaacaagcaaccagcggagttcttttgcaaaacgctgacggcgagcgacacaagtacccatggtggattttcagtgccacgtcgtgcggcggagaagatatttccaccactagactttaccatgcaaccaccagcacaagagctcatcgccaaggatctgcatgatatttcatggaaatttcgacacatttaccgaggtcaaccaaagaggcaccttctgacaactggttggagcgtctttgtcagcacaaaaaggcttctagctggtgattcagttctgtttataagggatgagaaatctcagcttctattaggcatacgtcgtgctaccagaccccaaccagctctatcgtcatcagttctatcaagtgatagcatgcacattgggattctagctgctgcagcacatgctgctgcaaacagtagcccatttactattttctacaatccaaggtattatagttcttacttgatatcccattatcccaatgcactctctgctaccctttgggactatgaactcattgttgttattctgatagggcaagtccatcagaatttgtcattcctttagcgaaatataacaaggctttgtatacacaagtatctcttggaatgcggttcagaatgctgtttgagacagaggattcaggggttcgaagatatatgggaacaatcacaggtattggtgacttggatccagtgcgctgggagaactctcattggcgaaaccttcaggttggttgggatgaatcaacagcatctgagaggcgcactcgtgtttcaatatgggagattgaaccagtcgcgacacctttttatatttgtccaccaccatttttcaggccaaaacttcctaagcagccaggaatgccagatgatgaaaatgaagttgagagtgctttcaaaagagccatgccatggcttgctgatgactttgccctgaaagatgtgcaaagtgcattatttccaggtctgagcctagtccaatggatggctatgcaacagaatcctcagatgctaacagctgcgtcccaaacagtgcaatcaccgtacttgaactccaatgcattggctatgcaggatgtgatgggtagtagcaacgaggacccaacaaaaagattgaacacacaggcacaaaatatggttttacctaatttacaggttggctcaaaagtggatcaccctgtaatgtctcaacatcaacagcagccacaccaactatcacaacagcagcaggtccagccatcgcagcaaagttctgtggttttacagcaacatcaagcccagttgctgcagcagaacgccattcacttgcagcagcagcaagaacatctccagcggcagcagtcacaaccggcacagcagttgaaggctgcttcaagtctgcattcagtggaacagcacaagctgaaagaacagacttcaggtgggcaggttgcctcacaagcacaaatgttaaaccagattttcccaccatcttcatcgcagctacaacagttaggtttacccaagtcacctactcatcgccaagggttgacaggattaccaattgcaggttctttgcagcagcccacactaactcagacatctcaagtccagcaagcagccgaatatcagcaggccctcctacagagtcagcaacagcaacagcaactgcaactgcaacaactatcacaaccagaagtacagctgcagctgcttcaaaagattcaacaacaaaacatgctatctcagctgaacccacaacatcagtcccagttgattcaacaattgtctcagaaaagccaggaaattctacagcaacaaattttgcaacatcaatttggtgggtctgattctattggtcaactcaagcaatcaccatcgcagcaagctcctttaaaccacatgacaggatctttgacgccccagcaacttgtcagatcacattcggcacttgctgagagtggggatccatccagttcaactgctccatccaccagccgtatttctccaataaattcgctgagtagggcaaaccaaggaagcagaaatttaactgacatggtggcaacaccacaaattgacaacttacttcaggaaattcaaagcaagccagataatcgaattaagaatgacatacagagcaaagaaacagtccctatacataaccgacatccagtttctgatcaacttgatgcatcatctgctacctccttttgtttagacgagagcccacgagaaggtttttccttccctccagtttgtttggataacaatgttcaagttgatccaagagataactttcttattgcggaaaatgtggacgcattgatgccagatgccctgttgtcaagaggtatggcttcaggaaagggcatgtgcactctgacttctggacaaagggatcacagggatgtcgagaatgagctatcatctgctgcattcagttcccagtcatttggtgtgcctgacatgtcctttaagcctggatgttcaagtgacgttgctgttactgatgccggaatgccaagccaaggtttgtggaataatcaaacacaacggatgagaactttcactaaggttcaaaagcgtggttctgtggggagatcaattgatatcacaagatatcgagattatgatgaacttaggcatgatcttgcatgcatgtttggtatccaaggtcaactcgaagatccatataggatggattggaagctagtctatgttgatcatgagaatgatatccttcttgtcggcgacgacccttgggaggaatttgtgggctgtgtgaagagcatcaaaatactctcagctgctgaagtacaacagatgagcttggatggtgaccttggtggcgtccctccacaaacacaggcctgtagtgcctctgatgatgcaaatgcatggagaggttgaggttcctgacagtaaatactaaattatccttaccattctttttaaggatacttgagagactcaaggatcaaatacacacctagggatctagagccaactcactgacaaattgatcaaaatgcttcgattaggcggaggatgttcagtgaaccgccttgttatggagctcttgacattttgttcacactaaaactggcaacctatcctcatagtcagattaatttcttcttttcttttcggcatacagaactgattttcagtttcataagctacctatgtttatctgggacttgttcattgtaatcttacaagttcataaacaatctgaccgtatatacatgctgttgtatctcccaatgtaatactcggatgattctattggtgtttacactacagaagtaaaaagttgtatggccaaaggcgttctattgtctg

SEQ ID NO: 5515 - DNA, 3550 bp, Oryza sativa
  Predicted polypeptide sequence is orthologous to G447
gtcagcatcaccaccaccctactctctctctctagctagggttgcgctgcttcggtctcggtcttggcgccgcctgcctcgcccttcttgctcgcccctgctcccctgtccctctcgtgtcggggcgacggacggacatcctcacccgcgcgcacgtacgggtgatcgatcgattgattcctgctccgacgaagacggcggcggcgccggtgacctcgccggacatgcgcggggcccgctgaggtctttgttgccggcgaaaggggtggagtgattgactcggtcggtgtctgcctgtctggtctgaggtcatgatgaagcaggcgcagcagcagccgccgccgccaccggcgagctctgcggcgacgacgaccaccgcgatggcagccgctgcggcggcggcggtggtggggagcgggtgcgaaggggagaagacgaaggcgccggcgatcaactcggagctgtggcacgcctgcgcggggccgctggtgtcgctgccgccggcgggcagcctcgtcgtctacttcccccagggccacagcgagcaggttgcagcctctatgcaaaaggatgttgatgcacatgttccaagctacccaaatctgccttcaaagttgatttgccttctgcataacgtcactttacatgcggacccagaaacagatgaagtgtatgcacaaatgactcttcagccagttacttcatatgggaaggaggccctgcagttatcagagcttgcactcaaacaagcgagaccacagacagaattcttttgcaagacactgactgcaagtgatacaagtactcatggaggcttctctgtgcctcgtcgagctgcagaaaagatatttcctccactggacttctcaatgcaaccacctgcacaagaactacaggccagggatttgcatgataatgtgtggacattccgtcacatatatcggggtcagccaaaaaggcatctgcttaccactggctggagtctatttgtaagcggcaagaggttatttgctggagattctgtcatttttatcagggatgaaaagcagcaacttctattaggaatcaggcgtgctaaccgacagccaactaacatatcatcatctgtcctttcaagtgacagcatgcacatagggattcttgctgctgcagcccatgctgctgccaacaatagcccatttaccatcttttataaccctagggccagtcctactgaatttgttatcccatttgctaagtatcagaaggcagtctatggtaatcaaatatctttagggatgcgctttcgcatgatgtttgagactgaggaattaggaacacgaagatacatgggaacaataactggcataagtgatctagatccagtaagatggaaaaactcgcagtggcgcaacttacaggttggttgggatgaatccgcagccggtgaaaggcgaaatagggtttctatctgggagattgaaccggtcgctgctccatttttcatatgtcctccaccattttttggtgcgaagcggcccaggcaattagatgacgagtcctcggaaatggagaatctcttaaagagggctatgccttggcttggtgaggaaatatgcataaaggatcctcagactcagaacaccataatgcctgggctgagcttggttcagtggatgaacatgaacatgcaacagagctcctcatttgcgaatacagccatgcagtctgagtaccttcgatcattgagcaaccccaacatgcaaaatcttggtgccgccgatctctctaggcaattatgcctgcagaaccagcttcttcaacagaacaatatacagtttaatactcccaaactttctcagcaaatgcagccagtcaatgagttagcaaaggcaggcattccgttgaatcagcttggtgtgagcaccaaacctcaggaacagattcatgatgctagcaaccttcagaggcaacaaccttccatgaaccatatgcttcctttgagccaagctcaaaccaatcttggccaagctcaggtccttgtccaaaatcaaatgcaacagcaacatgcatcttcaactcaaggtcaacaaccagctaccagccagcccttgcttctgccccagcagcagcaacagcagcagcagcagcagcaacaacaacaacaacagcaacaacaacaaaaattgctacaacagcagcagcaacagcttttgctccagcaacagcagcaattgagtaagatgcctgcacagttgtcaagtctggcgaatcagcagtttcagctaactgatcaacagcttcagctgcaactgttacaaaaactacagcaacaacagcagtcattgctttcacaacctgcagtcacccttgcacaattacctctgatccaagaacagcagaagttacttctggatatgcaacagcagctgtcaaactcccaaacactttcccaacaacaaatgatgcctcaacaaagtaccaaggttccatcacagaatgatggacttctacatcaaaatttccctatgtccaacttcaaccagccacagatgttcaaagatgctcctcctgatgctgaaattcatgctgctaatacaagtaacaatgcattgtttggaatcaatggtgatggtccgctgggcttccctataggactaggaacagatgatttcctgtcgaatggaattgatgctgccaagtacgagaaccatatctcaacagaaattgataatagctacagaattccgaaggatgcccagcaagaaatatcatcctcaatggtttcacagtcatttggtgcatcagatatggcatttaattcaattgattccacgatcaacgatggtggctttttgaaccggagttcttggcctcctgccgctcccttaaagaggatgaggacattcaccaaggtatataagcgaggagctgtaggccggtccattgacatgagtcagttctctggatatgatgaattaaagcatgctctggcacggatgttcagtatagaggggcaacttgaggaacggcagagaattggttggaagctcgtttacaaggatcatgaagatgacatcctacttcttggcgacgacccatgggaggaatttgtcggttgcgtgaaatgcattaggatcctttcacctcaagaagttcagcagatgagcttggagggttgtgatctcgggaacaacattcccccgaatcaggcctgcagcagctcagacggagggaatgcatggagggctcgctgcgatcagaactccggtaacccttccaatggttcatatgaacaattcgaatgaccaaattcaccagtccatattgtcatgctgcgccggtgtaagtagacaatcaccggagtgttgttgtagatgttatcagcttacatccgggagcgcaaatggctcggcggatcagtagtgttttttttgtctatatgtgtagtttctcacacatcaaaagggagtagggatggtaaatgaaacttacctagagtttcttaaggttaggcgaaagatgattgtactgttggaaaggcagttctgtagtaaaatgattcttctcc

SEQ ID NO: 5516 - DNA, 1548 bp, Oryza sativa
  Predicted polypeptide sequence is orthologous to G447
tcgcctcaaacctcaattcgacaaatccatctcccgctccacccaaaacccctcgtcctctctcccggcgacaatggcggcggcggcggcgccgctcgccgacgacggcgacgggatcgtagaccgtggcatgtggctcgcatgcgccgccccgaactccggccgcctccccgccgtcggctcggtggtcttctacttcgtcgacggccacgccgctcagttttgccagttccccgcccctctcctggagcagctcgccgtccccggcccccgcgtcttcctctgtacggtggccgccgtccgcctccgcgccgacgccctcaccaatgaggcctacgccgagatcaccctcgacccggtcgccgaccacgacgtcccgcgcctggcccccgctcccgctcccgcacccgccgccgccgccggtggccagcagttgcgttacttcgtcaagacgctgatgatttccgacttcgacttccgcatccgcttctccgcccccatggctgacgccaaaggcgtcttcccgccgctggtcgacgccaaagcggtccagcccctcctcgtcaaggacctccatggatctccgatgacgttcgactacggcaggaagggcaagagagtcacgctcgccaaggtctggaagaaatttcgggacgacatggacttcgtcgacggagacagcgtcatcttcatgcgtcgccgcgacgacgacgacgacgacggcgagctgtacgtcggggtgcggcgccagcgcacgctcgaaaggccactcaggaatacgatgcgccggtacaggcctccgaccccgccccaggcggccgtgcaggaggcggtactagccgcggcgggtcacgcggcggccggcgagcggttcacggtggcgtaccggtcgcggaaggacggcgacgagttcgtcgtgccacgcgaggcggtggaggaggggctccgcgccagactcacctcgctggcggaggtggagtttgtgtgggccgtcgaggacggcgcgccgcccgtcgtcgggccacggggcaaggtcaccgccattgccaccggacagctgtggcgaaatctcgagattgtatgggatggaaactcggagatggacatgagtgccaacttttggcaagttcgacctgttgaggaagttgatatttctccttctactcctcctccgaagaggctcaagaattgtgagattgatgataccgcctctacttctgtttccgtcgacaatggagatgagcaagttccaacgatgaggcaacggctagaggcgctgattcctgataacatctgaggccaagtacacctgcttgtgactaactcaagtaaaaattagttctgtcacttgcgagttgtgactttgtgagattgggtccgtcatgaatcagctttggtctgcatttagtttgaaggttattccgaatagtttcaaaattcggggaacaagtttgcagtgttaaatgtccattctaaatctgacggaataggaaaatggtgtacctgaaatctgatatctgaagaacacgaacagttcagatcgagatg

SEQ ID NO: 5517 - DNA, 2289 bp, Oryza sativa
  Predicted polypeptide sequence is orthologous to G447
atggcggcggcggcggcggcgctcgccgacgacggcgacgggatcgtagaccgtgccatgtggctcgcatgcgccgccccgaactccggccgcctccccgccgtcggctcgatggtcttctacttcgtcgacggccacgcagagcagttttgccagttccccgcacctctcctggagcagctcgccgtccccggcccccgcgtcttcctctgtacggtggccgccgtccgcctccgcgccgacgccctcaccaatgaggcctacgccgacatcaccctcgacccggtcgccgaccacgacgtcccgcgcctgctccccgctcccgctcccgccgccgccgccggtggccagcagcagcagttgcgttacttcgtcaagacgctgatgtcttccgatgccgagtaccgagaccgcttcgccgtccccatggatgttgccaaggacgtcttcccgccgctggtcgacgccaaagcggtccagcccctcatcgtcaaggaccttcaaggatctccgatgacgttcgactacggcaggaacggcaacagggtcacgctcgccaaggtctggaagaaatttcgggacgacatggacttcgtcgacggagacagcgtcatcttcatgcgtcgccgcgacgacgacgagctgtacgtcggggtgcggcgccagcgcacgctcgacaagccactcaggacgcgccgatccaggcctccgacaccgcttccggtggccgtgcaggaggtgatagctgcagcgggtcgcgcggcggccggcgagcagttcactgcgacgtaccgctcgcggcaggacggcgacgagttcgtcgtgccacgcgaggtggtggaggaggggctccgcctccgctccagattcactcccgagatggaggtggagtttgtttgggcccttgaggatggcgcgccgcccagcgtcgggccacatggcaagatcaccgccatccacgacactacatggatgtggcgatcagtcgagattggatggacgggaggttcagagatgaacaagtacgccaacttctggcaagttcgattggttggttcggacgattttgcttctgctgctcctccccctcctctttctccaaagaggctgaagagttcagagcagtgcccgtcgcgtccaccagagccccttccaggcagggtgtttctatgtaaagtcacagctgtccgcttggatgcaacaagaaatgagctctttgcgaccatgtccctcatcccagtcgccagagaccaagccatccagcctcaggcgcccgctgatccaggtccaagctcccctcaagtgcagactactcttgtttcatttgtgaagcctctcacgtgcaccgatgctgtcaagaatcggtatcggttcatagtgcccaagagagagaccgccatgggtgttctaccccagctccaattgaacgaacacgtgccgctctatatcaaggacatgcacggaaaggagtgggtgattaattatacatggaaagagtacacccacatgctttccagtggctggataaaattcgcgaatgccaaccgccttgtcacaggtgacaacgtagtgtttatgcgcagcatggacagtggcgagagatacatggggctgcgtcgcaccctcaagccggagccagtgtcagttgacgaagtgattgaggccgtatggagggcggcgcgtctcgagccgttcgaggtgacctacctctcgcgccaggacggcgacgagtttgttgtaccgtgtgggattgtacataatgctctacgagcgaagtttaccccaggaatggtggtaaacttcgtatgggctgttgaggaggacaggctgccgaatgttgggccacagggaaaggtcattgccatagagaactatgcaacctcaatctggaggatgattcaggttgagtggccatcctgtgcaggaatgaacagatatgttaatttttggcaaattcgtgaagttcttggagagagttcctttgaggcatccacttgcattgtgagaagtcaagattactcgccggcaccacagaggaatttagttaatgcgcttcagcttcctgacggaacaaaacagcttcagcaaaacaagaagtctgtttcctcgtcatccaccttccgactctttggcaaaaaaatgacacctggcgtgccaccaagaagagacaccagtggtctttctggacaggtatcattattcagccattatcttccccatgatgaggacgatggacaagttccaacgatgaggcaacggctagagacgctgtttcctgataacatctga

SEQ ID NO: 5518 - DNA, 3420 bp, Oryza sativa
  Predicted polypeptide sequence is orthologous to G447
atgaagcagcagcagacgccggcgagctccgcggtgaccgcggcggcggcggcctcctcctccgccaccgccgccgtggccgcatgcgaaggggagcggaaggcggcggcgatcaactcggagctgtggcacgcgtgcgccggcccgctcgtgtcgctgccgccggtgggcagcctcgtcgtctacttcccgcaaggccacagcgagcaggttgcagcttctatgcaaaaggatgtggatgcacatgttccaagctacccaaatcttccctccaagttgatatgtcttcttcacggtgtcaatttgcatgcagacccagatactgatgaagtttatgcacagatgactcttcaaccagtgaatacatatggaaaagaggcgttgcaaatatcagagcttgcactaaaacaagcaaggccacaaatggaattcttctgtaagacactcaccgcaagtgatacaagtacacatggaggattctctgtgcctcgccgtgccgcagagaagatattccctcccctggacttctctatgcaacctccagctcaagaactgcaagctagagatatacatgacaatgtgtggacatttcgtcatatatatcgaggtcaaccaaaaagacatttacttactactggttggagccttttcgtgagtggcaagaggttatttgctggtgattctgttattgttgtgagggatgaaaagcatcaacttctactaggaatcaggcgtgctaacagacaaccgactaatatatcatcttcagtactttcaagcgacagtatgcacataggagtccttgctgcggctgcccatgctgctgccaacagtagcccttttaccatattttataaccctagggccagtcctactgaatttgttatcccatttgcaaaataccagaaggcactgtatagtaatcagatatctttaggaatgcggtttcgcatgatgtttgaaaccgaggaattaggaacaagaaggtacatgggtacaataactggaataagtgacctagatcctgtgagatggaaaaactcccaatggcgcaatttacaggttggctgggatgagtctgcagctggtgaaaggaggaacagagtttcaatctgggagattgaaccggttgcagctcccttttttctatgtccccaacctttttttggtgtgaagcgccccaggcaattagatgacgagtcagagatggaaaaccttttcaagagggcaatgccttggcttggtgaggaggtatgcataaaggatactcaaaaccagaacagtacagcacctggtctaagtttggttcagtggatgaacatgaacaggcagcagagctcatcattggctaacaccgctgcgcagtctgagtacctgcaagctctaggtaaccctgccatgcaaaaccttgctgctgatgaacttgcaaggcaactatatgtccagaacaatctccttcaacagaactgcatacagtttaattctcccaagctccctcagcaaatgcaaaccatgaacgatctgtccaaggcggcaattccgttgaatcagcttggtgctatcatcaatcctcaagatcagaaacaagatgctgtcaaccatcagagacagcagaactccatacaagtgattcccctgagccaagctcaatctaatctcgtccaggctcaggtgattgttcagaatcagatgcaacagcagaagccatctccaactcaaaacccgcaaaggattaatggccagcggctgcttttgtctcatcaacagaaggatcaaaatttacagctgcaacagcagcttttacttcagcaaaaacaacagttacagcagcagcagcagcagcaacaacagaatcagcagcagctaaataagtcccttggacagttggtaaatctggcaagtcagcagtctaagttgtttgatgaggagcttcagttgcagatattacagaaactgcagcagcaatcactgatgtcacaatccacatcaacactctcacagccacctctgatccaagaacagcaaaagttaatcacggacatgcaaaagcagttgtcaaattcacattcacttgctcagcaacaaatgatgccccaacaagaaatcaagccttcattgcaagcaacaccattgctacccacggtccagcaagagcaacagcagaagcttttacagaaacaagtctcacttgcagatgtgtcaggagttgcttttcaaccaatttcatcaaccaatgtgatccccaaaactggaggtgctatgatcatttcgggtgctacacaatctgtagttacagaggaaatgccctcttgttcaacatctccatccacagctaatggaaaccactttacacaatcaaccaaaaacagacattgcatcaacacagaaaggctgccaccgtccactgctccaatgttgatcccaacctccattgacgctgtaacagcaactccactaatgaccaaggaattgccaaagccgaataataatgtgaagcaaagtgttgtcaactcaaaattaccaaatgttgctcctggcccacaaaattgtataaaccatgcattgcaaacagacaacttggaaacatcttcatcagcaacttcattatgtccttcccgaacagatggacttgtgcatcaaggtttcccctcttctaacttcaatcaacaccagatgttcaaagatgcacttcctgatgtagaaatggaaggtgtggatccaagtaacagtggcttgtttgggatcaacaatgataacctgttaggattcccaatagaaacagaggacttgctgataaatgcacttgattctgtcaagtatcagaatcacatatcaactgatgttgaaaacaactacccgatgcaaaaggatgctctgcaagaaatatcaacctccatggtttcccagtcatttggtcagtcggatatggcttttaattccattgattctgcgatcaatgatggtgccttcttgaacaaaaattcctggcccgctgcccctctgctgcagagaatgcggacattcaccaaggtgtacaaacgaggagctgtaggccggtctattgacatcggcaggtactctggatatgaagagttgaagcatgctttggctcgcatgtttggtatagagggtcaacttgaagatcgacagagaataggctggaaactggtctacaaggatcacgaggatgacatcctgcttcttggtgatgacccatgggaggagtttgtgaactgtgtaagatgcattaggattctatcacctcaagaagtgcaacagatgagcttggatggtgatctggggagcaatgtcctccccaaccaggcttgcagcagctcagatggggtgaatggttggaggcctcgctgtgaccagaaccccgggaacccttccatcggcccgtatgatcaattcgaatga

SEQ ID NO: 5519 - DNA, 600 bp, Oryza sativa
  Predicted polypeptide sequence is orthologous to G447
ttctgaacaaaaattcctggcccgctgcccctctgctgcagagaatgcggacattcaccaaggtgtacaaacgaggagctgtaggccggtctattgacatcggcaggtactctggatatgaagagttgaagcatgctttggctcgcatgtttggtatagagggtcaacttgaagatcgacagagaataggctggaaactggtctacaaggatcacgaggatgacatcctgcttcttggtgatgacccatgggaggagtttgtgaactgtgtaagatgcattaggattctatcacctcaagaagtgcaacagatgagcttggatggtgatctggggagcaatgtcctccccaaccaggcttgcagcagctcagatggggtgaatggttggaggcctcgctgtgaccagaaccccgggaacccttccatcggcccgtatgatcaattcgaatgacctgacttagaggttcattcacatatgaaatatttgacatccctgtcttattttgcgtccattatgaattcagaatgggatcagaagagatgcaatggctacaaaaacccagcataactatcatcaaatccgtggcctaaaaggctat

SEQ ID NO: 5520 - DNA, 385 bp, Oryza sativa
  Predicted polypeptide sequence is orthologous to G447
tcgtactgctgaattaattggaaatacatattcacaattaaatggtggtcaaacaccaacaacaccatcaccagcaaatacaacaacaggttctactgatacaacaacaacatcaactacagatcaaacaacagcaacaacaaccactgcacaatcatcgtcaacaacaagtggtgatgttcttccatggacagtaaacaaattctacaatgttggcgatcgagttagttatcaaaacaaaatctatcaatgtatcgaagcacatacatccctatcaacatggacacctgatgtcactccagcattatggaaacttatttcatcttaaaaagtgtttctgttttgaaagaattcaatcaataaacatggatttcagtgtaaaaag

SEQ ID NO: 5521 - DNA, 580 bp, Oryza sativa
  misc_feature (45)..(45): n is a, c, g, or t
  misc_feature (81)..(81): n is a, c, g, or t
  misc_feature (90)..(90): n is a, c, g, or t
  misc_feature (196)..(196): n is a, c, g, or t
  misc_feature (274)..(275): n is a, c, g, or t
  misc_feature (281)..(281): n is a, c, g, or t
  Predicted polypeptide sequence is orthologous to G450, G456
tggcgcctgtgagaagtgttgttctacgttgggctttcacccaancctggccaaaggatgggctttattctggagagccgnccaaagganggctgcaataatggtgcgtgacttgatgaagaccataggatggaggactggagtgcttgtgttggccgatgtttccactggggagaatcgttgtcccacaactctntgtcgcagactcaggatcatgaaaggttcagatgcaattggacttgctcacaagggcagttgataagtccctaatatnnccgcantactagaatggtttctggccccacaagtcaaaagccaagatggagtatcaaatgactgtagggaattttgctgaaaaccaagaagtgctgaacacgttttaagatggagtgctgcgccttatgggctgtactacactggtttgctattggtgaaagttaaaaaaaaaaggtgtcttgttatgttagcttcgccaaatctccctagggacataaactctatttggattgtgcccaagtcgtttgtacgtgtgttaatgctattcgtgtaaatggtttggtaaaaaaaaaaaaaaaaaaaa

SEQ ID NO: 5522 - DNA, 1118 bp, Oryza sativa
  Predicted polypeptide sequence is orthologous to G450, G456
attttgctttgctttctttgctttcctctcctctctcgccgcccacctcgccgtcgccgccgccgcgagggccaacgccggcgaagtccgcgagccgaagcatcacacagctgcgccagcgatgtcggtggagacggagcggagctccacggagtcgtccgccgcgtcggggctcgacttcgaggacaccgccctcaccctccgcctcccgggctccctcgccgccgccgccgcacctgaccccgaccgcaagcgctcctccccctcctcctccgacgccgccgacgccgcagacaactcctcccccctcgccgccgccgccgatgctccccctgctcccaaggcgagggtggtggggtggccgccggtgaggtcgttcaggaagaacgcgctggcggccaagttcgtgaaggtggccgtggacggcgcgccgtacctgcgcaaggtggacctcgaggcctactccggctacgaccagctcctccgcgcgctccaggacaagttcttctcccacttcaccatccggaagttcgccgacgacgagaggaagctggtggacgcggtgaacgggacggagtacgtgccgacgtacgaggacaaggacggcgactggatgctcgtcggcgacgtcccctggaagatgtttgtggaaacttgccagcgccttcgtctcatgaaaagttcagaggctgtcaacttagcaccaagagccgctcaatgaggcattcccggtgcccatgaccgtgtggttggattgaaagaaagtggaagctttgccccgccgatgttcgcccacgtgtgatatgaacatgtacagttgtctcctactacttttggttccttgatgatgctgagttgagaaaaaggttgtagtttcgttactcgtctgtagtctctccatatatagataatgaagcactgaagcttgaaatatacacctacagtttgtctctttatgaataagaccatatacgcaaaaaaaccgatgttctttgctgcggctcgcgtgtcgtcaggctatatgcagttttttgtcgcaccataggcgatggacatctctggccttatactttcgtaaaaatcttatcatgttaagcgatggtcttgctttggagttc

SEQ ID NO: 5523 - DNA, 1204 bp, Oryza sativa
  Predicted polypeptide sequence is orthologous to G450, G456
gatataatctcctccgccgccgcacctcgcagagagagagacgccgccgccgtcgccgccgccggcgaccggagagaaagagagagaagagcaacgcccacggcttcgccgccgctgccggcgaccatgtcggtggagacggagcggagctcgacggagtcatcggcggcgtccgggctcgacttcgaggacaccgccctcaccctccgcctcccgggctcctcctcctcctcctcctcctcctcgtcatcctcctcctcctcgtcgccgtcggagcccgaccgcaagcgcgcctccgccaccgacgacgaccccgacaaccgcctcggctccaccgccaccgagtcccccccttcccccaaggcgcgggtggtcgggtggccgccggtgcgcgcgttccggaagaacgcgctcgcggcgttggcggcggcgtcctccagcaaggccaagttcgtgaaggtggccgtcgacggcgcgccgtacctgcgcaaggtggacctcgaggcgtaccggggctacgaccagctgctcgccgccctccaggacaagttcttctcccacttcaccatccgcaagctcgggaacgaggagatgaagctcgtcgacgcggtgagcggcaacgagtacgtgccgacgtacgaggacaaggacggcgactggatgctcgtcggagacgtcccctggaaaatgtttgtggagacctgccaacgtcttcgtctcatgaaaagctctgaagcagtcaatttagcaccaagatctgcttgatgagtcgcaaatctctgctcctgtctttgagaagcatgagaggaagccatctttgcttgctgaggtttttccatgtctgtgagagaaatgtgtacagtcatcgacttcgacttttggttccatcgtgctattgagtttcagaaaagaaatggtttttagcttgtagctttgttaccagtcagtagtctctccatatagatgagcgaagcggtgatgctttaaaatacacccatagattgttttctcgataaataaaattggtctcactcactgagcccctgttcttcgacatgctttctaccactagtttgttcgataatgtgatgtgcatgtgaggcctgtgatggtgcaagaatcatataacttgtcatgttaataactattttgttgtaagattatgtttactgcatggtgttataagctatttaaagtttactcc

SEQ ID NO: 5524 - DNA, 1097 bp, Oryza sativa
  Predicted polypeptide sequence is orthologous to G450, G456
gatctcatcacagccaacgcatcgtcttccttcttcgtcgtcgatagatcggctctcgagctcacaaccacatcgatcgtctccggcaagccgacgtacgtacgactagctagctagagaggaagcgagaaatggaagccgccgtggggtacgccgccgacagcctcatcaaggccaccgagctcaggctgggcctgcctgggacagccgacgacctgccctccacgcccaggggcaagaagcgcgccgccgcggcggaggacaacaacgccaacgccgccgccgccgacgacgacgagcacgacgccgtcgaggccgcgccgccggtagccaaggctcaagtggtcgggtggccgccggtgaggtcgtacaggaagagctgcttccagcaacagtcagcggcggcgagcaagagcaaggccgccgtgagcagctgcaacaacaaagacgagcccatcaccaagaacgcggcgccggcgccggcagcctcctcggcggcggcggccaacggcgggtcgctggtgaaggtgagcatggacggggcgccgtacctgaggaagatcgacctgaggatgtacaagggctacagggagctccgcgaggccctggaggccatgttcgtctgcttctccggcgccgccgacggtgccaacccgtcggagttcgccatcacctaccaggacaaggacggcgacctcatgctcgtcggcgacgtccctttcgacatgttcaccagcacatgcaagaagttgaggatcatgaagagatctgaagccacagggctaggatcaccaaggcaaatgaagatctaatctaagagcgacaagagatcgatcgatgcattccatcaacttttcatttctttttattttttttcctcccaagccaaaaaggagatgagcttgggggcatcaaagcaaacacatggatgtgcttctgctttgtttccatctttaaaaactagtaggttttaattttatgattttagcagcacaaaggagatgtggagatttgggttcaactctccatgtgtatgtacaaacgaaacagttattatatattgattgttggttactactactatactacttcaaacc

SEQ ID NO: 5525 - DNA, 1230 bp, Oryza sativa
  Predicted polypeptide sequence is orthologous to G450, G456
gaccaccacacccctcgtctccgcaaactcgacgcgccactcgacagcgaccccgcagccgatccatcccgccgccgaagcagcagcaaccgccacggtgcgccgccgccgccggtaccgatgtcgacgagctccggcgccgactcgtccccgcccgtctcgggcctcgactacgacgacaccgccctcaccctcgccctccccggctcctcctcctcctcctcctccaccgccgaccccgaacgcaagcgcgccgcccacgccgaccacgccgacgccaagccgccttccccaaaggcgcgggcggtggggtggccgacggtgagggcgtacaggcggaacgcgctgcgggaggactccgcgagggcgaagctggtcaaggtggccgtggacggcgcgccgtacctgcgcaaggtggacctcgcggcgcacgccggctacgcgcccctcctccgcgcgctccacggcatgttcgcctcctgcctcgccgtccgcggcggcggcggcggcgacggcgagggtacaaagctcgtcgacttggtcaccggcgccgagtacgtgcccacctacgaggacaaggacggcgactggatgctcgtcggcgacgtcccctggaagatgttcgtcgagtcctgcaagcggatccgtctcatgaagagctccgaggccgtcaacttatcgccaagacgatcatccagataatcgatcctaccacacgcaacgatgcaatgccgcaattgatctgtctgtctgtctgtctgtctgaattagttcgtctgaaagtgtgtgcaatggaagaggcttggctgtacaggtcctccatgcatatgtacctataccgtagtaggatcagtgatcgatgagccaaattggtgtgtgtactgtacaggccacaagaacgaaaatatcctctctctttaattcaggtgtgctccctgctgccggatcacggccggcccggtttggtttttggacgacggcggcgaggatcgatccaagggaggcgccgccacgccgccgcggcggtgtactttaattttcaagttgtcagctactttctgtaatttgtttcatgatggttcggtttcctgtgacagccagcacttttgttgtatgtcaaatgcaatgtatacatgatataccggttgttatcgttgttgttgctgttgttgactttgttctgtccattgatgcattgcaaggtcaaatataggagcacaataatctgcc

SEQ ID NO: 5526 - DNA, 1545 bp, Oryza sativa
  Predicted polypeptide sequence is orthologous to G450, G456
ggctcctttacatcacatttctagccaccctctcatcatcaccatcaagctcaaaccaacaagaagagagctagcttttggtactattagccactagtagatagccaagaagaaaccaagaaattctttgagctatctaattagctaggtccattgattcatcatcatctccattgatccacttagctttgaagaagaagaagaagaagacatttagttagctagctatattgaggtgaggtggcggcggcaatggcggcggacctggccttcgaggcgaccgagctccggctcggcctgcccggcggcggcggtgatggagacgccgcggcggcggcggcgaggagctcctccgggaagaggggcttcgccgagaccatcgacctcaagctgaagctggagccggcggccgcggcggtggacgacgacgacgacaaggaggaggcggcggctgacgaccgggagaagaaggtcgacatcgtcggagctgacaacgacgacgcctcgccgccggccgccgccgccgccggcgggatgaagcggtcgccgagccagagcagcgtcgtcaccgccgccgccgaccccgagaagccaagggctcccaaggcacaggtggttgggtggccgccggtccggtcataccggaagaacatcctggccgtgcaggccgacaagggcaaggacgccgccgacggcggcggcgacaagtccggcgccggcgccgccgccgccgccttcgtgaaggtgagcatggacggcgcgccatacctgcgcaaggtggacctcaagatgtacaagagctaccttgagctctccaaggcactcgagaagatgttcagctccttcaccattggaaactgtgggtctcatggggtgaacggcatgaacgagagcaagattgctgatctgctcaacggctctgaatatgtgccaacctacgaggacaaggacggcgactggatgctcgtcggcgacgtcccatgggagatgtttgttgaatcatgcaagcgccttaggataatgaaaggatcagaagctattggccttgcaccgagggcaatggagaaatgcaagaacagaagctgagaaagaagaacatgtcgccatcaaaaacggatggatcatcatcagatgcaacaatctatctatagcttttcttaattgcagctttgcctcatccctgtatcatactcgcttgctgtcctcatctccaagtctgtacctttcctgatcagtgaaagtcattttggtgttgtggtcagtttctgttctgttgcagtcattaagttcctaagtgtgtcatcttgtcttatacataagaaagaagccaagaacatgtaccagtagtacctgtcccataattatgtcttttttgctctccctgttcttccctttctatctgtttttttttaccttaatggcacaaaatgtaaaggcaccctgctcaaagggacctcaatgtattttgtccatgaaaaggttgtttaattatcttcatggtgtatccatcaaacaaataattattactgcaaggtgttatgtgtt

SEQ ID NO: 5527 - DNA, 1241 bp, Oryza sativa
  Predicted polypeptide sequence is orthologous to G450, G456
accaccacacccctcgtctccgcaaactcgacgcgccactcgacagcgaccccgcagccgatccatcccgccgccgaagcagcagcaaccgccacggtgcgccgccgccgccggtaccgatgtcgacgagctccggcgccgactcgtccccgcccgtctcgggcctcgactacgacgacaccgccctcaccctcgccctccccggctcctcctcctcctcctcctccaccgccgaccccgaacgcaagcgcgccgcccacgccgaccacgccgacgccaagccgccttccccaaaggcgcgggcggtggggtggccgccggtgagggcgtacaggcggaacgcgctgcgggaggactccgcgagggcgaagctggtcaaggtggccgtggacggcgcgccgtacctgcgcaaggtggacctcgcggcgcacgccggctacgcgcccctcctccgcgcgctccacggcatgttcgcctcctgcctcgccgtccgcggcggcggcggcggcgacggcgagggtacaaagctcgtcgacttggtcaccggcgccgagtacgtgcccacctacgaggacaaggacggcgactggatgctcgtcggcgacgtcccctggaagtaagcaacgcgtgtacacatctcaatcagttcttgccgattaattcaccgaaatcaaatgcaaaatctgatccgatcaatcaacacaggatgttcgtcgagtcctgcaagcggatccgtctcatgaagagctccgaggccgtcaacttatcgccaagacgatcatccagataatcgatcctaccacacgcaacgatgcaatgccgcaattgatctgtctgtctgtctgtctgtctgaattagttcgtctgaaagtgtgtgcaatggaagaggcttggctgtacaggtcctccatgcatatgtacctataccgtagtaggatcagtgatcgatgagccaaattggtgtgtgtactgtacaggccacaagaacgaaaatatcctctctctttaattcaggtgtgctccctgctgccggatcacggccggcccggtttggtttttggacgacggcggcgaggatcgatccaagggaggcgccgccacgccgccgcggcggtgtactttaattttcaagttgtcagctactttctgtaatttgtttcatgatggttcggtttcctgtgacagccagcacttttgttgtatgtcaaatgcaatgtatacatgatataccggttgttatc

SEQ ID NO: 5528 - DNA, 1180 bp, Oryza sativa
  Predicted polypeptide sequence is orthologous to G450, G456
tcctctctcttcttccaacacctcctaatcaccacaaaggcttaaaaatctccagtctccatagagagaaagagagagaagagaaggcagcttgatttggggcgaggagacgcgatagccgcgataggctaagcagctggcagcggcggctgctgcgatggccggcgccgacgtggacgtcgggacggagctccggctggggctgcccggaggtggcggcggcgccgccgaggcggcggccaaggccgcgaagaggggcttcgaggagaccattgacctgaagctgaagctgcccaccgccggcatggaggaggccgccgccggcaaggcggaggcgccggccgccgagaaggccaagaggccggcggaggccgccgccgccgacgccgagaagccacctgctcccaaggcgcaggcagtgggttggccaccagttcggtcgttccgcaggaacatcatgaccgtccagtcagtgaagagcaagaaggaagaggaagctgacaagcagcagcagcagcccgctgccaatgccagcggcagcaacagctctgccttcgtgaaggtcagcatggacggggcaccctacctgcgcaaggtggacctgaagatgtacaacagctacaaggacctctcccttgctctgcagaagatgttcggcaccttcaccgcaactgggaacaatatgaatgaggtgaatggctctgatgctgttacaacttatgaagacaaggatggtgactggatgcttgttggagatgtcccgtggcagatgtttgtcgagtcatgcaaacgcttgaggatcatgaagggttccgaagccattggtcttgcaccaagagcaaaggacaagtacaagaacaagagctgaaaatgttgcagtattaagatgctgagcatggtgccataagaatggtgttcttgcagtgtgttatggtttccttagaaatataaggttttacttgtttagctggattaaaagaaggaagagttgtcatgtttaatttgtttatggaccagaagcaataatctatttgtgtgtagctggattggtgttatgtgatgtcccctaccgtgtgtcccaagatctacttgatgattttattccaatgttgttaatttaagtttgtgtgattgtgaagtaaagggtatcaatgagactattattattatggtatctggt

SEQ ID NO: 5529 - DNA, 982 bp, Oryza sativa
  misc_feature (62)..(62): n is a, c, g, or t
  misc_feature (200)..(200): n is a, c, g, or t
  Predicted polypeptide sequence is orthologous to G450, G456
cccccctcgtccggcccctcccctcctccccctcggcgcgctcgcgtcgaacgggatccggncttatggccggggacgcggcggcggcgggcgccgacgagaagatgtcgatgaagaggtcggcgagccagagcagcgtggtcaccgcggagcccgatcccgacaagccgcgcgcgcccaaggcgcaggtggtggggtgngcgccggtccggtcgttcaggaagaacgtgctcgccgagaaatgcaaggcggcggcgctggtgaaggtgagcatggacggcgcgccgtacctgaggaagatcgacgtcgccatgtacaagagctacccggagttgtccatggcgctccagaacatgttcacctccttcaccatcggcaagtgtgggtcccatcagcagctgaaggagagcaataagctgagagatgacctggagtacgtgccgacgtacgaggacaaggacggcgactggatgctcgtcggcgacgtcccgtgggagatgttcgtcgagtcgtgcaaacgcctccggatcatgaaagggtctgaagccattggccttgcaccaagggcagtggagaaatgcaagagctgaagctgatcaaggagaattaattagcgccgcatccagatttattaactttcacggatattatattatattatattatattatattatatcgcatgcatgcattggatctccctgtatatacaagttcaggtaatagatactggaatagcgtagaaaacagggtactagatcgtacggaatgagataccgaggagccctgtatgcagggctattgacaacgctatatcacacacgttgcggcgccatatacatagcgcatactctgtactatctgagctgtgatgtattgatagtacgtaatcatacgcgtgcgcacaacgatacaaatccgaccacagagtctaaccagtcacgagcacatagacagatagcgagactagccagatacgccaa

SEQ ID NO: 5530 - DNA, 1379 bp, Oryza sativa
  Predicted polypeptide sequence is orthologous to G450, G456
ctctctcttcttccaacacctcctaatcaccacaaaggcttaaaaatctccagtctccatagagagaaagagagagaagagaaggcagcttgatttggggcgaggagacgcgatagccgcgataggctaagcagctggcagcggcggctgctgcgatggccggcgccgacgtggacgtcgggacggagctccggctggggctgcccggaggtggcggcggcgccgccgaggcggcggccaaggccgcgaagaggggcttcgaggagaccattgacctgaagctgaagctgcccaccgccggcatggaggaggccgccgccggcaaggcggaggcgccggccgccgagaaggccaagaggccggcggaggccgccgccgccgacgccgagaagccacctgctcccaaggcgcaggcagtgggttggccaccagttcggtcgttccgcaggaacatcatgaccgtccagtcagtgaagagcaagaaggaagaggaagctgacaagcagcagcagcagcccgctgccaatgccagcggcagcaacagctctgccttcgtgaaggtcagcatggacggggcaccctacctgcgcaaggtggacctgaagatgtacaacagctacaaggacctctcccttgctctgcagaagatgttcggcaccttcaccgcaactgggaacaatatgaatgaggtgaatggctctgatgctgttacaacttatgaagacaaggatggtgactggatgcttgttggagatgtcccgtggcagtatgttactacttcattcttgtgcccccttaactgttttccttattttccacctcatgattagaatgcggtttagcgataccacgttcaagtttctcgcattagctgattggttactctgcaggatgtttgtcgagtcatgcaaacgcttgaggatcatgaagggttccgaagccattggtcttggtcagtatcttcagctaaaatttgctttcgtgtcaagatttatatcttaattcacaccccttgtgtgtgtggtttttcttccagcaccaagagcaaaggacaagtacaagaacaagagctgaaaatgttgcagtattaagatgctgagcatggtgccataagaatggtgttcttgcagtgtgttatggtttccttagaaatataaggttttacttgtttagctggattaaaagaaggaagagttgtcatgtttaatttgtttatggaccagaagcaataatctatttgtgtgtagctggattggtgttatgtgatgtcccctaccgtgtgtcccaagatctacttgatgattttattccaatgttgttaatttaagtttgtgtgattgtgaagtaaagggtatcaatgagactattattattatggt

SEQ ID NO: 5531 - DNA, 471 bp, Oryza sativa
  Predicted polypeptide sequence is orthologous to G450, G456
tttttttttttttttgacgtaaggatgacattgttgttacgtatatatatactccatgagcataacaagatggagctaacccacatgtaaatacatcaaaatcccttagaaaaactgagatgacacaagcttaactgacactgaattacagtaaactaattacttgatactagtataatacaggcaggagcaaagcatgcatgcaatataatataatataatataatataatataatataatatccgagaaaattaataaatctggatgcggcgctaattataagatctccttggatcagcgtatcagcgtcttgcattactccactgcccttggtgcgaggccactggcttcagaccctttcatgattcggagcgtcagtgtgtacgactctactaaaatgtcccacgggacttcgccgagtagcatccagtcgccgtccttgtcctcggacgtcggaacgtacgtccga

SEQ ID NO: 5532 - DNA, 1120 bp, Oryza sativa
  Predicted polypeptide sequence is orthologous to G450, G456
cgcgaggtcggtcggaattccgggtgaccacgcgtcgcatcgatcgatcgatcacaactactagaaatccagccaagaagatcgagaccggatacagctagcaatccatccaagaagatcgagagagcggatacagctagcctagctacgcgaaggatcagatcatcggcatggagctggagcttgggctggcgccaccgaattccggtcatctcgtcgtcgacgagctcagcagcagcagcagcagcggcggcggcagcggcagcgcgccggtgtctgcctcgtcggccgggaagaggggattcagggaggcgttccaggagacgctgctgctcttcgacgacggcagctgctgcaacaccagcgacgacgattgcaggaggaggaagaagacggtggtggggtggccaccggtgagctcggcgcggcgggcgtgcggcggcgccaactacgtgaaggtgaagaaggaaggcgacgccatcgggaggaaggttgatttggccctccattcctcctacgacgagctcgctgccacgctcgcccgcatgttccccaccaacgaccaccaaggcgagaagaaaatggccaatgatgatcatggcgatgccgctggacctgtggtcacctacgaggatggtgatggggattggatgctggttgggggacgtgccatgggatgattttgcacgatctgtgaaacgcctgaagatactggtaactgaatgaaggaaatgctgcttgattgaggagccagtcgggttgttgcagacattgtttggttacgaagtttatgtgtccaacacagagtgcgagagaaactcggaacaaatagcaacataagcgggacactgccggcgtgatgaacaggtacatataggagtactaaaaaaggcgatagttatataggagacaagcgaaagaagaaaaagaatcattagtaacattatacaataacgatgattaagacagaagaggagtctagagatccaagcatagagaagactaaagaagcaagtaagaagaataataatagactgatagtacgagaatacatgacaatagacaacagattaacgtagcacgagaagaaaacaaagaacaaaaacgatcaacgtcagaa

SEQ ID NO: 5533 - DNA, 480 bp, Oryza sativa
  Predicted polypeptide sequence is orthologous to G450, G456
tcggcgacgtcccctggaagatgtttgtggaaacttgccagcgccttcgtctcatgaaaagctcagagggctgtcaacttagcaccaagacccgctcaatgaggcattcccggtgcccatgaccgtgtggttggattgaaagaaagtggaagctttccccccccaattttcccccacgtgtaaaatgaacatgtaaccagttttctccaacaacttttgttcccttgataatgctgagttgagaaaaaggttttagtttcgtaactcttctttattctccccaaaaataaataatgaaccactgaagcttgaaaaaaacacctccactttgtctcttaatgaataagaccaaaaacccaaaaaaaccgatgttctttgctccggctcgcgtgtcgccaggcaaaatccagttttttgtcccaccataggcgatggacatctctgccctaaaactttcgtaaaaatctaatcatgttaacc

SEQ ID NO: 5534 - DNA, 605 bp, Oryza sativa
  misc_feature (201)..(201): n is a, c, g, or t
  misc_feature (280)..(280): n is a, c, g, or t
  misc_feature (503)..(503): n is a, c, g, or t
  misc_feature (520)..(520): n is a, c, g, or t
  Predicted polypeptide sequence is orthologous to G451
agacccccaaggatggtgaatatgtctgacttatgaagacaaggatgggagactggatgcttgttgccgatgtccatgggagatgtttcccaactcttgtcgcaagactcaggatcatgaaaggttcaagatgccacaattggacttgctcccaaggcagttgataagtccctaaaaccgcaaactagaatggttttctgnccccacagtccaaaaagcatagtatgggagatcaaaatggactgtagggaattttctgaaaacccaagaagtctaacangttttaaagatggagtcgcccttagggtctggtactacatgggtttgctattgtgaaagttaaaaaaaaaggtgtcttgttatgtttagcttccccaaatctcctagggacaataaactgctatttgattggtgcccaagtcttgtgtacgtgtggttaatgctattcagtgtaaaatggttttggaacaccatggtggctactgctatgattgagcaccccnacctacttgtgcaaaangttgtcaatgaactgtttgttcgctacataaatgttcaatgaagctggcaaatgtattgtccaccaaaaaaaaaaaaaaaaaaaa

SEQ ID NO: 5535 - DNA, 1164 bp, Oryza sativa
  Predicted polypeptide sequence is orthologous to G451
ggtcctcatctcatcttctcctccaaattcctcttccacatttcctcctcctcctcttctttctctcaagaaaatcagtagctagccatggcgtcttcttcttctctcaggagcaccagctgcctcgcctccgccgcggagaccgacgccgacaacctctgcctccgcctcggcccgccgggaagcagcatcaccaccaccaccaccaccggcggcgccgacccggcggcgaagaggtccctcggggcgaagcggtcgctggagagcacggacagcatggcctccggcaccggaacttccgccgccggcgacgagcacgacgacgacaccgccgcaccggccaaggcacaggtggtaggatggccaccagtgagggcataccggaggaacaccttccatcaggccgccgccgccgccgccgcaaccaagaagggtggtgatgagaaacagaagcagcagcagcagggaggagggctgtatgtgaaggtgagcatggatggggcaccatacctgaggaaggttgatctcaagatgtgcaagggctacagggagctgagggaggcactggatctcctcttcaccaagtgcttctctgcaaccgcctctgacggatgcagcgatggccagttcgccattgcctacgaggacaaggacggtgacctcatgcttgttggagatgtgccctgggaaatgttcatctcttcctgcaagaagttgaggatcatgaagggctctgaagccaggtgatggtctgatggatgatcaaaggagacaaatcacaggctaggacacaccacatgagaagatggatgatgaatcagagatcatgaatcacatggcatgagatgaatgggatcaagaagggagcagaggactagaagagccctgatggcttgtgctcttcgttgctgtacagagagagtttaggcactgccttgtttcagtgtttctgaatccaagagggacaagatgtatgaactgtgtatatagtcttttaattaggctcatttcttttttcagtttgagttttgtactgtatgagcgaaggctggaaaatatgaaaaaagggagaaatttgacctaagcttggtcatttctccacaccaaagattccttgtttctctgtgttcatatcataaatacagtaccaagccagtatttgtc

SEQ ID NO: 5536 - DNA, 1165 bp, Oryza sativa
  Predicted polypeptide sequence is orthologous to G451
gacgaagacaaagtcagaggtcacacagctcatcgtctcgagctacctagctggaagaagaagaggaagaagaggaggaggagctcgtcggagtttagttggtgagttcgccggagagatcgatcatggagaatctgaaggcgacggagctgaggctcgggctgccggggacggaggaggaggcggcgccgccgccgtcgacgcccagggccggaagcaagcgcgccctcgccggcgagcctgatcaggccaagatcaagcccgccgccgccgccaaggcgcaggtggtgggatggccgccggtgaggtcgtacaggaagagctgcctccagccgacgacgacgacgacgaagagcaagccgccgccggctgccgcggcggcggagacgcagcagaaggaggatgtcgccggcgccggtgggctgttcgtgaaggtgagcatggacggagctccatacctgaggaagatagacctcaaggtgtacaagggctaccgggagcttcgcgaggcactggaggccatgttcctctgcttctccggcggcgccgccgccgacgccgccgtcaacccgtccgacttcgccgtcacctacgaggacaaggacggcgacctcatgctcgtcggcgacgtcccattcgagatgttcattagtacgtgcaagaggttgaggatcatgaaggggtctgaagcaagaggcctaggagcaacaaggggttaaaaactgaacaacaacaagaagaaatcatcatcatgtgtgcatgagcaattcttttgttctttttgggttctccaagacatgcaatcatctcatctcctcattgcaaccttcaagaaagagagagagagaaagaaaaggaaagcaaaaaaaaaaaagatgcagtgaaaaaaatatgtgaagcttaattggagtcatcagattgcaaagcatgcatgcatgtgtggatgtgtggctttaatttgtttttttcctcttaattaggtgttagaaaacacagaaggaatggaggttcgagttgagcctccatgtgtgtttgtacaaagcaaacatcttttttcttttacatgaatggttgattacttttgtaactggagggaagaagaatgcatgtatgcatgggctgtgtgtacttctccctctggcttcaatgctttgatttccatccg

SEQ ID NO: 5537 - DNA, 1128 bp, Oryza sativa
  Predicted polypeptide sequence is orthologous to G451
gacgacgaggtcagtgtcgcagcgacgaacgccgacgagctagctctctctctcgatcggtggccatggcggcggagagcatcgacgcggagctgcgcctcgggctgcccggcagcggcggcggtgacggcgtggcggcgaagaagcggcggtcggcgtcgtcgacggtgaagagcgaggcctccggcacggcctgctgcggcggcgccggcgcccgggacgtcgaagacggcgcctcgccggcgtccaaagtgcaggtggtggggtggccgccggtggggtcgtacaggaggagcacgttccagtcttcgtcgtcgtcgacggcggcggcggcgaaggggaagggcggcggcgagacggatcaagggaggaagaataagggaggagggctgtacgtgaaggtgagcatggacggggcgccatacctccgcaaggtcgacctccggatgtacggcggctacagggagctcagggacgctctcgacgcgctcttcggctgcttctccgccgacgcctccgcctccgccgcccacttcgccgtcgcctatgaggacaaggacggcgacctcatgctcgccggcgacgtgccctgggacatgttcatctcttcttgcaagaagctgcggataatgcgaggatctgaggcgagatgatatatatcgaaatcgaaaggcgtcgagctgaagaaaaaattttcgccgatgcatgcatggagtagacatctcacagaaaaaaggcttcatgcatgagagagatgagatctatccgtggacatcgtcatgcatggcgatcggacggctggccaagaaggacacttacacgtagatgcatcttgtttttgttctacgtagatgtgtagatgagatatccaaggatctgaattctaaaaaagttcaggattcagttggatcggagttggtgaggaggaggatatgatcgatcgagcagagctgcagtactcctatgtacagaataatctagctgagattttggttgttggaaatggcaactgctagttctgcagatttgtgtacacatgccttttttttaaagctttttttttctagcttctgttgtgtcactgaagaaatctgagagctgaagaaagagaaacttggaagtttggtc

SEQ ID NO: 5538 - DNA, 1164 bp, Oryza sativa
  Predicted polypeptide sequence is orthologous to G451
cgtcctcatctcatcttctcctccaaattcctcttccacatttcctcctcctcctcttctttctctcaagaaaatcagtagctagccatggcgtcttcttcttctctcaggagcaccagctgcctcgcctccgccgcggagaccgacgccgacaacctctgcctccgcctcggcccgccgggaagcagcatcaccaccaccaccaccaccggcggcgccgacccggcggcgaagaggtccctcggggcgaagcggtcgctggagagcacggacagcatggcctccggcaccggaacttccgccgccggcgacgagcacgacgacgacaccgccgcaccggccaaggcacaggtggtaggatggccaccagtgagggcataccggaggaacaccttccatcaggccgccgccgccgccgccgcaaccaagaagggtggtgatgagaaacagaagcagcagcagcagggaggagggctgtatgtgaaggtgagcatggatggggcaccatacctgaggaaggttgatctcaagatgtgcaagggctacagggagctgagggaggcactggatctcctcttcaccaagtgcttctctgcaaccgcctctgacggatgcagcgatggccagttcgccattgcctacgaggacaaggacggtgacctcatgcttgttggagatgtgccctgggaaatgttcatctcttcctgcaagaagttgaggatcatgaagggctctgaagccaggtgatggtctgatggatgatcaaaggagacaaatcacaggctaggacacaccacatgagaagatggatgatgaatcagagatcatgaatcacatggcatgagatgaatgggatcaagaagggagcagaggactagaagagccctgatggcttgtgctcttcgttgctgtacagagagagtttaggcactgccttgtttcagtgtttctgaatccaagagggacaagatgtatgaactgtgtatatagtcttttaattaggctcatttcttttttcagtttgagttttgtactgtatgagcgaaggctggaaaatatgaaaaaagggagaaatttgacttaagcttggtcatttctccacaccaaagattccttgtttctctgtgttcatatcataaatacagtaccaagccagtatttgtc

SEQ ID NO: 5539 - DNA, 860 bp, Oryza sativa
  Predicted polypeptide sequence is orthologous to G468, G2866
ggcttgtttttttctcaactcgatccatctctctctctctctcgatctctccattaatttctacgtaagcattcgtagctatggaggagtgcaagggcggtggcatgtcgccgtcctcctccatggatagcagcacccacccggcgctgtccacgacgtcgtcggcggcgacggcgaggcgggacctcagcaccgatctccggctagggcttagcctctcgacgtcgtcgtcgtcctccctccggcggcgctcgccgacggcgaacgctgttcgtgaaggtgtacatggagggcgtcccgatcggccggaagctcgacctgctcttgctggatgggtatgacagcctcctcatcaagctctgccacatgttcaagacgcccatcacctatgctgatgttatggagtgccatcaacaagttcctggccagaaggctgcccatgtcctcacctatgaagaccaggacggggactggatgatggttggggacgtcccatgggaactcttcctgagcagcgtaaagaagctcaggattgcaaggatggataaatgctaaaacagttgcatttgaatttctctttgtttcttcttttttttttcccattggagggagggcccttattatatgtaggttagttgaaaaagatttttgctgaagctgagattatacttactagcagtgtacattatagtaaagaagtgtagcattatcagctacctaccgtatagcagaactgattattatttttcctctacttctttaactggtttgtaaatatcatgtattcgttaaagagagtagagaagttgataacacaaaggttccattttacctcagtggaatcaaattttgtggccttt

SEQ ID NO: 5540 - DNA, 1006 bp, Oryza sativa
  Predicted polypeptide sequence is orthologous to G468, G2866
gcgtttctctagtgatcttctttttcttttcttttgttttctgtctctagcgaactactagttcttggatccgatcgaccgaccctaccacccttgatttcatggagtgcatggcgagtactgaagagtctctcccagcttcttcctccatggatagttgcagcggcgaactgccgacgacgacgacgacggcgccggcgcaatccacggcgtcttccggctgccgaccgccggcgacggcggcgaagcggcggagtctgatcagcacagatcttcgcctcgggctcaccctctcctccgtcgtccacatcgacggcaacaacccttctaccccaaggagttccctcacgacggcgacagtgacagctgatcgaggcggcggcggcggcggccatggacggcgacggtcactgttcgtgaaggtgtacatggagggcgtccccatcggcaggaagctggacctgctgccgctagacggctacaaaggtctcgtcgcacggctcgcctccatgttcagagcatccatcacctatcatcattgccatcgacagttcgccgtcgtcgggatgaagacgaacaaggttcatcatgttctgacatacgaagaccaggagggagactggatgatggctggagacgtgccatgggagctgttcctgacaagcgtgaagagattgaggattgcaagagcggatgacaagtactgctatagctgttgaataattggttaaccaggatggtcaattaattcttccagagttcttggatttcattcattcttactttgctcattttggtggagcaatttagatttgagatgattgttttcgggagcggaaatttactagtaaaagcatagtgatattgagcagaggatattgtacaaaatatattgtacacactagtaaaagaaaagaaacatatatatagaaataccattttacttctcagtctagaataatttattccgaactggcaattttactgtatgaaaaataattttctc

SEQ ID NO: 5541 - DNA, 3151 bp, Oryza sativa
  Predicted polypeptide sequence is orthologous to G470
gtatgtactccctacaaagagaccaccaccaatccggctaccccatcccccctcctctttctctcctcttctcctctccacaaaaacatttctactgcttgctcgtctagtattccccacctccctttccttgccttcctcgctgcctcctcctcttcctcctccgtctccgctagggtttccgcgccgccgccgccccgatccgagatgccgccggccgccatggctccccctcccccgccgcagggctcctccacaggggatccgctctacgacgagctgtggcacgcctgcgcggggccgctcgtcaccgtgccgcgggtgggcgacctcgtcttctacttcccgcaggggcacatcgagcaggtggaggcgtccatgaaccaggttgccgacagccagatgcgcctctacgatctgccctccaagctgctttgccgtgtcctcaacgtcgagctcaaggcggagcaagacaccgacgaggtctacgcgcaggtcatgctcatgccggagcccgagcaaaatgagatggcggtggagaagacgactcctacgtccggccctgtgcaggcaaggccgccggtgaggtccttctgcaagacgctcaccgcgtctgacaccagcacgcacggcggcttctctgtactccgccgccacgctgatgagtgcctccctcccctggatatgacccagtcgccacccacacaggagctcgtggccaaggatctgcacagcatggactggcgcttccgtcacatctttcgcgggcaaccgaggaggcatctccttcagagtggttggagtgtgtttgtcagttccaaaaggcttgttgctggggatgctttcattttcctcagaggagagaatggtgaactccgtgttggtgttagacgagctatgaggcagctgtccaatgtgccttcttcagtcatatctagccaaagcatgcacctgggagtccttgctactgcatggcatgctatcaacacgaagagtatgttcaccgtctactacaaacctaggacgagcccttcagagttcattataccatatgatcagtatatggagtccgtcaaaaacaattactctgttgggatgaggttcaggatgaggtttgaaggagaagaggcaccagagcagaggtttactggtactataattggcagtgagaatctcgacccagtgtggcctgaatcaagttggagatccctgaaggtgcggtgggatgaaccatcaactattccgcggccagatagagtctctccttggaaaatagagcctgcttcatcacctcctgttaacccccttcctctttctagggttaaaagacctaggccaaatgctcctccagcatctcctgaatctcctattcttacgaaagaagctgctactaaggttgacactgatcctgctcaagcacaacgaagtcaaaacagtacggtcttgcaaggtcaagaacaaatgaccttgaggagcaaccttactgagagtaatgactctgatgtcactgctcataagccaatgatgtggtctccatccccaaatgctgcaaaagcccaccccttgacatttcagcagagaccccctatggataattggatgcagttgggaaggcgtgaaactgactttaaggatgtccgttctggctctcaatcttttggtgattccccaggcttctttatgcagaattttgatgaggctcctaaccgtcttacttctttcaagaaccagtttcaggatcaaggttctgctcggcacttctctgacccatactactatgtatctccacagccttccctaactgttgaatcaagcacacagatgcacacagacagtaaggagttacatttctggaatggccagagtactgtgtatggtaattcgagagaccgaccacagaatttcagattcgaacagaactaatcaagttggttaaatcagtcatttgcccgacctgaacagccaagagtgattagaccgcatgcatcaatagctccagttgagttggaaaaaacagaaggcagtgggtttaagatttttgggtttaaagttgatacaaccaatgctcctaacaatcacttgagctccccgatggctgcaacacatgagcctatgcttcaaactccatcatcattgaatcagttgcaacctgtacaaactgattgcattcctgaggtatcagtaagcacagctggaacggcgactgagaatgagaaaagcggtcagcaagctcaacagagttcaaaagatgttcaaagcaagactcaggttgcttcgacgaggagttgtacaaaggtccataagcaaggcgttgcacttggcagatctgtggatctttcaaagttcagtaactatgatgaactcaaagctgagctagacaagatgtttgaattcgatggtgaattggtgtcttcaaacaaaaactggcaaattgtttatactgataatgagggtgatatgatgcttgttggagacgacccatgggaagaattctgcagcattgtgcggaagatttatatttacaccaaggaggaggtccagaagatgaattcgaaatcaaatgccccaaggaaagatgactcttcagaaaatgagaaaggtcatctgccgatgcccaacaaatcagataactaggttcagtgaagcgagatgatacaagaggtagatcgcatggagtcttgagagagagatgccattctgcgggtcccagtcaagtaaaccccctgatgtgttggtgatcacccctgcccccccttttgcttatctgatggctgatgcaatgcaaaccctatggctttagctagtatgagatgtagactgcctattgtttatccttttgttcctttttcttctcttggcagaaagatttagggccaagatttatcattattgctattgcccctctcaactcctcccaactctctgatgtaaatatttatctacgtagccagccacccagccagaagtagagcagtagtagtagagttaccccctaccttgtattaaccagcagcctattcccccggataaatttgtgtaagctctgtagctcgagataaaaaaaaatggcgatcgaacgaacgaacaaatggcgtatgtattgtctgatctttgatataaatatttatcaatgaatgtatcatagatggat

SEQ ID NO: 5542 - DNA, 3981 bp, Oryza sativa
  Predicted polypeptide sequence is orthologous to G470
gggaattggactcggctcgtccgcacccctattaaaaccacgcgaggaagttttcttccccgtcgtcacctcccgcttcgcgaaccacccacccgtccgtttctcgcctcgcctcgcctcgccctccctctcttccttcttaacaatggcggtacaggcccagtacccttccagtctcctcttccacgataggtgcggcttgtctcctcttcttcgttagggcggctacgtgttttaaaggtttggcctcctttgggctgatggattattcgtcgtctggtttacagaggtgagccggagaggacgaaggagatggacctgcccaggccgcagatgttcgccggagtctcgccggaggtgtactttcccagcggaggaggtgggtggtggtgactgactgattgattgatagatagatagcctgatgttgaaggagttcaaggtcgcgccatggcgccgccgcactacggttcttggattgtgacatgggcgtatgtggttttggtttctttgcagcgagtgggattaatcggaggaataagcgctcgagggaggccattgccatggcgccgccgccggccaaggaggagttggtcaatctgttcacgctccagccgcagcagtctacgtcgtttgtcaacatggcgcagctccacaacagggtatcggcgtcgccgtcccgcgcgccggcggcactcgtgtccactggccttcgcctggcattggatgagcagcagcagcagcagcagcaacaacaagagagcaaacgcctgaaagccttgtgctactcgtcgtcgcccatgccgttcgtctcgttctccgacgagcttgccggacagatgaagcggcaagatgaggagctcgaccgattcatcaaagagcaggtaatcgacgattttgccccccacacgatccgtttgtttcggtggttcgttttttccgtggcgtgatgtgccggcacgttcttggacagggcgagcagctcaggcgggcgatggccgatcgggtgcggcgccataacagggcgctgcttgtcgcggcagagcgatccgcggcgcgccggctcagggagaaggcgttggaggcggagcgcgaggcgcggcgcggcgcggaactcgaggagcggctggcgcgcctccgcagcgaggcggcggcgtggcaggcgaaggccctctcggagcaggccgccgccgtgtccctccacgcgcagctccagcaggccgcggccgcggcgcgggcgtccggcgatgagctccgtggcggcgaggcgggcccggcggagtcgtcctcgtcggcgtacgtggacccgcgccgcagcgggtctgaccgcgcctgcctcacctgccgcctgaggccggccaccgtggtgctcctcccctgcaggcacctcagcctctgcggcgattgcttcgccgccggcgacgtggacgtggccatggcgtgccccgtctgccattgcgtccggacagggggcgtggaggccatcctctgttgagctgtcgtcgtctcatctcggcacacatggcggcttctcggtgctgcgacgccacgcggacgaatgcctcccaccactggatatgagccgtcagcctccaacacaagagctggtggccaaggatctgcacggtgtggaatggcgctttcgtcacatattcagaggtcaaccacgaagacaccttttgcagagtggctggagtgtgtttgttagtgccaaacggcttgttgctggggatgcctttatctttctcagaggtgagaacggggaactgcgtgttggagtcaggcgtgcaatgaggcagcaaactaatgttccatcttcagtgatatcaagccacagcatgcatcttggggttcttgccacagcatggcatgctgttaacacagggaccatgttcactgtctactacaagcctaggacaagtccagccgagtttgtggtcccttacgatcgctatatggaatcactgaaacaaaattactccattgggatgagatttaagatgaggtttgaaggtgaagaggctccagagcaaagattcactgggactattgtcggaatgggggattctgatccagctggctggcctgaatcaaaatggcgctcccttaaggtgagatgggatgaagcttcttccatacctcgccctgaaagagtttctccctggcaaatagaacctgctgtaagccctcctcctgtcaacccactaccagttccaagaaccaagaggcttcgtccgaatgctaccgctttgccggctgactcttctgctatagcaaaagaagctgctacgaaagttgtggtcgagtctgaaccaaatggtacgcaaaggaccttccagacacaagagaatgcaaccccaaaaagtggtttcggcaatagcagcgagttagaaagtgctcagaaatcaatcatgcgtccatctggatttgatcgtgagaaaaataacactcccatacagtggaagctaggttcagatggtcggatgcagatgagcaagcctgagagttacagtgagatgctatctggatttcagccacctaaagatgtacaaatcccacagggtttctgttctttacctgagcagattactgcaggccattctaacttctggcacacagtaaatgctcagtatcaagatcaacagagcaatcacaatatgttccccagctcatggtccttcatgcctccaaatactcgccttggattaaacaaacagaactattcaatgattcaggaagctggtgtgttgtctcaaaggcctggaaatacaaagtttgggaatggagtttatgctgcactgccaggccgaggtactgagcaatactcagggggttggtttggccatatgatgccaaattcccacatggatgatacacagccacgcctgatcaagcctaaacctctggttgttgcccatggtgatgttcagaaagctaaaggtgcttcatgcaaactatttggaattcaccttgacagcccagcgaaatctgaacctttgaaatctccatcaagtgttgtatatgatgggacgccacaaacaccaggtgctactgaatggcgccgaccagatgtaactgaagtagagaaatgttctgatccttctaaggccatgaagccacttgatactccgcaaccagactctgttcctgagaagccttcttctcagcaagcttcacgaaacatgtcgtgcaaatcacaaggtgtatcaactagaagctgcaagaaggtccacaagcaaggcattgcacttggcaggtctgtggaccttacaaagtttaatggctatgaagagttgattgctgagctggatgacatgtttgatttcaatggtgaactgaagggtcctaagaaggagtggatggttgtctacactgacaacgaaggtgacatgatgctagttggggatgatccctggattgaattctgcgacatggttcacaagatcttcatctacacaagagaagaggttcagcggatgaatccgggaaccctgaactcaagatcagaagatagtcatgctaattcaatggaaaggggctcagtcggcagagaaatgcgaggctgcttgtcaacctcgtctcttaattctgagaactgctaatgctttcccatctggtaacgtcttttgaagtaacatgggagacaagaacgcgatgcatcgttataagaaaatgcatttcgtagtggagttaatgctttttttccccctttgatgtattggataagctcaaagtaccctatttgtagatggtgcttgtccttggtggtcaagttgcactcttatttgctgcagttttggttttctattttggtgaggtaagttgtcagccgccagtcctaccatataaatgttggtatgcgtagaaaagtaagctcagccctcccaccctgcacttcctctctctcagcactaagctgccacctccttgtaaatagcccctgtttaattgagtctaatatattatctaccttaactgacg

SEQ ID NO: 5543 - DNA, 3265 bp, Oryza sativa
  Predicted polypeptide sequence is orthologous to G470
gggagaagagagagagagacggacacaagccacgcagcagcagcagccagcagcggcagcggcagcggcagggacacaaactgacgtcgccttcatcgtcctcctcctccgcctacataaatcccaccccgacctcctccgccgcttcctcttctcccctccgccgcaggtgtgggggttcaccggtgagcgagcttggacgtggcggagggcggaattgtgggggttctttcagttctccgagcgattcggggaagggggagaggagaggtggtggatgtgagatccgatggctgctgcagcgacggcggcggcctcgccggttgaggggctcaccggcggcggcggcggtggtggtggaggagtggacgggctgttcgtggagctgtggcgcgcgtgcgcggggccgctggtgacggtgcccgccgtcggggagagggtcttctacctcccgcagggccacatcgagcaggtggaggcatcgacgaaccaggtcgccgagcagcagggggctccgctctacaatctgccatggaagatcccgtgcaaggtcatgaacgtcgagctcaaggctgagcctgatacggatgaggtgtatgcgcagctcaccctgcttccggagaagcaggatgggaatgggagtggtaacgggaatgtgtccaaagacaaggtggaggaggaagaggtggtgccaccagctgcaactgagcggccccgggtgcactccttctgcaagacgctcactgcgtcggacacgagcacgcatggtggcttctcggtgctgcgccggcacgcggatgagtgcctcccaccactggatatgagtcagcatcccccaacacaagagctggtggccaaggatcttcatggggttgagtggcgcttccgtcacatcttccgaggtcagccacgaagacaccttctccagagtggttggagtgtttttgtgagtgccaaacgccttgttgctggagatgccttcatatttctcagaggtgagaatggggaactacgagttggagttcggcgtgcaatgagacaacaagctaatattccatcttcggtcatatcaagccacagtatgcatcttggtgttcttgcaactgcatggcatgcagtgaacactggaaccatgttcactgtgtactacaagccaaggactagtccatctgaatttgtggtaccacgtgatctgtacaaggaatctctgaaacgaaatcattcaatagggatgagattcaagatgacatttgaaggcgaagaggctgcagagcaaagattcactggcacaattgttggagtaggtgattctgacccatctggttgggctgactcaaaatggcgttcccttaaggtgcgatgggatgaagctgcttctgttcctcgtcctgatagggtttctccttggcaaatagaacctgctaacagcccttcccctgtcaaccctcttccagcaccccgaaccaagcgggctcgtccaaatgttttagcttcctcacctgacttgtctgctgtaaacaaagaagttgcttcaaaagtcatggcaaactcgcagcaaaatggtcttccaagggccttccacagtcaagaaaacatgaatttgagaagtcgttttggtgatagcaatgagctaaatacttcccaaaagcttaccatgtggtcttcaggaagcaatcaagagaaaaataatgtttctgtccagagggagctaggttcacagagttggatgcagatgagaaggcctgatggttcctctgagatattatctggatttcaaccactgaaagatacgcggaaccctctgagttcatttcctagtcagatatctggaaaccgttcaaatacgtggaacacaatcaatgttcattatcccgaccaaaatgccaatcataatatgtaccctggcacatggtctcttatgcctccaaacactggttttggtgtgaatcagcagaactacctaatgacgcctgacatcacactccctcaaaggtctcttaatgccaagtttggtgggaatggagcattcacttcgcttcgggcccatggcatagatcagcgctcctctggttggcttgggcatattgagccaagttctcacattgatgatgcctcatcgagtcttatcaagccacagcctttggttattgatcacaatgttcagaaagctaaaggctcttcatgcatgctatttgggatttctcttgacagccctgcaaaacctgaactattgatatccccaccaagtgttgcatttgatgggaagctccaacaggatgcacttgaagaggatgaatgctctgatccttccaagactgtgaagccacttgatggagctcagcacgattctgctagagagaaacatcagtcatgtccagatggtaccaaaaacattcagagtaaacagcaaaatggttcctcccgaagttgcaagaaggtccacaagcaaggaatcgcactcgggaggtcaatagatcttacaaagttcacttgctatgatgagttgattgctgaactggaccagatgtttgacttcaatggtgagctgaacagttcaagcaagaactggatggtcgtttacactgataatgagggtgacatgatgttggttggtgatgatccttggaatgaattctgcaacatggttcataaaatcttcatctacacgagggaggaggtccagaagatgaatccgggtgccctaaactcaaggtcagaggatagccggtctacttccgtggaacgagggctagttggcgaagggctccaaggtggtctatccaccccatcactgaattctgagaactgctaattcgttcggtcactgaggtcttttgtggtttgcaagaacagaagacgacatatccatggtaggaaggaatcttttcgtggtgtagtagtagtagctggtgctttatatgtatcgggtaagccccgcagtaccccatttgtagatggtgcttgtcctggtatcagttgcccgctcttcgttttcgacaagttttgggtgtgctttgttgaggttttaagttattgtatgatatgccccgtagtagtgaaaggtgctgaggccaagctgccgcgcccggtgcgcttgcttgcttgcgctcttcctccctcctaagccttgtaaatagctttgcttccccccctttcttcagtcagttctaatatgttgcgaactgcggtaatcggtgtacccctcaagaaggcaaggcaatttgaccctaaaatgttgccattttaacatcctgtttgtttgccc

SEQ ID NO: 5544 - DNA, 411 bp, Oryza sativa
  misc_feature (42)..(42): n is a, c, g, or t
  misc_feature (75)..(76): n is a, c, g, or t
  misc_feature (95)..(95): n is a, c, g, or t
  misc_feature (202)..(202): n is a, c, g, or t
  misc_feature (252)..(252): n is a, c, g, or t
  misc_feature (374)..(374): n is a, c, g, or t
  misc_feature (376)..(376): n is a, c, g, or t
  misc_feature (381)..(381): n is a, c, g, or t
  Predicted polypeptide sequence is orthologous to G478
ctgtgctgattgcttggatgcaatcacggggcacagggcacncgcccacgcagatcaacacgctgtgttggctcnngcgcctatgtacgggatgngattgcagcggcacaggggaattgggaatgataagaaggggtgagtgagctgcggcaccgaatgaaaaggatgtggggaaagatggcaaaagtgtgcttgatgaatntgtgtggggatgggatggctggcgtgcaatggtgtactgtgttggttganatgtgtgtgcggagtggatgtgatgcaacactggtgacactgaattgaaatgggttgtgatgtgggattgatgtgggcggtgttgatgactgaaacgatacaaaattgaataccatacggtntntttgngattgcaaataaaaaaaaaaaaaaaaaaaa

SEQ ID NO: 5545 - DNA, 1791 bp, Oryza sativa
  Predicted polypeptide sequence is orthologous to G478
ggccctcctgctcgatccatccatccatccacccgaaccctagatagatgaaaaagggcaaaaccatggcatatgccgcgcgatccatctctgcgcgctgctgatataagagatccatcgagtagtagccctgttagctagagcgagctcgatcgatggagaggatgatggtggtgtccttgccgcgtcctctcttccattcctagtcctttccgtgtgtgtgcgactgcgtgagtagtgagggatagataaaggagggaggaggagacaggccgcgaggatgatgaacgttccatccgccgctgccgcgagctcctgcgatgatttcggctacaacgccaccccgccgccgccgccgtcgcttctcccaatcatggaccaggacggcggcggcggtagcatccagagggatcaccaccaccaccacaaccaccagcagctcggctacaacctggagccgagctccctagctctgcttcccccttccaacgccgccgccgccgcagcacaccacgccaccatcgcccacgcctccccacatgacctcctccagttctacccgacctcgcactacctcgccgctgccggcggcgccggtggcggaggcaacccctacagccacttcacggcggcggcggcggccgggagcaccttccagtcgtactaccagcagccgccgcaggccgcgccggagtactacttcccgacgctggtcagctccgccgaggagaacatggccagcttcgccgccacccagctcggcctcaacctcggctaccggacctacttcccgccgagaggcggctacacctacggccaccacccgccgcggtgccaggccgagggctgcaaggccgacctctccagcgccaagcgctaccaccgccgccacaaggtgtgcgagcaccactccaaggcgcccgtcgtcgtcaccgccggcggcctccaccagagattctgccagcagtgcagcagattccatcttcttgatgagttcgacgatgccaagaagagctgcaggaagcgactcgccgaccacaaccgccggcggaggaagtcgaagccgtccgacggcgagcattctggtgaaaagagaagggcgcaggcgaataaatcggcagctactaaagacaaagcaggaagtagcagcaagaacgcaggcattggagacggtttcgagacacagctactggggggtgcacacatgtccaaagatcaagaccaagccatggatctgggagaggtggtgaaagaagctgtagatcccaaaggtaaggcatcgatgcagcagcagcagcagcaagcacatcatgggattcatcagcagagccaccagcagcatggcttccctttcccttcgtcgtctggctcgtgcttattccctcagagccaaggagctgtctcgagcactgacacatcaaatatagctcaagtgcaagaaccaagcttagccttccatcagcagcatcaccaacacagcaacatccttcagcttggacaggcgatgtttgatctcgacttcgatcactagtataattaatatttatcaatcatctcgatctctccttctctctctctctctctctctctctctctctctctctctctctctctctctctctctctctccctcgtacgtgtgtgtacgtccagacatctcttttcatcttgtctctattaattactgtaatttggatataataatgatagcttatgcgttattgtcatgtgtactggcagttttcctcgttggagaagctggttaattagccggtacatcaaatttagtgc

SEQ ID NO: 5546 - DNA, 1418 bp, Oryza sativa
  Predicted polypeptide sequence is orthologous to G483
cttcccccacctccgcctctctctcgatccatctcccccctctctcctctcctctctctctccgttcccaatctgcggaggcggaggcggagctagggcgcggcgtcgccggcgaggagttccgcaggcgcggtgtggacggggctcctctgcttccgcacacggcgggcggcgacggcgagcagggttggaggggcggcgcggcgacctcctcgttcctgccttgcctgcctccatctggtgttggaaatatcataagttttgggacaagcaagagaggacatggagccatcatcacaacctcagccggcaattggtgttgttgctggtggatcacaagtgtaccctgcataccggcctgcagcaacagtgcctacagctcctgctgtcattcctgccggttcacagccagcaccgtcgttccctgccaaccctgatcaactgagtgctcagcaccagctcgtctatcagcaagcccagcaatttcaccagcagcttcagcagcagcaacagcgtcaactccagcagttttgggctgaacgtctggtcgatattgaacaaactactgacttcaagaaccacagcttgccacttgctaggataaagaagatcatgaaggcagatgaggacgttcgcatgatctccgcagaggctcctgtgatctttgcgaaagcatgtgagatattcatactggagctgaccctgagatcatggatgcacacggaggagaacaagcgccgtaccttgcagaagaatgacatagcagctgccatcaccaggacggatatgtacgatttcttggtagatatagttcccagggatgacttgaaggaggagggagttgggctccctagggctggattgccgcccttgggtgtccctgctgactcatatccgtatggctactatgtgccacagcagcaggccccaggtgcaggaatagcgtatggtggtcagcaaggtcatccggggtatctgtggcaggatcctcaggaacagcaggaagagcctcctgcagagcagcaaagtgattaagaagagtaaatgatccctgtgaattgtcaagaagcttaccacctgattcagaattttacttttagccaggttgtcgtctattctgaatttatgaataggattaggattctctcatggtagttgcatttctgctgtagtggaaaaggatttatgacatgagagtatgagactaatgggtttcagttactataccgtttcctgtcaatccaaaagttggcctttgcgaggccattgatattgaacctaatgtggttgaactgcccatgccaacgtttgtaagctctgatgtgggtcattctgtatttcatgtttgcatggtttcatggaatcttctttgtttagacaatgaaaatgttttacattcgtggcatctgccataacac

SEQ ID NO: 5547 - DNA, 660 bp, Oryza sativa
  Predicted polypeptide sequence is orthologous to G483
atggtagaaccatcagccgctgctgccttccctccagctccccaggttgctccagcctatccagtgaacccaatgcagcttccagagcatcagcagcacgcaatccagcaagttcagcagctccagcagcagcagaaggagcagctccaggcgttctgggccgaccagatggccgaggttgaacagatgactgagttcaagctccccaacctcccgcttgcaaggatcaagaagatcatgaaggccgatgaggacgtcaagatgatcgcgggcgaggcaccggcgctcttcgccaaggcctgcgagatgttcatcctggacatgacgctgcggtcctggcagcacaccgaggagggcaggaggaggacgctgcagaggagcgacgtcgaggcggtgatcaagaagaccgacatcttcgatttcttggtggatatcatcactgatgataagatgaaggatgatggcatgggctctcaggctgcatccatggtttcgccatatacctcaggaggaatgggattttcctttgatctgtacccgaaccagcatcacctcgcatatatgtggcctccacaagagcagcaggagcagtggcctccacaggagcagcaggagcagaagcagaagcaggattctgatggtggtggacaagatgaatga

SEQ ID NO: 5548 - DNA, 780 bp, Oryza sativa; identical to SEQ ID NO: 2003
  Predicted polypeptide sequence is orthologous to G483

SEQ ID NO: 5549 - DNA, 1310 bp, Oryza sativa
  Predicted polypeptide sequence is orthologous to G484, G2631
gttaggtgtcgcgcctggagacgcggagatggatccgatggatatcgtggggaagtccaaggaggacgtctccctccccaaatcaacaatgtttaagattataaaggagatgttgccccctgatgttcgagtggcaagagatgcacaagatcttcttgtggaatgctgtgtagagttcatcaacctcctatcttctgaatccaatgaagtttgcagccgagaggacaagaaaactattgctcctgagcatgttcttagagctctgcaggatcttggctttagggagtacattgaagaggttcaagcggcctacgaacaccataagcatgataccctggattctccaaaagcaagcaaattcactggtgtggagatgacagaggaacaagctgtagctgagcaacagaggatgtttgctgaggcccgagcaaggatgaacaatggtgccgccaaaccgaaggagccagaacctgaagcgcagcaacaaacacaacagccaccacagcctcagctgcaccctcaaccacagcaacccctgcagcctcaacttcagctccatcctcaaccacaacaacagccctcacagctacatcctcaacagctgctgcatcctcaatcgcagcaaactccgcagcctcaacctcaggtccaccctcaaccacagcagcctccacagctgcaaccgcaacctcagcttctccagcaaccgcagctgccccaacagctgcagccgcaatctcagctccccccacaaccgcagcagcccccacagctgcagctgcaatctcagctccacccacaaccgcagcagcccccacagctgcagccgcaacctcagctccatcagcaaccgcagccgcaggcagagctgcaatcacagtcacaaccacaaacagaacatggcttggacagttcatgattcagattccatgttgtgtagcctcagtataaggaaaagttggtgtacttccgctggcatttactaggactctgtgtgccccttgatagttttaggtttccatgcttcatgtacaatgtaaatccagtgtgatttcagttaccatgttgctaataatctgaagctctcttttgtcactgatgttattacttttccaaacaccctttctctgactctatgactgtagtagtatcatggcatgtatgatgccttgtcaaaagggactccattagcagtgtaacttgactttttccggtggcggttgtggtttccgtggcttttttaaaaaaaaaaaaaaaaaaaaaaaaaaaaaaaaaaaaaaaaaaaaaaaaaaaaaaaataaaaaaaaaaa

SEQ ID NO: 5550 - DNA, 1250 bp, Oryza sativa
  Predicted polypeptide sequence is orthologous to G484, G2631
acttataaaaaaatattttaaaagaaaatttagacaaagagaagtgaataaagaagagaaaagagaaaatagaagtgggacgagaataagacgatgatgtcagacaacgacgacgagttctgcatcccgcgctcggccatgtacaagctggtgaaagagctcgtgccacaagtgcgtctcagcggcgaggcgaaagacctcatcgtgacggcttgcaacgagttcatccacctgctagcgaccgaggcgaatcaggtgtgcgagaagcagtccaagaagctcatcctgcccgatcacgttctgtgcgcgctcgacaatctcggcttcggcgagtacaaagaggactgcgtcgaggtgatgaagcagatgcaagaggagaccgacaagcgcaagaagctgcgcaatcggctcgaaaagcccggcattccggaggaggagctcctccgtcagcaaaaccagctattcgccgaggcgaaaaagcagcagcaggccgccgacgaggccaacgacgagtggacccgaatgcagcacgaagccaaactcgctctccagcggcaggcttctaccgccgccgccgctgccgcttgctccacttcatacgatgaatctgccgcggctactgctcaactagccgccaacaatggaaaacccggtggaaaagacgacgacgatgataattacgattaatattcaactcttacacattcccttttttcttaatcttaagaacaaatttctttttatatatatgtttacacagggaactatatgctgtttttttttacacggtgatgaggaaaaaattataatgaaatttcaattttctatttttctgaaaacaaacaaaacactaaaactaaatcggtacgctttattttactattttattgtcaatcgtctatttatattattatttcattttattaaacaaacgtttttaaaagattttaacatcatctctatcaatcatcatctctttttatgtctaatgtacaaatgtagaaaatgaaatatatagcacacaatctctctaattttaagatttactagaataaaattaaataaaactaatttaaatttttttttcgtctctctcttatgttagtatgtcaataaaattaaaaaatgtgtgtgtgataaatcgattgattgatgtatcttatacatatatatataatatatatttgattttttgttgttaatttctttatatatttttttcatcaagaataaaatttattaattaaatg

SEQ ID NO: 5551 - DNA, 841 bp, Oryza sativa
  Predicted polypeptide sequence is orthologous to G502, G519
atgcacgagtaccgcctcgccgacgtcgaccgctccgcccgcaagaagaacaccctccggctagatgattgggtcctgtgccgaatctacaacaagaaaggcggcgtggagaagccgagcggcggcggcggcggcgaacgttcgaatatgatgagccacggggagaccgcgtcggcgggctcgccgccggagcagaagccggccgtgctgccgccgccgccaccgccgtacgcggcggcggcgccgttctcggagctggcggcgttctacgacgtgcggccgtcggactcggtgccgcgggcgcacggcgcggactcgagctgctcggagcacgtgctgacgacgtcggcgtcgtccggcggcgtcgtcgagcggccggaggtgcagagccagcccaagatcgccgagtgggagcgcacgttcgccggcgccgccgccccggctggcgccgtcagcacggccggaccgattctgggccagctcgaccccgccgccgccgtcgccggcggcggcgacccgctcctccaggacatcctcatgtactggggcaagccgttctgacggctcggctcggctcggcggcttgagccgggagggatgaatgatctgatattctatcggggtggctcgggcgagccgctggaatcgatcggtggccgttggatggcggccgagttattggtagccgtcagatgggagatggaatggcattagttagttactagtatccgtatggacggcggcgatgaaacaggggagccccgagatgcgtgtaggaaggagatgcatggtactgtactcgagaattataagccgtgtgtatatgcgaaattggttggct

SEQ ID NO: 5552 - DNA, 1361 bp, Oryza sativa
  Predicted polypeptide sequence is orthologous to G502, G519
gtcactgcagtgcctttgagctttcgttctctagagtgtctagggtgaatcttgagcgagtgagcgagcgatctctgtgttgtgtagtttgtgagctagggtgatggctaacaccggacttagcatccccatggtgaatggtgccacaatccacctcctccctggtttccggttccgtccaactgacgatgagctagtcatcaaatacctctacccccgtgcttttcatgtgccactgccctgtgcgatcatcaccgatgttgacatccatcatcacaacccctgggacatcgtcccagtggcggagagggagaaagggaagcacttcttcacaagaaaggaggtcaagtaccctggtagccgccgtagcaaccgtgttgctggtaatggcttctggagagcagcaggctcggaggtgcccatctattacaaaccagaaggtgctgctaacgacatgctagttgggatgaggcggactctagtgttccactacggaaagtcacgatctgcagagcgcactgaatgggccatgcatgagtttcagcttgctggtgctggtctccttcctcaccctatgatgaggcatgcaaccagcaatggttcagagccaccctgtggctgccttgaagcgacaatcgctaagaaaagtgatggtctctctgcaactcttcgtgccaagcgtgattctgcccctcttatgagaatcatggtagaacccgatagctcatgggtgatctgctgcatctacaagaagaggcagcgtgccccgcctgttgttatccctcctgtcattggcgatgtaggggaagctatcatccctcatgctattggcgatgcaagggaaggccaacttcacttcattgacttcctggggcagccagctcgcaatgatccatcctcgccccatagctgcaccattgacccctcctctttggaggaagggagtgatgagtctgccggtgatggtgaagataaggatggtgatggcatgaatgaagcaaattgatcgagtgtgaaggaagtgaactgagtctcaagaataaaaactgcaagtatggcgctccattccatggaagacctgcatgcatcctatatatgtgcttttatgttcaagttggagaactatgtgtgttgtctttaagttggagtactctaagctattcgatctggagattatgctgtttttaataaaagtttgaagtgtatctgtcctgtttaattagtttcaagaaagccaagcgtgtttgggttctaggatgaacaaagtcgtccaagatgcaagaagttctagagaggtagctacatttctggaaattgttgcatcttcctttcttcaatatatatatattgtcctatttcat

SEQ ID NO: 5553 - DNA, 1319 bp, Oryza sativa
  Predicted polypeptide sequence is orthologous to G502, G519
tattcttaccccgacgcggcgtctcctcccctctcctctccccttccctccatcgcatctcctcccgctccttcgatcccaaatcggccgccgccgccgctccgccatgtccccctcccgccccgacgaggcggaccccgccgccgacttcggctcccaccccaccgaccaagagctcgtcaccaaatacctacgccgccacgtcgactccggcgggaacccgtggcggtacgtccacgaggccgacgtgtacgccgccgatcccgacgacctcaccggcaagtactccccggccgtcgccagcgacgggtccagggcgtggtacttcttcaccaccgtgcggtccaagagcaccggcgggcagaggagggcgcgggccgtgggcgacggcgggtgctggcactccgaggccggcgccaaggacgtcgtcggaggcatccgcagcccccgcccgatagggcggcgccagttcttctcgttcgtcaacaaggagggcccccggcgggtgcggtcggggtggatcatggtcgagatcggcctcaaatacgcccagcagaacgcctcctccgacgagcttgttctgtgtaaggtgtaccggagcccgcgggcgccaccggctgccgccgccgccaacaaatccatggccgccccacctcccaccgccacgaaatccaagacggaggaggctacaccacctcccgatgacgtgaaaccggtggtggcggctgcgcagactcccgacaccaaaatactcagggcggcgaaggaggcggccgcgactggatgcaagaggaaggctgacgtgaagagctctggtgcaagaaggggcaagcggctctgctcccgctgccgggcggagacatcggaatcggacagcgagacggcggtacttgacaggtcgccgtccatcgaagacgaaacggcggactcttcagaaatccatggaagcagtgatggcaaattcatcaggttcttgtgatttagttcgatctggagccccgagggtgctagcctagattggaatcagcgtgtaccaacaaaatggatagagctgctgtagttctcattttgagttcttaagccctagtataatgcctaccccaaatcatgcgttacccgcaaatttcagcatgatacagacaaggtaagcatttattttcagtatcagttgcaccgtatggtgcacttgtagatagaagttactacagcatggagaaatttggagattaacatatagacattagacattttctttcatgtaatatagtagtagaacacacaagaggttcaagcttgaatgattagaaaagcttcttgcc

SEQ ID NO: 5554 - DNA, 1255 bp, Oryza sativa
  Predicted polypeptide sequence is orthologous to G502, G519
gacccaacaacccaccaccctcattccctcaagtcccaagatcgaacacctcgtgtccatggcggcggcgaagcggcgagtgcgcgacgcggaggcggacctgaacctcccgccgggcttccgcttccaccccaccgacgaggagctggtggcgcactacctctgcccgcgcgccgcgggccgcgccgccccggtccccatcatcgccgagctcgacctctaccgccacgacccatgggacctcccccaccgcgccctcttcggccgccgcgagtggtacttcttcaccccgcgcgaccgcaagtaccccaacggctcccgccccaaccgcgccgccgcctcgggctactggaaggccaccggcgccgacaagcccgtgctgcacaacggcaggacggccgggatcaagaaggcgctcgtgttctaccacggcaagcccccccgcggcgtcaagacggagtggatcatgcacgagtaccgcctcgccaagaagggcggcgccgccgccgccgcgggcgcgggcgcgctcaggctggatgactgggtgctgtgccggctgtacaacaagaagaacgagtgggagaagatgcagagcaggaaggaggaggaggaggccatggcggcggcgcagtcgtggggggagacgcggacgccggagtcggaggtcgtcgacagcgacgcgttcccggagatggactactcgctgccggcggcgtcgttcgacgacgccctgctgcccaaggaggaggcgcgcgacgacgactggctcatggggatgagcctcgacgacctccagggcctcggctcgctgctgcaggccgacgacctctccatgctcgcgccgccgccggcggcgaagacggagccgctcggcgcgccattcttctgagctctctctctctctctctctctctctctctctgtgactgcaccactgtatataaattcagagttttcagacatgttcagtattcagagttctcaggcaagttcagaattcagagatggttaaggattagtggcttatgagcagtatgatatgcaggttagtttctagtttagcagtgttactccagattggagatttgattaatgatttgattctaattaatgtagtatactgagtgttactcatcatcacagattcatcagagctgtgtcaagtgacaattctttttttttttatttcctggatcaagttcaccatgttgtgctcaagatttgtggataaatgcacatccatccttgaattggc

SEQ ID NO: 5555 - DNA, 1529 bp, Oryza sativa
  Predicted polypeptide sequence is orthologous to G502, G519
gccaagccctcctctcctcttcccaacactagtaggataaagccacagagagagcagtagtagtagcgagctcgccggagaacggacgatcaccggagaagggggagagagatgagcggcggtcaggacctgcagctgccgccggggttccggttccacccgacggacgaggagctggtgatgcactacctctgccgccgctgcgccggcctccccatcgccgtccccatcatcgccgagatcgacctctacaagttcgatccatggcagcttccccggatggcgctgtacggagagaaggagtggtacttcttctccccgcgagaccgcaagtacccgaacgggtcgcggccgaaccgcgccgccgggtcggggtactggaaggcgaccggcgccgacaagccggtgggctcgccgaagccggtggcgatcaagaaggccctcgtcttctacgccggcaaggcgcccaagggcgagaagaccaactggatcatgcacgagtaccgcctcgccgacgtcgaccgctccgcccgcaagaagaacagcctcaggttggatgattgggtgctgtgccggatttacaacaagaagggcgggctggagaagccgccggccgcggcggtggcggcggcggggatggtgagcagcggcggcggcgtccagaggaagccgatggtgggggtgaacgcggcggtgagctccccgccggagcagaagccggtggtggcggggccggcgttcccggacctggcggcgtactacgaccggccgtcggactcgatgccgcggctgcacgccgactcgagctgctcggagcaggtgctgtcgccggagttcgcgtgcgaggtgcagagccagcccaagatcagcgagtgggagcgcaccttcgccaccgtcgggcccatcaaccccgccgcctccatcctcgaccccgccggctccggcggcctcggcggcctcggcggcggcggcagcgaccccctcctccaggacatcctcatgtactggggcaagccattctagacgaccaaaaaaaaaaaaaaacaaccgcattggcagcaatggtgtcactgaacaccgtgcaggctagctagcttcatggccggtgaactttgactcaggcgagccgccggagttgactcaaagataattaaaagaagtgttttaagtggattggattggattagacagaggagatgaggactcgagaaaggcggcgatgagaccgtggttggggggaccctggcctggactgaacgacgacgaggcagcagcagaaagatggtgcaattgcatcgggtggcatgtcagtgtgtgtgtatagtggcatgtacatagtacatggtgattgattcggtatacagggggctagctttcctgtttctgtttcttcattggttaattattactcccattataaggtcttcttcagggttgctagcttaattaattaattaattagcccagtggttgaagtgtaagtcaaaattcatcaagtcagagactggaataatacaatacagtactgc

SEQ ID NO: 5556 - DNA, 1868 bp, Oryza sativa
  Predicted polypeptide sequence is orthologous to G502, G519
attccaaaactttcgaaagcttccattagcgactaatccagccttcgttaagggtgattagaatttgattaatttcaaggcctcagatcggagattgaatggagtgcggtggtgcgctgcagctgccgccggggttcaggttccacccgacggacgacgagctggtgatgtactacctgtgccgcaagtgcggcggcctccccctcgccgccccggtgatcgccgaggtggacctctacaagttcaacccatgggatctccccgagagggcgatgggaggggagaaggagtggtacttcttctcgccgcgggaccggaagtacccgaacgggcagcggccgaacagggcggcggggacggggtactggaaggcgacgggggcggacaagccggtggggtcgccgcgggcggtggcgatcaagaaggcgctcgtcttctacgccgggaagccgcccaagggcgtcaagaccaactggatcatgcacgagtaccgcctcgccgacgtcgaccgctccgccgccgcccgcaagctctccaagtcctcccacaacgccctcaggttggatgattgggtgttgtgccgaatctacaacaagaagggagtgatcgagaggtacgacacggtggacgccggcgaggacgtgaagccggcggcggcggcggcggcgaagggtggtcgcatcggcggcggcggcggcgcggcggcgatgaaggtggagctctccgactatgggttctacgaccaggagccggagtcggagatgctgtgcttcgaccggtcggggtcggcggaccgcgactcgatgccgcggctgcacaccgactccagcgggtcggagcacgtgctgtcgccgtcgccgtcgccggacgacttccccggcggcggcgaccacgactacgccgagagccagcccagcggcggatgcggcgggtggcccggcgtcgactgggccgccgtcggcgacgatggcttcgtcatcgacagctccctcttcgagctgccctcgccggcggcgttctcccgcgccgccggcgacggcgccgccttcggcgacatgttcacgtacctgcagaagccgttctaattaacggaacgtgacgcctctgcaaacgctaattagctcactaaccactgtcaggtcgatcgtgtaattcttttaccagtctagggtacagccaaaaaaccaaaaattaaccgtgctcgatcgatcgatcgatccatggatcgatgatcgcctccaccggcagatcaaaatcgaagcaaaaaatcagggagaattcttggtacttccagtacctctcgtcgacaccacgtgtcgggttttctgcaccgcggatcctcgctggccgcatcgtaacggcgagcgaggttaaaaatagtggagaattcaagaacacatccctgatttttgtttctgccggatggggagtaccgtgagcatggtagaaatgactggtaaaattttcgttgatgataggtagccagagtcgatgtaaccagtcgatttttttttttttttggttttagttgacatgccttcctgatagattcagaacaaacaatagagaagagaggagaaaaaaacacagaggagaaattcagagaccaaagttcaaagttttggaattttcaggggcgccagcagctgatggtattgtcagtcgtgtctaggttcgtagaggaaattaaaatgtagaagaacgggtacttcagttcacttcaggttcgttcgtgccaaacaggtctctgacactttagttaggttttgatttttttttctctttttttctggttttttgtcgtttggtaatgtaatgtaagggtgattgcgacatggtatttatgtgattagagtcgctttcagttg

SEQ ID NO: 5557 - DNA, 969 bp, Oryza sativa
  Predicted polypeptide sequence is orthologous to G502, G519
atgagcggcggcggcgaaggggcggcggcggcggagaggcaggagctgcagctgccgccggggttcaggttccacccgacggacgaggagctggtgatgcactacctctgccggcggtgcgccggcctccccatcgccgtccccatcatcgccgaggtcgacctctacaagttcgatccatggcatctcccaagaatggcgctgtacggcgagaaggagtggtacttcttctcccctcgggaccgcaagtacccgaacgggtcgcggccgaaccgcgccgccgggtccgggtactggaaggccaccggcgccgacaagccggtgggcacgccgaggccggtggccatcaagaaggcgctcgtcttctacgccggcaaggcgcccaagggcgacaagaccaactggatcatgcacgagtaccgcctcgccgacgtcgaccgctccgcccgcaagaagaacaccctccggctagatgattgggtcctgtgccgaatctacaacaagaaaggcggcgtggagaagccgagcggcggcggcggcggcgaacgttcgaatatgatgagccacggggagaccgcgtcggcgggctcgccgccggagcagaagccggccgtgctgccgccgccgccaccgccgtacgcggcggcggcgccgttctcggagctggcggcgttctacgacgtgcggccgtcggactcggtgccgcgggcgcacggcgcggactcgagctgctcggagcacgtgctgacgacgtcggcgtcgtccggcggcgtcgtcgagcggccggaggtgcagagccagcccaagatcgccgagtgggagcgcacgttcgccggcgccgccgccccggctggcgccgtcagcacggccggaccgattctgggccagctcgaccccgccgccgccgtcgccggcggcggcgacccgctcctccaggacatcctcatgtactggggcaagccgttctga

SEQ ID NO: 5558 - DNA, 1332 bp, Oryza sativa
  Predicted polypeptide sequence is orthologous to G502, G519
gccacggaagcgcagcatcaacaaaggcagcagcagcagcagcagcagcagcagcgttggtggtggtggtgtgtcatcaccaacattttcacgagaggagaaggatggaaatggcggcggcggttgggggcagcgggaggagggacgcggaggcggagctgaacctgccgccgggcttccgtttccacccgaccgacgaggagctcgtggtgcactacctctgccgcaaggttgcccggcagccgctccccgtcccaatcatcgccgaggtcgacctctacaagctcgacccctgggatctccctgagaaggcgttgttcgggaggaaagagtggtacttcttcacgccgagggaccggaagtacccgaacgggtcgaggccgaaccgcgcagcggggagagggtactggaaggcgacgggagccgacaagccggtggcgcccaaggggagcgcgaggacggtggggatcaagaaggcgctcgtgttctactccgggaaggcgccgaggggggtcaagacggactggatcatgcacgagtaccgcctcgccgacgccgaccgcgccccgggcggcaagaagggctcacagaagctggacgagtgggtgctgtgccggctgtacaacaagaagaacaactgggagaaggtgaagctggagcagcaggacgtggcctccgtggcggcggcggcgccgcgcaaccaccaccatcagaacggcgaggtcatggacgcggcggcggctgacaccatgtccgacagcttccagacgcacgactccgacatcgacaacgcctccgccggcctgcggcacggtggctgcggcggcggcggcttcggcgacgtggcgccgccgaggaatgggttcgtgacggtgaaggaggacaacgactggttcaccggcctcaacttcgacgagctgcagccgccgtacatgatgaacctgcagcacatgcagatgcagatggtgaatccggcggcgccagggcacgacggcggctacttgcagtccatcagctcgccgcagatgaagatgtggcagacaatcctgccaccattttgagatggatggagcaagaaaaaggttgctgtagataaagggcggaaataggagtgatggctagaaaattattagatttactagaacgaaaatgattagaaatctggcaagcatgattctgcaaatgtggtggtagatgcttgcagtatgtaattcatttgttcagtatatgcatttggtaatctgcaaaacatctccttttgttctcatatcctaagcgaaacatatatgattttatccttcaaaaaaaaaaaaaaaaaaaaaaaaaaaaaaa

SEQ ID NO: 5559 - DNA, 1312 bp, Oryza sativa
  misc_feature (1168)..(1168): n is a, c, g, or t
  Predicted polypeptide sequence is orthologous to G502, G519
acattttcaaacaacgcaaagcagtagcagcagcgagaagcaagcaagaagcgatggggatgaggagggagagggacgcggaggcggagctgaacctgccgccggggttcaggttccaccccacggacgacgagctggtggagcactacctgtgcaggaaggcggcggggcagcgcctgccggtgccgatcatcgccgaggtggatctctacaagttcgacccgtgggatctgcccgagcgcgcgctgttcggcgccagggagtggtacttcttcaccccgcgggatcgcaagtatcccaatgggtcacgccccaaccgcgccgccggcaacgggtactggaaggccaccggcgccgacaagcccgtcgcgccgcgtgggcgcacgcttgggatcaagaaggcgctcgtgttctacgccggcaaggcgccgcgaggggtcaagactgattggatcatgcatgagtaccggctcgccgatgctggccgcgccgccgcgggcgccaagaagggatctctcaggttggatgattgggtgctgtgtcggctgtacaacaagaagaacgagtgggagaagatgcagcaggggaaggaggtgaaggaggaggcgtccgacatggttacgtcgcagtcgcactcgcacacccactcgtggggcgagacgcgcacgccggagtcggagatcgtggacaacgaccccttcccggagctggactcgttcccggcgttccagcctgcgccgccgccggcgacggcgatgatggtgcccaagaaagaatcgatggacgacgccaccgcggccggcgccgccgccgacaccatccccaggaacaacagcagcctgttcgtggacctgagctacgacgatatccaggccatgtacaggcgcgctcgacaatgctgccggcgggcgacgactctactcggtcgtctcgcgtcgcgcgggtgaaggtgagaagcacgcgccgcgccggatgggatggcccgtctgagggacgggaacgacgaccgggtggacaagctgaagggttaatatacgcggggggcagaagcctggtatccccgcggtctacatgtccggacataatcactatccccgggcaaaccggtcgtctctttcacccggggctgttcaacgggcgcactgctgactcttcactctcacgagancgaacatctcagcatgtacactgtcacagatcactcacggctagcgtcgtctcatcgcacatatctacactatacgagtcattcacagactgatgctgcagtagtctctgatactagagctgtgctctcatgtcacgtctagac

SEQ ID NO: 5560 - DNA, 1336 bp, Oryza sativa
  Predicted polypeptide sequence is orthologous to G504, G1425
atcctccacaagagaaactaggatcttcaagtatagctagcattgcgccctcatttcatccatggcaatgcagctgtccttgcctgtcttgccaacgggttttcgtttccatccaaccgatgaggaactagtcatcaactacctccagaggcgtgctaccgggctatcgtgccccatccccataatcgcggatgtcgaaatatacaacttcaacccgtgggagcttccatccatggctctatttggggaacatgagtggtacttttttacactacgcgaccacaggtaccccaatagtgtgcgccctagtcgctcagcggcgtcaggcttttggaaggccaccggcactgacaagcccgtccaagttgctaacatgcaaagcactcctgtagctatgaagaaggcacttgtattctatgttggccgcccgcccatggaaaccaagactacatggatcatgcatgagtaccgtctcacaaacacgggagggtccactgcctcccacccatccttgtcttcatccaccgcacacccttctgtgaagctagacgagtgggtgctatgcaagatcttcaacaagtccccagagccggacaacaccgcaccaccatcaaacgtcgtctcacggttacagtgctcgccgccgctgccgccgccggcggcaccgcccggcaactacccgccgctgccggtgggtgcgacgaacgacggcggcgtgttcgcctgcgccggcgacatgctcttcaccatccaagagcaccaggagggaacaccatcgatgctgccgccgatccctaaccttgagccaccggcggcaacaattgggaattcctctctcaatggcactgctgctgctgctgctgctgctgatggccatggccgccttgaggaagaggacaccagcgcctacaccttcaccgaccaggaaatggagcagatgctcatggacctgatggaccaggatttctttggcaatgatcaaccccaggagtgaactgtgtggtggagtgattttcatatcattccatagctctgatctgtgctggagagtgaatttagtatctattgtaccagatagaataaaaccagaaaagaaataaaagaaggccaaagaaaaaagcaaaaagaaaattgtataattactaggtttggatgccgtctgtagaaccttgtgtgctatgtaacttttttctttgtattttggcattttcatcatattgtgtcataaataaagcagggctttcttttgtagtttgccatctcaatcttgcaccgtgatgttataaaaaaacaaaattaattattgtgctacactgtacttttggctgtgttcggc

SEQ ID NO: 5561 - DNA, 2717 bp, Oryza sativa
  Predicted polypeptide sequence is orthologous to G504, G1425
ggcttccgcctctcctcgcctcctcccttcctttcccccccaaaccctagaattcccccccacaaaaccctagaattcgcgcgatcgaggcggctatggcggcggccgcggatgggcttccgccgggcgtcaggttcgaccccgccgacgacgagctcgtctcccgctacctgctccggcgcctccggaagcagcccatcccgctccacggcgtcatccacgaggcggatcccctcggcgcgccgccatggatgctcctcgccgctcacggccggggcggcgacgaggccttcttcttcgccgaggcgcgcgccaagaacgtcagggggaagcggcagaagcgtaccgtcgagggtggggggttctggcaggggcagcgggtgtgcatcgacggcgagaggctgcgcgtccccggcgacggcggcggcggcgaagtcggcggggaattggagatcgagtggcggaagtacatgctgagcttcttcgccgagggggagaggggcagctcggggtgggtgatgcacgagtacgccatcacggcgcccgctgacctcgcctcgtcgccgatccggctttaccgcgtccggttcagcggccacggcaagaagcgcaagcgggagccggaacgcctgggcgcccgcgtccacgacgacgacgtcgacggtggagaacgcgccgcgccccggcgcgccgtggcagagaccgccctgttcgtgcagcagtcgagcgccgtggattgcgccgaatccgccgatcagagcttctccggcgtgatcgagcctgtgttccacgatctccccgacatgatgccagagcaagctgatgccggagacactgcagagactacagcagcggtggtgaacctcacggacgccatgaccgagcagcccgttcttccgctagcagcagatggcgacgatcagagctcctacggtgtcatcgatccggcgttccgcgatcttgctgacctgatggtcctgccacctgtgctcgcgcagcaggagcctccgctcgcgcccgtggcaatggtggatctccctcctggcaatgctgattgcgccgatcatcagagctgctctggcgtgatcgacccggcgttccgtgatctccccgacatgaccgtgctgccaccagagcaagctgacaccggaggcggagcagagactaccacagcaatggtgagcctcacggacaagctgaaatactcctcctccatggacggcgaggcagcgccggcgtggtgtgatttcgattttccagagagcactgatgaggtgctcagctacatgaacttcaccgccggtgcccacgacaacaatgacggcagtgtgggacgcgccgcgccatggcgtcccgtgtcagagatcgccatgttcgagcagccgagcgccgtggatctccctcctggcgatgctgattgcactgaatccgccgatcagagcttctccggcgtgatcgagccggtgttccatgatctccccgacatgatccgtgagcaagctgatgccggagacaccgcagagactactgcagcggtggtgaaccagaactactccatggcgttgtgtgatttcgacagcggcattgacttcaccgccggcgcccacgacagcggcatggaacgcgccacgccctggactcccatgtcagaggccgccctgttcgagcagcaagggcctccgctcgctcccgcggcagtggtggatctccctcctggcaatgctgattgtgccgatcatcagagctcctacggtgacatgatcgtcctgccatcagagcaagctggcgccggaggcggagcagagactaccgaggccctgttcgaccagcccgttccgccgcttgcagcagattgcgccaatcagggctcctacggcgtgatcgacccggtgttccgcgatctcgccgacttgatcgttctgccaccagagcaggccgacgccatggacggcgaggcggcgccggcgtggtgtgatttcgattttccggagaacattgatgaggcgctcagctacgtcgacttcaccgccggcgcccacgctgacaacgacggtggcgtgtcagagaccgccatgttcgagcagccggggtctccgccacagcacgatcctctgctgatggatgctgatggcgccgatcagagctcctcctccggcgcgctgatcgacacggtgttcggtgatcacgccgaaccgatcgtcctgccactggagcaagctgacaccggaggtggtgcagcagcggcggtgaaactcatggacaagcagaagtactcctcctcctccatggatggcgaggaggcgccggcgtggtgtgattcggatttcccggagagcattgacgaggtgctcagctatgtcgacttcagcaccgatggcgcgagctgcgacttctccatggacgagctcttcgatcttgcagattagttagcatcctggagatagcaagccaccaagaacactggcattgacattgtctttctaagaagagctgtaatcagtagcgcaaaggcgagatttgttgatattctggtgtaatctgtagactagaggcagagtagatagatgttccttagtttattgactaatctatgcatagatgagttatttgtttattgattgaactcaatgtaagtaacattattgtaagtaatgaatatactcccttttcaatcattatattccctattcaaaatcaatatactgcattgatctgcc

SEQ ID NO: 5562 - DNA, 1654 bp, Oryza sativa
  Predicted polypeptide sequence is orthologous to G504, G1425
gatttcaatccttcctcttccttagcttattagcttccttccttcactagtgccagttttcctcctacctaatctaagctagccaggtcgtcatcttcttccttcagctcacgctgaccaaacaccatctgttattctgtttgtttgtttttttaaaaaaaagaaaaaaaatctagctaggcgagccgattgaaggagctgagcatgccgagcagcggcggcgccatgcctgcccttccaccaggcttccgcttccaccccaccgacgaggagctcatcgttcactacctcatgaaccaggccgcctccgtcaagtgccccgtgccaatcatcgccgaggtcaacatctacaagtgcaacccatgggaccttcctggtaaggctttgttcggcgagaacgaatggtacttcttcagcccgagggaccgcaagtaccccaacggcgctcgccccaaccgcgccgccggctcggggtactggaaggccaccggcaccgacaagtccatcctctccactccgaccagcgacaacatcggcgtcaagaaggccctcgtcttctacaagggcaagcctcccaagggcgtcaagaccgactggatcatgcacgagtaccgtctcaccggcacatcagctaacagcaccaccaccacaaagcagcgtagagcgtcatccatgaccatgaggaatccacaagaagagcaacgacttcaattcctctgaccaacacgaccaagaacccgaggaatcaaccgtcgaacagcttgaagacatccatgacaacaactcctctgaacaacctccagctccagctgacatgaacaaccaacagtcagatttccagcccatgacggcgatgagcatgagcaagtcatgctccctcaccgatctcctcaacaccatcgactgcgccgcgctctcgcagtttctcctcgacggctcatccgacgccatcgctgagcctcctgctcctcccagccccctaatatacacaacacctcatccaaattaccaaacactaaactataacattaacagcaacagcagcatgccacacgccttcgagtcacgcctagatcatcacgatggttacgttaacaattataatgttaatggcctgaggaggaagagaatgatggcgtgtagtgcaacttcctttgatgatggcagcagcagcaatgactttgtgcatgccgttgtcaagaaaccgcagctgctgccaagtgattcgaggggtagtggttttggaggaggttactgcaaccagcagctttcagagactgcgactggctttcagtttcagaacggcaatctgctgagccatccatttcctctgaacaatcatctgcagatgcagtagtaggcgtctagatcccgtttaccgatcgatctgaagagaggtgaattaatttcaacgaatgaaactacagattcagagaggaagatactgattgttccatttgtgatttattttgaggagttgcatgggcagatagacaaacagacggaattcttgatgtaaccgatgcaaggaaagattcagatttcttcctatggcattaatttgtgagtttttttttgttttcattttcatgtacaagaatgtaaattataaatggtaatatcgtgcaagctagtactcaagccaatttatatg

SEQ ID NO: 5563 - DNA, 1524 bp, Oryza sativa
  Predicted polypeptide sequence is orthologous to G504, G1425
gaacacccaaccccctctctctctctatctctctcctctctctctctctagctctagctctagctcgtcgccgccatgaacgttccaagcaaatgcatggctcctgcaaagtaaaaaaagaagaagaagcagcagctgcagcttctcttcagtatcgatctttaactgtatcgagctagcttagcttagcttagctctctgccattaacttgtgcttcactgagcttgagctagctagcttcttggctgtgtgactgagtagctctagctcctcgtcgtcgtcgtcgtcgtcgtcgtcgtcggcgtcggtggtggtgtgaattgatagaattgatacgatggagagggcggctgcggcggcgccggtggtggtgaggcatggaggagtggtgttgccgccggggttcaggttccacccgacggacgaggagctcgtggtgcagtacctccgccgcaaggcgttcggcctgccgctccccgccgccgtcatccccgacctccacaacctcttcaagctcgatccctgggacattcctggtgcgagcagcgacggggacaagtacttcttcgccgtgcggccacctgcggcgagggggaggaggcagcatgtgacggcgagcggtgggtgctggaagccggcgggcgggcgggacaagccggtggtggtggcccggtgcggcgggagccacctcgtcggcgtcaagaagggcatggtgttcgtcccacggcaagggaggaaggcaccggcggcggcggcggcggccgccggcggtggctgctgggtcatgcacgagtacagcctcgccctgccgatgcacaagaagggttgcttggctgaggctgaagaatgggtagtgtgccggatatttcagaggagcagcagcggcagccggtcgccgaggaggcctgacaacgacgtgaggcgaacgatgccggccgtcgccgagctcggccggtcgccgtcgccatcgtcgtcgtcgtcgcaatccagctgcgtcacaagcagctccgaccaggaagaggtcagcagcggctagctagctgaagaagaatgcaggcagcagcagcaagcagctaagctgcctctcaaagagaggcttgagtgttagcctagctaagcatatatatttatagccggccaaaccctctgaaagtgatctgcatcaatgcatgcccccctttaatttcttcttcctccttaattattttttcccaaccatgtaatgtaatgtaatttaatgtaatgcagtgtaatgtaacgggaaggaagcactgaattaatcaaattaaattaacaaatgaagagtgctcaaaagtccaaggaagcttctaaggttcaggagccagatattatctacttaattaattaattatgggcacatatctgtagttgctagctagctgcatatgcatctcgtcgttgtcgatccatttgtaacttgcaagttgtgttggtgtaatattgtaatatttttctccgatggttgagaaattaatctgaaatccattatagcaattaattgc

SEQ ID NO: 5564 - DNA, 1650 bp, Oryza sativa
  Predicted polypeptide sequence is orthologous to G504, G1425
atcgatcgatcgatgagcactcgctttgattcgatcaatcgattgatcgagctataggtagccaattacaagctaattaaagcagtaaccgtattagatcgtcgatggagatgacgatgtcgtcggcggcgacgtcgctgccgccggggttccggttccacccgacggacgaggagctgatcctgcactacctccgcagccgcgccaccgccgggcagtgccccgtccccatcatcgccgacgtcgacatctacaagttcgatccatgggacctgccatgtaagccttcttcctcgatcatatcgatggatcgattgagttggtcgttcggtcaattgctactggttaattaattgcagcgaaggcggtgtacggggagagtgagtggtatttcttcagcccgcgagaccgcaagtaccccaacggaatccggccgaaccgcgccgccgggtcggggtactggaaggcgacgggaaccgacaagcccatccacgacagcgccaccggcgagagcgtcggcgtcaagaaggccctcgtcttctaccgcggccgccctcccaagggcaccaagaccagctggatcatgcacgagtaccgcctcgccgccgaccctctcgccgccgccgcaaacacctacaagccctcctcctcctcccgattccgcaacgtctccatgaggctggacgactgggtgctctgccggatctacaagaagtccggccaggcgtcgccgatgatgccgccgctcgccgccgactacgaccacgacgagccgtccggagtccttgacgacgcctacagcttctacgcgccgccgatgatcagcaccacgctcatccccaagctccccaagatcccctccatctccgagctcttcgacgagcacgcgctcgcccagatcttcgacaccgccgccgacccgccggccgaccaccatcagcatgccctcgccgtccacccctccctgaaccagctcctcggcgtcggcgacaacttcctcgcggagtgctacccgtcgacggcgtccacggccaccgttgccggcggcaagcgcaaggcgagcccggccggagactacgccggcggcggccacacgccggcgaagaggctcaacggctcatgcttcgacgtggcgccgcagtccgtggtgggcggcttgcaagcgacgccgtcgtcagtcctcgccggactcaaccaccagatgcttcctcctcagctattctgaatatattcttaactagcttaattaatggccatggaaatcgatcaaacgcagtcgatcgaatttacggatgctacgtactggcatgaacaatcttgccgacgatattaagatcggatggaagcatggacgacgatgatgattggggtacggtatagaattattgtagtattgaacaattaggcatttgtatgcgattttttctcctacgtattcatttcaggcacagtgcaaaagcaagctggagccttgatagtactttacaccgtagagagggaatgttgtacaattaaagattactagatatacagaacaataatactttactgtagccaattgatatactactagtatacaggattgtagaagatatcaaatgcaatagattctggctctgatctgggaaatggaaattgcatggatgtgtt

SEQ ID NO: 5565 - DNA, 1817 bp, Oryza sativa
  Predicted polypeptide sequence is orthologous to G504, G1425
aactagcttagctagacagcgtgtgttggtggtggtggtggtgtgtgtgtgtgtgaggagggtgatcgatcgatcgagcgatggagagcccggactcgtcgtccggctcggcgccaccgcgagtactacggcggcaacagcagcagccgggctcggcgccggagctgccgccggggttccggttccacccgacggacgaggagctggtggtgcactacctcaagaagaaggccgcctccgttccgctccccgtcaccatcatcgccgaggtcgatctctacaagttcgatccctgggatctccccgagaaggcgaacttcggggagcaggagtggtatttcttcagcccgagggaccacaagtacccgaacggggcgcggccgaaccgggcggcgacgtcggggtactggaaggccaccggcaccgacaagcccatcatgtcgtcggggagcacccgcgagaaggtcggcgtgaagaaggcgctcgtgttctaccggggcaagccacccaagggcgtcaagactaactggatcatgcacgagtaccgtctcacggacacgtctagctccgccgccgccgtcgctacgaccaggcggccgccgccgcccatcaccggcggtagcaagggcgccgtctctctcaggctggatgactgggtgctgtgccgcatatacaagaagacgaacaaggccggtgcggggcagaggagcatggagtgcgaggactccgtggaggacgcggtggccgcgtacgcgccgtcgtcgcagcagcatgccacggctgctgctggcatggccggttcggacggcgccggaggagttgctgcagcgcacggcggcgactacagttcactgctccatcacgacagccacgaggacaccttcctcgtaaacggcctgctcaccgcggaggacgccgccggcctctcgaccggcgccagctctctcagccagctcgccgcggcggcgagggcggcggcgacaccgtgcgacgccaccaagcagcttcttgctccgtctccaaccccattcaactggttcgaggcattccttccacgggccaaggagtttcctagtgggctaagcaggagtagcagagacatcggcgacatgtcgctgtcatcgacggtggacaggagcctgtctgaggctggcgccgtggccattgacaccggcgacgccgccaatggcgcaaacactatgcctgcatttatcaatcctctcggcgtgcagggtgcaacctaccaacaacaccaagccatcatgggtgcctcgttgccatcggagtcagcagcagcagcagccgcctgcaatttccagcatccgttccaactctccagggtgaattgggattcctgaataaaaggtgccggcattatgcatacacatatatgcacatgcatacatgcatggcttttcaagtagtagcacaacattactagtaattaatcacactaatgtgtgtggcagtcgcattcagtgagcactgatcgagtagttgcatgaacacaacactaatgcatgcactacatatatatggccgcattgctcctagggcacgtacctgtacgaactaggtaagtgacctaaccagctagatcatgttcagaataaggagaagaagccgcatgcaaacacgtagatcatatggctttgccttcacatgcgtttgcatcatatatatcgcattcagaaagtagtgctgcagctaacacatagatatggtgttagcttcatgcgtttgtaccatatatagcggatgcagaaagtagctagttgcactgttcatcattatcccatgagatatgaactttatat

SEQ ID NO: 5566 - DNA, 1206 bp, Oryza sativa
  Predicted polypeptide sequence is orthologous to G504, G1425
atggctgaatcctccgaatctgcgtggccgcagcagagtcagcagctgcagattagcagcacaatgccggccggttctgcatggccggaggaggagaatctcgagaatctcgagcagccgcttcccctgctgatgccatcgtcggaggatcatcgcgagcagcagcttgttcccgttccatggctgcagcaggatcaggatcaggagtggcatgagcaggagcagtttcttcccctcaaaaatcagaatcaggagcagcttcaggatcagcaacctctgcaggatcaggaggagacgcgtagatatttgggcgtgcccggaatccggttcgtgccgtcggatatagaacttatccttgacttcctccggccgaaactacgcggcgagcagctgcccagctacagctacatgcatgtctgcgacgtctactccgaccatcctaaagaacttacgagtaagctgggtcccagccgcgaaggaaactggtacatgttttcacctagaaaccggaaatacaacaaaggcaaaaggcctagccgaagcaccggtcaattgggtttttggaagtcgactaccaagaacgaggccgtccttgacgccctcagcgataacatgttgattggatacaaggcatgcctcacctatcacgaatacgatgagagcatgccgacgccaaagttgaagaaagagaacgcgatcaagacgccgtggaagatgtgggagttcgtgtgttccaactccaaccggccgttcgacgcggaggaggagcccatgcggctcaacgactgggtgttgtgcaaagttaccaacaaggacaacaaagttaccaccaagaagttcaaaccacaacgcagcaagaagccgaagaagccgaagaagctacagcaggaggaacagccacaaaaccaaggcattgtgatcaggcagccgtcagaatccggctcggcctcctcgtcgcaccaagaaatccctggctcttctcttcccggagccggaggagacgccgcggccgcggcggcgacggcggcggcggtggtggatcctatgccattgcatatgattcctccttcttcatggaattatttcagcacgggagttactgcagatggtattgttatggatgacagtacgggagtcgattcatatggttgtgtagatggtgctggtgctcttaatttccagaggaacatcttctaccaccgttaa

SEQ ID NO: 5567 - DNA, 1125 bp, Oryza sativa
  Predicted polypeptide sequence is orthologous to G504, G1425
atggcggcggctggcgcggatgggctccctccggggctcagattcgaccccagcgacgacgagctcgtcggccggtacctgctccggcgcctccagggccagcccctcccgctcgacggcgtcgtcctcgatgccgatcccctgagcgcgcagccatggaggcttctcgcggatcacggccggggcggcgacgaagccttcttcctcgcggaggcgcacgccaagaacgccaagggcaagcgccagaagcgcaccgtcgagggtggagggttctggcaggggcagaggatgtgcgtcgacggcaagaagctgctcgtccccggcggcgacgacggcggcggcggcggcgaagtactggagatcgcgtggcgcaagtatgtcctgagcttctttgccgagggggagagggggagctcggggtgggtgatgcacgagtactccgtgacggcgccggctgacctcgcctcgtcgccgctccggctctaccgcatccgattcagcggctacggcaagaagcggaagagagagccggaagacgacggtcgagcacatggcgcgccccggcgggctgaggcggagactgctctgttcgatctggaggtcgggccaccgccaccgccactgctcgttcctcctcccgcggcggcggcggcggatcatggcaccgatcagagctcctccggtgtgaccgacatggtgttccgtgatcttcccgacctgatcgctgatgctggagctgctctgcccgatcagaaccaacaggattggtctgaagtcgccgatcagagctccttctgtgtgatgggcgatgactcttctctgctgctccctgatcttcctgggatgattgatgacaatgagcaccagcagtttgtgcgcgagtgcgacatgccacacctgttcgtcccgcaagcagaggaagccattgctggtggtggtgcagcatcggcgccatcggcggacaaccagaactgcgagttcaatgacggcgaggacatggcattgtcagattttgagtttccggagagtattgatgaggtgcttagctacatcgacttcagcacgagcgacacgagctgccgcgacttcaccatggacgagctgttcgatctgccggtggactag

SEQ ID NO: 5568 - DNA, 1818 bp, Oryza sativa
  Predicted polypeptide sequence is orthologous to G504, G1425
atggcggcgggtggtggtggcgctgatgggctccctccgggcctcaggttcgatccgaccgacggcgagctcgtctcccgattcctgctccggcgcctccagggtaagcccctcccgctcaatggcgtcatcctcgaggccgaccccctcagcgtgccgccatggaagctgctggcggagcacggccggggcgacgagggcttcttcttcgccgaggctcgggccaagaacggcaaggggagccgccagaagcgcaccgtcgagggtagtgggctctggcaggggcaaagggtctgcgccgacggcgagaagctgctcgtccccgatggcggcggcgtggaggtggagatcgtgtggcgcaagtacttgctgagcttcttcgccgagggcgagagggggagctccggctgggtgatgcatgagtacgccgtcacgtcccccgccgagctcgccgcgtcgccgatccggctctaccgcgtccggttcagcggccacggcaagaagcgcaagagagagccacaatccggcgaggacggtgtcggtcgagcacgcgcggcgccacagagcgctggaacagagactgctctgctcgaggagcgcgtcatgccgccacagccggcgccccagagcgtcggaacagaggatgccctggtcgaggagcgcatcccgccgccacagcccgttcccatccctcctatcgccggaacagaggatgccctggacgtcggcactgaggacgttcgaggacgagccgcgccacagagcgctggaacagagtctgctctactcgaggagtgcgtcctgccgccacagaccgcgccccagatcaccggaacaggggttgctctgctcgacgaggtcgttccaccgccacagaccgtgtcgatttcccctcccgcagcgctggtggacgctgtcgatgatgctgactgtgccaatcagggatgctccggcgtgatggacgattccacaatggtgttcagtcatcttccggacatgatcaccctgcccgcagaagaaggtgatgccgccggtggtgcagcgctggcgtcgatggactactcctgggctgattttgagttcccagagatcaacatggatgagttgcctaactgcatcgacttcaccacaactgaccccagctgcttggacattgagctctccatgggcgacctccatgagccccagagcactggaatagagtctgatctgctcgaggagttcgttccgcagccacagccagtgcttgttcctcctctggctgctctggttgaagttgccgatagctctgaaggccctgatcagggatgctccgttgtgatgcatgattcttctgcggtgtttactcatctgtcagacccgatcgtcctgccagaagaagaagaagctgatcgtcctgatgcgccggctgggactatgtcactagactatcagaactactccttgtctgatttcgagttcccagagtaccctctgctcgatgttgccggtgatgctgacggcgcagatcagtgctcttccaacgtgatggatgattcttccatggtgtttagtcaccttgaagacctgattaccctaccagcagaggaagcagaagccgatgcttgtagtgcagcgcctgcgccgtcgctggacaaccaaaaatactcctcacagggcatcatcgacagtgaggcgccggcattgtctgatttcgagttcccagagaccattgatgaggttctaaacagcatcaacttcacaatggccgacccgagctgcttggatatggagttctccatggacgacctcttagactttgatccgccggctgattag

SEQ ID NO: 5569 - DNA, 1524 bp, Oryza sativa
  Predicted polypeptide sequence is orthologous to G504, G1425
caacacccaaccccctctctctctctatctctctcctctctctctctctagctctagctctagctcgtcgccgccatgaacgttccaagcaaatgcatggctcctgcaaagtaaaaaaagaagaagaagcagcagctgcagcttctcttcagtatcgatctttaactgtatcgagctagcttagcttagcttagctctctgccattaacttgtgcttcactgagcttgagctagctagcttcttggctgtgtgactgagtagctctagctcctcgtcgtcgtcgtcgtcgtcgtcgtcgtcggcgtcggtggtggtgtgaattgatagaattgatacgatggagagggcggctgcggcggcgccggtggtggtgaggcatggaggagtggtgttgccgccggggttcaggttccacccgacggacgaggagctcgtggtgcagtacctccgccgcaaggcgttcggcctgccgctccccgccgccgtcatccccgacctccacaacctcttcaagctcgatccctgggacattcctggtgcgagcagcgacggggacaagtacttcttcgccgtgcggccacctgcggcgagggggaggaggcagcatgtgacggcgagcggtgggtgctggaagccggcgggcgggcgggacaagccggtggtggtggcccggtgcggcgggagccacctcgtcggcgtcaagaagggcatggtgttcgtcccacggcaagggaggaaggcaccggcggcggcggcggcggccgccggcggtggctgctgggtcatgcacgagtacagcctcgccctgccgatgcacaagaagggttgcttggctgaggctgaagaatgggtagtgtgccggatatttcagaggagcagcagcggcagccggtcgccgaggaggcctgacaacgacgtgaggcgaacgatgccggccgtcgccgagctcggccggtcgccgtcgccatcgtcgtcgtcgtcgcaatccagctgcgtcacaagcagctccgaccaggaagaggtcagcagcggctagctagctgaagaagaatgcaggcagcagcagcaagcagctaagctgcctctcaaagagaggcttgagtgttagcctagctaagcatatatatttatagccggccaaaccctctgaaagtgatctgcatcaatgcatgcccccctttaatttcttcttcctccttaattattttttcccaaccatgtaatgtaatgtaatttaatgtaatgcagtgtaatgtaacgggaaggaagcactgaattaatcaaattaaattaacaaatgaagagtgctcaaaagtccaaggaagcttctaaggttcaggagccagatattatctacttaattaattaattatgggcacatatctgtagttgctagctagctgcatatgcatctcgtcgttgtcgatccatttgtaacttgcaagttgtgttggtgtaatattgtaatatttttctccgatggttgagaaattaatctgaaatccattatagcaattaattgc

SEQ ID NO: 5570 - DNA, 407 bp, Oryza sativa
  Predicted polypeptide sequence is orthologous to G505
atactcgtatagcctataccgacgatacacacactttaaactacaacactggcaccatacccaatcccactcctttccactagacatccacacatgcagaaaacctcatcgtcgtccggcagcggcagcaacaggcgccttcgtccacgtcccagcctgcccagctcgatcctactcctcagcctcctgtccgcagcagcgactgtcggagtgactgcaagcgatgcaccactacagcaaggacaagggtaccactccttccagatagcaaagcgagggaggtcgtttgcagacgccaacggaatctttgaccccgagctctttgcacaggacagggagctcgtcgcggaaaagtacagacacagcaacgcacggtaccgccgtaatcttgaacgatcagcggcagc

SEQ ID NO: 5571 - DNA, 1531 bp, Oryza sativa
  Predicted polypeptide sequence is orthologous to G509
gacacaatcgccaacctatacagatatatgtgctagctacttccaagttcctacctatcaatttctctcctcctcttcttcttctctgcatcaatctgcagcttaattcttagctatgtacatatagctagctaccacttccaaaatactccacagagatcaatcacatatagatatagctagattgctatagacagagagatcatcaaagaaatttagcaggtgatagccacatggggttgagggacatcgagctgacgctgcctccggggttccggttctacccgagcgacgaggagcttgtctgccactaccttcataacaaggtggtgaaccagcatcgcttcgccggagttggaggagccgccgccgccggcggcggcaccatggtcgaggtggacctccacacccacgagccgtgggagctaccagatgtggcgaagctgagcacgaacgagtggtacttcttcagcttccgcgaccgcaagtacgcgacggggctccgcacgaaccgcgccaccaagtccggctactggaaggccaccggcaaggaccgcgtcatccacaaccccaagctgcacgccgccgcccaccgccgcgcctccatcgtcggcatgcgcaagacccttgtcttctaccgcggccgcgcccccaacggcgtcaaaaccaactgggtcatgcacgaatttcgcatggaaaaccctcacacccctcccaaggaggattgggtgttgtgcagagtgttctacaagaagaaggcggagacggagacggagtcgtcgtacagcatggagaacgagcaggaggcggtgatcgccatggcacggagcgccgcggccatcaaggcgggtggatgctactccaactcctcctcgtctcacgacccagccgccgccggccatcactcgcccccgccattcccggcgtcgctcgccgcctgcagcagcagccaccactacagcagccacccaccgccgcctcccgatcaccaccaccaccaccacatgcccgtcaccggcggcggcggcggctccctcaacgagttcatccccaccaccagcatggcgctgtacagcagcatcttcgacttcagccagcatctcgacggcggcgccgtggcggcgtcggcgtcggcggcgggatcgagggtcgacggcggcgagcagtgcggtctgatggagctagggctcgaggagcactacaactacaacggcctgatgccgatgtgacgatccaccataggtgtcggtgctgctagtgctagcttagctagcttacacacacccccagctgctagctagctgcagttctgcagcgcagctagctagcgtttattattaataacctcttttcacctcgattgtttgatctgatttgtttcgtggtgatcgattccatcgatcagcttgtgcagatttcgttgattgtgcatgcaaacatgcgcacctgtgtatagggtatagtggtacgtcgtatagcgctgttgcattgtttggaggtaaattatatatcttagcctttaatttgattg

SEQ ID NO: 5572 - DNA, 1077 bp, Oryza sativa
  Predicted polypeptide sequence is orthologous to G509
tgcacgtagtgttcgattaattcttgagctcatatattacttattcatccaaatagtattggtagcttgttgatcgaagaattaatccatggatggattgatcagtgatgatagtatgatgatgggtggtgaggtgagggcgatcgagtcgaggctgcctccgggtttcaggttccatcccagcgacgaggagctagtcggctactaccttcggaacaagcagcagcagcagcagcagcagacggcggccacctccatgctcgtcgaggttgacctccatgcctgcgagccatgggacctaccagaggtggcgaaggttggttcggatgagtggtatttcttcagctggagggagaggaagtacgcgacggggtggcgcaggaacagagcgagcaagcaagggtactggaaggccaccgggaaagacaagcccatccttcatccgacggtggccggcgccaggaagacgttggttttctactccggtcgcgcccccaacggccgcaagaccgcctgggtcatgcacgagttccgcctcctccatcatcatcatcatccaaacccaaatattcagaatatgcagcagcaggagggggatgactgggtgctgtgcagggtgttccgtaaggggaacaacagcaatggacaacctctagccacttcttcgccacctgctcatcacctggtggagtcactcatcagctcacctgcaccaactatcatgagcgatcacgatcggctcttcaccatccagctgccgcatcaccaacattgtgatgagcagtactttttcttagatgacgatgaacagcaccagcagcagctgctagatctttcagtgctccaagctccaacctcgttcgagtctgagcaagctccaggccacggtggcatggagattaatatcgcagagatggagagcttcgacacgacctgtgctgcgctgcaagacgcgagcgattactgcatgcagctctattaattaattcaatggatggatgaatcacacgtatatatacgcatagccttaaattaattaatgtgtatcatcagcttaattaattgcgcacttggctt

SEQ ID NO: 5573 - DNA, 1288 bp, Oryza sativa
  Predicted polypeptide sequence is orthologous to G509
aaaaatttacacctatatctatctatatttctcgtttgtgctcgggctagctcaccatatgcgtaaaattctgtagccaaaaggagcaagcaaactaggaggaggattagttcttgcgcatcgcttctgagctcgatctacgtcgtccggccggccgggagggatcgatcgatgggtctgagggagatcgagtcgacattgccgccggggttcaggttctacccgagcgacgaggagctggtctgccactacctctacaagaaggtgtccaacgagcgcgcctcgcaggggacgctggtggaagtcgacctccatgcgcgcgagccatgggagcttcccgacgtggcgaagctgacggcgagcgagtggtacttcttcagcttcagggaccgaaagtacgcgacggggtcgcgcacgaaccgcgccaccaagacaggctactggaaggccaccggcaaggaccgcgaggtgcgcagcccggccacgcgcgccgtcgtcggcatgcggaagacgctcgtcttctaccagggccgcgcccccaacggcgtcaagtccggctgggtcatgcacgagttccgcctcgactcgccgcattctccaccaaaggaggattgggtgctttgcagggtgtttcagaagagcaagggagacggcgagcaagacaaccccaccagcgcagcctccccggcggcgaccttcgccggctcgtcgcaggcggcggtgcctggccaagccgcgtacagcagcgacgaccatacgggctcgtcgatgggattcgcgccgaggcagaacgagatactcgacagctcgagccatcagttgctgaacttggcgatgctgcagtgcaactcggttctcgatcatttcccgcaggaggtgaacagctcgccgatgatggggttggcagggtccatcggaattggggatgaatacggcttcttctacgataccggcttcgaggagacggcgagcctcgggggcatgaggttcccacaagggtggagttgatgccaattgatcgtgcatgcagtgagatcatcgtgcctgcgcgcatttgcgaaggaaaatgattgaattaattccattgatacagttatttcgtcctaaaaaaataaactattgctactgtaggtagtgtttggtttagcatagaacctgcatgagatggttcggtcacttgaactgtatatatattgtgtgagtcaaaatgtatcgctctactcgtatgcaagttgatacaatccatcccaaagttccagttcatagatcaaacgatctatgagctatc

SEQ ID NO: 5574 - DNA, 1456 bp, Oryza sativa
  Predicted polypeptide sequence is orthologous to G509
aagaagagatcatatttagctatatctctagctagctgcgtctcgtcttctccaagctattgttacttagctagctttagctaggagagtaaaagatcgagtgatcattagtgagtttgattagttgattttgttggggttgagatcgaagagatcgatggccgggctgagggagatggagtcgacgctgccgccggggttcagattctgccccagcgacgaggagctcatctgcttctacctccgcaacaaggtcgccaaccaccgcgtcgcctccggcaccctcgtcgacgtcgaccttcacgcccgcgagccatgggagcttcccgaggtggctaagctcaccgcagaggagtggtacttcttcagcttcagagaccggaaatatgcgacagggtcacggacgaaccgtgcgaccaagacaggttactggaaggccacggggaaggaccggattgtccatgagggtacaacacgagcggtggtcgggatgaggaagacgctggttttttacctcggccgtgcccctaatgggcaaaagacgacatgggtcatgcatgagttccgccttgaaacacctaactcccaacctaaggaggattgggtgctatgtagggtgtttgacaagaagaagccatcgacaatagaagccgagggtggcggaagcagtggcagcgaccttttcattcccggtgccaccgatggctctactgacccctcctcgccgacgacgatggcacctctccttggctcatcgcccgatccgacagtggtggacaggttcgaccaccggtcagcggcggtgccaccattaatggtactcatgcaaggtggtggggaccaaatgatcagtggtagcggtgtccactgcagcaacaacgacaactccggtagtagcagcgcactgcttaacctgacgatgctgcaatacagcttcctagaacatcggccaactggtgacgacatggcggtgggggcccactttggaacatgccagggtggcaacaacgatgccacgatggcacttgggatggggtttgaggagcatggcatgggagagatcatagagatggaaccagcatggcgccaaggtggtagcaactgcgtgtacagggacgagctctacttctagcagaagtagtacaatggattaatattaatgatttgcatgtgttagagttcagttaaattcagaaaatatgtagagcttagaagaggtttgctagtttgtgattagagtgtgattattaattaaggtggagttaattaaggggtcgattagttcgagtggtcgtgatatgaaaatatttgtgtaattactcagtttgtaggtgagccatatatcaaacaactttagggaaaggggatgatcaagaattcagaaccaggatgaatttgatattcttgtactttaaaaaatgtaatgatgggaataatatttaaatctgattgagcc

SEQ ID NO: 5575 - DNA, 2565 bp, Oryza sativa
  Predicted polypeptide sequence is orthologous to G521, G2887
gggttgcttcctccgaaaatcctcatcctctccattgaccagacggcggcgcaggcgcaggcgctcacctccctcctcctccgcggcatccccaatcgaccagctggctcccctgcctcctccgcgattttgatcctaatcacccatgtctgctgaagtcagcgaggaatatccttatttcctctcctgctacttctggttcatatattgcataaaattccgagatttcacttgatacaagtggatcacctggagttttgtgctaatacttcctatcatgtgaatcagttgtagttagcataattggcaagactcaagttttctctcatctgggttcagaaacatttgtcggttgagtgctcgatctaaactctgcttgagtcttgccgaagattgtttctcaacaatcacgtcttctgttctctctgaggttggaccaatctcccttttggtctgatcaacctcctgatctcccttaagtgaaccgtcctgctgtgttcacgcaatacaatcttctgaagtcctctcttgttccttctgtgctcaaacatcaaaagcagctctctcctaagttctcttgattgtttgtgctcctaaattctgttgtttgagcactcaaacatttcccttactggtcaatcttagatcacttgttgattattggtattggcattatttggtgaagcatttctgcttgtaccttaaacaaaggtctctgttgtcttattggtgctgaaggcaagatatacactgcagtgatggctcaaacttgcttgccacctggctttcgttttcatccaacagatgttgaacttgtttcatactatttgaaaaggaagattatgggaaagaagcctcttattcaagctatatcagatgttgaactgtataaatttgctccctgggatcttcctgctcaatcctgtctccagagcagagatcttgaatggttcttcttttgcccacgagacaagaaatatcctaatgggtctaggacaaatcgttccacaccaaatggttactggaaaacaagtgggaaagatagaacgattgagcttaactctcgcattgttgggtcaaagaaaacactgatttttcatgaaggcaaagcacctaaaggcaacaggactgattgggtgatgtacgaatacaaaatggaagacaatcaattggtctctgctggtttctcaaaggatgattttgtcctctgcaaaattttcaagaaaagtggccttggtccaaggattggggagcaatatggggctccatttaatgaagaagaatgggagcatgcagatgctgaaatgtttcccttgctgccaaatgttgaaacttctgtgtttccattgctgccctcttcagaggtagtaaattctactgatgatacacgtgttcagccttctgttgctgccagagctattgaggaactacctgtgcagcatttacctcatgtatgtgctgggaatggatcaacatatcaaaatattactgttactggtgaaagtgctctcatggaactgccttcccagcactctgttgaatctattggtgatgaggtagtttctgtggacaactgttctaatgtggtcaataatgcagacagtcctgtaattgaggggcttgtattggaggaactttctaggtttttaactgattctcctcatcatggcaaccctgttggggagcactctggtctcccaccaatgtctgaggctgaagctcatgcttttgaggttagcacaaatgatctgtacaatgaaattgcagggcttgctgaattgggtgtgccaaatggtgatggattttctccgtccaatgctggtgttactgaacaacagcccacatactttggagttcctaacagtgaaaattatgtaaatatggatgatatctttgctccagacacaagattatcctatgcatatcctttgccaaacaaccaattttggcattatcccatggatcagttcacatacagtactactctatctgctgcctttccatctggtgactcgcgtccaactatgcgcattgttgatgatttacctgctgctgctaataacggtggctttgcttcaaaacccagcatgcagttcccactgtcataactaagtccagaaccgttctagaggactctgatactgatgacctagtgggattccatatgctggcagtactgcgcaacagatgtgtcttcatggccacctgctgccgctccgagctaagccaaacctcgctgaatctttctcgtggactgttgctggatttaccagtgctcgaactggtggtcactgcaagcattgtgaggccaacaatgtacattgttttgaaggtttggcctagttctcgatggcgatgctctatgatccgaacttgtctagcctggcgcgctactgaggatcagatattcgctttgtgttaccttatttacttgctgctgaataaagtttgtttatcaaactagtgtatattgtgttatgactgcacttaaaccttatgtaagtttgcatggtttggcctactatttacttgctattaatcttctcctaagttcgttgttttggc

SEQ ID NO: 5576 - DNA, 2255 bp, Oryza sativa
  Predicted polypeptide sequence is orthologous to G521, G2887
ggacgggagccgcctgcctctctccgctgcgcgccgcctctttccaattccacctcgccgcttctcctctcctctcaatctctcatccctcccttgtcgtaccgcatccgcatcagcaccaccatctcctctccgcggcggcgccgcatttccttccctcgccgaccgccaccaccagcggctccgcttgctcttcaaatgactcttgacatcaggaaggattatctctgttttccttgctgtggatgctcaataatatgccaaattcttaggccaaggtctatttggatctcgttatgctagtatagacaacgttccattctccttagtatggccaagacatctcttcctcctggattccggtttcatccaacagatgttgagttgactgtctattacctgaagagaaaattattgggcaaacacttacggtgcaatgctgtttcagagcttgatctatacaaatttgccccttgggatcttccagagaaatcttcgttgcagagtaaggatcgagaatggtatttcttttgcccacgtgataggaaatattctagtgggtcaagaacgaaccgatcaactgaagctgggtattggaaagctactggaaaagacagaccagtaatatataattctcagactgttgggatgaagcgaactttggtgtttcatcttggcaagccacctcggggtgatagaactgattgggtaatgtatgaatacaggctggaggacaaggaactgtctgcttctggtgttaaactggatgcttgtgttctctgcaaaatctttcaaaaaagtggtccaggtcccaagattggggaacagtatggtgctccattcaatgaagatgattggaatgaagcgaacggggagctatcctcttttgccttttctgtgcccccttgtgcgctggaatcaagtaatggcaggttaaacacagctggtcagcagctggctgttagtgataatattggatcttctttggaccattgttcagaaactaatgacaagatcgctgttggtggctgtgggacgactagtcctagcgttccttttgataccatacatacccagcagctagatgagattatcagttgtttctcgacagatcttttgaactccgttagtcgagatggttcattgcctgactcaactgctgactatgataatgacaatgaagtatcgtccgatgatggtgaagcaatatttaatgaacttgatgaacttgattcccaatcagatgagagcatttccaaccattgtaactcatgtggtgaagacttgattcctcctacgctggaagtacttaaaactgaacagtacttggagctgaatgacttgtccttttctcttgccgatgatcctgatccatgtaacctgctgctgacaactaatctatctgatcagaaccatccagaattagagaccaggtttgagcaggggtctcttgttgacatctgcaataccactaatgctaccatatccaatgctgcctgttcagcgtcaacagttggtgatcatgtgacctgaatcacaggtatggctcctatacctatagcctgaaccagacgggggttcgttcgctcgctgttacttgaggcatgtcatggttcttctgtttcctgtttattgaagtgcattttacagctcaaacaggaaggcgctcagattatgagattgggagttgcagctagtttgcgaagattcagtttgggccaattcaggagaattcgtggttcatggacatttcgcttaccctagtttgcgaagaagattttgtcaccaataagggatcggtacgaataactcgttggcgacgttggatcacttgtccttaaaaagatgttggaagcctgattctggagcggacagccttacattcctggtgatcccctgagcttgtgtggtgcttactgccgtccaaattagtactcctaggcagctagtaggaatttcctctttttttttcctgttttacctgtacgagcggtctgtctgatcatctgatgtatgctaacgtcaatagcgagttacgcagcagcgtagtacaaagctcaactattaggctagattagagagagacggcgatggtgacttttcgcaacgaacctagattgaacatgttgcaaactaaatgttggcacagctaaatattcttaaaaccaacgactaaatgtaatatgcgcaaatctttgaccatacccatacgttgcagatgcaattaattaatgaaaccttacatctgatttttc

SEQ ID NO: 5577 - DNA, 1753 bp, Oryza sativa
  Predicted polypeptide sequence is orthologous to G522, G1453
atccagatgcgcttgcacttgcacttgcatgcagttcattgctctagctataggctatagctactatacactcatgagaatctgagattgggctgaaaattgatgagcatcgatctgaagaagacatatatatagctgatgatgatatagctttttctgcatatgcttgttttgatctgcagccaatcgatcgaggcatagagagtcaccaggcaatcaaattccaaccatccatcagctagatatatatacagcaaagatcacgatactcctagctagctagctagaagaattgatcggtcgatcggaggaaatagcaatggatcggcatgaggaggaggcaggagagtctccatgtgtgccgccggggttcaggtttcacccgacggaggaggagctggtgggctactacctcgccaggaaggtggcctcccagaagatcgatctcgacatcatccaggagctcgatctctacaggatcgagccatgggatctgcaagagcgttgcaagtacggtgggcatggcggcgatgagcagacggagtggtacttcttcagctacaaggaccgcaagtaccccagcgggacgaggaccaaccgcgccacggcggcgggcttctggaaggccaccggccgcgacaagccggtgctctcgtcgccgtcgacgagggtgatcgggatgaggaagacgctggtgttctacaagggtcgcgcccccaacggccggaagaccgactggatcatccacgagtaccgcctccaatcaaacgaacacgcccctactcaggaggaaggttgggtggtttgccgcgcgtttcagaagccgatgcccaaccagcagcagcacaggctgtcctacggctgcatccccggcagctacggcgccggagcctacgccgccgtccccgacaactacagcttgctgctgcaccacgacaaccctagcttcgccgggcggccattgatgagcgccgctgcctcagctctcttcgccaacaacaacaataacagcgtcgtcgaccacagcaacattctgagttcagagtccaagcttcacttctccgacatgatgccgcctctggagagccccaccatcgtcgacggcgagggctacgtctcgcaggctagcagctgcgtcgacgtcgatcagcaagccggcatcgtcgactggaacctgctcaccagcttgctgccgccgccggcgcatcagctcttccaccacctgccttccgcttctagctccaagaacagcaacaacatttcttcgtcaggcttcatcgatgaccgagactgatcgatcgatccagatcgattattatcaattgacaattcattcatcatatatatgcatgaattcttacaaatacgcacaattaaacgatcgagtgtactattaattagttgattactccgtctccatgatgtatacattaatttgaccactggccatcatcaggccatctgcatgcttactatctagcttatgtcagtacacggttgttagttcattcttaattaattagctactagtgtcagtgtgtgtatctatcggttgttcgtcttttgacctcattgctgagagaggtttgtaactgatgatgattaagttagctagcatttaattaggtgctatatatacacatatatatgcactatcactatatacatcatatatatgtatacatatatcgttgtctgcttaatgtgtacaccacctctctgcagtatatatagtattgatcaattaatttgt

SEQ ID NO: 5578 - DNA, 1418 bp, Oryza sativa
  Predicted polypeptide sequence is orthologous to G522, G1453
ctcatgcgatcgatatagctgctccatccgtttgaaggctggctgctgctggccgagggaggcgctgcatgctgctgcaagctacgaagcagtagcaattgcaggcgcgcgcgcacaagttcatattaacttgctaccagttcgggagctatactttgatccgcggaagaagatggacgcattctcccatgtcccgccaggttttcgtttccaccctactgacgaggaactcgtggattactaccttaggaagaaggtagcactgaagaagatagacttggacgtcataaaagatattgatctgtacaaaattgagccttgggacctacaagaacaatgcaagattggaaacgaggagcagaacgagtggtacttcttcagccacaaggacaagaagtacccgacgggcacacgcaccaacagggcgaccactgccggcttttggaaggccaccgggagggacaagccgatctatgtcaagaactgccttgttgggatgaggaagacgttggttttctacaggggccgggctcccaacggacagaagtcggactggatcatgcacgagtatcgcttggagaccaacgaatacggagctccccaagtaagtttgtgtactagtgcatgcatgctaccgaggattcagacttcagacacctaacatgctccatgttcaggaggaaggatgggtggtctgcagggtgttcaagaagcgagtcgcggcggtgcaaagggcggccggcgacggcggcgactcacctttctggttcaacgagcacgtcgcgttcatggcgccggcgccaggcctcgactcgccgtaccatggccaccgccagagccacccttgcaagctggaggtagagtatcaccaccacctccttcctcaggaggcggcgccgttcatgcacctcccaaggctggagagccccaagctaccggccgccgacatcattgtcgccaccgcagcgtcgtccgctctccagccgtgcggccacacgacggcgcagcagctgcagctgcagatcgagccggtctacgtgacggccgatgcgtcggcagcagattggagggatcttgacaagctggtggcgtctcagttcggccacggcgactcgactgcgaaggagcccagttactgcaatccggtgcaggtgtttcaggtcgaggggaagcaggaggatagcttggattacgtgtccacgtctgcctcctgcggaggggaggaggatttgtggaaatagccgcgtgaatgatgcaaaacacatactaacatatacgccattgtatacagcctaataacattgcggtgtgatttgatacagtgtataaatagctagcattgtcatggtaattaccaactgcccatctatatatactaataaagtataaccgaagtggttatacatgcatgcatgatt

SEQ ID NO: 5579 - DNA, 1346 bp, Oryza sativa
  Predicted polypeptide sequence is orthologous to G522, G1453
aatttgcttctcatctttcttctctactcctctcaaatacaagagctcacactgctccctagcttccttcttcatcccttgaactagttgtcagctactgaccagcctgaagatagatgctagtttgtgtagagaattcgatcttctgaggcgtatggtgatcatggagtcatgtgtgcctcctgggtttaggttccaccccaccgacgaggagctcgtcggctactacctccggaagaaggtggcctcgcagaagatcgacctcgacgtcatccgcgacgtcgacctctaccgcatcgagccatgggatctccaagagcattgcaggatagggtacgaggagcagagcgagtggtacttcttcagctacaaggacaggaagtacccgacggggacgaggacgaacagggcgacgatgacggggttctggaaggcgacggggagggacaaggcggtgcgtgagaggagcaggctcatcgggatgaggaagacgctcgtcttctacaagggcagggcacccaacggccacaagaccgactggattgtccacgagtaccgcctcgagtccgacgagaacgccccgcctcaggaagaaggctgggtggtgtgccgcgcgttcaagaagcgaaccatgcagccgccgcggagctccatcggagcatgggaggcgagctactcctaccacgaccccgccgtcttcgtcggcggcggggaacacttcaagcaagaggccgcggccgagctggacggcgtcgccgccgccgccggagctaacgccttcctgcggtactccacccgcctggccgagctcccgcagctggagagcccgccgctgccaagccaggggagccaggcggcctcggccgtcgtcgacggcgaggaagataacgccgattctagcaggcgccctggcggcggcggcggcgccgccgccgcggtgaccacggactggagggcgttcgacaagttcgtcgcgtcccagctcagccccgaggagcagcacacctgccgggccaccgacgacgacgacatggcagcgctgctgctcctcgacggcggcgggcaggaggacgacgccgggaggtggctgggctccgccgggttgctgagcgccgtggcggccgacgcgacgacggactgcggcctcggcaccagctgcgtgcctggcgacatcaactgattcagggccaagccgatcgagctctcacttctccttagcataaagtgtgagatatctacgaattgtatggatggctatatatacgtacgcctatacatatgtagctggtcaaagcatcgtttcagtttcagtttcagttcttggaagtcaatggatgttgaccatt

SEQ ID NO: 5580 - DNA, 2350 bp, Oryza sativa
  Predicted polypeptide sequence is orthologous to G522, G1453
gctagcttcgccatccacattcttcttgcttcttgctcctctctctctctctctctctctctctctctctagcttcctgctgcatcttcctcagccatctctttcatcctcccagtcgtcccaggctgcttaattacatatatctagatatatatattattcttgttaatttcgatccatcagtgtgcaatatatatatatagttttacctctaatatttagcttcttaatttctcctcatttttctgcctgtgctactgcatacatgcgttaattcatggtcgccatggatcgcatggagatccgtttctttactactccacttgttttctctagctactagttttctcttcttcttttcatcaaacaatcaatcaatcatatcccgttctatcttcacacatcaaccccgttccctgttctccgttctctctcagctgcagctagctacctctcctcctctcttccgatctctcatcaggatcggatcgaggagggaggagggagaccaacgatcgatcgagccatccaggatttactagtcaatcaacaactttatatatcatgcagctgatgcatccacacatctagataacgagctagatagctagctagggatcgagaaggagagagaatatatacatactgcatatatatatgcacattgatcgagcaactaatccagacagggatcgacaagagaacaaaagttcattcatgtctcctagctagctactcttatctgctacctatcgagattcatctttggatttctacaaggattttgatcacatcatacactgattttaacccaaccaaccacgactgatcaaaccaaggcaagcagaggcaggctctcaaatatatagatagatagcgatcgatcgatcgaaatggatggatctagtatgagcagcagcagcacgcagcagcaggcgcaggttcctcctggatttcgtttccacccgacggacgaagagctggtggattactacttcggaagaaggtggccgcaagaaggattgatctcaatgtcatcaaggacgtcgatctctacaagattgagccatgggatctgcaagagcgttgccggatcaatggcgggtcggcggcggaggagcagaacgaatggtacttcttcagccacaaggacaagaagtacccgacggggacgaggaccaaccgtgcgacggcggccgggttctggaaggcgacggggcgagacaagcccatctacgccaccaagcagcacagcctcctcgtgggcatgaggaagacgctcgtctactaccgcggccgcgcccccaacggccacaagtccgactggatcatgcacgagtaccgcctcgagaccaccgagacggccccgccgcaggaagaagggtgggtggtatgccgggtgttcaagaagagattacccacaacaagaagagattcagaccatgacgcaccttgcggcagctggtacgttgatgaagatgcaccgggcgccttcatgtctccgatgatgatcaccagatcatcaatattgcgcccacaccaacaccacgccggcatcacgctgcaagagcaacacctccacaccacttacaagcacagagacctcactactaagattcagcagctccaagtccctgcggcaggccatcatctcctcaacaccatgccccatgacctggagagttctacttcctccttccattctcttttggtctcacctgatcaccaccaaatcaacatgcaccatgctcaggctgatcccttctttgacgacatgcatgcagtcgatcaagccactaccactgactggagagttcttgacaagtttgttgcctctcagcttagcaatgatgctacaaacaagcctgcggatcattatactgatgaaggagacattcttcaggtcagtgacaagcagtaagaggtggcagccgccgattatgcgtccacatcaacgtcaagcagccaaattgatccatggaagtgatcgatccatgcatgatcgatgccctgcacgcatttaatcaagatatattatatcttatagataaaattatctcaataatgattatgatcgtatcgtatcaattggacagatcgatacaagtggtttgagctacatattaatgccgtgtaaataagactactctagctagtacaacgtgtggtgtttgtgtgctgcttatatatatattgaccttcgtacgtgtgtttctatatgaaataaggtcatggaggacaaattaaaagcttcatgaatataatcgtggtttgtaatagataaacctcttctgctatgtgattgtaaacttctggtgtttcaacatatgtaacaagtacgccaatatgc

SEQ ID NO: 5581 - DNA, 1101 bp, Oryza sativa
  Predicted polypeptide sequence is orthologous to G522, G1453
atggaatcatgcgtccctcctgggttcaggttccaccccaccgacgaggagctcgtcggctactacctccgcaagaaggtcgcctcccagaagatcgacctcgacgtcatccgcgacatcgatctctaccgcatcgaaccctgggatctccaagaacattgtgggatcgggtacgatgagcaaagcgagtggtacttcttcagctacaaggacaggaagtacccgacggggacgaggacgaacagggcgacaatggcggggttctggaaggcgacggggagggacaaggcggtgcacgacaagagcaggctcatcggcatgaggaagacactcgtcttctataagggcagggcgcctaatggccagaagaccgactggatcatgcacgagtaccgcctcgagaccgacgagaacgcgccgccacaggaagaaggatgggtggtgtgccgagcattcaagaagaggacggcgtatccggcgaggagcatggtggagacgtgggactactccttgcacgagcgcaacatcatgagcgccgcggcggcggcggcgttcgccgatccgagcgcggcgtacgcgcagatgaggcggcagcacaggagcgggcggttcaagcaggaggcggagctggacggcgccgccacagccctcctccactactccagccacctcgccgagctgccgcagctcgagagcccctccgcggctgcggcgccgctccagcccaacccgagccagctggccaccgccggcgaggacgacgactgcaagggcgataatggcggtaggagggccaagaaagcccgcgccgccggcgacaaggtggcgacgaccacggactggagagcgctcgacaagttcgtcgcgtcgcagcttagccccggggagtgtggcagcatggaggcaacggcggaagccgcggcggcggcagtcgccggtgtgagctcgccgctggaccacggcgatgacgacatggcagcattgctgtttctcaacagcgacgagagagacgaggtcgacaggtggacggggttgctcggctccggcgccggcgcgagcggcgtcgacggcgacctcggaatctgtgtgtttgacaaatga

SEQ ID NO: 5582 - DNA, 495 bp, Oryza sativa
  Predicted polypeptide sequence is orthologous to G522, G1453
atggagtcatgtgtgcctcctgggtttaggttccaccccaccgacgaggagctcgtcggctactacctccggaagaaggtggcctcgcagaagatcgacctcgacgtcatccgcgacgtcgacctctaccgcatcgagccatgggatctccaagagcattgcaggatagggtacgaggagcagagcgagtggtacttcttcagctacaaggacaggaagtacccgacggggacgaggacgaacagggcgacgatgacggggttctggaaggcgacggggagggacaaggcggtgcgtgagaggagcaggctcatcgggatgaggaagacgctcgtcttctacaagggcagggcacccaacggccacaagaccgactggatcgtccacgagtaccgcctcgagtccgacgagaacgccccgcctcaggcaagatctccatttatctctctctcaatcaacaagatcgatctacagtttctagaaaagattaattag

SEQ ID NO: 5583 - DNA, 1308 bp, Oryza sativa
  Predicted polypeptide sequence is orthologous to G525
ccttaaccacttcatcacttctctcgtcgatctagtctaaaaggtttagtagatgcgattagccaggcagcagcagcaggtggtggtggctgcgacgatggagcatgacgtgcaccaccaccggcagatgatgcagcagcagcagcagcaggagatggacctgccgccgggcttccggttccaccccaccgacgaggagctcatcacgcactacctcctccgcaaggccgccgaccccgccgggttcgccgcgcgcgccgtcggagaggccgacctcaacaagtgcgagccatgggacctgccatcgagggcgacgatgggggagaaggagtggtacttcttctgcgtgaaggaccggaagtacccgacggggctgaggacgaacagggcgacggagtccgggtactggaaggcgacggggaaggaccgggagatcttcagggggaaggccctcgtcggcatgaagaagacgctcgtcttctacaccgggagggccccccgcggcggcaagaccggatgggtcatgcacgggtaccgcatccacggcaagcacgccgccgccaattccaaggatcaggagtgggtgctgtgcagggtgttcaagaagagcctcgagctggcgccggcggcggcggcggcggtcggcaggagaggcgcgggcgcggggacggacgttgggccgtcgtcgatgcccatggcggacgacgtcgtcggcctcgccccgtgcgcgctcccgccagcgcacgtgacctgcttctccaacgcgctggagggccagttcctggacacaccgtacctcctccccgccgccgatcccgcggatcacctcgccatgtcctccgcctcgccgttcttggaggccctgcagatgcagtacgtccaggacgccgccgccgccggaggagcgggcatggtgcacgagctgctcatgggcggcggctggtattgcaacaagggcgagagggagaggctgagcggcgcctcgcaggacaccggcctcacgtcgtcggaggtgaaccccggcgagatctcgtcgtcgtcgcggcagcaacgcatggatcatcacgacgcgtccctctgggcctattgaaatattcattcatcatcattgaaaattgcattagccattattattagtactgttggccaccgattattgattgtgttgtaatattggtattgttgattataattaattagtacgccaaagagacaaatcacaagagaacgaagtgtgtatgctgtagattaattccgtatgtttgtgaaaatattcttgaacccaagtgaatgttactagtgcttttc

SEQ ID NO: 5584 - DNA, 1548 bp, Oryza sativa
  Predicted polypeptide sequence is orthologous to G525
gatatacaacgatttcctcttgtcaccctgaatctacttctgctgcaaaagcaataagcaaggagcagttagccaggtaaagctctagctagctagcttaggcagcaatggagcagcatcagggccaggcaggcatggacttgccccctggcttccgcttccacccgaccgacgaggagctgatcacgcactacctcgccaagaaggtcgccgacgcccgcttcgccgccctcgccgtcgccgaggccgacctcaacaagtgcgagccctgggacctgccatctctggcgaagatgggggagaaggagtggtacttcttctgcctcaaggacaggaagtacccgacggggctgaggacgaacagggcgacggagtccgggtactggaaggccacggggaaggacaaggacatcttcagacggaaggccctcgtcggcatgaagaagacgctcgttttctacacggggcgcgctcccaagggggagaagtctggctgggtcatgcacgagtaccgcctccacggcaagctccacgccgccgccctcggcttcctccacggcaagcccgcgtcgtccaaggtacacgaacgcacgtacgccgcgtgcgtgtgtttggttgtgaccagtttgatcgatcgatcgatcgatcgattgagcaggccggactgacacgccgtgggtttttcttgttggtgcgtagaacgagtgggtgttgtgcagggtgttcaagaagagcctcgtggaggtgggcgcggcgggagggaagaaggcggccgtggtgacgatggagatggcgaggggagggtcgacgtcgtcgtccgtggcggacgagatcgccatgtcgtccgtcgtcctccctccgctgatggacatgtccggagccggcgccggcgccgtcgacccggcgacgacggcgcacgtgacctgcttctccaacgcgctggagggccagttctttaacccgacggcagtacacgggcacggcggcggcgactcctcgccgttcatggcgagcttcacgcagtacgggcagctgcaccacggcgtgagcctggtgcaactcctggagagctgcaacggctacggcggcctcgtcgacatggcagcgtccggcagccagctgcagccggcggcgtgcggcggcgagcgggagaggcttagcgcgtcgcaggacaccggcctcacctccgacgtgaacccggagatctcgtcatcctccggccaaaaattcgaccacgaggccgcgctatggggctactaaggtttgatatgatcagcgccgtgtacgttaatcgcgggcgattagcgaagtagcgattactgtaaataaaaccatgagatcgcgatcgaggcatctaccaaggttcgcttaatttgcttgtacctataggtgtagattatttggtgatttgggagatgtaattagcattgtttgtttgtaattcgtatcagaatgatcgatgcagtattgtttggagggttagttaagcaattggccactcctcagttgccagttaattagttagagttgcttaatttagctctttct

SEQ ID NO: 5585 - DNA, 1229 bp, Oryza sativa
  Predicted polypeptide sequence is orthologous to G525
ctggtagagtggtaattgctcgcgcgcattctgcatgcatgagcgcgcgcggcggtgtcacgatggcaggaggcggaggcggcgaccgcgcgccgtcgtcgtcgtcgacggcgatgatctcgcgactcctgccgccgggcttccggttccggccgaccgacggggagctcgtcgcccactacctcgcccggaaggcggccgacgccggcttcacctccgccgccatccgcgacgccgacctgtaccgcgccgagccctgggacctcctgccgccgccgcgttgtgatgcggcggaggaggaggaggaggaggaggaggagcggtgcggctacttcttctgcacggcggcggcggcggcggcggccgccccgtgggggtgaagaagacgctcgtgttctacagggggagggcgccgaggggcgagaagacgacagttgtcgcccgcagtgagtgggtgatttgcagggtgttcgtcaggaagacaccagatggtaacaacgataggggaactacagaacatcatcttccctcctacgacgctcatctccgttcgtcgccggcgccggcgaactctgtggacggcgcaggccatgcgagctgcagcttcttctccggtgctaatgagtccatggcgccaagcgaccatttcaacataggagacgacatgatcctccatggccacgacgaggaggagttgctgatgatgaactgttcttcggcttttgatctgccagagcttctcgactacgagagcttctcgctggacctttgatccaacgagcaatggcatgttctaaaatctaaagtatgatctggttacttctcttaatacaaaagatacataagtcttttgcgtattctccaaaaaaatctgaaggatgatgcagctagctagctagctagctagatcgatcaatcgagatatatatgaaggccataatttgatcattagatgcatatgcatcatccatgtctacttcttcagatcactagctacttaatatgtcccctctctgtaattaaacttgcacgtatctgtatatatatttgtactgtagtcattcatgtaatatacgttttgtgtttgcgtattttatacacgcctctatttcaggcgctcttagcatttcttttactttcttagattataaaaactagtgtgtggttgtgtgtttttgctgtgtacatcttacttatatagagagttaaataaaaactctactatcttt

SEQ ID NO: 5586 - DNA, 1587 bp, Oryza sativa
  Predicted polypeptide sequence is orthologous to G526
ttttattcatcacaacaccatccatccatcttaattcgcttctacattggggcgcttgttaatttacatgcgagcttgttgaggttgaagcgatcgggatcatcgttgagagctgtagtacgtggtgagcatgggagagcagcagcagcaggtggagcggcagcctgacctgcctccgggctttaggtttcacccaacggacgaggagatcatcaccttttaccttgcacccaaggttgtggacagcaggggcttttgcgtggctgccattggagaggtggatctcaacaagtgcgagccatgggacttgccagggaaggcgaagatgaacggggagaaggagtggtatttctactgccagaaggatcggaagtatccgacggggatgaggacgaacagggcgacggaggcgggatactggaaggcgacggggaaggacaaggagatcttccgcaaccaccacatgctcatcggcatgaagaagacgctcgtcttctacaagggcagggctcccaagggcgacaagaccaactgggtcatgcacgagtacaggctcgccgacgcctctccgccacagccgccgccgccgccatcctccgcagagcccccgaggcaggacgactgggccgtgtgcaggatcttccacaagagctccggcatcaagaagccggtgcaggtgcccatgcagatgccgatgcagatgcagatgccggttgctcatcaggtgcccgccgccaactaccagcagcagatggccatggcctccgccagcatcatccaagtccccatgcagatgcagatgccctccatgtctgaccagctgcagatgttggacgacttctccaccggttcactcatggcgccgcctccgcctccgccttcctactccactctacctggcttcccgcttcagatcaacggcggcgcccagcagtttgttgggaacccgtcgatgtactaccagcagcagcagcagcagcagcagcagcagatggacatggccgccggaggcttcgtggtgagcgagccgtcgtcgctggtggtgtcgccgccgccaacatggacgctaccatctggaagtactgatacatacatacatacatacatacatacatagatacatacatgcatgcgccgatgcgcgagtgtgatgacagagggtggtgggttaattagctatactccatttttatgcatatgcatcatggcttttgcattgcctttggcttcttgtgtgatcgatgtgagtgagatttgctgagagattattagttattatagattggctagctatattatcatatactgtatgtactaataatatgtgtgtaccagcaatatgtatgtgtgtgagcgtgcagccgtgcaccgtatagcaaggtatagttacaggtatatacatacaagatatatataggtatacatgcatgcgtgatagataaatgtgtgtactgcatgtatttgtgcgtgagcccagcttgattgtgttgtacatagctagcagtgcatgccttctatccctccgtacggattgaattatgtgaattaattattttgtttaattataacatgcatggtgtatggtgt

SEQ ID NO: 5587 - DNA, 1644 bp, Oryza sativa
  Predicted polypeptide sequence is orthologous to G526
gcttcctaaacccatctcgatccctacctagctaagctatttcattcacacctcgatcaatctcgatcgtctctctcgtctactactagtactagcttcttctcctccatttctgacctgagctagctcagaacagagagctgagaatcatcagctagctagctaggcgtctggggagagagcaggagccatgtcggagtcggaggtgtcggtgatcaaccagctggaggaggaggagactcggctggagctgccgccggggttccggttccaccccaccgacgaggaggtggtgacccactacctcacccgcaaggcccaggaccggagcttctcctgcgtcgtcatcgccgacgtgaacctcaacaactgcgagccatgggacctcccaagcaaggcgaagatgggggagaaggagtggttcttcttctgccacaaggaccgcaagtacccgacggggatgaggacgaaccgggcgacggccagcgggtactggaaggccaccgggaaggacaaggagatcttccgcggccgcggcctcctcgtcggcatgaagaagacgctcgtcttctacatgggccgcgccccccgcggcgagaagaccccctgggtcatgcacgaataccgcctcgacggcaagcttccccccaacctcccccgctccgcaaaggaggaatgggcggtttgccgggtgttcaacaaagacttggcggcaaagattgcccaaatgccgccgcctcccttcccgcgcaacgactccttcgacctcgacctcgacgacttcctccacctcgacgccgacctgccgccgctcatcgacgaccccttcgcctccacctccacgctcaagacggagccacctccgccggccaacctgatgcacaaccactacggctacttctccctcccggcgtcagcgaccaattataaccacagctccggcgccatggcggaccaggcgattcggaggttctgcaaggcggaggcgtcgacggcgtgcttctccggcgccgacgctgacgtggatccggtggtggacgagctgctctccttcccggactccatcacggactactcctacatatggaaggcctgaccagattaatttcgtggttaatttgccatatgatcgatcagattaatcctgtttaattagttggtttattaacttgattactgtcaaaggtttgggttaactaggagatgatgatgatggagtttgtggtgatgcgagagagagagagattaggtcgcgctgatctggtctgatcaaggtgtgcagagcagatggagcggactaattcattaattagcttaatcaaattagttatataggtttgtttgtcttaattctgtatgtatatagttatctgattggggataatacatagagattactagctagctagctagtttggtgattaggggggtgatgagctagctagagagagatatctcatcaaaattaaggtctcggttggttgattaatctgcagattatatattgccttgtgtgtgataggccatgtggcctctttctgtgtatgtgtgtgtgtggatggaaggagtaaattaactaaaccccttgtacatgtaccatcagttgtgctttacttacatgatcaattcaaccattgatcgatt

SEQ ID NO: 5588 - DNA, 1570 bp, Oryza sativa
  Predicted polypeptide sequence is orthologous to G526
gcattatacctttatccccttcatttctgttccatttctcatccatcgcgcgtcgtctccacctttgttgcttgtgccaccaagctatctcctcctctcctctctactagtgcttctgcttgctcgatcagcagtgagcttcaagctagctagcaagcatggtggagactagtacatcccttgtgaaattagagcaagatggcagcttgttcttgcctccaggcttcagattccatcccacagatgcggaggtaatcttgagctacctcctgcagaaattcctcaaccctagcttcacctccttgccaatcggcgaggtcgacctcaacaagtgcgagccatgggatctcccaagcaaggcgaagatgggggagaaagaatggtacttcttcagccacaaggacatgaaatacccgacggggatgcgaaccaaccgagccaccaaggagggatactggaaggccaccggcaaggacagggagatcttcaacctgcagcctaccagctatggaggcagcagcaacaacaagaataataagcagctggttgggatgaagaagacgcttgtgttctacatggggagagctcccaagggcaccaagaccaactgggtgatgcacgagttccgtctccacgccaacctccacaacgacaacccgaaccttcgtctcaacctcaaggatgagtgggttgtgtgcaaggtattccacaagaagggagacgatcgcgaagccatcaacaagcagcaggcacaggctgcagctgttgatcagtactctgccggaacacccaacaacggcagctccgtcgaagccggcgacgacgacgacgacttgttccagctcgactccatcatcgaccccagcatctacttcagcaactcatcagctgccaacatcttgtcggcgccgcccaacatgtccaattccgtcgtcgctgccaactacggtgcaagtacgacgacgactggtactgctagtgctggtagcttccagcagcagccaaactactgcagcttgatcaacaaaagcatcagcagcagcaatgtctcctcttggaataatatgcctccacctcctcctgtagctgaaggaggagtccatggaattggaagcagctacagcttgcagcaccaggcagcaatggtgaaagccctacgagatgtcattcgtctcccaaatcctcttggcatgccgcagtacaagttagatgatgcttatctatgggactcatcgtaatagctagtgctgctgctgctgctgcttaattacgtgctgagaatttttggtgctcgatcggctagctacggcactactgaattgagcatgtgcctggatactttgcatggtcgtttggtcatcgaattattaggaatatactatatagctatacattcgtgcaattttgttgattgctttgttgtttagttttggtcttctgtacaaagatcatgacattttgcttcgtgagtttcttgctggtaatgctgattgatagatgttctcttgcggcacatatttttggaacttgctatataatactctagcctttaatttggtggcatttgtgg

SEQ ID NO: 5589 - DNA, 1796 bp, Oryza sativa
  Predicted polypeptide sequence is orthologous to G526
gaaccccaagtccattctctcgttcccaaaccctgcatccttctctttcacacaagcctctctctcgccggcttcggcgtccgtctcctcctcctcctcttcgtctagccttgtggcggcgtgcggtgcggtgcggtgaggaaaggagggagctttgaaggtcgggggagggcggaggagatgtctgaggtgtccgttatggccgaggtggaggagacggcggcggcggcgccgctggacctgccgccggggttcaggttccaccccaccgacgaggagatcgtctcgcactacctcacccccaaggccctcaaccaccgcttctcctccggcgtcatcggcgacgtcgacctcaacaagtgcgagccatggcacctcccagccatggcgaagatgggggagaaggagtggtacttcttctgccacaaggaccgcaagtacccgaccgggacgaggacgaaccgggcgacggagagcggctactggaaggccaccggcaaggacaaggagatcttccgcgggaggggcatcctcgtcggcatgaagaagacgctcgtcttctacctcggccgcgcgccccgtggcgagaagaccggctgggtgatgcacgagttccgcctcgagggcaagctccccagccagctcccgcgctccgccaaggaccagtgggcggtgtgcaaggtgttcaacaaggagttggcgctggcggcgaagaacgggccaatggcggtgaccgaagcgaccgccgacgacgcggggatcgagcgggtcggctcgttcagcttcctcagcgacttcatcgaccccgccgagctgccgccgctgatggacccttccttcgtcgccgacatcgacggggtggacgacgccaaggtgtccgcgtcgacctccgggcaggccgcgatcgccgccggcttccatgtcgcgtcgcaggtcatgagctaccagcaggtcaagatggaagagccgttgccgctgccgtacctgcaccagcagccgccgcggatgctgcactcgggtcagtacttctcgctcccggcggtgcaccccggcgacctgacgccgtcggcgatccggaggtactgcaaggcggagcaggtctcggggcagacgtcggcgctcagcgcctcgcgcgacaccgggctcagcaccgaccccaacgccgccggctgcgcggagatctcgtcggcgccgacgtcccagccgttcccggagttcgacgacgggattctgggcctcgacgacttctggaactaatccactcctgaatgatccggagctagctccctaccgaccttgcgctacaggattttgcttcaggctggttgattaattacttgatttgattaattaacttggtgtttcatgcttgggttaattagtggcagtttgttgatgcatccttctcttcctccttccgatcgaaggcttcttctcgggatgggttcggatgatcagattatttatcatccatccagacctccagggattagctaggactccttgttaattaatcctagctagctaggtttcttcatgtcttgatctgatgtaaatacaattactactactaagtacggggtatcctgattgtgtctagtagcatgatgattgattatactacaatcaatggggtgtagattaggggtggattgatcatttacgaattgattaatttggcatttgatgagccagctagctgctagctttataaagctttatactatgtacatgtaccattaattgcttgagctagacatctcatcatatgtgaattgatgcttcggtttagcctt

SEQ ID NO: 5590 - DNA, 963 bp, Oryza sativa
  Predicted polypeptide sequence is orthologous to G526
atgggagagcagcaacagcaggtggagcggcagccggacctgcctccgggctttaggtttcacccaacggacgaggagattatcaccttttaccttgcacccaaggttgtggacagcaggggcttttgcgttgctgccattggagaggtggatctcaacaagtgcgagccatgggatttgccagggaaggcgaagatgaatggggagaaggagtggtatttctactgccagaaggatcggaagtacccgacggggatgaggacgaacagggcgacggaggctggatactggaaggcgacggggaaggacaaggagatcttccgcgaccaccacatgctcatcggcatgaagaagacgctcgtcttctacaagggcagggctcccaagggcgacaagaccaactgggtcatgcacgagtacaggctcgccgacgcctctccgccgccgccgccatcctccgcagagcccccgaggcaggacgactgggccgtctgcaggatcttccacaagagctccggcatcaagaagccggtgccggttgctcctcatcaggtgcccgccgccgccaactaccagcagcagcagcagatggccatggcctccgccggcatcatccaagtccccatgcagatgcagatgccatccatgtctgaccagctgcagatgttggacgacttctccaccaccgcttcactctcactcatggcgccgccttcctactccactctgcctgcaggcttcccgcttcagatcaacagcggcgcccatccccagcagtttgttgggaacccgtccatgtactaccaccagcagcagcagatggacatggccggcggagggttcgtggtgagcgagccgtcgtcgctggtggtgtcgccgcaggatgctgccgaccagaacaacaacgccgccgacatctcgtcgatggcatgcaacatggacgctgccatctggaagtactga

SEQ ID NO: 5591 - DNA, 1644 bp, Oryza sativa
  Predicted polypeptide sequence is orthologous to G526
tcttcctaaacccatctcgatccctacctagctaagctatttcattcacacctcgatcaatctcgatcgtctctctcgtctactactagtactagcttcttctcctccatttctgacctgagctagctcagaacagagagctgagaatcatcagctagctagctaggcgtctggggagagagcaggagccatgtcggagtcggaggtgtcggtgatcaaccagctggaggaggaggagactcggctggagctgccgccggggttccggttccaccccaccgacgaggaggtggtgacccactacctcacccgcaaggcccaggaccggagcttctcctgcgtcgtcatcgccgacgtgaacctcaacaactgcgagccatgggacctcccaagcaaggcgaagatgggggagaaggagtggttcttcttctgccacaaggaccgcaagtacccgacggggatgaggacgaaccgggcgacggccagcgggtactggaaggccaccgggaaggacaaggagatcttccgcggccgcggcctcctcgtcggcatgaagaagacgctcgtcttctacatgggccgcgccccccgcggcgagaagaccccctgggtcatgcacgaataccgcctcgacggcaagcttccccccaacctcccccgctccgcaaaggaggaatgggcggtttgccgggtgttcaacaaagacttggcggcaaagattgcccaaatgccgccgcctcccttcccgcgcaacgactccttcgacctcgacctcgacgacttcctccacctcgacgccgacctgccgccgctcatcgacgaccccttcgcctccacctccacgctcaagacggagccacctccgccggccaacctgatgcacaaccactacggctacttctccctcccggcgtcagcgaccaattataaccacagctccggcgccatggcggaccaggcgattcggaggttctgcaaggcggaggcgtcgacggcgtgcttctccggcgccgacgctgacgtggatccggtggtggacgagctgctctccttcccggactccatcacggactactcctacatatggaaggcctgaccagattaatttcgtggttaatttgccatatgatcgatcagattaatcctgtttaattagttggtttattaacttgattactgtcaaaggtttgggttaactaggagatgatgatgatggagtttgtggtgatgcgagagagagagagattaggtcgcgctgatctggtctgatcaaggtgtgcagagcagatggagcggactaattcattaattagcttaatcaaattagttatataggtttgtttgtcttaattctgtatgtatatagttatctgattggggataatacatagagattactagctagctagctagtttggtgattaggggggtgatgagctagctagagagagatatctcatcaaaattaaggtctcggttggttgattaatctgcagattatatattgccttgtgtgtgataggccatgtggcctctttctgtgtatgtgtgtgtgtggatggaaggagtaaattaactaaaccccttgtacatgtaccatcagttgtgctttacttacatgatcaattcaaccattgatcgatt

SEQ ID NO: 5592 - DNA, 1435 bp, Oryza sativa
  Predicted polypeptide sequence is orthologous to G526
ggcacgagccttctcctctagctagagctagtgcttcctccatcttcagtctagcttcaattcaagctagggagcaagctagctagctagcatggtggagtctactacatcccttgtgaaattagagcaagatggaggcttgttcttgcctccaggcttcaggtttcacccgacggacgctgaggtaatcttaagctacctcctgcagaagttgctcaaccctagcttcacctccttgcccatcggcgaggtcgacctcaacaagtgcgagccatgggatcttccaagcaaggcgaagatgggggaaaaagaatggtacttcttcagccacaaggacattaaatacccaactggcatgcgaaccaaccgggccaccaaggagggctactggaaggccaccggcaaggacagggagatcttcaggcagcctgcagctgttaatacaagcagctatggaggcagcagcaacaagaagaagcagctggttgggatgaagaagacgctggtgttctacatggggagggctcccaagggcaccaagaccaactgggtgatgcacgagttccgtctccacgccaacctccacaaccaccacccaaaccttcgtctgaatcccaaggacgaatgggttgtgtgcaaggtcttccacaagaagcagggagacgaagccatcaacaaccagcagcagcaaccacagtatgcagccgtggatcagtactctgccgaaacccccaacagcggcagctccgtcgttcaagccggcgacatcgacggcggcgatgacttctttcagctagacgacatcattgaccccagcatctacttcgtcagcaactcttccaacatcttgtcggcgccgcccaacaacaacaacgcggtttattccgtttctgcaagtacgacgacgactaatactactgccgttagcttccagcagcagccaaactactacagcttgatcaacaaaagcagcagcagcagcagcagcaactatagtgctcctctgcagcagcacgtctcttcttggaatattacgcctggagctggaggagcccatggaattggaagcagctactacaacttgcagcagcagcaggcagcaatggtgaaagccctagaaaatgtcattgctgtcccgaattttggtactctactgccgagcagcaacaagctgaagggtttatcgaagtcggcgatggctgggcttacgcagcagaatccccttggcgtgccgcagtacaagatagagaattatggggatcattacatatcacgacagtaatgatcacatatacatatatattgcatgctgctgcgttctgagaatttttgtgctcggctactgcattactgaattacgtactgaacatggacatcatcgagatttaggaatatatgtgtgtgcaatttattttaaaaaaaaaaaaaaaaaaaa

SEQ ID NO: 5593 - DNA, 699 bp, Oryza sativa
  misc_feature (661)..(661): n is a, c, g, or t
  misc_feature (699)..(699): n is a, c, g, or t
  Predicted polypeptide sequence is orthologous to G536
tttttttttttttttttttttttttgaatagcaataattgataatacttcattgcaaactgcccttagttcatcctctactttctttttgtagccatttattgttacacctggttgctcaccagctgtcaccttctgctcaagtgattcaaggattctccatgatgctctcctggcaccaatagttttcttaaaaccaactgaaaataaaattttttttgaatagcaataattgataatacttcattgcaaactgcccttagttcatcctctactttctttttgtagccatttattgttacacctggttgctcaccagctgtcaccttctgctcaagtgattcaaggattctccatgatgctctcctggaaccaatagttttcttaaaaccaactgaaaataaaattttttttgaatagcaataattgataatacttcattgcaaactgcccttagttcatcccctactttctttttgtagccctttattgttacacctggttgctcaccacctgtcaccttctgctcaagggattcaaggattctccatgatgctctcctggcaccaatagttttcttaaaaccaacctgaaataacaatttttttgaatagcaataattaaaaaacctcattggaactggccttagttcacccccaaanttttttgtggacccctttattgttacaccgggtggctn

SEQ ID NO: 5594 - DNA, 702 bp, Oryza sativa
  Predicted polypeptide sequence is orthologous to G536
ttttttttttttttttttttttttttcgaaccattggaagggctgtcataacttcaaataatccgccaagaggactttgatcaaccctatctgtttccatacggggatgttcatgtgctaccaaaacgaaaacaggggggggaattgtgagcgctggaaaagccatacaccggtccaccatcttcgccaaaagcagggtgaagtatctcataaaaaagactttcaagttcgtgcggagtcgcgtgaacacaccctgcgtgctttgatgaggctagtatacaatcagggataggcaagggaaaaacatcattcatgggaatccgaccgtccgacccgtttgctgccaaagccaaattttagaaacatacatgacacatacaactcctgaagatgctccctgccagctttcttcgtctgtctggggacagataatattggctggagatgaacaatgtcaatcgaggaggatggtgcttaagcagcggcaggaggggtggtagccggtggctgctcctcagccttgggctcaaaagcagcgggtgcctcctcagtagcagcagccttgggggcttcctccttgggcgcatcggcagcggggagcctcggcgtcattaccatccgacgatgtccagagagtgaggttgtcacggaggagctgcatgattagggtgctgccgcgataggactcttcaaacagagagg

SEQ ID NO: 5595 - DNA, 634 bp, Oryza sativa
  Predicted polypeptide sequence is orthologous to G536
gattttgtttattgtattcaatcatgttcgaagattgaaatattatatacatccttttttaggggttacaggttaaattaggtttagattcgaatttcgcaagaccaagaatttactcgtccttgtcgtccttgtcgtcaccaccgtccttgtcgttgtcaccttgtaccgtcgctggtccacaaagtcaagttgtctcggagcaattgcataatgactgtggagtccttggtagagtcttcggtgaggttgtcgagctcagcaatggcgtcgtcaaaagcttgtttagcaagttggcaagccttgtccgggctgttcataatttcgtagtagaaaacagagaagttaagagcaagggccaatcggatggggtgagtagaggccaactccttggtggcgatatcagaagcagataggtaagcacccaaagacttgtcagcggcgtccttgcggaggtctccagccttgaactcagccaatatctgtagtagtcacccttcattttgtagtagaaaaccttagcctcgttggattgagcggcggggatgaggtgcttgtcgaggacgttcaaaacgtcttggctaatgccggaaaggtcggcttcaaccttggttctgtatgagcgaattcttgg

SEQ ID NO: 5596 - DNA, 1152 bp, Oryza sativa
  Predicted polypeptide sequence is orthologous to G536
gtcctcggttcctcccctcttctggtcgcccccacccactcacaggctcaactcaactccacccgaatccgcaagagagagagagagagacgatggcggcggcggcgggaggagggacgagggaggagatggtgtacatggcgaagctggcggagcaggcggagaggtacgaggagatggtggagttcatggagaaggtggtgacggcggcggcggcgggcgggggtggggagctcacggtggaggagaggaacctgctgtccgtggcgtacaagaacgtcatcggcgcgcgcagggcgtcgtggcgcatcgtgtcctccatcgagcagaaggaggaaggccgcggcgccgcgggccacgccgccgccgcgcgctcctaccgcgcccgcgtcgaggccgagctctccaacatctgcgcggggatactccgcctcctcgacgagcgcctcgtccccgccgccgccgccgtcgacgccaaggtcttctacctcaagatggagggcgactaccaccgctacctcgccgagttcaagaccggagccgagcgcaaggacgccgccgacgccaccctcgccgcctaccaggccgcgcaggacatagccatgaaggagctgtcgccgacgcaccccatcagactgggccttgcgctcaacttctccgtgttctactacgagatcctcaactcgcccgaccgcgcgtgcacgctcgccaagcaggccttcgatgaagctatttcggaactggatacccttggggaagaatcctacaaggacagcaccctgatcatgcagcttcttcgcgacaatctcactttgtggacttctgatatgcaggacgatggaggtgatgaaatgagggatgcaaccaagcctgaggatgagcactagctaaagatcctagtgacagtcgtctgtctcttaaccgctgggggtagttatgatgcttgtacaaggaccattttcttgtgtcctttcgtcgggtctttgcttaccctttgtttacttatattgctatcgccatcctcatgtattatttgttactttcctgctggaatcctgctcgtgtgtgggagagtgcctcaagcctttaactaggacaaggattgtcaactcttgtttactatgattgaatggctatgcttgttcgatattt

SEQ ID NO: 5597 - DNA, 2438 bp, Oryza sativa
  Predicted polypeptide sequence is orthologous to G536
gagacaaatccattgctgggaagtgaagaagatgaaggagagggagaaggtggtgcgactggccaagctcgccgagcaggcggagagatacgacgatatggtggaatttatgaagacacttgctaggatggatgtggatatgagtgctgaagagaggcttttattttcagttggttttaagaaaactattggtgccaggagagcatcatggagaatccttgaatcacttgagcagaaggtgacagctggtgaccaaccaggtgtaacaataaatggctacaaaaagaaagtagaggatgaactaagggcagtttgcaatgaagtattatcaattattgctattcattgccttccattggccaattcgggtgaaaatgtcgtgttcttttataagatgtatgtgcaggttcatcaagtcaattatttgcttctcaattgtgttttacttcatatcggtctatttcctaatggttacattcagaatttattcccaaacaaacatcttattattatccaggcatattttgatgatgcaatctttttctttgtagaagaatacacaactttgagctcatgtagtgttttgaatagcattgacataacacatccatatgagtttctgactttctgctaaattctcttcctaagaaatgcttgactgaacaccttggtccaaagaattgcagaaggtgacaaacatgttgactttgctctgctttaaactttgacatcaaccaggttttaccaaatgatgctaaggtttcatagaatcaaagatttaaacataccagccatgactcatgtgtcattcctccagggactaactatgctgaccttttttgctcacagtatccaaaaacttataggtaacctcatgacatatagttttgctcacatggtcctaaagtttcagaataaagactaaattatcataatttaaagggcagtatgatacatatatatactgataaataaagggaaggcttctaaataagcaaggagttgaagagctgatctgtgccagcacattagcttaacttgtttatttatctaattctgcacagaaatgcaagtactttttttttctttagtgcacgaccatttgtagtgttggggtattcttcagaaaaggaaagggaaacaagacctaaagatgagatgaacctcttgattccccaactgttttcttagtcttggtctttaattaaatcatgttacacctggattgttctacattttagcctatacctgagcatagtttcttatgaagctttgctaagttgtttttccataataataccttctggtgaaagtttccataataattaaagtttcaataattatttactaagcttttggattactcaattatcttttccatcattgtttttcaagtattaacaatgaaaaaaaaaactgaatagtgcctcactagttctgaagtttcccctcagtacctcttgtttcagatattttgagattttctgagatgagatgttataagattatactaggatcttatgtgttgccctggtaatctatttaacaatgggcaggttggttttctatcaattaaccgaggatcttccctctatagtatgtgcatgttcgcacgatactcatgtgtatatcttttttctttaatctgctttatacatcactcttaaaaaaattacaggaagggtgactactaccgttacttggctgaatttagcactggaactgaaaagaaggctgctactgatcagtcccttatggcctatcagcacgccatggttgttgcctccagtgagctttctcctgcccatcaattcaggcttggccttgcgctcaacttttcagtcttcttgagataatgaactctcctgagagagctagccaagtggcaaaacaagcacttgatgaggctactgctgagattaactctgctggtgtggagggttacaaggacagcatgcttatgatgcagctcctgaaggagaacctggcattgtggacatcagaactaactggaggtgaaacatctaaggacgatgatgttgttatggagggctaactgtctgaaatgttctaaaggccccagcatgtgagcaaaacaatcagtaacattgtaacaatactgctactgaacttgcgacatttatcatgggagccgtggaaatcacctttatttttccctttcttctgtagtttcttttttttggccctcgcttgggtcttggtgtgactcccaaagtattttcagagtttggatttgataaccatgcaccagctttggttatattttgagatcttggagtggtcaccaacccagctttaatattagtttgagagtactttttttttccaatgcttgttaagcatctttgtataccaacgggatgatgaactatatatctcttaatgatgacgaaataaacgtctcttttgttaagatg

SEQ ID NO: 5598 - DNA, 1876 bp, Oryza sativa
  Predicted polypeptide sequence is orthologous to G536
gtctccccccaaaatttccgacgccagagcgcgaggagacgcacacagaggtattccttcgctcgcgatctctctcctccccctctcgaattttgatctcttcccgtagaattttcgcttcgtgtgtgtgtgtttccgttcgattggatcggtgctggtagtacttgctagcatgatcccccgcgtgatctgtggccgtttggtgggatcgttttccatctgaattctcagctaaaccctgctgttttcgtagcgatttttttttgctaggcgtgctttagtggtaggtttgtctgcacgaatcgggtgggtctctggtggttttgaagtgatctgtgtgcggttgatgtgattttacggagtatggttggatccgtcaaaaacctgagttctgtaggggttctgtggttctggtccatgtttgcttctcagaattttgcttataattttgatttttctcgtcttgatctattgttagattgactctgatgtacagttagctcgggaatactgaagctacgattgcggggcagtaattcaaaattgctctttgaaatgtgctacggtaccaaattcaaaaatcaaacttgagatcattggcttgcccacttgaaacaggaattggatggatttcccaacaatgcatcattttctgttttttgcttctgaatttatgcctttattctgcatcgtggattactctttaaattgtttgtatggatcctccaaagaacggttagttcatcaccgtttttgttctttgatcttgcagacttggcatttgtagagtttttagatttatagatagcaaagatgtcggcacaggcggagctttcccgtgaggagaatgtgtacatggccaagctcgctgagcaagccgagaggtacgaggagatggtcgaattcatggagaaggtggccaagacggttgactctgaggagctcaccgtggaggagcgcaacctcctgtctgttgcatacaagaatgtgattggagcccgccgtgcgtcatggcgcattatctcctccattgagcagaaggaggaaagccgtggtaacgaggaccgtgtcacactcatcaaggactaccgtggcaagatcgagactgagctcaccaagatttgcgacggcattctcaagctgcttgaatcccaccttgtcccctcttccactgcccctgagtccaaggtcttctacctcaaaatgaagggtgactactacaggtaccttgccgaatttaagaccggggctgagaggaaggatgctgctgagaataccatggtggcatacaaggctgctcaggacattgctttggctgagctgcctcctactcatccaattaggcttgggctagctcttaacttctcagtgttctactatgagatcctcaactcgcctgatcgtgcttgcaacctcgcaaagcaggcttttgatgaggccatctcggagctggacaccctgagcgaggagtcctacaaggacagcactttgatcatgcaactcctccgtgataacctgaccctgtggacttcagacatctcggaggacaccgcggaagagatcagggaagctccgaagcgcgactccagcgaggggcagtaaagccggctttatgtgccctagaagcttgtagctagtgctttgctactgtgtaatgacacctatgtggctgtgattgttgtcgggaaatctggggctcccccgtatgtgaggttgctagcgatggttttgcagtctcgcctttaagctactcgtagcagagcaggtgggggtctgtggagccaggcctggttgggggtgggggagcctcttgaactgcttggtggcacttcctgtttttctgtttgcctttttattggtgtttattgttatggtc

SEQ ID NO: 5599 - DNA, 1345 bp, Oryza sativa
  Predicted polypeptide sequence is orthologous to G536
ggcgttcgcatccgccgccgcagccgcagccgccgccgccgacgccgacgaggagaggaggagagggaaggcgagagggaggtaggtaggtaggcagttagccatgtcgccggcggagccgacgagggaggagagcgtgtacaaggcgaagctggcggagcaggcggagcggtacgaggagatggtggagtacatggagcgcgtggcgcgcgcggcggggggcgcctccggcggggaggagctcacggtggaggagcggaacctgctgtccgtggcgtacaagaacgtcatcggcgcccgccgcgcgtcgtggcggatcatctcgtcgatcgagcagaaggaggagggccgcgggaacgacgcccacgccgccaccatccgctcctacaggggcaagatcgaggccgagctcgcccgcatctgcgacggcatcctggccctgctcgactcccacctcgtcccctccgccggcgccgccgagtccaaggtcttctacctcaagatgaagggcgactaccacaggtaccttgcggagtttaagtctggcgacgagaggaagcaggctgcggagagcaccatgaatgcatacaaggctgctcaggacattgctctcgcagatttggctccgacccaccccataaggcttgggcttgcactcaacttttcagtgttctactatgagatcttgaactcccctgaccgtgcctgcaacctcgcgaagcaggcgtttgatgaggccatatcagaactggacagccttggtgaagaatcctacaaggacagcactttgatcatgcagctcctgcgtgacaacttgactctgtggacttcagatgccaatgatgatggtggtgacgaaatcaaggaagccgcagctccaaaagagcctggggatcagtgagatgaattcggacgccagtctgatgcaccatctgttgttgttggggcaatggacattgatgtcttcggctttcagtagctatcttctagtacacgaactgtcgtcgcaccatcgcggaggagacgatgatgttcttaaattacttaagtagttctgggtcacgcttttgttcagttgataaatgatggctggatcctggttttcttgttccacgatgccagccacaggaaaaaccctactattctgcactgttagaatgctgttatattaaccatgtttgacaagacattttcagtatgtttgtatgaccgtcttggaagtgtttggttgaacctgtctcagggtctttggtccaagacattattcacctggcttgcttaactcgttttagagaacaaaaaaatattgtctgtatggtgacatgcttgagttcaccgtaatctc

SEQ ID NO: 5600 - DNA, 2091 bp, Oryza sativa
  Predicted polypeptide sequence is orthologous to G536
ggcatttctaggcgtgctcgatctcacgggaaggcgtgcggcgatgtttttttttttttggcgatttttttggggtggtgggttctggactgtgggatgtggttttgggctagatctggtgtgctcggtggtgatgggtgatttggatgggattggattcgtgagatctgcgatcccgtgcacgcgaggggagtagatccgctcggtttggcgagcttcgtctcgtttagaagtggggatttttgttttttgctttttttggattatcatctctgagttgagcaaacgtctgttggggatttggaaaagttagacagatttatttatttatttatttatttatttatttatttatttatttattgtggaagtatgttgatggtatcggttattagctgcgtttgatccacggattagatctaggtttaatctgttaatagtgtggggatctatatatatgtagcggtgaaaggtgcacgcctgctcggtattggggtgataatttttttatctggattgggaggtaggtggtcttggtttgtggaaaatcagtgtttgtctcgtgggtggattgatgcgacgtttagatctagcctagccatgtttatgatttattgatctgcaatgtttagatatatccctcattataaggctgtaattgagtttctgttagttctttctgtattgaacaatttttagtgattacaaatacaacttagttgagattatgaaatattttgaatttggacatgatattggcttattcatttgttacagcctttaaaaagagttagtattaaatatttgatggaatttgtaggattcagtagtattattcacaattgtttaattattcatttctcaacaaatgaacatccttgatatgaatgggaacatgatctgttttgtacaattataccttctggagagaccccatggctttcagattattaatgttggtgaatgcttatcagtacctttttatctggctacagtaatcccttaattggtcaaaatgtctcgggaggagaatgtctacatggccaagctggccgagcaggctgaaaggtatgaggagatggttgagtacatggagaaggttgcaaagactgtagatgtggaagagctcactgttgaggagcgcaacctcttgtctgttgcttacaagaatgtgattggtgcccgccgtgcctcctggcgtattgtctcatccattgaacagaaggaggagggtcgtggcaatgaggaacatgttactctgatcaaggagtaccgtggcaagattgaagctgagctgagcaagatttgcgatggtatcctgaagttgcttgactcacaccttgtgccctcatctactgctgcagaatctaaggtgttttacctcaagatgaagggtgattaccacaggtaccttgcggaatttaagactggtgccgagagaaaggaagctgctgagagcacaatggtggcttacaaggctgctcaggatattgctctggcggatcttgctcccacccatcccataaggcttggactggcacttaacttctctgtgttctactacgagattctaaactctccagacaaggcttgcaaccttgctaagcaggcgtttgacgaagccatctccgagttggataccctcggggaggagtcttacaaggacagcactttgatcatgcagctcctgagggacaacttgaccctctggacctctgacctcacggaggacggtggtgatgaggtgaaagaagcctccaagggcgacgcctgcgagggcagtaaaatgggaagatcgatcgatcgatggctccgcatgttattggagaccatcgatttagatgcctcatgctgctgtcaccatgatggatggattcttctcctgttctactagaatgtttttcttcctgtccccccttcctctctcttctctggtttttactagggtggtagcggtcgaattagttcttcccattgctttgcatttggtgctagtggtccgtctgggctgattgttttcctctggatatgactctcgtgtgtgttgtctccagatagtgttttattgagcaatatttaaagttgtcgtcc

SEQ ID NO: 5601 - DNA, 2361 bp, Oryza sativa
  Predicted polypeptide sequence is orthologous to G536
gacaggagaagccgcagccactgaggtcctagttctgatccagaagtggcggctacgcctttgctgtagcctcaccgatccgccgccgccgccgccatgaagttccgctctgattcgtcaggcggcgacgagccccgcgctccggctgccggcgacggcggcggcggcggcgacgagccggccaagaggcagcggaccgatccgtcctccagttcgagccagggcgaggcctcctcttcctcgcagccgccaccgcagcagcagcaggaggagcagcctccggaggatgcgggagagggcgagcagccgagggttccggatctcggggaggacctggtgttcgaggtgctgcggcgagcggaggcgcggacgctggcggccgcggcgtgcgtgagcagggggtggcggcagctcgcggaggacgagcggctctgggaggccgcgtgcgtgcgggagtgggcgaacctcggcttctccgagcggcagctccgggccgtggtgctctccctcggtggattccgccggctccacgctgtctacatccgccccctgcagtggcgtggcgccggcgtgcccaggcaacaggggaggcggcagccgccggtgaggttgggccgggaccaggttcagctctcgctgtcactgttctccattgggttctttcagaatatgccttgtcctaagaaagacaagggaaatgacagtgataagaatggagggggccaatgcgggtagtcgaatttgtggaataagcttcactccaacaagcatcatcctaagctaccatggcagttgccctattgttcacactggtgatgctagagagtgttggagagacgaacaggaaaatcggcatgcttgatttgggacatgagagaaattaagtggaattgcaagatctgaattggttcggttgtgttccgcacttgtaagatttatgtgatagtgtcacatggattgatggacgttgagtgctatgaggacagttgcgtgaatgctgatgacaagtgatttacttcaagagaagggagaaatggtttgcaattcgttctgctgttgctgatattctagttatcagctattgtgtcaacttgatatatctggcccaagagcagtatggactgtgtgccttcttgcgccggtaccaagctttagagggaaagctgatgcaaatagcttttgtttgcataacctttttcaattagggaaacataatttcccatattaggcatatggagaattatgtgagatttgaccttctgtttctaccagaaaaacacaacagtgaagatgtcgcagcctgctgagctttcccgtgaggagaatgtgtacatggctaagcttgcagagcaggccgagaggtatgaggagatggttgagttcatggagaaggttgctaagacagttgactctgaggagctcactgttgaggagcgcaaccttctatcagttgcttacaagaatgttattggtgctcgccgtgcgtcatggcgcatcatatcatccattgaacagaaggaagagagccgtggtaatgaggatcgttgcacgctcatcaaggaatacaggggaaagattgaaactgagctctccaagatctgtgatggcatcctcaagcttcttgactcccaccttgtgccttcatccactgctccagagtccaaggtcttctacctcaagatgaaaggcgactactacaggtacctcgcagagtttaagactggagctgagaggaaggatgctgctgagaacaccatggtggcatacaaagccgctcaggatattgccctggcagagttgcccccaactcatcctatcagacttgggctggccctcaacttctcggtgttttattacgagatcctcaactctcctgaccgtgcttgcaatcttgcaaagcaggctttcgatgaggctatctcagagctggacactctgagtgaggaatcctacaaggacagcactttgatcatgcagcttctgcgtgataacctgacgctgtggacttccgatatctcggaggatgctgctgaggaaatcaaggaggcccccaagggcgaatcaggagatggacagtgaacatgatcgaatgcgtgcgcccacaaactagaatagtgacgctgcaaatgtgctgtgggttatcgtttcattttatagattgtaatgtctcgtgatttgtcggaaacaggaggcgctccccatttatgttgtgctaggaaaccttgcagctgactcgctgcttggctggtggattctcgagctgcactttctttggggggagcctcagggtggaaccttcatgtcacttattggatcgattgttttcggtatgtcagttgtgagccttatctccagagtcct

SEQ ID NO: 5602 - DNA, 1508 bp, Oryza sativa
  misc_feature (1471)..(1475): n is a, c, g, or t
  Predicted polypeptide sequence is orthologous to G536
gtcggaatccgggtcgaccacgcgtcgtttcttttctcccaccctctctctctctccggtctccactccctccgctcctccgctcctcgcctcttttacccgctcttccccccgatctccccggactcccacagccgcagcgaacaaatcccgcgcgggttgggaagagcgagctcgtgaggagagcagagggaaagcgcgagggggaaggaggaggaaaggtgcacaaggtcagactaagtttgcgttgaagaacaaaggagaggaaaaatgtcgcctgctgaggcatcgcgtgaggagaatgtgtacatggcaaagcttgccgagcaggctgagcgttacgaggaaatggtcgaattcatggagaaggtggcaaagaccactgatgttggtgagctcaccgttgaggagcggaacctgctttctgtggcttacaagaacgtgattggtgctcggagggcatcgtggaggatcatctcttctattgagcagaaggaggagagccgtgggaatgaggcatatgttgcatcaattaaggagtaccgtagcaggattgaaactgagtttaagtcaggagctgagaggaaggaagcagctgagaacactcttgtggcatacaagtctgcccaggatattgcactcgctgacctgcctacaactcacccgataaggcttggacttgcactgaacttctcagtgttctactatgagatactgaactcaccagaacgtgcttgcaaccttgcaaagcaggcgttcgacgatgctattgctgaactggacactcttggcgaggagtcttacaaggacagcaccttgatcatgcaacttcttcgtgacaatctgactctctggacctctgacaatgcggaggatggtggtgacgagatcaaggaagcagcgaagcctgaaggagagggccactaatctgtcctgaagtctatttctgagtccatttactcagctacctgctgtattactggatcataagatgtactaggatcaattgctatgtggaatcataagattagggctgcgtatgtcaaaatgtgtcgagctgaagtacccagtggacacagtttatgtgcactacattgcttccgtgacttatttactagttaattagcaactttcaaccacttcctgtatttgcagcacattattagtatcgctgtattagcgttttccatgggctggttatgattgagaatacaggccaggcattgcatgtctttatttggaagtcgatggggcacgttgggatttaaaaacaaaaacaaagggggcggccaaggatcagctacgagcggctgcaggatagctcaagtgactaatcatatggcgcgttaacgcgagggaccgcggcccactaacggggcgcaacccccgggggagaaacgcgcgaccacaggcgggaggcgacgccagggggggtgacccacacccctcccccgaccggcagacgcacaannnnncgcacaagcacgcacaagacacacaacacaaag

SEQ ID NO: 5603 - DNA, 409 bp, Oryza sativa
  misc_feature (380)..(380): n is a, c, g, or t
  Predicted polypeptide sequence is orthologous to G536
gagttcggtggccatctttgttcagattcgtctcatagggctgtagtgtttcaaagtgtaattagttgaaaattaatctgaattcatccgaaatgtccgaaagagaagacaatgtttataaagctaaactagctgaacaagctgaacgttacgatgaaatggtggaggccatgaagaaggtagcctcacttgacctggagttgacggtcgaggagaggaacctgcttcttcgcctacaagaatgtgatcggtgccagacgtgctacctggaggataatcagcagcatagagcagaaggaggagaacaaaggcgccgaagaaaaactagaaatgattcgcacctacaggactcaggtcgagaaggagttgcgagatatctngtccgacattcttggagttcttgacaagc

SEQ ID NO: 5604 - DNA, 433 bp, Oryza sativa
  Predicted polypeptide sequence is orthologous to G536
ccctgagcgaggagagctacaaggactctacactgattatgcaactgctccgtgacaatcttactctctggacctcctctgaggccgagacctccgctgctggtcaggccgaggctcccaaggaggacgcacctgcggccgctaccgaggagccagctgccccggccgaggagcctaaggccgagtaaggagtcgactagtgatttgtctatgcaggtgtcaggtggactggtgtctacggagtgtggacggaagacctcgtttttgatcaagagcttcggcatcgtttcagtacagacaatggccatggaaaggactgggtttttcaccaacgggctggctaggcgagtctataacagaacacttttacgttctgctcttagactgttaatgcgttggccgtctggacaataaaaatactaaaattactttc

SEQ ID NO: 5605 - DNA, 428 bp, Oryza sativa
  misc_feature (191)..(191): n is a, c, g, or t
  Predicted polypeptide sequence is orthologous to G536
gaaaaccaaaccacttctttttttccatctctcttggccccattcgccatctgccaactccttcaactgaagctcctctcagccgaattttgtttattcgctttcccttaaacaatccctcaagctactataaatttccacgactcaagtcgccaaacatcaacaaaatgggccacgaagacgccgtctancttgccaagctcgccgagcaggctgagcgatatgaggagatggttgagaacatgaagattgtcgctggtgaggatcgagatctcactgtcgaggagcgaaaccttctctccgttgcctacaagaacgtcattggcgcccgccgtgcctcctggcgcatagtcacctctatcgagcagaaggaagagtcaaagggcaactcttctcaggttacccttatcaaggagtaccgacagaag

SEQ ID NO: 5606 - DNA, 317 bp, Oryza sativa
  misc_feature (29)..(29): n is a, c, g, or t
  misc_feature (42)..(42): n is a, c, g, or t
  misc_feature (48)..(48): n is a, c, g, or t
  Predicted polypeptide sequence is orthologous to G545
ccttaaccaaggtgccaaccaagccaagncattaaggggttncaccancagggaggcccagggagggcttatcccacccctggaggtcttcattaaataaaatggatattcatgataatccaaatcccagtggtggccatcggatctctcttgatttctgtcacggtggtatttccaataagctatgataatcacgatctgcccatcatatattatcttttcttgaggatgtgagcatatgtagagtgatgatatcattgcctaagaaataaatcttgtcatcgggatggatcccttttgtaaaaaaaaaaaaaaaa

SEQ ID NO: 5607 - DNA, 394 bp, Oryza sativa
  Predicted polypeptide sequence is orthologous to G545
ggcgaggaaacagctccgagtgcaagagcatatggaaccatcaggattcattctctaggtcggccgccgcaacttctcaagtcattctctaggtcggccgccacaacttcaagagcacatggaactatcaggattcactctctaggtcggccaccacaacttctcaattcattctctaggtcggccaccacaacttctcaattcgcatgctcaaagtacgattgtaagtaatgcatttctgggatggattaggggggggggggggttgttagattcagacataaatttgaggcattagatgatgtaagtataactggtgagattttttttgtgtttcgtctaagaaaggccactgaatcaaagttttgcaagtttactccctaaaaaaaaaaaa

SEQ ID NO: 5608 - DNA, 892 bp, Oryza sativa
  Predicted polypeptide sequence is orthologous to G546
gtgcaccaccacgagagcggtggctatgcagccatgcgggcgccgtctcctcggcgccggcaccgcctcgccgccgccgctgccgggcttgggttcggcttcggcccactcgatggaccgcgcgcagcgggcgcacatggtgcgggcgctgggggtgaccaccacggtgctcttcgtcgccagcgtctcctacatcgcgctcaccgcgctctacgcctgcttctgcgacggcggcgggcggcgacggcgagaagacggcgggtcgtcgtcggtgcgccccgagccgtccgaggagaccaagcgcgcgctcgacgggatcccggtgcacgtggtccagatgccgccccgcgacggcggcggcggcggcgccgacgaggagggcggcagcggcgactgcgcggtgtgcctggcggagtacgccgccggggacgaggtgcgcgtgctgccggcgtgcgggcatgggttccacagggagtgcgtcgaccggtggctgctcacgcgcgcgcccacctgccccgtctgccgcgcacccgtcgtcgcgcgcgtcgagggcccggacgacgacgccaaggaggattactgcggcgacggcgagagcgtcgagaggcacggcggcggcggcggcgacattggcttcctgtccgtcgccggcgagtcccgcgtgcttcctgcgatttgattttgctacgagtactcatcagctgtaatagggtacttagtaggtgtttagctcaattttgctagctgtggacaaacgtagcttagtaggatgattcgagtttgtttattggcgagagcaataacgatcatacgagtagtttcactttcagggttacaagttcatgtgcgatcaatctggttatttagttattataccttcttaaaatttctg

SEQ ID NO: 5609 - DNA, 722 bp, Oryza sativa
  Predicted polypeptide sequence is orthologous to G546
cacggggaggtagtgacaataaataacaactcaaacacacttgtcaccttctctccccgcatcgcaacgataagcccgtgaacccgaccccgcgcgccacccgtccttcccacccccgagcgagctagagaggaagacgatgcagctcatggcggccaggaagcttctagagcagccgggcaccgccgcgccgccggtgctgggcggctccatcgccgacgacagggacatcgtcatcatcctcgcgtcgctcctctgcgcgctcatctgcgtgctcggcatcggcctcgtcgcgcgctgcgcgtgctcccgccgcggcggcggcggccccgacgcggccgccgccaacaagggcgtcaagaagtccgtgctccgcgcgatccccaccgtcgagtacgcctccgcggtctggaagccgacacactacagcgaggtcccgcccttcttgccgtagaaggcgcagccgcatcgcgcgctccggagattccggggggctagagctagaagaggaacagagaaaccgaccaaaccataagcctgagatggttaaatttctcgtttgcttgctagattttagtgccctagctagctggaaatggatagcatttgggaaaaaattccgagtcagagatcctggtttgcaacttgcaagtggatggctgcagctttttcgctttgtacattttgtaaagtgatgagaataagatctgcaatttagctcc

SEQ ID NO: 5610 - DNA, 1495 bp, Oryza sativa
  Predicted polypeptide sequence is orthologous to G549
ctcgaaacacaagaaacaaccggagaaactgagcccggccgaccgcaaggacagcaagctattagccatcctcgcatggatcccaacgatgccttctcggccgcgcacccgttccggtgggacctcggcccgccggcgccggcgcccgtgccaccaccgccgccaccaccgccgccgccgccgccggctaacgtgcccagggagctggaggagctggtggcagggtacggcgtgcggatgtcgacggtggcgcggatctcggagctcgggttcacggcgagcacgctcctggccatgacggagcgcgagctcgacgacatgatggccgcgctcgccgggctgttccgctgggacctgctcctcggcgagcggttcggcctccgcgccgcgctgcgagccgagcgcggccgcctgatgtcgctcggcggccgccaccatgggcaccagtccgggagcaccgtggacggcgcctcccaggaagtgttgtccgacgagcatgacatggcggggagcggcggcatgggcgacgacgacaacggcaggaggatggtgaccggcaagaagcaggcgaagaagggatccgcggcgaggaagggcaagaaggcgaggaggaagaaggtggacgacctaaggctggacatgcaggaggacgagatggactgctgcgacgaggacggcggcggcgggtcggagtcgacggagtcgtcggccggcggcggcggcggggagcggcagagggagcatcctttcgtggtgacggagcccggcgaggtggcgagggccaagaagaacgggctggactacctgttccatctgtacgagcagtgccgcctcttcctgctgcaggtgcaatccatggctaagctgcatggacacaagtccccaaccaaggtgacgaaccaggtgttccggtacgcgaagaaggtcggggcgagctacatcaacaagcccaagatgcggcactacgtgcactgctacgcgctgcactgcctggacgaggaggcgtcggacgcgctgcggcgcgcctacaaggcccgcggcgagaacgtgggggcgtggaggcaggcctgctacgcgccgctcgtcgacatctccgcgcgccacggattcgacatcgacgccgtcttcgccgcgcacccgcgcctcgccatctggtacgtgcccaccagactccgccagctctgccaccaggcgcggagcagccacgccgccgccgccgccgcgctcccgccgcccttgttctaagctcgccggagactctgctgctgttcccgcgccgccacggcgcgtgggagtttcctgtggtgttgggccgtgttttcgttgtaaggcagttaggtcgttctaagctattcgatgggccgatcgaggatgcgtcgtcgtgtaggaactcgtcgtgtacccatgtttgcgatctggatggcccatttgtttagctgttaccatgttaaattcgtttcctttatttatgaaatggtaaatcctaaatgtcgtg

SEQ ID NO: 5611 - DNA, 2257 bp, Oryza sativa
  Predicted polypeptide sequence is orthologous to G550
gactactatagtgtcattactccgaacacaacgcgagcggccgcctcctcctccgcccagtgacatgccacccgccgccgccgccgccgctggcatcatccccgctcgtcgccgtcgtcgtgctgcgcccgaggaggaggaggaggagccggtgccggtgccggtgccggtggtggcagcgcggacgagatcggggcgccgctatggccgcgcttaggcagggcgacgaccccgccatcaagctcttcggccgcaccatccccctcctcctcgacccccccgccgccgccgccgccgccgccgacgaggtcatgcctaatttaggaaatggtgtaaaaaccaataatgacttacctttagtctcagacaagcttttgattgtcaaaggtattcctttttgtcccaacaatagtaagaaaaatgatttacaaggcatcagcagaccggatggaagaatagaaatcgattccatgactgaggatgttaagactgagcctgatggatctgtccctgagaagatactcaagaagccagataagattctgccatgtccacgctgcaatagcatggaaacaaagttctgctacttcaacaactacaatgttcaccagcccaggcacttctgcaggaactgccaaagatattggaccgctggtggagctatgaggaatgtcccagttggtgctggaagacgcagaaataagcatgtgtcaaaatactgtcaggcgatgatgacgtgcaataatactgtagctcctggagatgtttctgatgtggttcaccatcaggttattacacatggatcttctctccttccggcaacactgaaggaaaatgaaacacctacagaattcatatcagaagtaccaccatgtaagtcttcagcttcaatccttgatattggagagccgaatgatactgaccttgttcccttggcctctggtgataacaaggaagaaaaatcatgtgcatcttctgtggtagtatccagctgttcagagaatctgatgccagataatgcaattatgaaagagccaaacaacaggtcaggatgttgtaatggtgtggcattgcctttccctactggacctgctttggtgctcccctggagtcttggatggaacagtgttgctctcatgccagctacccagtgctcgatgcagcccgttcttgggttaaaaggtgggataccctgcccgccttcatggccaccgcaactgatggtgccggccccaggaatctgtactcctgttgttccaatccctcttgtgccacctctgtggcgctgcttccctggctggcctaatggaatgtggaatgcacaatgccctggaggtaatactactgtgctgccgtcaaccgctccaaacaaaatttcttgttcaggaagcagttctctggtgttgggaaagcattcaagagaagaaagcttgcaggaagaagagaagacgagaaattacttatgggtacctaaaactcttaggattgatgatccagctgaggctgcaaagagttcaatctgggcgacccttggcatcaagcctgacgataaaggcatattcaagtctttccagccaaatgttgcgaaaaatggcacggcaccagaatcgcctcaggctctgcaggccaatccagcagcattttcgcgttctcaatcgtttcaagagacgacttgaggagcttttctgtttgttttctgacataaggatcatactgctacctccacaggaatggtcacaatgtttctatccagtgtgatcttgagctcatatgttgctagagccagatcaaatctagcaactcaaatctggcagagttgccagtgatgaacttggttctgtggtaatgtttatgttgatcaaaaatctctgcttctccccaaggagagaattgtgagcttgtgatccggagctcaaaacatgctccatctgaaatcattagtcaatagctgtcgctgtgatggaggtgaaaaggataactgtgaagtctcttttttcttactttctttgaatttttagactggcattctgacgtttgtatatagcttctcaaaattcatgtaatggcttctatgttaacctgcagaaaatgcataattttgtaactggatggggatcaactccgtttggacataagcaaatcagcctagttatctcatttgcagcattgaaatttaccccaaactaacaccatatctgtcaataccattgggtcaaaatgaacacccatttctaaattatcaaaattcatttacccc

SEQ ID NO: 5612 - DNA, 1720 bp, Oryza sativa
  Predicted polypeptide sequence is orthologous to G550
atatgatgaaatgaaggttgatgtgccacaagaggaggaagataacgaaatgaaggtcgatgcaccacaagagaaaaaggataatgaagtgacggctgatgtgccagaagagaagggaaatgatgaaatgagggttgatgcatcagagtcaatagaaagcatagagccagtcagcagatctaccttggacaataaaaaagaagatcagggtcagatgaacaacgttgaagagaaagcagcatcagactcaaaagatgaaaatgaaaagacagcaaatgatgaatcaggccaggacaaagtacttaagaagccagataagattctcccttgccctcggtgcaacagtatggacacaaagttttgttattacaacaactacaatgttaatcaacccaggcacttctgtaagaactgccaaaggtattggactgccgggggaaccatgagaaatgtacctgttggtgctgggaggcgcaaaagcaagagctcatcgttgcactaccgtcacttactgatggcccctgattgcatgatggggtctagagtgaaaatatccaagtcaatgaaccctgaagctttcgcatctgcgcattcgacccctatacaaccaattggcagaaacgaaacagttctcaaatttgggcctgaggtgccactctgtgaatcgatggcatcagtgctgaacattcaggagcagaatggaaccaatgctgcagcagtaccaacgggtgaaaatcaggaagataactcttgcatctcttcaatcacatcacacaacgtgttacctgaaaatgcagcccaagttgacaagaacagcacgccggtgtattgcaacggagtcggcccagtgccgcagtactaccttggagctccttacatgtacccatggaacataggatggaacaacgttcctatgatggtgccaggtacaagcatgccagagtctgcttcccaatctgagagctgcagcaccagttcagctccatggatgaacatgaactcccccatgatgccggttgcctcgaggctttctgcaccaccatttccataccctctagtgccacctgcactatggggttgcttatccagctggccggccacggcatggaacataccgtggatcagaacgaatggcggctgcatgtctccatcgtcgtcgagcaacagcagctgttcaggcaatggctcccctctggggaagcattccagggactcctctctcccactgaaggaggacaaggaggagaaatcactgtgggttcccaagacgctccgcatcgacgatcccgacgaggcggcgaagagctccatctggcatcttcaagccgttccagtccaaaggtgagagcaaaggccaagcagcatcagagactcgtcctgctcgtgctcttaaggcaaacccagctgcattgtcgcggtcgcagtcgttccaggagacttcttgactctttacctgttgaatttcctatagtttttgtcagcacagtgtgtgtactgtaaaatgtgtatagcagtagaggttttgcggtattcagaaggatcaggagagagctttttgtgcagccactaacttgaggtggataggagttgcaaagggctttcatgagaaactacatcgagatgtatatgtattgtaaatacttgacaaactggttgtgtacatctaggttaagtcaggaaaatacactcacctggtttagctctcctagtatattatact

SEQ ID NO: 5613 - DNA, 1461 bp, Oryza sativa
  Predicted polypeptide sequence is orthologous to G550
atgggagggggtggtaagtgcaaaagagggaaaagaggaaagattgcagccaagcgaagaaggggccagtgttgcagcagcagcagcagcagcggaggcgcaagaagacgagctagagagagagaatcagaggagagcttgggtgagatgggtgagtgcagaggaggaggaggaggaggagatgggctgatcaagctgttcgggaagacgatcccggtgcagccggatgccaaggatgttcagcagcatagtggcagtagcagcagctcaaccgaatccgacgtccaagaaaccgccgctgtcgccgtcgccgacccctccccgcggtcggaggtcgtcgacggcgagagcccgccgcagccgggcggcgaggcggcgagccatcagcagcagcagaaggagatgaagctgaagaagccggacaagatcctgccatgcccgcggtgcagcagcatggacaccaagttctgctacttcaacaactacaacgtcaaccagcctcgccacttctgcaagcactgccagcgctactggaccgccggcggcgccatgcgcaacgtccccgtcggcgccggccgccgcaagaacaagaacgccaccgccgccgcccacttcctccaccgcgtccgcgcctgcgccgccgccgccgccatgcccgcggcgccccacgacgccaccaacgccaccgtgctcagcttcggcggcggcggaggcggacacgacgcgccgccggtcaccctggacctcgccgacaagatgacgcgcctcggcaaggaggggctcgtcgcccatgcccggaacgccgacgccgccgccgcgtgcagcgaggtgtcgagcaacagggacgacgagcagatcggcaacactgtagcaaaacctgcaaacgggttgcagcagcatcctcctcctcctcatcatcatcatcattcagccatgaacggtggcggcatctggccctactacacctcggggatcgcgatcccgatatacccggcggcgccggcgtactggggctgcatgattccacctcctggagcttggagcctcccatggccggccacagtccagtctcaggccatctcatcatcatcaccacctacaagtgctacaccttcagtctcctccttcacactaggcaagcatcccagagagggtggtgatcatgaggcaagagatcaccatggcaatggtaaagtgtgggtgccgaagacgatccggatcgacaacgccgacgaggttgcccggagctcaatccggtcactcttcgccttcagaggcggcgacaaggcggatgataacaacgacgacgatggcaccggcgtgcacaagctcgccaccacggtgttcgagccaaagagggacagcaagacggcgaaacatccggcgatcacgagcttgccgctcttgcacaccaaccccgtcgcgcttacccgatccgcgaccttccaggagggatcttga

SEQ ID NO: 5614 - DNA, 1809 bp, Oryza sativa
  Predicted polypeptide sequence is orthologous to G550
gcctcgcttgtgcgaatgaaaagatttcaagaaatccaaccaaaaatctcgcgctctcctctcctcctcctccgcatgagctcatcggcgttggcgttggcctgtcgtctccgggaggagtagtgcaggcggcggcggggaattccgaaacggagtttgttcgttttggagcggagtggtgaggtgagtcgtcgagatgggggagtgcaaggtgggaggaggaggcggaggcggagactgcttgatcaagctgttcgggaagaccatccccgtgccagagcccggcgcctgcgccgccggcgatgttgataaggaccttcaacacagtggcagcagcacgactgaaccgaaaactcaagagaacaccgttcaagactccacaagtccacctccgcagccagaggtcgtcgacaccgaggactcttcagctgataagaactcatcagagaatcagcagcagcagggcgatacggccaaccagaaggagaagctgaagaagcctgacaagatcctgccgtgcccccggtgtagcagcatggacaccaagttctgctactacaacaactacaacatcaaccagccgcgccacttctgcaagaactgccagaggtactggacagcgggtggtgccatgcgcaacgtgcctgtgggtgcaggccgacgcaagagcaagagcgtatcggccgcttcccatttcctccagagggtcagggctgctctgcccggtgatcctcctctctatgccccagtgaagactaatggcaccgttctcagcttcggctccgacctgtccaccttagacctcacagaacaaatgaagcatctaaaagataagtttatcccaacaaccggtatcaagaacaccgacgagatgccagtcggtttgtgtgctgaaggattgtcgaaaacagaagaatcgaaccaaacgaacctaaaggagaaagtttcagcagatagatctccaaatgttgcacaacacccatgcatgaacggaggagccatgtggccatttggcgtggcaccaccacctgcttattacacttcaagcattgcaattccattctatccagctgcagcagctgctgttgctgcatactggggctgcatggttccaggagcttggaacgctccatggccaccgcagtcccaatcccaatcggtttcatcatcaagtgctgcttctccagtatccacaatgaccaactgcttcagattaggaaagcaccctagagatggtgatgaggaactggatagcaagggtaatggcaaggtgtgggtgccgaagacggttcggatcgacgatgtcgacgaggtggccaggagctctatctggtcgcttattgggatcaagggtgacaaggtgggagcagatcatggcagaggatgcaagcttgcaaaggtttttgagtcaaaggatgaggcaaaggcatcaactcacacagcgatcagcagcttgccattcatgcaggggaacccggctgccctaacacgctcggtgaccttccaagagggatcttgacttgaacaacgccttggaaatttttatgctgccttctgctgctataaagacatagcgtgatacagctgaaattttgtacattagaggattgtaaagtaggtatgggagatggagtgtcagggtgtataacttaacatagctacaagcaagcccagtagctgtattagataacttgtacatagctatgtgggtttgagaaagatagggagagcaagttccccttataatatgtagataaataatataatgatttgaatatttagatcaaaaggatttccttttgcagtagt

SEQ ID NO: 5615 - DNA, 1849 bp, Oryza sativa
  Predicted polypeptide sequence is orthologous to G550
gcaaactccacttgtcggatctctctctctctctctctctccctctctctctcgcccatgtaccatctccatggacgacctcgccgccgcctcccctcctcacccgccgccgccgccgccggaatcccacgtgcctccgcccccgcagacgccggagaaggattcatgtgaggatacaggagacatgaggatcagtgaagaaaagccatgcacagatcaggagttagatgctgatcagatgaatagttctagctttaatagttccagcgagtgtgagaatcaaacacctagcaatgatgaaatgactggatcagagtccaaatctgaggcagctcaaacagagggtggtggatcgagtgaagagaaggtcctgaagaagccagacaagatcctgccttgtcctcgttgcaacagcatggatacaaagttctgctactacaacaactacaacattaaccagccaagacatttttgcaagagttgtcagagatattggacggcaggtggaagcatgaggaacctccctgttggtgctggtaggcgcaagagtaagagctccactgcaaattaccgcagtatattaatcacgggcagcaatctagctgctcctgctggagatgctcccctctatcaactctctataaaaggagatcaaacagcaacggcagttaaatttgcacctgattccccactctgtaattccatggcctctgtgctgaaaattggagagcagagtaagaatgccaagcctacctcaacagcacaacccagaaatggagaaacccagacctgcccggcttcaggaacaacttcagatagtccccggaatgaaccagttaatggagcagttagtgggcatcaaaatggaattgttgggcatagtggagtccctcccatgcatcccataccatgcttccctggtcctccttttgtgtacccatggagtccagcatggaatggcattcctgccatggcaccaccggtatgcacagcaccagctgaaccagcaaattcttcagacaatggaagcacagctagtgttcagtggagcatgccaccagtgatgccggtaccaggatactttccggtaattccatcttcagtttggcccttcatttctccctggccaaatggtgcatggagctcgccatggattcaacctaattgcagcgtgtcagcttcatctcctacaagcactagtacatgttcagacaacggctctcctgtcctaggaaagcactccagggactccaaaccgcaaggagatgacaaggcagagaaaaacttgtggattccgaaaacgcttcggatcgatgatcctgacgaagctgcaaagagctcaatctggacaacccttggcattgaacctggtgaccgtagcatgttcagatcattccagtcgaaacctgaaagcagggagcagatatccggtgctgcacgagtcctgcaggcgaatccagcagctctatctcgatctcaatctttccaggagacaacgtgatgtatattgaagaaatcgtgtgacaattgtagaacatgttactactataatttaagcaagtgctacagcctgaaggatgattggcgatgtaggcgctgctgcaaacatggaggcagcgtgatctgtactattgaaacctgaagagtactattcttgacatttttctataatttgcctgtggagcatgcaccagtctactgggttcatgatcaggctgtcagcatatgttttgttgtacaataataataattgttaatagctttgcctaaaggatactgatagtattctgctgatccttcagctctgtgatcaatggcccatatatttacctgacaagtttcagaaagg

SEQ ID NO: 5616 - DNA, 567 bp, Oryza sativa
  Predicted polypeptide sequence is orthologous to G557
atgcaggagcaggcgacgagctcgcggccgtccagctccgagaggtcgtccagctccggcggccaccacatggagatcaaggaaggcaaggaagcgccacttcgatcccttctccttccctttcttgatttccattttactgttcctctttcgggaatggagagcgacgaggagatagggagagtgccggagctggggctggagccgggcggcgcttcgacgtcggggagggcggccggcggcggcggcggcggggcggagcgcgcgcagtcgtcgacggcgcaggccagcgcgcgccgccgcgggcgcagccccgcggataaggagcacaagcgcctcaaaaggttgctgaggaaccgggtatcagcgcagcaggcaagggagagaaagaaggcatacttgaatgatcttgaggtgaaggtgaaggacttggagaagaagaactcagagttggaagaaagattctccaccctacagaatgagaaccagatgctcagacagatactgaagaatacaactgtgagcagaagagggccaggtagcactgctagtggagagggtcaatag

SEQ ID NO: 5617 - DNA, 1011 bp, Oryza sativa
  Predicted polypeptide sequence is orthologous to G557
atggctcacagcttccgttccgtccgagaaaggcaagtggttttacgcttttacgaaatcggatggatggggatgccgctacgcttccggggaggtcaccgtcagatgcggtggatgcgtgtatggtgccttcgcacgccacgctccccgaacccccaccgtcggatggctccggagtggacggcccggatgacggccaccagagcacacagactcgttttctctctcctccgctctctcgatttctctctctctcctctcatccgatctgcatctgcttctcctttccacacttgtgcttcgtgttcgtcgtggtctcttgtttcttcttcttcttctagatttgattttctttttttttcttccctttttcgcggcggcgaggggcgaggggggaggatggcggcgcaggagcaggagcaggagaagcagcaggtgaagacgagcacgacgagctcgctgccgtcgagcagcgagcgctcctccagctcagcccccaacaacctcaaggaaggaggaggggtggagagcgacgaggagatacggcgggtgccggagatgggagggggcggcgggtcggcgtcgtcgggggcgggggcggacgagcggcaggggaaggaggacgggaagcagcagggtggtggcggcggcggggcggcggcggcggggggcgggcaggagcaggcgccgccggcgaggaagcgagggcggagcgccggcgacaaggagcagaaccggctgaagcggctgctgcggaaccgcgtgtcggcgcagcaggcgcgggagcggaagaaggcgtacatgacggagctcgaggccaaggccaaggacctcgagctccgcaatgccgagctcgagcagcgcgtctccaccctccagaacgagaacaacacgctccgccagatactcaagaacacgacggcgcacgccggcaagaggggcggcggcggcggaggcaagggcggcgatggcggcggcggcgggaagaagcaccatttcaccaagagctag

SEQ ID NO: 5618 - DNA, 872 bp, Oryza sativa
  Predicted polypeptide sequence is orthologous to G557
aagtacggtcggaatcccgggtcgaccacgcgtccgcggacgcgtgggttttttttttggcggaattacatacatttattacacttttgcagggctcggccaatccgccaataggaggtagacatggaaacaattatatgccttccagagttgattcgagaaggcataaataggtaagttcatttgtctcgatctggctagcactaacgagtacttattcaggtgcatagccaagaatggttgtatttaatgtagtaattaattttatctaagaaactacaaatcaatcaaaagggagcagcttccctttgagtcttagttgtgactctgccaaatggagctagccaagctaacaaaattaatcgaactccagattccagactacagattgcggttactagctgtctccgccggcactgctgtctggccctcttctgtttgctgttgtgttcttcagcacctgcctaagcatctggttctcgttttgcagggtagagagcctctcctccagctctgagttgctcctctccaggtccttcaccctcgcctccagctcactcatgtacgccttcttcctctcccgagcctgctgcgctgacacccggttcctcagcaatcttttgaggcgccggtgctccttgtcggcggggctgcgttcgcggcggcgcccggtgctgctggtgcgggcgacgccggcctggccgggggcgaaaacacgaagtccggccgcggcccgccgggcacgtgaacccgaaatactcttccgagtcaagtcccgggaagcagccaatcggacccccatatctgtggggaaacctctggggtgggggggggggcgcaaccccagaggggacaaaaagatcaagggaaat

SEQ ID NO: 5619 - DNA, 1548 bp, Oryza sativa
  Predicted polypeptide sequence is orthologous to G558, G578, G629, G1198, G1806
actcactatagggctcgagcggccgcccgggcaggtgtcgctcgtcgacccctctccgccgccgaggctcgctgtcccaagctaatccgtccgcttcgttgaggattccattgaatgcttggctgtggtggagtgctacactgctagtagcagcttgcatctcagcaatttgggtgaaccccccacattcttgaggcagtaacaattggatctacatcttgccactacaaaaggatcaacgatctgtactagccttcatttgtgggttcctcattgggaattgggattctttacaatggcagatatgagccctaggacagatacatcaacagatgataccgatgataaccacatgcttgaaccaggtcagcttgctcttgctgctgcttctgactctgacagatccaaggacaaacatgaagatcaaaagacattgcgtcggctcgcccaaaatcgcgaggctgcaaggaagagtcgtttgaggaaaaaggcatatgttcaacaattggagaatagcaggctaaagcttacacaactagaacaagaattgcaacgagctcgtcagcagggcatttttatatccagctcagtggaccagactcattccatgagtggaaatggggcattggcttttgatatggagtatgcacgttggttggaagaacacaataggcaaattaatgagctaaggtctgcagtcaatgctcatgcaggtgataatgagctccgtggtgttgttgacaagatcatgtcacactatgaggagattttcaagcagaaaggaaatgcggccaaagcagatgtctttcatgtgttatcaggcatgtggaagacaccagctgagaggtgtttcttgtggctaggaggattccgaccatccgagcttttaaagcttctttcgacacagcttgaacctctcactgagcagcagctgtcagggatagccaaccttcagcagtcttcacaacaagctgaagatgctctttcacaaggaatggaggcccttcagcagtccttggcagaaacattggctgggtctcttggttcttctggatcaacgggaaacgtggcaaactacatgggccaaatggcaatggccatggggaagcttgggacccttgagaatttccttcgccaggctgacaacctgcggcagcagactcttcaacagatgcaaaggatactgaccactaggcagtctgcccgtgcgcttcttgtgataagcgattactcttcgcggcttcgtgcccttagttccctctggcttgctcggccgaaagaatagcaagcgcaagtaacttgactgcaaccacatttttcgggtttgggaggtgatggtgatcttacctggaagagttgacaatcctgcaaaggacttgattcggagatatttgcacatactataatccaaaagagatccttgtgttcaggtagcttagtcttatggttaagtgcattaggccctggcccatgttgtactgttagccgctgtaaaatactgttccattattacttatgtatctgtaatatcctaattttcagagaatg

SEQ ID NO: 5620 - DNA, 2155 bp, Oryza sativa
  Predicted polypeptide sequence is orthologous to G558, G578, G629, G1198, G1806
tcgagcggccgcccgggcaggaaaccgctcctcctcctcctcccaaatccaccacggcgacgccgccgccgcagagcccctagctcccggaggtccctcgcccccgccagctccgacggcctcacggaaggaggagtaacgtgggcgttgattggatttttttgttttccccccaccttgagtgagtctgtgccgtttccccggcggcgagggagggcagagggctgatcatggtcgtgcgccgccggtgccttgccgagatttcccccaaccgccaccgacgatcgttcacttggcacaaaggggagtagcactgtccaagctgttgtggtccgtcagggagattggccaacctgtggggtttcagatcgacataagtacgtcagtatttcagccatcgatcaatctggcggttatagggctgtgcttgcaacctttctggcagaaaggagagagcaaagtgatttgctgtctcctgttgattgtggcctgttgaggcccagtaatggcagatgctagttcaaggactgacacatcgattgttgtagacaacgacgacaaaaaccaccagttagaaaacggacatagtggtgcagtcatggcttctaactcttcagatagatctgacagatctgacaaacttatggaccaaaagacaattcggcggcttgctcaaaatcgtgaggcagcaagaaaaagtcggctgaggaaaaaggcatatgtgcaacaactagagagcagtaagctgaagcttgcacagctagagcaggaacttcagaaagctcgtcagcagggaatcttcatctctagctctggagaccagacccatgccatgagtggaaatggggcattgacttttgacttagaatacactagatggctcgaggagcaaaataagcagataaatgagttgaggacagcagtgaatgctcatgcaagtgacagtgaccttcgtcttattgttgatggcataatggcgcattatgacgaggtattcaaggttaagggtgtagctgcaaaggccgatgtgtttcatatactttcaggcatgtggaagacacccgcagaaagatgcttcctgtggcttggtggtttccgtccatctgagcttctaaagctcctagcaaatcacctcgaacctttaaccgagcagcagttgctgggattaaacaacctccaggaatcttctcagcaggcggaggatgcactttcacaaggtatggaagcactgcagcaatctctggcagatactttggctggatctctcggttcatcagggtcttctgggaatgtggcgaactacatgggtcagatggcaatggccatgggtaaactaggaacgctcgagaatttcctttgccaggcggacaacctgcgacagcagacattgcatcaaatgcaacgaattctgacgatccggcaagcctcgcgtgctcttcttgccatacacgattacttttcacgcttgcgtgctttgagttcgctgtggcttgctaggccacgggagtaacaaaatggtcatgtgtgcctgtgacgaggttagacgctcattttgatggactgcagataattgggtttttccctgtacaattgtgtttggcagctgtggactaaagttaaaaactgtacctaaagtggtgtatgcaaataggtgaagcctctaagtaattataacgattgcattattgtgttagcaataaaagttgggtaattcaggatgtgtcctgagttgttttgttgtagtagaagaactgcatgtagtggctggaaatgcagtgttgaatgtaactaaagctctgctgctcacgttgcataatgttgtgtagtaatagttagctagtgatgcccattttacctgcactcctctgggaagctgaaactgcaacctgaagcaaccacggtgcagaagaccgcatgcatggtaaatgattaaaaggatatatatgggctcaacatcgctgccaaatcctgagataatgaacaggcatgctaaactgctacttccacatgaaacctcccagttgacatgaagaatgagctgttcagttttatggtttctgtgttgcactgtacataattcctgtacgggtctgaatttatcctgaaatcatgctaaactgcagaagcatatgaaatctccagaccggttgacatg

SEQ ID NO: 5621 - DNA, 1654 bp, Oryza sativa
  Predicted polypeptide sequence is orthologous to G558, G578, G629, G1198, G1806
tcgagcggccgcccgggcaggtcgcctcgcctctctctcttccttctgaccaacccgacctcggcgcctccccccatttctctctctctctcttcgcgttgccgtctcgaccccgcctccaccgccgaagccgcccgaggcggcggccgccggcagctgggctcctccgaatccgaacacggcggggtctctcccctcgctccccacggcggttggcacctgctggctctcgatccaacgtgtacagctaatttgatctgttggcgccttagctagaaaggtggcgactctggcatctcagtgatcatagggcatttgaaggtggcctgcatccctgttacaagtaagggacaacaaagcaatttgttgtctctttatttggagctgggaagaacccggcatggcagatgctagttcgaggactgacacatcaacagtcctggataccgacgataagaatcagatggtagacgggcaaagtggagctattgtgccttctaattcatctgatcggtctgacagatctgacaagcccatggaccaaaaggtgttacgccggcttgctcaaaatcgtgaggctgcaagaaaaagtcggctgagaaaaaaggcatatgtacaacaattagagagcagtaagctgaaacttgcaagcttggagcaagagatcaataaagctcgccaacaaggaatttacatttcgagctcaggagaccaaactcatgctatgagtggaaatggagctatgacttttgatttagaatatgcccgttggttggaggaacaaaacaagcagataaatgagctgaggactgcagtaaatgctcatgcaagtgacagcgacctccgtctcattgtagatgggataatggcgcattacgatgagatattcaggctgaagggtgttgccgcaaaggctgatgtgtttcatatactttcaggcatgtggaaaacacctgctgaaaggtgcttcttgtggcttgggggttttcgttcctctgagcttctaaagcttcttgtgaatcagctcgagccattaactgagcagcagttgttgggactatcgaacctccaacagtcctctcagcaggctgaagatgctctatcacagggaatggaagcgttgcaacaatccttggcaggtacgttggccgggtcccttggtccatcaggatcttcagggaacgtggcaaactacatgggtcaaatggctatggccatgggcaaacttgggacccttgagaatttcctccgtcaggctgacagtttgcggcagcagactttacatcaaatgcagcgaattctgacaatccgacaagctgcccgtgctctacttgcaatacatgattacttctcacgtttgcgtgccctgagttctctctggcttgctaggccacgggagtaacaacacatagggtgcatcaccgttaatgcttcatgaactgatctgggaggaacggcggagcgggactgattgcggatgcatttgcagaagattggtggctcagttccctcggcacaagttgtattgacaccttttggtttcatgttgtacctgatgttgtacaagtagggtaaagcttgtaacttgtaagttatggtgaatttatgattggcagattgtacaattgtattagcaataaaataaaaggtaggt

SEQ ID NO: 5622 - DNA, 1565 bp, Oryza sativa
  Predicted polypeptide sequence is orthologous to G558, G578, G629, G1198, G1806
atcatcttcttcctcctcccgacctcccgctcctccgcactagtccgaatccgagctccaagtcgtcgagcaacctcaccgccggaggacaccttccgccgctcgccgtcgccgccgccgccgccgccgcgcagcatggcgtagcggtggtgggcatggcggcgcaccaggggatggcggcggcgacggcggcggaccggttctgcctgccgaggatggcggcggcggcggcggccgcctcgcaggtggagaactggggcgactccggcgtcatcgtcagcagcccgttcaccgacgacacctccaccgacctcgacgacagcgccgacaagcaccacctccacgctctagtgggcggcggcgatggcggcgacgacgccggcgagcagcgaggcgcggattcctccgccgtgtccaaggaaagaagaggggatcagaagatgcagcggaggcttgcgcagaatcgcgaggcggcgcggaagagccggatgaggaagaaggcatacattcagcagttggagagcagcaggtccaagctgatgcaccttgagcaggagctccaaagggcaagacagcagggaatcttcattgcaactggaggctccggcgatcacgggcactcgatcggaggaaatggtacgttggcgttcgaccttgagtacgcgcggtggctggacgagcaccagcggcacatcaacgacctgcgggtggcgctgaacgcgcagatgagcgacgacgagctgtgcgagctcgtcgacgccgtgatgatgcactacgaccaggtgttccgcctcaagagcttcgccaccaagtccgacgtgttccacgtcctctccggcatgtggatgagccccgccgagcgcttcttcatgtggctcggcggcttccgctcgtcggagctcctcaaggttcttgccagccatcttgagccgctgacggatcagcagctgatgggcatctgcaacctgcagcagtcgtcgcagcaggccgaggacgcgctgtcgcaggggatggaggcgctgcagcagacgctgggggacacgttggtgtcggcggccgccaccgtggtcagcggcggcggcggcgccgacaacgtcaccaactacatgggacagatggccatcgccatggccaagctcaccacgctggagaacttcctccgtcaggctgatctgctgaggcatcagacgctgcagcagatgcaccggatcctgaccacgaggcaagcggcgcgggcgctgctcgtcatcagcgactacttctcgcggctccgggcgctgagctcgctgtggctggcgcggccgagggactagactgactaaagaggatcaatatcatttgcctgagttctgagttctgacgatggatggaggtgaacctgttttttgattgctgaatcctgagagagcgttaactgcgatcggcattgtaaaatcagttgctttggtgatgaagcagtagtagtaggagaatattttagattgggctcttgggcctgtaacgtgttgtagtgttagcgtagtaagaactaatccgcgtacaatgtcaaaaggagaagttttatt

SEQ ID NO: 5623 - DNA, 1831 bp, Oryza sativa
  Predicted polypeptide sequence is orthologous to G558, G578, G629, G1198, G1806
tattatgctcaggttattcatcattatccacagatatgttttttcttctttgcaaatattctccttttcccagagccgcattggactccaatacaagagtcagagggtggaagcaaagaaatcgtagtaaatgatctctactggcctctgtagccaaaggattcagcaaatctgcgaagacctcacgagtcaggagctttccaggagttgcaacctgcagctgctgcttactttggtgagttggagaaggcccttatccatggcaccagtgctggtgctggtgtcgatcatggcatgatccaaagtgacgcgtacacagagtcagcaggatatcttgcagctaggccccccacactggaaatcttcccttcatggccaatgagtcatctacaggagccatacagtaactcgcagtcagtagggagcaccactgactctagctcagctcagaacacaatgtcacaggccgagttggtgtccccagcgagcatgaggtccgactctgggcaggaacagcaacaacaggaggtattgatggtgaccattgatgattacaactacaaacaaggacttggagcagcaatagctactgcaccaagctttcagcaacatgcaggaggcctagacatgaggaagcatggatccactagaaaagacggaaaactgttagatgccaagactgaaaggcgattggctcagaacagagaagctgcaagaaagagcaggctgaggaaaaaggcttatgtgcagcaacttgagactagccgcataaggcttcagcaaatcgagcaagagcttcagagagcacgctcacagggcttgtttcctggaggatgcagtgcacctggagatatgagctcgggtgctgtaatgtttgacatggattacacccgatggatagacgacgacagcaaatgcatggcagagctccagggcgcgctacaggcccagctccccgacggaaaccttggtgccattgtggaagaatgcatgcgccactacgacgagctcttccaccttagggccgtgctcgccagctccgacgtgttccacctgatgactggcatgtgggcggcgccggccgagcggtgcttcctctggatggccggtttccggccatcagaaattctcaaaatgctgatacctcagctcgatccactgacggagcagcagctgatggggatgtgcagcctgcagcagtcgtcggagcagaccgaggaggcgctcgcgcaggggcttcaccagctgcaccagtcactggccgacgcggtgggcggcggtcctctcaacgacggcgcagatgttgccaactacaccggcctcatggccctagcacttggcaggcttgagaacctcgagagcttttatcgtcaggctgataatctgaggcaggaaacgttgcaccacatgcggcgaattctcacaaccagacagacagctcggtgttttctttccattggagagtataatcgccgtctccgtgctctcagctccctctgggcttcacgtcctcgcgaaaacttcattgcgacagagaatgtcagccctacaggaactgaatttcaggttattcagcaatctcagcaaaatcaattctccggtttctgagacctcttctccaggagggtacaaattctgcatttctgccagtagcaaggtggagagagagagagagagagagagagagcgaatgtaatgttctatcattatgatattgagaaaggaacatcactaggaaaaaaaaagatggcagaaagttggaaactggggcggctcgatcacttgctatgttccaatggctcttgaattgaatgaagggttagctctaagc

SEQ ID NO: 5624 - DNA, 1974 bp, Oryza sativa
  Predicted polypeptide sequence is orthologous to G558, G578, G629, G1198, G1806
ggatgcgtcgtcgccattagcggggagaggagcgggagagagctcgtcgggattattccgagctccatatccattgaaccgaaccagctctgagtgagagagagagagagagatcggagctgttgtttcttctcgtttctttgattggtggcggtgttgaattgaattgaattgatcgatcgattgtttcttggtgtggtggtggcggcgacggcgagcagcgcgccaaggtacatgacctcggcggcgccggcggccgcgcagttcgctgcgccggcgccggcggcgatggggatctacgaccgccggcaccatcccctcgccgccggcgtctggggagaccaccccttcatccgcccggacaccaccgccagcaccagcaacgccgccgccgccgccatggtcgtcgcgccgccgccgctaacagagcccaagttcgagagccagctagctctgcctctgcagcatggagacgatcaagacaacgctgcagctctgcaagaatcgccgaggcatgcgtcggacagcttcgagcaggaggcgtccaagcctcgagacaagatccagaggcggctcgcgcagaacagagaagcagctcgcaagagccggctacggaaaaaggcttacatccagaacctggagacgagccggatgaagctggcgcatctggagcaggagatcacccgagcaaggcaacagagcgcgtacatcaaccgcagcagcaacccagccaccctaccagcgcccatcgattcaggtgtggtgacgttcgaggtggagtacgcgcagtgggtggaggagcaggggaggcagacggcggagctgagggcgtcgctgcaggcggcggcggaggggccggagctccgggcggtggtggaggcggcgctggcgcactacgacaggctgttcgcggcgaagcgtgaggcggcgaggcgcgacgtgttcttcgtgatgtccggcgtgtggcgcaccggcgccgagcggttcttcctctggatcgccgggttccgcccctccgaggtgatcagggtgctcgcgccgcagctggagccgatgacggagcggcaggccgccgacgtgcaggggctccagcagaaggcgcgccacctcgaggacgcgctgtcgcagggcatggacaagctgaagcagacgctcgccgactcgctgctcgccgaggccgtcgtcgtctccacctcctgcgacgcctcgccgccgccgccgccgccggaggaggaggagccgtcgtcctccgccgccggtgacggcggatgctacatggcgcagatggggagcgccatgggcaggctcagcaacctcgtcgcgttcgtcgaccatgtacgccatcgccgatcaccaccacctacctcccatctccatgtccgacgacgagcagagctcggctgacatcttgctgatgacgtgcaggccgaccatctccggcaggagacgctgcagaacatgtacaagatcctgacgctgccgcaggcggcgcgcgggctcctcgcgctcggcgactactgccagcgcctccgcgcgctcagctcgctctgggcggcgcgcccgcgcgagccggcgtaaagcgagctgagctcgccgccggcaacggccagcctgatcgatcaccggaggaggagcaagatgtcgtcgctgagctcgccggggaagacgacatggagctcaagtggctcagtttgagttctctgcattttcatttgcaaggacaggaaagaaattaaacggacgtgttcacttcatcataggatagcagcagcagcagtagctaggaggaggaggaggaggaggagaatttgaatttgaatttaaaagacgtgtaaatatttactacagtaattaacttgcttgggtagttatttgcgtcgctcaacttgtaattgctgccatttccatggataaaaaaaatgtcagggatggtcatatgaaaaattgggagtgattccaggcgcctgaagtttg

SEQ ID NO: 5625 - DNA, 4510 bp, Oryza sativa
  Predicted polypeptide sequence is orthologous to G558, G578, G629, G1198, G1806
gtccttgcgccatctcgcggctgaaccggggaggggcgccgatctctatccgacgagcagaccaagggaggggaggggatcctgggttcacccaaatatttgaagacccaagcgtttggtgattggcaaagatgggttgggggatatcccggttgattggactgaaagcagctgtgttcctctctgtggcttatttcttccatagattggacatgacactgctttcttttcccctcatatatgcctctgtgattgcgatgcttgtttctattgcttcacatccatcaattgaccttcctttgctccttggcaaggggtcgaatggaagctttcctgtgtggtcatggatcatgttctcaccatttcttcttttcatccatctgtttgttctgttacgaagatttgtgaaaaatgagcccttgtacactgagattgctgatggagtgtatgttggagggtggccctcttcagttgagcgcctgccccctggtgaacctgcagtcatagactgtacgtgcgagctcccaagaagctctactatatccgagaattcatatttgtgtgttgccacctgggatacaagggctcctcaaccatcgcagattgagtctgccgtgagatgggcactgagaaagcgttcgcagaacaaagctgtatatgtccactgtgcctatggccatggaagaagcgtctgcgtgatgtgtgcacttcttgttgcattgggattagctgaggattggaaagctgctgagcaaatgattcgtgagaagcgaccttctattagcatgaattctcttcatcgtaaaagtttagaggaatgggcaaaacacttgctcactccctcaaaaagaagtggggaatcagatgtgagttatgcgattctttcggatcatacccgaaaaaggcattgatctcgcaagaaaactaacttgctcagtggctgtgataattgagatgaagtttaaatgctctggcattatctactgttatcctagtcatgtccaaggcatttcattctctaagttaattgtttgggagtatgttgtaaaacttctactactgtggcttacaacgccagctcttttaggcgctctgttggctgcgtttgttgccctgacttgggattagggttcacagatggaatttcgcgaaaaccaatcggatttcttgaaactgctaggtctcggtttatgaaaaccggaccagttttgtaccgcattgaccgaaagtcatcggtttttaccggtttttggtcggatttcggtaaaccggtgaggagcggtttttacttcgaaattgaaaagtaaaacccttgttgggaacctttccttccccttcggcacaaaaaatagagcaactcattagcgcttgagcaattaagttagctcaaactaacttaaaaaatggatttaatatgatttttaaaacaactttgctatagaagagttttgcaaacaccatttagcattttgaaaaacgtgtgtgtggaaaattgagaggtataagttgggaaagctcgttgccgaacgcagcctaagaacaagttttataatagagccaactttaagtttatagcttatattagaattaacatgtatagtgatgagctataaggttatctctctatttttctcctctctctatctctctcatgcatatgcatttaatgtatttatcttgaagtatgtgaatagctatctcttgcataataagagccaatctttttcattttctaaattctctttcctccacataagtttatttgccttatagtgtactattaaacttgctctaatgatcttccctgtcattgaatgcttgccagagacgtggtattgtcggatctctctttctgaaaaagaggggcctctgctagcctgctagattctcatttatagcgaaatgtggtatgtttttcatttttggtagtttgcatctatctctctgttaggttcttttcatctggcctgaaataaatgctcaactattcaccactttgctgtacccctgtattctgtggacatttcatacttgactcatgaaaattttcatgtttgtatctcatgttttgtgtgtaatgatcgtggctaagctgtagtgtactcatcccatcatgctatcttgtgtggagtatgctcttctggccttttcataatttttgccatttttctgcccttgtctcaagcaccagtttgccagttgatggatcaaaatcaagagctgcactattggaacaatctacatcctacggaaagtcgcatgcctggcaagaaatatctcaaatggtcttggtagatgtcacatgacaaaagggttgcttttcacctttctagttctttgatcttcttatcagttgaattcactgatctgccctttcttccatttatttggtctttgaaaaaagggacttccatctatttgtttcttgttttactaataagcattgtgacattccttgtgacttgcgttgtttttctgtgtcctgttttttacatgtatttcagatgtacctcttagtgacaactattttgtctgtcaattgatggtattagatttgtcctccgtgatttcagagttcagacagttatcatctctcttccatcagtgccattagtgccaggttgggaaagccttatttgctggcacgttttcttttttcttttttttttttggtagtgttgatctgcgtcatgttctgttgttatctgtagatgtctattttcaaagtaagcttgggaacatcctacctttaaaaaaaatggcttgttcagcagaaatattagaggttgttttatgcatcgtcttttgggaggattttgtctgctcaagtcatgagcagccacgcatctcctgcctttgcattgctctggtctgcaacaattatttctgtgctaactcttcagcctgttcaagagccattggaagtttggaacaagtgagccagtgaccagcattgcattgcacctcaacaaatttttgcctcttccttttcctagtgatgttgctttctcaatactttaataatagaacattacaacccctctccctctcccaccctctctttctaacatcacttttggccggagtttacatcctccaggagaagctctcaaaatcctgagtactgattctgctgaggctgattatgcatcggttgcagctcggttcctgtgggactgacgctctcggtgccaatgaagttcctgttgcaagagaaaaaagagtcaatgccagccatgttcatctgtttctccgactagaagagatattgcacgaatatctgtcctcgatataacacatcaaatgatcaaatcaaccatccaccctatgaacactagtataattcatcgcttatctaatgactcgctggagataagcagttctgagtcttactcgcgaggacgtgaagaccagaggttgctgagagcacggaggcggcggtaatactccccaatggagaggaaacaccgagccgcctgccgggttgttagaatccgccgcagctgatgcaacgtttgttgcctcagattgtcagcctgcacatttgccaggaatgaagaagaaaaaaaaagtaagttctgcatgaatgatcaacggaacgggatgacaatgctaagctgttgacgtacctgctggtagaagctttcgaggctggcgagcttgtccagggcgatggccatgaggctcatgtagttgggcacgccggggccgtcgttgagcgtgccggcggcgacggtgtcggcgagcgactggtgcagctgctgcagcccctgcgcgagcgcctcctccgcctgctccgacgactgctgcaggctgtagatccccagcatctgctgctccgtcagcgggtccagctgctgtatcagtatctgcatatatagtcgacgatgagtatatattcgtgacacgcccatgcaggcaacgccggcgatgcaggcggcggcggcggcggaggcgaaccttgagaaggtcggaggggcggaagccgcccatccagaggaagcagcgctcggcgggggtagcccacgtgccggtgaggaggtggaagacgtcggagcgcgcgagcgccgccttgagctggaacagctcgtcgtagtgctgcatgcactcctccacgatgaggccaaggttggtgtccagcaggtgcgcctgcaggccgccacggaggtcggtcagccgcttgctgtcgtcgtccagccagcgcgcgtactccatgtcgaacatggccgcgcctgcaaacgattttactgcgccgtggtgagaactccgaggcacaccctcgtctgcaagctgcaggcttgcaggctgcagctgctgctgctcaacgcatcgaaaaaagaaacggacggctctgattaccagaactcatgtcgcctgctgctctgcaccccccaagaaacaggccctgacgatcaatcaagcaatgcgggtaccatattaaattcctgctaatttatttcatttctggatagtagaaaaaaaatagtactagtactagcatcagaaattc

SEQ ID NO: 5626 - DNA, 2225 bp, Oryza sativa
  Predicted polypeptide sequence is orthologous to G558, G578, G629, G1198, G1806
gtgactccatgacaaaacaccttcaagtagagacaagacctatacctctctctcctttcctctcttcaaagaagaaaaaaaccagcataggagaaaggaaggacaagatctttccatcaactgtgtgattagcatgccccagaccggaaggtgaagctgctacactttcagatactccatatcaagattcaagagagagctaaagctataggagtgagcagcaatagcaagagccaagaacagctagctactccagctgagagccaagaaccggtcaagctttgcttcttgcacttcttgctagctaaagctactccggtcacttttctgctatagtagctcttggctcttgcttatcacaagagaccacaatcttgatcgaagaaatttgagctagcgcttcgttctgattcttggagatactgggagatcgagctgtggttttgtggctcgtaggatgggagaggctaggagagggcagaatcctcatcatgttcttggctatggcttccatggcaccaccttgcccaactccatggcttctgcaaacctcttcgagcaaggaggaggaggaggaggtggcgctgcctattttggagagctagaagaagctcttgttcatcaggttgccacactcaggaggagggctcaacaaactgcaaccaccaccacctctcaccatggacacaccactcccttctccactgctgctgctgcagctacagcaacagcaacagctaggcctcctgctacactggacatcttcccatcctggcctatgaggaggagctctcttccaacaccgaaggatggatgttcaaatgtaacggcagacacaacggactccgagagcagcagcaagaacaacggcgatcagggtgcagcagcagccgacatggcgagccagtttgatcagatcccacagcagcagcagaagcagcacaagaagatggcagcaagttccactcacagtgaccacaggatgacaaagacacttgatccaaagataatgagaaggttagcccagaaccgagaggcagcacgcaagagccggctgcgaaagaaggcttacatccagcagcttgagagcagcaagttgaggctggctcagatggagcaggatctcgagagagctcgttcccagggcctcttgctgggaggatcaccaggtggaaacaccagcgcaggagcggcgatgttcgacgccgagtacgggcggtggctggaggacggcgggcggcggatggcggagctgcacggcgggctacacgcgcacctgccggacggcgacctgagggcgatcgtcgacgacgccctggcccactacgacgagctcttccgcctgagggcagccgccgccaaggccgacgtgttccacctcatcactggcacgtgggccacccccgccgagcgctgcttcctctggatgggcggtttccaaccgtccgatctgctcaagacagtggcaccccagctagaccctctgactgaacagcaagtggttggcatctgcagccttcagcaatcatcgcagcaggcagaggaagctctctcccagggcctggagcagctgcatcagtcactagctgagaccgtcgccaatggcggctccgtggtcaacgaagccagccttgggagcttcatgggttacatggcccttgccctgggcaagctgtccaaccttgaaggctttgtcatacaggctgataacttgaggcaacagactcttcatcagatgcacagaattctgacaattaggcaggcagctcgatgtttcttggcaattggcgagtaccataatcgcctccgtgccctcagctccctctgggcttctcgtccccgagagatattggtggcagatgaaggcaactgtggagagctaagcatagcagcacaaccatctgaaagccaattttcagctttctgatttacaaggactttgaagactaaccttcagataggagcagaagtaagcaaaactgggaacaaattttggaagtaatctgacacgtgtgggaaacactgatatgagctgggaaacaatgcaagctccagaactaggaagatttctcagaacccagattgcatagaactcacatggtaatttgcctgagatgtcaaatgatttaatgtcctgcccagtgacaacaaaaaggggttagctagattttgttgctgaaatactacttatttatgtgatttagtggcaaattatgtttcccgtg

SEQ ID NO: 5627 - DNA, 1899 bp, Oryza sativa
  Predicted polypeptide sequence is orthologous to G558, G578, G629, G1198, G1806
gagtggatgaaactccaaggctgattcaatttgccagtgtgtgagaaacgagaaacaaccaagaggctcatcaggatcaagtggctgatcatcatcatctctctctaggatgtagagctagtggtgatcatggtgcaaggtgaggagagttcttggaggatggcagcaagcacccaccatgagagagcaatacctctcaaccaagcacttgcctatggagtccaagcccatgcttctccttctgttgctgctgcaccacctgccagcttcttggacttccagcctgctgccgcggcagctgcctacttcggcgagctggaggaggccctcatccatggcgccaacgccggcggcgtcgtcgatcccggcatgatcagagccgacgtgcacagcaagtcggcggcagcggcagcgacggcaggatatctcgcggccaggccccccacgctggagatcttcccttcatggccaatgaggcagcaacagcagctacacagtgggaattcgcagtcagtcgggagcaccactgactcgagctcagcccagaacacaatgccgcagatggagttggtgtccccagcgagtatcagggcctcctccgagcaccagcaccagcagcagcagccggggcaggaggtcatgatggtgaccactgatgattacagctacaagccaggcctcgctgctgcctccccaagctttcagcagcagcatcagctccagcaccaccagcagcagcagctgcacggaggaggagaccatgacaagaggaagcatggatccacaagaaaagatggcaagtcagtggatgccaagacagaacggagattagcgcaaaacagagaggctgcgaggaagagcaggctgagaaaaaaggcttatgtgcaaaacctagagaccagcagggtcaggcttcagcagatcgagcaagaactccaaagagcacggtcacagggcctgtttcttggggggtgcagagcagcaggcgacatgagttctggcgcggccatgttcgacatggagtacgcgcgctggctggacgacgacagcaagcggctgaccgacctccgtggcggcctgcaggcgcacctgctggacaccaaccttggcctcatcgtggaggagtgcatgcagcactacgacgagctgttccagctcaaggcggcgctcgcgcgctccgacgtcttccacctcctcaccggcacgtgggctacccccgccgagcgctgcttcctctggatgggcggcttccgcccctccgaccttctcaagatactgatacagcagctggacccgctgacggagcagcagatgctggggatctacagcctgcagcagtcgtcggagcaggcggaggaggcgctcgcgcaggggctgcagcagctgcaccagtcgctcgccgacaccgtcgccgccggcacgctcaacgacggccccggcgtgcccaactacatgagcctcatggccatcgccctggacaagctcgccagcctcgaaagcttctaccagcaggctgacaatctgaggcaacaaacgttgcatcagctgcggcggattctaacaacccggcaggcggctcggtgtttcctctccattggggagtattaccgccgcctccgtgctctcagcaacctctggtcttcacgtcctcgcgagaacttcattggcaccgagagcgtcagtcccacaggaaccgagctgcaaccgatgcataatcagcctcagcagaatcagtactcaggattttgagagcttctcctggaggatgtaaactccggccaaaagtgatgttagaaagagagggtgggagagggagaggggttgtaatgttctattattaaagtattgagaaagcaacatcactaggaaaaggaagaggcaaaaatttgttgaggtgct

SEQ ID NO: 5628 - DNA, 2027 bp, Oryza sativa
  Predicted polypeptide sequence is orthologous to G558, G578, G629, G1198, G1806
gtcatgacaaaaaccttcgagtgaagacaagaccctagaccgtctctctctctctctgaccaaggctagctagggaaggaagaacaaaaacagcataggaaggacaacatctttctctgaactgtgggattagtacgcccaagaacgtgaagctattacaccgtcagatatatcaagaagatgcaggcggagcaagagcaactgcgcacagaaacggtcaggcatgcctgctctccctcctgcttgtcataaaagggaagccacaagctgaagccagattgctagaaggtagttcttgaggactgaagcaaggtagaagaacttgagcttctggttcgtgtggagctactgggataagttggctgctgattgctgaagatgggagaagctagcagtagttcaggacatccaaggcagaatcctcatgttcttggctatggcttccatggagctatgcccaactccttgccttctgcaaacttgttcgagcagcaaggaggtgctaactattttggagaactagaagaggctctgatgcaacaggtggccacactcaggaggactcaacaaactgcaaccaccacctccacccttcatcatggagacaccacccccttctccaccactgctactgctgcggctacagctaggcctcctcctacactggacatcttcccatcctggcctatgaggtctctccacacacccaaggagggttcaaatgtgacagcagacacaacagactcggagagcagcagcaagaacaacagcaaccaaaatgcctcatcagaccagcatgtgctagtaggagacatggcaggccagttcgaccaaattccacagcaggaacaacacaagaagatggcaactaacagtcccactcatagcagcaagactggcaaggcgcttgatccaaagacgatgagaaggctcgcccagaaccgagaagcagcacggaaaagccgactgcgaaagaaggcttacatccagcagcttgaaagcagcaagctgaagcttgctcagatggaacaggatatccacagagctcgttcccagggcttactgcttggagctccaggtggaaacaccagctcaggtgccgcaatgttcgacgtcgactacgcccggtggctggaggaagacagccagcgcatggctgaactgcacggagggctgcacgcacatctgccggacagcgacctcagagccatcgtcgacgacacgctaacccactacgaccacctcttcaacctcaagggcatggcggccaaggccgacgtgttccacctcatcaccgggatgtgggcgaccccagctgagcggtgcttcctctggatgggcggattccggccctccgagctgctcaagacattgacaccccagctggatcccctgactgagcagcaagtggttggtatctgcaatcttcaacagtcatcgcaacaggcagaggaagctctctcccagggcttggatcagctgcatcagtcattagcagaaaccgtggctggagggtccccgttggatgaccccaacgtcgggagtttcatgggtcacatggctattgccctcggccagctatcaaatcttgaaggttttgtcatacaggctgataatttgaggcagcagactatccatcagatgcacaggattctgacagtcaggcaggcagctcgatgtttcttggccattggagagtaccataatcgcctccgtgccctgagctcactttgggcttctcgccctcgagagatactggtggcagatgaaggcaattgtggagagctaagcattgcagcacatccatctgagagccaatattcagccttctgaaatcctgtttcaaatgtattttgcaactaaccttcaaagtagggagcaaaagcttgttttttaaatgaaatctagcactctagcagatatgtgagaaactcagaagagagttgggaaacaatggaaggctccagctgcactagcaaaattttcagatggaatgaatgggattgcatgattttcagttactgatc

SEQ ID NO: 5629 - DNA, 3130 bp, Oryza sativa
  Predicted polypeptide sequence is orthologous to G558, G578, G629, G1198, G1806
gacccaacccaacccaacctcaacctcaacctcaagctctcctcctccttcctcctctgctcctgctcctgctcctgctgctgccgtgtgctctgctggctgctcctgctggtgaggtggtggtctctctccccccacttcaccatctcctcctctccttcgccgccggcgcgcttgcttcctcctcagcacgccacctcctcgcccctcctcatagctcaatcagattactcgaccgtgcaaacatcctgaccattttctacagccccgcgctttagcgttcttgtttttttttttttggctgctgctgatttggtggcggcggctatcttggagagagatacagaatccgtgcttcttcttgagcgagctggttggttggtggcatgaggcgtggagagcttcagagtgagtgccatggcgcgtgttgattgctgttggtggtgagatggagggtggtaggctaggaggagcggcggcttcagcatcggcggcggcggcggcggacgcgcgcggcgggatgtcgggcttcgcggctcctcagcacgccatccatacaaatttgaacaacgtgcaacctactcaagttactgattttggggcacttgcgcagtctgctggattccgaatagaagatctcgctaatctcagtacaaatggtttgttcaatctgaagtcaaatgctcataccattatcaatgaccccctccaatttgagaattatgtaaagtctatttctccgtctaatattactacaacagcaacagtaacagtagttgaccctcagacactggtcccacaaaagggagcacaactgaatttggtaactataaggactggtaacgttgagaattggggggagtcgactattgctgatacaagtccaaggactgatacatcaacagatccagacactgatgagaggaatcagatgtttgaacaaggacagttagctgctcccactgcttctgattctagtgacaggtcaaaggacaaactagatcataagacacttcgccgccttgcccaaaatcgtgaagctgctaggaaaagccgtttaagaaagaaggcatatatccaaaaccttgagagtagcagattgaaacttactcagatagagcaagagcttcagcgggctcgtcaacagggcatttttatatcaacatcgagtgatcagtcccactcagcgagtggaaatggagctttggcatttgacatggagtatgcacggtggttggaggagcataacaaacatataaatgagttgagggctgcagttaatgcacacgctggtgataatgatctcaaaagtacagttgatagtattatggcacactacaatgaaattttcaagctcaagggtgtggcagccaaagcagacgtttttcatgtgctgtcgggaatgtggaaaacccctgctgagaggtgcttcatgtggctaggtggcttccgatcatctgagcttcttaaggtaagaatatactattattatattgcgcctacttattttgaagcctcacccggaggcaaaatgctgacctgaatatatattattttaattgatccaatatttttcttaggctctgttttttttgaaaggaatactaccaggcaatggcccagtagtgtattttatagaagccaacaaagtttttacagggaaaaaaagaaaaaatacaaaaggctacaaccccctatagaagctataaagtttgtaaccaattagaaaccaattgtctaagatcatcattcatcctacacatatgtagaagaatttcatgcttaaaagaattccaccagctgtcaaatgaaggatctatattctggaaaatctttccattcctttgcttccaaatgtgccaacacgcaatgaaataaatctccaagaatccttttttctgaaatctcaatcttgctagcaccagcatccttttttctgaaagaattctagagaagtgttccaagatattcccagcttctgccaacattttctactaaaagggcattgaaagaacaggtgagacaaagtttctctgtcatgcaaagggcataagacacaagtaagatcagcatttaggggggcgtattttctcctgtccaacatgtctctcgtgttcagcctatcagagaaaagaagccatatgaaaacttttatcttcatcacacatttgctcttccagatccatcggaaaggtctgggaggttgcgtggatgcaaaattcaacttgtaaaaagcttttgaggtgtaattgttcctgccccatataaaactccaattatccccctgctgacttgctaaggacagagcatccagctctccctttagcagcagaaattctgtgtaagcttcctgggtcagtggcaacttaaaacaatcctcaaaaggtttagcacaggtgacagccaaggaatcatttctggcaatggcatggccacatagatgtggttactggcagggcaattagagcctcttacagagcagcagcttgctggcatagccaacctgcaacaatcctcccaacaggctgaagatgctctttctcaagggatggaagcactacaacagtcgcttgcagagaccctggcatcaggatctctcggccctgcaggatcttctggtaatgttgcaaactacatgggacaaatggcaatggctatggggaaacttggtaccctagaaaacttcctacggcaggctgataatctgcggcttcagactcttcagcaaatgcagcgcatattaaccactcgccagtcagcacgagctctacttgcaataagtgactacttctcccggcttcgtgccctgagttctctttggctcgcccgtccaagggaataaataaattgaattgattcgtaagtaggatattgttaggtaatgtatctctagtgttatatcagataggaattgaggtattccctacttcctagattcttcacaatgttcatgtattggtgacagactcggatcactatctttccatgtatgtcttcaagtgaatgttcaatgcatattgtagtctgtatatgacatcatatgatgagttgttgggcaaatttgtaacatttttgagaaaagtggggatgtaaatacttgcagaataattttagagcttatccagtgatt

SEQ ID NO: 5630 - DNA, 2651 bp, Oryza sativa
  Predicted polypeptide sequence is orthologous to G558, G578, G629, G1198, G1806
gtgcgctgttcctgcctacgagcgagagagagaatctcatctcgatgctgaacaagtaattttcccggttctgaatccgttcaatcatccaggaaaaatgtccggaattccaggtaagtaattttctctaatttcttatcctgatcagatttatagtgagattcaggggaatagagatctgctggctttttcatcggaaaatttcgctgaattgcgttcgcgaaaaaaaaaattcgctgaatttcgtacagcggatgatgaggattgaaaaggttgggtgctgcaaaagcgagagggggtggggaaagaagggcgcaagaccaatcaagccaaaaggaaggcaatgccacgaaggaatcggctagggttagccatccgcagccacagccgaggggttagcgggtttagccctagcccaccatgactgttgcggcgcatttcatctcctcctcgccgaggggaagaaaaaaccgcatcgcgacggcgacatcgggggggcctctttaataatgcttccatcagagagcatggccatggccatggccacgaccttgatcttgaggttagccggggtcgaaaggttcttcttcttttgcgcctttatggcaaaggggaattcttcgtcgtcacgcaccaagcgttacgcaattcgcaaaagaggagggagggcagctgtggctctttatataaccctgcatcacttcttctggctaactggtgtcctttggagctgagctacatagcacatccgtggagtctcttgtgctaagcaatttaccgttccagtgctctactttgtaggccatccatattagacggaagaactttatcagtattattattggaggagaccaattcaagaatgatataatggagctttaccctggctatcttgaagaccattttaacatccacaagcttagtatcagcagcgcctctcctccggagtacatgacctcggcgtcgacgcagttcgcggcaccggtcagaatgggggcgtacgaccggcctccgccagttggcatgtggagtcacgagcagttcaaggttgacaacggccaggccacgagtgcatccacgatcatggaggcagagatgaaatttgagaataggctagaagaaattccccaagtagttctggaggaagggagaaatgttgatcaggaggcaagcaagccgccagacaaggtcctcagaagacttgcacaaaacagagaggctgcacggaaaagccgcctgcggaaaaaggcttatatccaacagctggagacaagccggttgaaactagcgcagttagagcaagagcttcaacgggccaggcagcaggtacacggataacaatttgttgtgcagccacttcagcttacacttgtgtcactgactccattgcaaatttgcaactgctctgatgcaggctgtgtatgcaaatgggagccttcgagaaccaaatcttggatttacaggaccgatcgatccaggtgccttaggttttgagattaagtacagccattgggtggacgagcagaatcgcaacactggtgagctgaggaatgcgctgctgcaggggcagacgacggaccaggacctggagctcaagttgctcgtcgaggctgggctcgacaactacaaccgcctcttcgagatgaaagaggaagccgccaactccgacgtgttctacatcatgtcgggcatgtggaagacccccaccgagcggttcttcctgtggatcggtgggttccggccatcggaggttctcaagaatttgagaccgcagctggagcctctgacggacaagcaggtcgtggaagtgggcggcctgcagcaaacctcgatgcaggtcgaggacgccctctcgcagggcatggacaagctgaagcagacgatcgcggactccctgacggcggccgacccgttcgactcccccgaggcctacatggtgcacatggccaacgccgtggagcagctcagatccctcgtccagttcgttacccaggcagatcatctccggcagcagacgctgcaggagatgctcgatcctgacgacgcggcaggcggcgagggggctcctcgcgctgggggactacttccagcgcttccgagcgctgagctcgctatgggcagctcgcccgcgcgattcagggataagctaaacaccgtaatatggtcacggtagaagctactgatatcagtagcaattcgtcgtgttagttcgctacttcagtgtcaggtcaatggccagtgaaggatgaagagatctttctacctgtgcttcgtcgaagaagaacaactcgtgatcgactttctgcagcgccgctgcaactgcaatccaaggaatggtgtatgttcgcctgctgagatgaagaaataaccaaaattaactttggtctttctgatgtgggcacaagagaagatgtaatataatatgtaaatatatacatgttttgggtatcattgccagaggcctctacagctggttttatagacatgtgatgtaattatctgtaactagtgttgctcggttcctcctccctagtacggcagacataggtgacatactgccattgtattgtatgggagaacaaattagttcacttgagaactagaaaaacatgcagtgatgttttgctgaagttgaagtagtttctgccacc

SEQ ID NO: 5631 - DNA, 1605 bp, Oryza sativa
  Predicted polypeptide sequence is orthologous to G558, G578, G629, G1198, G1806
atgagctctgtgcgctactgcttgggcagggacttccagcctgctgccgcggcagctgcctacttcggcgagctggaggaggccctcatccatggcgccaacgccggcggcgtcgtcgatcccggcatgatcagagccgacgtgcacagcaagtcggcggcagcggcagcgacggcaggatatctcgcggccaggccccccacgctggagatcttcccttcatggccaatgaggcagcaacagcagctacacagtgggaattcgcagtcagtcgggagcaccactgactcgagctcagcccagaacacaatgccgcagatggagttggtgtccccagcgagtatcagggcctcctccgagcaccagcaccagcagcagcagccggggcaggaggtcatgatggtgaccactgatgattacagctacaagccaggcctcgctgctgcctccccaagctttcagcagcagcatcagctccagcaccaccagcagcagcagctgcacggaggaggagaccatgacaagaggaagcatggatccacaagaaaagatggcaagtcagtggatgccaaggcttatgtgcaaaacctagagaccagcagggtcaggcttcagcagatcgagcaagaactccaaagagcacggtcacagcagcagctgcagcctgcaagcctgcagcttgcagacgagggtgtgcctcggagttctcaccacggcgcagtaaaatcgtttgcaggcgcggccatgttcgacatggagtacgcgcgctggctggacgacgacagcaagcggctgaccgacctccgtggcggcctgcaggcgcacctgctggacaccaaccttggcctcatcgtggaggagtgcatgcagcactacgacgagctgttccagctcaaggcggcgctcgcgcgctccgacgtcttccacctcctcaccggcacgtgggctacccccgccgagcgctgcttcctctggatgggcggcttccgcccctccgaccttctcaagatactgatacagcagctggacccgctgacggagcagcagatgctggggatctacagcctgcagcagtcgtcggagcaggcggaggaggcgctcgcgcaggggctgcagcagctgcaccagtcgctcgccgacaccgtcgccgccggcacgctcaacgacggccccggcgtgcccaactacatgagcctcatggccatcgccctggacaagctcgccagcctcgaaagcttctaccagcaggttcaggattgtagtgatcattctgcaaaaacaagtcctctacgatgcatggtgaatagatcaggttgtgttagatatacttgcatgagaaaaaaggtgactaacctggcaaatgtgcaggctgacaatctgaggcaacaaacgttgcatcagctgcggcggattctaacaacccggcaggcggctcggtgtttcctctccattggggagtattaccgccgcctccgtgctctcagcaacctctggtcttcacgtcctcgcgagaacttcattggcaccgagagcgtcagtcccacaggaaccgagctgcaaccgatgcataatcagcctcagcagaatcagtactcaggattttga

SEQ ID NO: 5632 - DNA, 780 bp, Oryza sativa
  Predicted polypeptide sequence is orthologous to G558, G578, G629, G1198, G1806
atgaggtcccgcatcttgtggatgagccacgctgagcgcttcttcatgtggctcggcggcttctgttgctctgagctcctcaaggtacttgagagccatcttgagccgctgacgaatcagcagttgatgggcatctgcaacctgcagcagtcgtcgcagcaggccgaggacgcgctgtcacaggggatggaggctctgcagcagacgctaggagacacactggcatcggcggccgccaccgtggtcgtcggcggtgtaggcgccgacaacgtcaccaactacatgggacagatggccatcgccatggccatgctcaccacgctggagaacttcctcaagcttcggcagcagatgcatcggatcctaaccacgaggcaggcggcgcgggcgctgctcgtcatcaacgactacttctcgtggctccgagcgctaagctcgctgtggctggcgcggccgagggacgcgcgtcacggcatggcagagcgcgcatcgcaccgaccgcgcccccggcggcacggccaggtacgcgccgcagccactgcatcccgctgtcggcgaccacctccccacccaccggccggcctgcccaagaggagaaaagtgagagagagagagaaagagagagaggaggaagggagaggaggggaaagagatagggtgatgacgtggaatcctggcatgtggggcccacatgggttccacgctgattcagccgtcacgtcagacaaaaccgcggtcaaaaccaccgagggacctaaagtgaacggttttgtaagttga

SEQ ID NO: 5633 - DNA, 3528 bp, Oryza sativa
  Predicted polypeptide sequence is orthologous to G559
aagcgaaaaaccgagtttgtatactcgataaattaagaaaaagttgagcgcgccgtaccgcccgccgcagcgccgacgcgcacagactagggccggtgccactggtggtggctgtggggtggtcgtgggcggcggtctgcgcgtcggcactgtccggcacgtcttggccggtgcaggcgcggccgtcgaattggccgcagacaccgcctcagcaactgtcacaaccaacgagtcgaaacgcgccggcgccgctgtcgacgacggcgatggaacgctggagcgggtggtgcgcatcgcatgcgcgtgtctgtccaaattcacgcccgaaaagagccgcactgtggcggtgcagctcgtggagcgtgcgtttgggcacacacgcgcgaccgtgacgcgcgctaaattgcgtgcgattgccgcgctggtgctggacaaagccgtgactgaaccggcgtttgtggtgtgttatgcggactggactcacgcgctgtgtgagcagctgcgggcattgacgcccgccgataccgacgcggccgcagctgcagccgctgcggccggtggtgtgtcggtggctgacggtgacgcggatgcgcacgcgcgcgtgtgtaccacacccgacgccgcgtactgccaggcgctagccgacgccgtgcgtcagcggtttgacgacacgtttggtggcgctgctgtcgtgcagcatcctgctgcacccgcgctggcgtcagcggacggcgctgccgtaccgccacagtggcccgatctggtggtggtgcacgaattggagtcactgctcacccgcgagcgcgacgccgacgacgcgtttgtgcggccgcgcgaacgcgacgacgaacggcggcggtctgtggccgaccgggagtgccgtcgcgccgccgcactgtgtcacttcattgccgcgctcttggacgttcgcggcatcggcagcggcgacggctcctgtggtggtggtgagcagcatgaggctgctgcgggcggcgtcatcgcatggccgtggatgacgcatgtcattggcgtactgtgcggtccgcaggcaccaccgcgggcgcacacgtcagcgtgtggcgcagcgtatggtcggcctgggcggcgaccgaacaacggcgcacgctaccggccgctctggagcgtttgggcgctgccgtcgatgcggcggtcggtcacctgcgcgtgtggtgtggcgaaccatccgccgatgcggttgccaaaggcagtgcgcgacgggccgctatgcgccaacgcctgacaccggacgtttgtgaggctgtcgacgcgctatgcgcgttggctgcacagcgctgggcggtaccatcagctgcctcagcgggcacgggcccgcaccggcaatcggccgcagtgcgcagactcgtcgcggcgcacgcacaggctcgcgcacacgcggtgcgctgtctcgcgtctgcggttgcggctgcggggcacagcgcgccggtacgagcagttgttgcggcggcagcggcagcagccggtccggctgcatgtgctctcagcgcagtggctgctgcggccgcacccgcaaccgacgccgtgatcgctgccacgtcgccggcgtcaccaccgctgcgcccacagcgcgtcatgtcagccgcggcgccgcctgcgcgtcggcagccgcaacacagcgacagcggcggtaacgaaggcgttggtcactttaaggcgacgcgtcggctcaatgcaagcgcccgcgtgtttgtgccgcgcactgccgtcactttaggcgctgcgactgcttcaccgccgccgctcctccctgccggcgccgtggccgcggcaggagccgtggcagccgctgctgtcggcccgccgccgtccgcagtggcgctgcctgcgcgggagcagcggcagcaaccgcaacaccaacacccgcaatatcgcggcgacaccgatgcggacgcggaggagacgaaggaaacggcggcgcgtgcacagtggcgacggcacgtgtccgcacttatcggcaaactcacggcggagacatgcgagcgcttggccctgcggtttgttgcggactcaccgggcagtttcggggcggacgtaccggaacgcgtgcagcgcgtgcgcatggccgatgccgtggcccttatcgtgtactatgcgcagagcgagtacatgtacacgccgatgtacgcagcatttatggcgcacgtgcgcgatgcgtttgcccaagccgatgtagcactggcggcggcggactccgctgctgctactgctgttcccacagcccctcccggtggtgccgctccggacggcaacagacaccacaagcccgcacggctgcccgcagtactgccgtgggatcgtgcacgggcgtggtttgcgaccgtgagcgagtgtgtgacgggcgaagtgaacgacttttttggtgccgacgcctttctgtgcactccaacgctggccgacctgcagccgcacaccaccaacagcagcagcagcagcagcagcagcagcaacaacaacaacaacaacaacaacaacaacaacaacaacaacaacaacaacaacaacaacaacaacaacaacaacaacagcagaagtgcgtatggcattccgctcgacagcgatcacgctgcggcggctgtcgtcgccgacgcagccggtgccagtgccggtgacggtatcggtttgccgatcgcctgcggtcattacgtgataccactcggcgggtggtgtgcagcggcgaacacagcggcgcgcgaacacgcctccggtgacgcctgtggtgcgtgggagctggtgccggagatggaggccgtcaaagtgctcgaagacctgctttcgtccgacggtgagcatcccgcgcctctgcacgctgcgtcgatggtcgctgctgagcgcgaacggcgccaacagctcatgacacgcgtacggcggcgcatacacgggtgtgtggcgttggtgtgcgaactgcacgcacggcacatggcgcggcgccgtgtgctgctgaccgtactgtggggtttgcgtggtgtggcgttggggaccggtaccggcgtagcggcaccgccgttttggtatggccatgcgccggtgctgccgcccacgtgggcgctggagatgctgtgccgtgcgctgagcggccgtctcggagccgcactgatgccgccatcacagccgccaccacagtcgccaccggcatcaccggcatcggcagcgccgtcgccagcactggcaccggcggtcagccgcgccggagagcgcgcgttagcgcttgcgctcagcgaactccacgcactgagcgtgcgcaaggatttgctgccgagtgcgcgcgcacgcttcctggtactcgacacactcgacgatgccgcacatcactgggagccaaattggcgcgcgcgggaacggcgcacgcgctaccaacagcagccgcagcagcacccgcagcagcaggcgtcaggggttggtgccgcagcgccgttgacatcgtagcagttcagtgttgtctgtgttttcagtctcatttgccgtcggcagtctgagatgtgccattggtct

SEQ ID NO: 5634 - DNA, 1805 bp, Oryza sativa
  Predicted polypeptide sequence is orthologous to G559
gactccgattcctcttctttcgcccaaattttggctcaacatttcgcagcgcaatctcgagctgaatcttggggggtaaagctttgcttcttggaatcttggtgcggtttttgggggagatttgcgagcgtttggagccgagaagatgaacagggagaaatccccgatcccgggagacggcggcgacgggttgccgccgcaggccacccgccgggcgggccctccggcggcggcggcggcggcggagtacgacatcagccgcatgccggatttcccgacgaggaaccccggccacaggcgcgcccactccgagatcctgagcctccccgaggacctcgacctgtgcgcggccggcggcggcgacgggccgtcgctgtcggacgagaacgacgaggagctcttctccatgttcctcgacgtggagaagctgaacagcacgtgcggggcgtcgtcggaggcggaggcggagtcgtcgtccgccggcgccgcggcggcggtggcggcggcggccgccgccgccgcccatggagcgaggccgaagcaccagcacagcctgtccatggatgagtcgatgtcgatcaaggctgaggagctcgtcggggcgtcgcccgggacggaggggatgtcgtcggcggaggccaagaaggccgtgtccgcggccaagctcgccgagcttgctctcgtcgatcccaagagggcgaaaaggatttgggctaacagacatctgcggcaagatcaaaggaaaggaaaatgcgatatattgctgaacttgagcgcaaggtgcaaaccctgcaaacagaagcaacaacactgtcagcccagttggcactgctacagagagataccagtgggctaactactgagaatagtgaactgaagctacgtctgcagaccatggagcagcaagtccacttgcaagatgctttgaatgacaccctgaagtctgaggttcagcggcttaaggttgcaaccggtcaaatggcgaatggtggagggatgatgatgaacttcggtggcatgccacaccaattcggaggcaaccagcagatgttccagaacaaccaggccatgcaatctatgctggcagcacaccagctgcaacagctccagcttcatcctcaggctcagcagcagcaggtgctgcaccctcagcatcagcagcagcagccattgcaccctctacaagcgcagcagctccagcaggcggcacgagacctcaagatgaaatcgccgatgggcggccagagccagtggggagatggcaagtcaggaagcagcggcaactgatgcgtcatttacaaatttacaaaaaaattccccaaagtttcggtgtaaggttgtggtttaacaaccatggagatggtctgtttcattgagatgatgatgatgtgcaagagtagttatcatcatcatcatcggtaggttcaggttggcttcagcttcagtcatacagttgggtggatgttcagttgaagagtttatctgtagctggttcagtaaggaaatggtcgaataatcaagaattccaggttaaaatctttcgtttctttggtaaggtagcacatcaccaagatgtactgttgtagtgttgtctacagttccataaattcaagtagccagtatacgctgttgtttagtttttctccggttttttagaggtagaggcgtttctagtgttaatcgagaggtatactgtataccttctgattaacatgtaaatcactcaacacctctacctccataaggaccggagaaaaactcaattgtttaattaagatgccattcatgactagatgttctctgtc

SEQ ID NO: 5635 - DNA, 1879 bp, Oryza sativa
  Predicted polypeptide sequence is orthologous to G559
cagactctccagacagaagcaactacactatcagcacagttgtccatgttacaggtactttattttggctttaccttatctcatactttgtgcatccatgatttagacactctacaccaatgtttagcagttggttctactctactagacaaatgcctcagccccatgaaaatgtttatttaggtacatgcctatgcttttaacttggcattttttacctggcaggcttcctattatctgtgttagtataaggttactaaacttgtaggttattctaaatttcatgctggttgtatatcaagtgaagctatttgacaaagtgctgcactgctgcttgttctggaaattccgacaacccatacctaggggtggtaatgggcccatcattttgacctacaaaatgtgagggttgggtccaaaaaggtttgggctgaaatttagaatttttttgtgctaaaaatatttaagggttgagatgggttgtgaaaggacccacaggccaccccgaccctgtttcctctatctgagcagtaaccatttatggtagttaggatgttaacatctgatttattttttccagctgcaaatacaccttttgtatcctacaggttgatactgttaacatattgcagattatgtagtttttgaaggaacttacttttcagttttccacgagtctatccttgattatctctacctgaataatacagagagataccactggtttaacaagtgaaaatagtgatttgaaaatacgggtgcaaacaatggagcaacaagtcaggctgcaggatggtaaggttttcatatcatcgcagtaattctaatcgaattgccatatattttgagaaaaaaaaatgaagtgtcttcatgacacactaatttatagtatatataactggaaattacttgagcctattaagtattgttttcttttctctttattctcttgcgtcttcgttggaataatatagtgtgatattatcttcaattttctcctgatattttctttttcatcacctagtgatcgaagtgatattattgttttctctaccccttttgctgagttattaaccttttgtctatggtagagacgtaacaaaaaatcatataacaagatataagttgtatgaagaaagtaagcattagttaatgcaaattatgacttaggatatcatctttgataggcttcagatcatttattactattttgtaggtgtcacaaaaactctcctacagtgtttttccaatcatctttaggattgtaactgttccttgtttgcatgtagcactaaatgacaggctaagagatgagattcagcagctaaaggttgcaacaggtcaggttaatgccaactgcggcaaagtgggaaactttggcctctcctcatttggaggcgccaatccacaaggttaccagcgcagtcacatacaatctcttctggcagcccagcagctgcagcagctacagatccactcccagcaccagcagcaacagatgcatctgcagcagcatcatcatcttagcacggtccaacagcagcttctgcaggaggggttgcccttgccaggggatctgaagatgaaaggaattgtggcggcatcccatgcacagaacgccggcgcatctgaaagccacgctctgaggagtgagccgtgagttggcataggctcatggcggttgtcagtaataataacatgttgtatctgagtgactcatgcataggctagcgcagtatctaggtaaaatttcagactatctatgaagcacttagatgcctgcagcctgtagaatgtagatcccattcagttgtaagttgtagaactgatgaggcaaaactgagtaattcaccggtgccatggagtatgttcacgtcat

SEQ ID NO: 5636 - DNA, 516 bp, Oryza sativa
  Predicted polypeptide sequence is orthologous to G559
atgccggactcgccgccgcggcgggcggcgaggcaccgacgtgcgcagtcggagatcgtcctcgggacggacgacattgcctccgacgccgacctcggcgtgttcttatttggatatgaaagtaaaaatgatgagaggtttatatgtatgattttcatgttatcgttatataagtgtgagactaatgtttactcgagtcatatcttatttagtctaatttacattaagaacagggagatcatgaagagccgccagagccacaaccggtcagaccgagcctgtcagggttatggataccacatacctaatagtagttgcctaaatctcggcagaacccactacataccatgtcctatacggaagcaaccttcggacataggaggagttccggataaggaaagacaaccaaagttctacatggaaacgacaagtactactcggattgtatccatattggtttccctagttctacttggacaaggggacacctatgggtataaatacaagctcccctag

SEQ ID NO: 5637 - DNA, 406 bp, Oryza sativa
  Predicted polypeptide sequence is orthologous to G559
cacgcaatttttaataacaattcaacagattatttgtcaccaagtggtgaaactggtgccaatttgaatggaggtaacgtcgaagaatgtccatcattgaacattgatgattctacaggtgcagcatcaccagcaggagaaccagaaccagcagcgttagaatcaacagcagtagaactagcagaaccaggaccaacagcagttcaaacagtactcgataaaaaagatgaaggcggcaatgttcaagctgattcaaagtttgtcaatcgtgcaacgggcacaaatggtcatgaagcaacttctcgtagtgataatcactatgaccaatgaacttcttcgtttttgtttgttttaatttattctcgcataatatccagaataaaaacaaaaaaagcttcgtagtttg

SEQ ID NO: 5638 - DNA, 1548 bp, Oryza sativa
  Predicted polypeptide sequence is orthologous to G561, G562
agcgcgcctcagcctcagtacccaccacctccacgctcgcgccgtcggcttcgtgctcctgcgccgccgcaccgatctgcaccgtacgcgggcgtcgatccatccaaggaactcataaaaagtcatgggaaatgacgaagctgtagttactcagaagatggggaaagcaccatcgccccctaaggatcatccagcccttagtccataccttgattggtcaaatatgcaggcatattacggcccagggatcttgccaccaacattttttagccctggaatagccgctggtcatacccctcctccatttatcttgggtcctcagcctctggtgccatccgcttttgggaagccatatgccgcaatttatcctcctggtggagctttttcacatccgttcatgcccctaatggtgagcccattgagcatggagccagcaaagtctgtcaacagcaaggatagctgttcaaataagaaaatgaaggaaattgatggtgcgactgtgtcaactggcagtggcaacagtgaaaaaacaagtggagattgcagcttagaaggatccagtgatggaaacaaccagaaggcaagtggaactcccaagaaaaggagcatagatgataggcctaaatcaggcgtggaaactggtggagctttaacacctaatgatagacctagcgaacaagcagctttgccaaatctatgcattccggttacagcaatcaaaccagacgtgagcactgctagtgacttcagagttattgccaccccagtaactgaagtgccaactaaggatgataaggaatcgaagcgcgagagaaggaagcaatcaaacagggagtctgctcggaggtcaaggttgaggaagcaggccgagactgaggaactggctagaaaagttgagctattgactgcggagaacacatcccttagacgtgaaataagcaggctaacggaaagctccaagaaacttagattagagaattctgctctaatggagaaactaacggaaaccgggcctgatgaagcacaagaagtgcctccagtcaaaacaaaagcacagcaagctcgaggcgtcgaaaatttcctgtcaatgatagacaagactggcacgccgagaagcagcgggcacatggatcatgccattgccacgcccaagcttcgtcaactcctgggctctggtctggcgactgatgctgtagccgcaaggtaatcttaacgacttgaccctcccgccgttcgtgctcaaacgcagcatgtggcctggtgaattttataagctcaacctgcccgcacgattaacatcgaagtattaggtacgattttgtcactgtattcgcccttgtaaattactagtagctgccttttagacgagcattccaaccgctccaccgggatatgaatgcccccctggccgtcagttcttccctgagtttttactctactctcgtagatctgtaacatcagtgctggctcgcgttgttcatatcaaactgatctctgtaaatactgtaacactgacagaaagccttctaactttgatcttttaccttt

SEQ ID NO: 5639 - DNA, 1853 bp, Oryza sativa
  Predicted polypeptide sequence is orthologous to G561, G562
gggagatcaatctgctttcacgtctcctctctctctccgcgtgcttcctccgagggtctcctcctccaccgccgtctcgcttcccggcacgcgcgcgcgggcggcggcgagctccctctccttcgccactcctccaacccctgtgcggctactccggtgcggagccggcgagcgagcatgttctaagtggctctcttccttaaatctctctacaagaggcaattgaattgaagacagcaggctttcataaaaggcatggctcatgatgaagctgttgctacacaaaagattgggaaaacaacctcccctcctaaggatcaaccaactccatgtccatttcctgattggtccgctgttcaggcatattatggccctggtgtcttaccaccgacatattttgccccagcaatagcttcaggccatgctcctccaccatatatgtggggtcctcagcctataatgccacccccttttgggaccccgtatgctgcaatgtacccacacggtggagcttatccacaccctcttatgcccatgatggcaaatccattgagcatggaaccagccaagtctgcaagcagtaaggaaaaaggctacaacaagaaacttaaggaagttgatggggctgcagtatccactgggagtggtgacagtaaaaaaacaatgacgtctagtggggattacagtgcagaaggctctagtgatgtaaatgatctaaaggtgggcaagactggcaggaaacggagattggatgatggagctggtgctgaaacatcagcagctgcaaagatggaaaatgctttacctcccagccatatattgggaagtactgcgattttgccaaatcacagctttccagctcaagtaattaggcccagtgctactaatgttgctaattcgagggcattgggcacaccaatatctccaccgcctggtgtgattgttccaagtcatacaggagtatcaacagaattactgatcaaggatgaaagggaattaaagcgtgaaaagaggaaacaatcaaatagggaatccgccagacgatcaaggctgagaaagcaggctgaaacggaggatctggctacacaagtagaatcacttacagcagagaacacgtcacttagatctgaaatcagtaggctatcagaaagctccgagaagctcaggctggagaattcggctctaatggggaagcttaaggatcctgcagcatcgacccaggcagaaacatctctgcagaaaaccaccacagcctcctctcctcgcgtcgtggagaactttttgtcaatgatcgacaacacgaacaagacgagtgtcagacacacagagcatgctgaacccaagcttcgacaactcctcggctccggcccggccactgatgttgttgctgcaagctaatctgccattttccctgtcacagaggagagactacgcgcatgcggcctggggattttgcaagctcacgctactactcacataacattcggcagtacagtgttaggtgtcaatttggtcagtatattcaggtgaccatctactactcaaaataccgtttccaattgctgttccctgctcaggcatggaagcttgctaggtgagaccaatgtaccacgttttagcagtgttgtaacataggggtgttgtgctgcatgccaacctcaaaccttgtgagatcgctaaacactttttagaattgaaatttgtggagaccaaactaaatgaaatgtaacctaccctttttacttgggtatatgggcccatattctttacatggcttggaactgtaactttgtaagatgtttttagtcaaacttctttaaaatttatatttataacactaaattagtttcatt

SEQ ID NO: 5640 - DNA, 1950 bp, Oryza sativa
  Predicted polypeptide sequence is orthologous to G561
atgggcgtccatgtcttcaccgaccggctggccatcgccgccgattggtgcctccgcctacacggctggcctattatgccgccgctgttgggcgtctacgacttcaccgccggcctgcctccgttgccgccgactggtgtcctcgcctacacggctggcctattatgccgccgctgttgggcgtctaccacttcaccgccggcctgcctccgtcgccgccgattggtgcctccgcctacacggctggcctattatgccgccgctgttgggcctccgtcgccgccgactggtgtcctcgcctacacggctggcctattatgccgccgctgttgggcgtctacgacttcaccgccggcctgcctccgtcgccgccgactggtgtcctcgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcccgcctccgttgccgccgagtggtgccaccgcctacacggctggcctattatgccgccgctgttgggcgtccacgacttcaccgccggcctgcctccgttgccgccgagtggtgcctccgcctacacggctggtctattatgccgccgctgttgggcgtccacgacttcaccgccggcctgcctccgttgccgccgagtggtgcctccgcctacacggctggcctattatgccgccgctgttgggcgtccacgacttcaccgccggcctgcctccgttgccgccgagtggaatggatcagtcagaacatcacccccggctcgcctcgaccgccgccgactggtgtttccgcctgcacggctggcctttatgccgccgttgttgggcgtctacgtcttcaccgaccggcttgccttcgccgctgccgactggtgtttccgcctgcacggctggccttcatgccgctgttgttgggcgtctacgtcttcaccgaccggccgcctcgtctgccgccgactggtgcttccgcctgcacggctggcctttatgctgccgttgttgggcgtctacgtcttcaccgaccggcttgccttcgccgctgccgactggtgtttccgcctgcacggctggcctttatgccgccgttgttgggcgtctacgtcttcaccgactggcttgccttcgccgctgccgactggtgtttccgcctgcacggctggcctttatgccgccgttgttgggcgtctacatcttcaccgaccggccgcctcgtctgccgccgactggtgcttccgcctgcacggctggcctttatgccgccgttgttgggcgtctacgtcttcaccgaccggcttgccttcgccgccgccgactggtgtttccgcctgcacggctggcctattatgccgccgttgttgggcgtctacgtcttcaccgaccggccgcctcgaccgccgccgactggtgtttccgcctgcacggctggcctattatgccgccgttgttgggcgtctacgtcttcaccgaccggcttgccttcgccgccgccgactggtgtttccgcctgcacggctgacctttatgccgccgttgttgggcgtctacgtcttcaccgaccggcttgccttcgccgccgccgactcgtgtttccgcctgcacggctggcctttatgccgccgttgttgggcgtctacgtcttcaccgaccggcttgccttcgccgctgccgactgcgttgattggccttatcttcttcaccgccggtcgtctcgtctgctgctgactagtgccctcacctctacgtctggtttatacagctaccactactga

SEQ ID NO: 5641 - DNA, 897 bp, Oryza sativa
  misc_feature (608)..(608): n is a, c, g, or t
  misc_feature (658)..(658): n is a, c, g, or t
  misc_feature (663)..(663): n is a, c, g, or t
  misc_feature (688)..(688): n is a, c, g, or t
  misc_feature (712)..(712): n is a, c, g, or t
  misc_feature (738)..(738): n is a, c, g, or t
  misc_feature (743)..(743): n is a, c, g, or t
  misc_feature (772)..(772): n is a, c, g, or t
  misc_feature (781)..(781): n is a, c, g, or t
  misc_feature (795)..(795): n is a, c, g, or t
  misc_feature (810)..(810): n is a, c, g, or t
  misc_feature (818)..(818): n is a, c, g, or t
  misc_feature (825)..(826): n is a, c, g, or t
  misc_feature (833)..(833): n is a, c, g, or t
  misc_feature (838)..(838): n is a, c, g, or t
  misc_feature (862)..(862): n is a, c, g, or t
  misc_feature (866)..(866): n is a, c, g, or t
  misc_feature (880)..(880): n is a, c, g, or t
  misc_feature (884)..(884): n is a, c, g, or t
  Predicted polypeptide sequence is orthologous to G562
gggatccccaaccgcgatgtgctagggtttggaggcccggtgttcaatcccatcttccctccgtgcagccgctaggatcagttttatcttctttctttctttctttccgtgtcattgttattagattagattctaagttccctgttgagattccttgctgctcatgggggcctgccgaaaactacctcacctgattacgttttgtttttggttttagccccttattttttttatatgcagatagcgctcgccggaaattccaagcagtatatagaattatagatcgccgacatgtgtaggcgtttcttgtttcaggaattctcgtccgtgctgtccagatcgatgcctaatcgtcctacctccgctgaaggaggaggcgtttctgctatcaacaatgtttttaatggagctctccgtcgttttagcacggtgattcccaataaccatggccttcctttttctcaagcaaagtgcctgaattctattcaaagccctaacgcagctaccaaagcaaaccacccaacaattggtgtgggttccttttgccagcccggactttcttctcttatacaaaaccctaccacctgccttctctgggtgaaaccaantacctggattatgcagcagcagactttaaagcgtaagtctgagtactagncctgnatcaggttactttcctggtacttgnaatgatggttaattggtggcttanccccgaatcttggtctgctatagatnaaccnaaattcagcttattaatttgggccttttntttattggngggatgcatttganagcatatattggcantggaggtncccgttnnatctggntacangggaccggctggttaaggagttancggnccaaaagaagaatngganttttttgggttgg

SEQ ID NO: 5642 - DNA, 1467 bp, Oryza sativa
  Predicted polypeptide sequence is orthologous to G565
ggtggttctcttctcacaggtagaaggaagcaatggcgatgccgcccaagcccggcgatcagccctccccggggcggagccccaaccccaacctcaacctcccctgcccgctcccgcccatccctagctgcggcggcggcgcgccagatctgaggtggccttccgcttcccggacgacctgggcctcgggggcggcgcggacggcgggggcttcgacgagatcggctccgaggacgacctcttctccaccttcatggacatggagaagatcgccggcgccgaccgcgaccgcgccgccgagacctcctcccctccccgccccaccaagcaccgccacagcgcctccttcgacggcttcgccttcggggccggtgcgggtggccccggccctggccttgggaagcagcaagacggagcaggaggcgtgttctccgaggttatggaggctaagaaggccatgtcctccgagcagctggccgagctcgccgccatcgaccccaagcgcgccaaaagaattctagcaaacagacagtctgcagcccgatcaaaggaaaggaaggctcgatatataacagagttagagcggaaagttcaaactcttcaaactgaggctaccacactgtcagcacaactgacactatttcagagagacacaaccggactttctgcagaaaatgctgagctcaagattagattgcaagccatggagcaacaggctcagctgcgtgatgctctcaacgatgcactgaagcaggaagtggagaggcttaagattgctacgggtgagatggcaaagtcaaatgatgcgtataatacaggaatgcagcaggtcccgtacagcccttccttcttccagctatctgaccaacacgcagttcagcaccatgcaggcgttcagcagctgctacatcaattccaacaacctcatccaagtgtccctagccaccagatgctatcccacccaaattccctctctgatatgatgcagcaagactcgcttgggcggctccaagggctggacattggcaaaggaccagtggctgtgaagaatgaggcagaggtagtggtgaagtctgagggtagttcaatatctgcaggtgaaagcaacagcacattctaattatagacctacatgtcaacaaattgctccgtccgtttagttttctttgttcatagtctgacatgccttcctgaactgcttccctctctcccactagtttttttttttcaattcaattctttcaattttagttacattgtttgtttgttgatcatcgtgtggctgatcatgtagagacttagatatgctcgtttggaaacatcgggtttatttcttgtgtgttgtgtgttgtttgatttagggggtgaggggcactgagtgggtttccagtgacttttatgtattcttttagttatgttgtagacttgttgtctttgaaaatatgtacatttttgtgttactatgct

SEQ ID NO: 5643 - DNA, 1612 bp, Oryza sativa
  Predicted polypeptide sequence is orthologous to G565
gggagccgaacactcgctggcgggcgcgcgcgcgcgcagccggggaaccgggggggagacagggtggtggtggtgaggcgggggcgagcgcaatgcaggagccaaagcacaccgatccggcggccatgcgcggggcgcaccaccgccgggccagatctgaggtcgccttccgcctgcccgacgacctcgacctcggcggcggcggcgcgggggcgttcgacgagatcggctccgaggacgacctcttctccaccttcatggacatcgagaagatctcctccggccccgccgccgcggggggctccgaccgggaccgcgccgcggagacgtcctcgccgccgcgccccaagcaccgccacagcagctccgtcgacggctccgggttcttcgccgccgcgcggaaggacgccgccgcatcgctggcggaggtcatggaggctaagaaggccatgacccccgagcagctctccgagctcgccgccatcgaccccaagcgcgccaaaagaattctggcgaacagacaatctgcagctcggtcaaaagagagaaaagctcgttacataacagaacttgagcggaaggttcaaactcttcagactgaagccactactctctcagcacaactcacactatttcagagagacacaactgggctttctgcagaaaatgcagagctcaagatacggttgcaggccatggaacaacaggctcaactgcgagatgctctgaatgatgcactaaagcaggaactggagaggcttaagctcgctactggtgagatgacaaattccaatgagacatatagcatgggactgcaacatgtcccatacaacacccctttcttccctctcgcccagcataatgcagcccgccagaacggtggaacccagttgccaccacaattccaaccaccccgtcctaatgtgcccaatcacatgctatcccatccaaacggtttgcaagatatcatgcagcaagaccctcttggccggcttcagggtttggacatcagcaaagggcctctagttgtgaaatcagagagcagctcgatctctgcaagtgaaagcagcagcaccttctaaccaggcctacccaccgagcccacagttccattagattcgtttgttcatagcctgacatcctcgcgctgctccctgttctgtaagcttattatttattcaattcgttcgatttagttgaaattgttcgtaattgcagtggctgatctattcccttctgtggacatgattcctgtacccctcacatccatttgttttgggttcatctcctgtgtgctgtgtttgggattatcagggcaccaggactggctttctccgagaatactgtgttctttgtggtcgtgtggacttgttcaccatggattcaattcaaccttttgaaaagatgcatgtattctctgatttttttttctcagtcatgtacatgtcactgttatgctagtttgattgatgtgtactgtggaatttgtggataacaaaaggagttaagattgggattgctgtggaaccatctgtatcgtatattcgtatgtgactaatgttgggaaattgttctattcttgttcaccatatgcatgtggggtaacttttcc

SEQ ID NO: 5644 - DNA, 816 bp, Oryza sativa
  Predicted polypeptide sequence is orthologous to G565
atggcgcacacaagggcgggcggtgcagcccggttgagtcgtttgctccctccgcccccatcgctcctcctccccctccaccaccgccgctggttgccgccgtcgctcccaccttcgggccgacttcctcacagccaccgtcgtcgctcctcctcctccaccaccgtcgctaccatttgtcacctacgctcccttccatcgccggtgcgacgcttctcattctccaccaccatcgtcgggtgcaggggccacggcaacgatggtgcttgtcttgtgcactgcgatgtcgcgggggcacgatcgttggtcgggggaggagaaggaggcgcagcgggaatggcgaaggcgccactgcaggcgccgcgactgttcaacatcgtgcacaggggctccaacgatgagcttcccgaggagacagtggtggcgtacatgcgcgacaaacccatccctggcggtgccggccgtggttgccactgcccttgtcgccacgccagatctgaggcagccttccgcttcccggataacttgggcctcgtcggcagcgcggatggcgatggcttcgacgacatcgactccgaggacgacctcttctccaccttcatggacatagagaagatcgtcggcaccaactgcgacagcgccgtcgagacctcctccctgccacgccacaccaagcaccaccatagcgcttttattggcaggtttgtctttgggctggtgcgggtggcggtaggagggctcaggagtcgtcgtcgccatcgacctcctgtcatctgccgtcgcaccaaccacgcgccaccgtatcagcaacactaa

SEQ ID NO: 5645 - DNA, 2067 bp, Oryza sativa
  Predicted polypeptide sequence is orthologous to G571
aggtgacatccaaacgaaaagcttcagcccccttctttatagccttttgttacaagtataaaaacaagggtgcaaacagaagtcagttttgccattaatgtctgattttgtatcttttgctagcaagaggggatgtgcatagtgtgaggagagagaggtacaacaagaagagagaaattaagagagcagtagtagaggtgtgctgcaggaggatggtcagggccttcataagggcttcatggggggctccagagaggaagatcgtcagcaccacaatcacctcccttctgagctccccctcggcttccggagctcctcaccgacgacgatgatcgcctcttcctccatgagcaaggaatcgagcaactacgacatggccgatttcgatcaagcttcgctttttctctacctagacagtcatgatcaacaatccatccaagaacaacgacaaactctgaacatcttcccttcccagccgatgcatgtagccgacccagctcatgaagcaaagagtgctggggtagccatggccatgcttcccaatggcaaccagctgcaggttcttgcttctcatcccagcaagaagcctgatcagcaaggtggtcaaaagattaattccagtgtccctactaatccacctggccctaatcttcccttgcctaactctgccaaggataacaagaatagtagcctcattaagaaggaaggaagcagcagtgggaagggtgcaacaacatccaatgatccagaaagagaaggaaggaggacactagaccctaagacactgaggaggcttgcacagaatagagaggcagcaaggaaaagtaggcttaggaagaaggcttacattcagcagttggagtcaagtaggattaggctaagccagcttgaacaacaagttcacgtggcaagagtacagggtgctatgctgggtgctggagatcagcaccagggccttccttctggcccttcagctgcatcgttgtttgacctggagtatgggagatgggtggaggagcacagcaagctgatattccagctgagggcagccctgaacgagcagatggcggacagccagctgcaggtgttcgtcaacggcgcgatggcgcagcacgacgagctgctgagcctcaagggcgccattgccagggctgacatcttccatctcctctgtggcgtctgggctacccccgccgaacgctgcttcctttggctcggtggatttagaccctctgaggccatcaaggtgatgcttaagcaggtggagccgttgtcggaggggcagctgatgagcatctacgagctccagcaagcggcgaaggggacggaggacgccctcagccacgccatggacggcctccagcagtcgctctccgacaccgtcgccgcccctgacgtcgccgccgccggcggcttcatggggcacatgtccctcgccatgaacaagatctccgctatggaggacatcgtcaggcaggcagatggcctgaggcagcagaccctgcacaagctgcagcatatgctgaccatccggcaagccgcccggtgcttcgtggcaatctccgactacttccaccgcctacgcgcactcagcacactatgggttgcgaggccaaggccggaggaggggccggcaatgtagaataagtgtctcagagaagatcagaacatcaacaacaatgcttgcaaaatttaacctggttaagaattaggtagttagctgcatgcagtgaattgaactagggagcacatttgaagagaggtgtatgtgagagtaatgctctctcagatgtgtaacttgcaactttgtaaggtgtatatagcttcttaggtgttagagaagaaaagaagtagggaatagtggaaacttaatttgaactttcttttgtttctttttatccctgactttttctacttctttgccagctatatgtaagttcacctggaactacatcattgatttggatagtgtttctaatacttgctggtaacaaaatcatgagataaatgctctaaggggaaaaaaaaacttccagagtctcatatcccctctgaaatttgttcgct

SEQ ID NO: 5646 - DNA, 2396 bp, Oryza sativa
  Predicted polypeptide sequence is orthologous to G571
gtgatgcagagggagcatggagccaaacagaaagtctgtttcgccattaatggctctcccactcacctctctctctagaaacacatagccaagatcatcatcatcagcaaccatattagtgaattaagaggaaatcaaagcagtagcagcccaggaacagcatcatcaaagcagtaagagagggtagtttgcaagtggtgctagtgtccaaggcgccatcacgaactagagtcctagatagagctagaggtcatgcatggggtagttgctggtgtggaagaggaagagagaaagtgagtgagagagagagaggtggcgccttggctgctagcctcatagagtcaaagagtatttaggaccttgcagctatggctatagatagatagaggcacatacgcatacgtatatagcttgctaccttgccttctctgtgtatgtttcggcgtgtgttcttcttcttctcttcttcctcctctcgattctgaagaggttagctttgatttgatcgatcgatgatgagcgggagcgagagccagcaggagagggagcatcgtcagcagcaggagatgaacatctcctttgggatgatgatgaaccatggccaccatcactacggacagcatcagcagcagcaccatcatcatccgcctccgtcatcgtcttcctcttcctccatgcatgccgctgccgcaagcttcatcaaggaggcatctgcaggagcttatgatcatctgggggagctggaccaggccttgttcatgtacctggatcatggcagccatgcggcgtcgcaccaagaacaaaggcagaccctcaacatcttcccttcccagcccatgcatgtggagccatcacccaagggagagattagtttagtgctgtccccagcagctgtgggaaccaagatggcgaggtcacctgatcatcaccaccaccatcagcagcaagcagcagcagccatggaggagttggcgacagggagcaggagacaggatcaccaccacctgcagcaccaacctttcgctgctgagcctgcagggatcaacagggatgtgaagccggtgacagccaagaaggatcacaggaggggtgtatctactggtgaacgcgacccaaagacgctgaggaggctagcccagaacagggaggcagcaaggaaaagcaggctaaggaagaaggcttacatccagcagctggagtccagcaggatcaggcttgctcagctcgaacaggaactgcacaccgcgagagcccagggggtgttcttccccggcagcggcgggctgatcggcgagggaggcagcgggaagggggtcctgctgggcgggatcgatggcgtcggcggcggcggcggcggggggctgagctcggaggcggcgatgttcgacgtggagtacgggaggtggcaggaggagcaccaccggctgatgtacgagctgcgggcggcgctgcagcagcagctgccggagggggagctgcaggtgtacgtggagagctgcctggcgcaccacgacgaggtcgccgccatcaaggacggcgccatcaggggcgacgtcttccacctcatctccggcgtctggatgagcccagccgagcgctgcttcctctggctcggcggcttccgcccctccgaggtcatcaagatgctggtggcgcacgtggagccgctgacggagcagcagatcgtgggggtgtacgggctgcagcagtcggcgctggagacggaggaggcgctgacgcagggcctcgacgcgctctaccagtcgctctccgacaccgtcgtctccgacgccctcagctgcccttccaacgtcgccaactacgggccagatggccgtcgccatcaacaagctctccaccctcgagggcttcgtccgccaggctgagaacctgaggcagcagacgctgcaccggctgcagcaggtgctgacgacgaggcagatggcgcggtcgctgctcgccgtctccgactacttccaccgcctccgcaccctcagctccctctgggtcacccgccccaggcacccgcctcacgaccaccagccgccgccgcactccgccgccccccacacctgagatcaccgccgccggcaacgcatgcaaacaccgtagctcttagctagcagcttagagatatcgagagatcagaaattaagcgatcgatcgagagaggacgacgactgtgaaaccccccatggaatggatggatggatggatggatgaaccgatgtgtactgtgtttgggcattaaccctttgatgtaaacaaagtaggcgtgtttgactgcttggtcgatcgatcgagatctctgtcgataggatcttgaattagcggatcttacctcagcaactggttcatcaagtgttgatgcagctcaatcaaactttttcctgatg

SEQ ID NO: 5647 - DNA, 2843 bp, Oryza sativa
  Predicted polypeptide sequence is orthologous to G571
gatcgattcctcccttggcaaatgaatggcacaccactcttcacgcacctctgctcccctctgttggtttccatcagaaagaaggaaacaagtttctctgcgtctccgatctgcagtgcgagccacgaaggttggcgtcgtctcctcctccctctcctcctcgcgcgcggctgccgtcgagaagacgctcggcctcccttgtgcggcctcacctcctcgcgctgaatcccctactccccgtgttagatttgaccttcataatccaaaagaagaggttttagttcaagcgaacgataatggggatatccaaggtgattggcatcgctggaacaactcttctagtcacgtctgttggtctgtggaagatcggcttaagaattgtcgcggttccttttctagcaaccagtactattgcctatatcatcgctgttgcatcccacaattccatcaacataccttggatcttgggaaagaattcaaaggggaggtttccaatttggtcaagtgtactttttggtcctttcttgatacttgcccgggtatatgcaactgtgaagagacatatgaggaagaaggaggctgtgtataacatgatcactgaaggtgtttatctgggaggatggccgtttatgttgaagcatttgcccccaggagacccgtctgttattgattgcacttgcgagttgccaagaagtgattttgtcccaacaaatgagtatctttgtgttcctacttgggatacaagagccccgacgatatcccaaattgaatttgcggcatgctgggcatgtgaaaagagagccaaaggaaaaccagtttatgtacattgtgcatttggtcatggaagaagcgcttgtgtcgtgtgtgcagttctagtagcattgggcattgctgaaaactggaaggatgcagaaaacatcatccgagaaaaaagaaagataaaaatgaatgctgttcaccggaaaaccttagacgattggtcaaaatatagagcttctcagaagaaggataaataactgacattaaatcatttgacatctcaggcaaattaccatgtgagttctatgcaatctgggttctgagaaatcttcctagttctggagcttgcattgtttcccagctcatatcagtgtttcccacacgtgtcagattacttccaaaatttgttcccagttttgcttacttctgctcctatctgaaggttagtcttcaaagtccttgtaaatcagaaagctgaaaattggctttcagatggttgtgctgctatgcttagctctccacagttgccttcatctgccaccaatatcctacaggcaaataaggctccagctataaatatatgatggatgcgtccagataaatagcactacagctgctgtcctattattcttttagacttttatagaatttagttagttggctgaaagcctgaaatagttgaaacatgcatagaaagggacaaaatccatatctagcccttattttgtacaccttcacatcattgtattttatcataatcttttttaggataagggactaccactagtttattggtgtaatgaccttcaaaattatgataaaataaagtgcatgcagtatgcatgatgtgcaaaaaaaagtttgctagcttttgactacctccagtaggaggctggtccattccatgctgatttaatagggtgcattccttatatttttttgtctagtaaataatggttcagttatatgtacttcgaactttccaatcagagattaaaccttcaacaactacaggtaggaggcttatcataaaataaagaaaggaaaagaattaattgcaggtaggactagagcatggtgcttactctcggggacgagaagcccagagggagctgagggcacggaggcgattatggtactcgccaattgccaagaaacatcgagctgcctgcctaattgtcagaattctgtgcatctgatgaagagtctgttgcctcaagttatcagcctggaaatccaatttgacagttgcagttttagtacatgatgaaaggatctcactcttggcactagaaaattgaaaactagagcagatactggtagtaagtttgttttactatgccatactatagttaatcagataagctccaaagtccaaaataaggataatgtcacatgtttaggtgaccattcttttctttgtatgatgtagagataacatctctacatgttgatgccatagcatattactgtaggaaaatttgttccttttcactctttattaattaacatgttggcatgtcgcattattaaaaggataaaaatgactgtttttttgctcgactgtcaagtgattggattgctcatctagacatccacaaagttgagtcaaacagggagagaaggatcagaactggaaaaagggcaggcaacaaggacttcacctgtatgacaaagccttcaaggttggacagcttgcccagggcaagggccatgtaacccatgaagctcccaaggctggcttcgttgaccacggagccgccattggcgacggtctcagctagtgactgatgcagctgctccaggccctgggagagagcttcctctgcctgctgcgatgattgctgaaggctgcagatgccaaccacttgctgttcagtcagagggtctagctggggtgccactgtctgcatcaacatcaagagtttgtaatgaaattagaaaaaccatacttgtacttagaagatgaggtcagatttagcatggttaaaacttgatttggcaaattgttttgcacattgtgaactgtgaagtgagcttcatgtttgatgtcagattgtcaggtgcattttcttatgaaaact

SEQ ID NO: 5648 - DNA, 1892 bp, Oryza sativa
  Predicted polypeptide sequence is orthologous to G571
aaccactggttcccgttccatttcttgcacaactactcctctagccaaaagtcatcctttagcttctggtcagaagaacagccgcagggcctgcttggaaggggattaatttgagcaagtcagcaggcaagtttgggagaggaacaaaaagtttgcgggtatcgataaattcatcggttgatcatagaagatcagatgggaaagaagcaggagatggatttggattactaggctgtcagataccatttcaagatgggtgaatcatgtctgaagtgattcagaaggaaggttgaagcactgctgtttagtttaaggaagtatttttcatggcttatccttccacctctggcatgatccaagcttcttcctccctccatggcagcatcacaagaaggaaccctgaaggatatgacatgccatctgatttggatcaagctctcctcctctactttgatggccaggaacaagataagccatctactcaagaagaaccccacaaaccacttaattttgtaaaagagactctcaacatcttcccctcccagccaatggatggagagccaactccaacaccaaaggcttcgatgtcagcgccgcccatcgccggcttttccaggagatcgccggcgccagcggcggcagatggcaggccactcaccctaggcaagacctccaaggcagcattcaagaaagaaggtggcagtggcagcggcggcgccatggcagcgtcagcaagttcagagctcaaggggcccaagacgccggaccccaaaacgctgagaaggctggcgcagaatagagaggccgcaagaaagagcaggctaaggaagaaggcttacattcagcagctagagacaggcaggatcaggctggcgcatcttgaacaggagatacaattcacaagagctcagggtgcattctgcggtgctggaattctaagcccagacgctgcattgttcaacttggagtatgagcggtggcaggaggcacaccaccaagtgatcagccggctccgggccgctgtggaggagcaccgaccggatggcgagctgcagccccatgtcgatgaagccatgtcacactatggggtgctgatggctcacaaggctaggctggttggtgctgaccccctccacctcctctccggcctgtggaagggcgccgtagagcaatgcttcctctggataggcggcttccgcccctcggagcttatcaaggttgtggtccggcatgtggagcccctgacggagcagcagctcgccgccgtctacagcgcgcagcaggcggcgaggcaggaggaggacgcgctcgacggcggcctgcaggcgctgctccggtcgctctccgacgtcgtctcctcctcggacgcgccgtcgtcgtcgcagcagacgccgccggtgatgtaccacccctccgccgccgccgccatggctgcggcgagcttcatggggcagtacggcagctacagcaacctgcagctcgccatggacaagctcgccaacctcgccatcttcctacgacaggcggatgaggagaggatgcggacgctgcacgcgctgcggcggatgctgacggtgaggcaggcggcgcgctgcttcgtcgccgtcgacgactacttcggccgcctccgcgcgctcgccttgttctggaccaccacccggccgcacccggccgccggctagaaatcaattgaatcggcttagcttaggttattagccacacacgcacacatgcaaagagtagctaaggctatatagcgacatgtaagagggagacgaggagtagatatatagctagagagagcatatgcaccatcttaacgatcaaaataaggttgtatgtgtattcgatcgggaaaatagttttaaaaatagactcgacgtgttgatctt

SEQ ID NO: 5649 - DNA, 2822 bp, Oryza sativa
  Predicted polypeptide sequence is orthologous to G571
gaagccattgtcaatcgctacgagcatctagggttagggttaatccaatccaagccaatccatggcggggggagtgcatagtagcgtaccttgatgacctcggaggggcggaagccgccgagccagaggaagcagcgctcggctgggctcatccagacgccggagatgaggtggaagacgtcgcccctgatggcgccgtccttgatggcggcgacctcgtcgtggtgcgccaggcagctctccacgtacacctgcagctccccctccggcagctgctgctgcagcgccgcccgcagctcgtacatcagccggtggtgctcctcctgccacctcccgtactccacgtcgaacatcgccgcctccgagctcagccccccgccgccgccgccgccgacgccatcgatcccgcccagcaggacccccttcccgctgcctccctcgccgatcagcccgccgctgccggggaagaacaccccctgcaccatgtatagatccgtacacattttcatccataatacataatccgaattggttgtgtttgatttgatttgggtgcagtttgaattttgctcgaatttgaaattatgaaattcgcctacctgggctctcgcggtgtgcagttcctgttcgagctgagcaagcctgatcctgctggactccagctgctggatgtaagcctgtcgtttcagtcaaaatttcagtaaagtaattaatccacagtggctgaattgaagaagagtggtagtaattaactagcaaaattaatttggtttaatttgatcaaatttgggtgattgcttttgttctgaatatattgaatatatatagcctgtcattttcttctttttctttctgtgtttaattactgtttaattttgcttcactcaccttcttccttagcctgcttttccttgctgcctccctgttctgggctagcctcctcagcgtctgcatatatttacattaatcacaaaatgatacgcaaaaaagtaagcatgatcagaccaaatcatttttagtattgtccttaactcaactgatatgcacaaaaagagaacaacaactaatctctaattatttcttgagaatatcactagtatagtacctttgggtcgcgttcaccagtagatacacccctcctgtgatccttctgcaataataaaaaaaaacataaacaatatgcacattaatgtaagctaaaacataaaaacaatcaaggacagtgttctgaatagattaatcagggtgttttctttagctagcagggttagatattagttggttaattaagtggttaagtgatgatgctgaccttggctgtcaccggcttcacatccctgttgatccctgcaggctcagcagcgaaaggttggtgctgcaggtggtggtgatcctgtctcctgctccctgtcgccaactcctccatggctgctgctgcttgctgctgatggtggtggtgatgatcaggtgacctcgccatcttggttcccacagctgctggggacagcactaaactaatctctccctgccaaatcaatcaatcaatcatcacatccacaaacattaaaccaatctttgatttcatatatactacacacgagtgctacattgaaaagacaaatgacataaccaatgtgagattcagatgaaagtaagtaaaattaattaaataccttgggtgatggctccacatgcatgggctgggaagggaagatgttgagggtctctgcatcatccatgagcacaacacaaatcaagagatcgatcgagcaaaagcagaagaccagctaaccctggagactcacacaccacaactcacaaactgatcgaattgctactgaaaactctactgaagaagagagctaggctgtatatatgcaggcatgcagctggaacaagacactactgtgctactgctgctgctgctcaaattcatcatgctttgcatggcagagagtagtgtgtactatatatgcatgtaggtacgtccaaagctagctatagctgcagtactgcaggcacacaggcaacacgagaaagctgggggctacgagagatacgggagccaaggacagatatcacacagctgcacagctagctgctgctacactgcaacactgatcactgtaacctgaagctggaaacaacagaagtggatagcatcgatcgggtcaaactcgaacaaatgtgcacatcttgctactactcctagctagtagcagcaacaagaacgatcagtagcatggggattgatcgatcatctcttcggcgtgtgtgtacgtccctctttctctgcaccaggccacatgcagatgcagctcgatctcggcgaaatcattgagcagtttgttacatgtcacagtccaaaccagccggccagatcttagcagtcagagatagagagagagagagagagggaagagagaggtatagctagagagattgttggtttcatatgcatggactttgggttgctgattccctggtcctgagatgtgtgatctccacaggagtgcagtggtagtagtagcagtagtagtactgcagagatttgttgcagctagcagatatcctggtcaaaatggagtacctgagaatctgctgcatgcaggccggccggccgtataccatgatcgtttctgatgaccccagaaaaaggatgcaactttctgcaaccataggaatatatccctcctcctcctatactacagcctactgctactccctgtgtatgcttggcacatttgtttctgtgcctaagctatatatactgctgttattatgctattattactactaatgctaaatgccaaaagaagaac

SEQ ID NO: 5650 - DNA, 557 bp, Oryza sativa
  Predicted polypeptide sequence is orthologous to G571
aaggaagaaggcttacatccagcagctggagtccagcaggatcaggcttgctcagctcgaacaggaactgcacaccgcgagagcccagggggtgttcttccccggcagcggcgggctgatcggcgagggaggcagcgggaagggggtcctgctgggcgggatcgatggcgccgccgcactccgccgccccccacacctgagatcaccgccgccggcaacgcatgcaaacaccgtagctcttagctagcagcttagagatatcgagagatcagaaattaagcgatcgatcgagagaggacgacgactgtgaaaccccccatggaatggatggatggatggatggatgaaccgatgtgtactgtgtttgggcattaaccctttgatgtaaacaaagtaggcgtgtttgactgcttggtcgatcgatcgagatctctgtcgataggatcttgaattagcggatcttacctcagcagctggttcatcaagtgttgatgcagctcaatcaaactttttcctgatgaaaacgcaacctgcagtcgttgttaattcgtttaaaa

SEQ ID NO: 5651 - DNA, 2100 bp, Oryza sativa
  Predicted polypeptide sequence is orthologous to G583
atgaacctttggacggacgacaacgcgtcgatgatggaggcgttcatggcctccgccgacctcccggccttcccgtggggggcggcctccaccccgccgccgccgccgccgccgcctcaccaccaccaccaacagcagcagcagcaggtcctgccgccgcctgcagcagctccggcggcggcggcgttcaaccaggacacgctgcagcagcggctgcagtcgatcatcgaggggtctcgggagacgtggacgtacgccatcttctggcagtcctccatcgacgtctccaccggcgcctccctcctcggctggggcgacggctactacaagggctgcgacgacgacaagcgcaagcagcgctcctccacccccgccgccgccgccgagcaggagcaccgcaagcgcgtcctccgcgagctcaactccctcatcgccggcgcaggcgccgcccccgacgaggccgtcgaggaggaggtcaccgacaccgagtggttcttcctcgtctccatgacccagtccttccccaacggcctcggcctccccggccaggccctcttcgccgcccagcccacctggatcgccaccggcttgtcctccgccccctgtgaccgcgccaggcaggcctacaccttcggcctccgcaccatggtctgcctccccctcgccaccggcgtcctcgagctcggctccaccgacgtcatcttccagaccggggacagcatccccaggatccgcgccctcttcaacctcagcgccgccgccgcctcctcctggcccccccaccccgacgccgcctccgccgatccctccgtgctctggctcgccgacgcgccccccatggacatgaaggactccatctccgccgcagacatctccgtctccaagccaccacccccgccgccgcaccagatccagcacttcgagaacgggagcaccagcacgctcacggagaatcccagcccgtcggtgcacgcgccgacgccctcgcagccggccgcgccgccccagcggcagcagcagcagcagcagagcagccaggctcagcagggccccttccgccgggagctcaacttctccgacttcgcgtccaacggcggcgccgcggccccgcctttcttcaagcccgagaccggcgagatcctaaacttcggcaacgacagcagcagtggccggaggaatccgtcgccggcgcccccggccgccaccgccagcctcaccaccgcgccggggagcctgttctcgcagcacacgccgacgctgacggcggcggcgaacgacgccaagagcaacaaccagaagaggtccatggaggccacctcccgcgccagcaacaccaacaaccacccggcggcgacggcgaacgaggggatgctgtccttctcgtcggcgccgacgacgcggccgtcgacggggacgggcgccccggccaagtcggagtcggaccactcggacctggaggcgtcggtgcgggaggtggagagcagccgcgtggtggcgccgccgccggaggcggagaagcggccgcggaagcgcgggcggaagccggcgaacgggcgggaggagccgctgaaccacgtggaggcggagcggcagcggcgggagaagctcaaccagcgcttctacgcgctgcgcgccgtggtgcccaacgtgtccaagatggacaaggcgtcgctgctgggcgacgccatctcctacatcaacgagctccgggggaagctcacggcgctggagacggacaaggagacgctgcagtcgcagatggagtcgctcaagaaggagcgggacgcgcggccgccggcgccgtcgggcggcggcggagacggcggggcgcggtgccacgcggtggagatcgaggccaagatccttgggctggaggccatgatccgcgtgcagtgccacaagcggaaccacccggcggcgcggctgatgacggcgctgcgggagctggacctggacgtgtaccatgccagcgtctccgtggtcaaggacctcatgatccagcaggtggccgtcaagatggccagccgcgtctactcgcaggaccagctcaacgccgcgctctacacccgcatcgccgagcctggcaccgccgcccggtaa

SEQ ID NO: 5652 - DNA, 2517 bp, Oryza sativa
  Predicted polypeptide sequence is orthologous to G585
tgctagatctctcctccacatccggactctcgctatcaaatttacgtaagcacagtgagaaaaataattagcagggccaccagcatactgttggcgtacagctgcaaatacctgtcgagctaatcttggttaaaatgttggtttagattctgttgcttaattgctggtgaggaggagcactcactatatagctcaatccatcttcctctgcaaaacgtacgcacgacactctggttgcgatcgattatcactccctgatcgcgagttcttggtctgcgagcgtctgcaattaagggaagagttcctctttgttttgacgaggatcgaggattgtttggacgaaccagcagcagcgtacgtgccaatttcattgatagtcgctgtatctgatttacaggaaaaatacatacaacagtgtgtggtaaagtatactactattactggagtactaattaatggaagagacccctctgccatccgggaagaacttcaggagccagcttgctgctgcagcgaggagcatcaattggacgtatgccatattttggtccatttcaaccagccgcccaggagttctgacttggaaggacggcttctacaacggcgagataaagacgaggaagatcacgaactccatgaacctcacggccgacgagctggtcctgcagagaagcgagcagctgagggagctctacgactctctcctctccggcgagtgcggccaccgagcgaggaggcccgtcgctgcgctgttgccggaagatctcggggacacggaatggtactacgtcgtctgcatgacctacgccttcggccccggccaagggttgccaggcaaaagcttcgcaagcaatgaatttgtttggctgacaaacgctcagtctgcagatagaaaactattccatcgcgcgcttatagcaaagagtgcatctattaagacaatcgtctgcgtgccatttatcatgcatggtgtccttgagctcgggaccactgatccgatttcggaggacccggctctcgtcgaccgtatcgcggcgtcgttctgggatacgccgccccgcgcggcgttctcgtcggaggcgggagacgccgacatcgtcgtcttcgaagacctcgaccatggcaacgccgccgtcgaagcgacgacgacgacggtcccgggggagccacacgcggtagccggcggcgaggtcgccgagtgcgagcccaacgccgacaacgacctcgagcagatcaccatggacgacatcggcgagctctacagcctctgcgaagagctggacgtcgtgcgccctctcgacgacgacagtagcagctgggcggtcgcggatccctggtcgtcctttcagctagttctgacgtcttctccggcgccggatcaggcgccggcggcggaagctactgacgtcgacgacgtcgtcgtcgccgctttagacggtagctccattgatggatcttgcaggccgtcgccgtcgagttttgtggcgtggaagaggacggcggactcggacgaggtgcaggccgtgccgctcatcagcggagagccgccacagaagttgctgaagaaagctgtcgccggagccggtgcctggatgaacaatggtgacagcagcgcggcggcgatgacgactcaagaaagcagcatcaagaaccatgtcatgtcagagagaaggcgccgggagaagctcaacgagatgttcctgattctcaaatcagttgtcccgtccattcacaaggtggacaaagcatccattctcgcagaaacgatagcctacctcaaagagctggagaaaagagtggaagagctggaatccagcagccaaccatcgccatgtccattggaaacaagaagcaggcgaaagtgccgtgagatcactgggaagaaggtttctgcaggagcgaagagaaaggcgccggcgccggaggtggccagcgacgacgacaccgacggggagcggcgccattgtgtgagcaacgtgaacgtcaccatcatggacaacaaggaggttctcctcgagctgcaatgccagtggaaggaattgctgatgacgagagtgttcgacgcgatcaagggagtctccctggatgtcctctcggtgcaggcatcaacatcggatggtctccttggactgaagatacaggccaagtttgcctcatctgctgccgtcgaacctgggatgattacagaagctctccggaaagctatagcaagctagctagctagaaggttgagatcagtatcgtcttggtcatttgctctcatcttgtttaggaggtaccgggaaataaatcttgtcgctctgatcagtgcctccttactagtctcgtgatctgttgcaagtaatagttagacatgcatatatatcatacaacaacgtttgatcttgcatggtaggatatatatgtacaccacatttcttatatctttactcctttaaaattcagtgaggatggtaagtgatgaatctgccaccccatcaccaactccctaaaattctgaaaaaaaaaaaaaaaaaa

SEQ ID NO: 5653 - DNA, 365 bp, Oryza sativa
  Predicted polypeptide sequence is orthologous to G585
atgtccgagagaaggcgccgggagaagctgaatgagatgttcctcattctcaagtcactggtcccgtccatcgacaaggtggacaaagcatccatccttgcagagccgataccctacctcaaggacctggagaggaggttccaagagctcgagtccgggaagaagatgtctagcccgcccaagaggaacccgtgctcagagacgatcatcggcggtgccgcccgcgccggtcccggagctgttaaagggcaccaccactgggtgctctccgagtcccaggagggcaccccaagcgacgtgcgtgtgatcatcatggacaaggatgagctgcacctggaggtgcactgccggtggaaggagctgat

SEQ ID NO: 5654 - DNA, 1323 bp, Oryza sativa
  Predicted polypeptide sequence is orthologous to G585
atggtcaccggcggcggccataggcacggcggagcggcggccgagagaggggagggaaaggaagaaacgaggcggcggtccacggctcaccctaggtcgacggcgacgacgaaaaaggcggccggaggggtggaaggcggcggcgcggctcgggtggacttggacggcggcgctccggcgatcggcgagctcgacgagggggtggacggggtcgacggctgtgcggcgaagccggaggaggcgacgccggggcgggaggcggtttcggaggaaccaaacgtggtaaaccgaatcaccacggctttctgggagcttcagcttccggcatgctcagacgagccaattagctccggtaccccttcttccccatcatcgccgccgacgaaagaaactggagacgccaacaccgtggtcatcgacgacctcttcctcgcccacagcgatgcgatactaccagcaggaggagatcaaaaagaagaacatcagctaggcgacgacctcgggcaacaacaagcagccaccgccatggagatcgacgacgatgtgatctacagcctgatcaggaactgggataacgacagcagcagcagctggatcgagctcctggaccacgccattgtctctcccgcctcgtgctttgtgccttggaagagaacggagctggacaaggaggcggtggccggcggggaggcggcgcagaggttgctgaagaaagtcgtgggcggcggcggcgcatggatgaatcgtgccgctggtagctgcagcatcaagaaccatgtcatgtccgagagaaggcgccgggagaagctgaatgagatgttcctcattctcaaatcactggtcccgtccatcgacaaggtggacaaagcatccatcctttcagagacgatagcctacctcaaggagctggagaggagggtgcaagagctcgagtccgggaagaaggtgtctaggccggccaagaggaagccatgctcagagacgatcatcggtggtggcggcggcggcggcggtgctggagctgttaaagagcaccaccactgggtgctctccgagtcccaggagggcaccccaagcgacgtgcgtgtgatcgtcatggacaaggatgagctgcacctcgaggtgcagtgtcggtggaaggagctgatgatgacaagggtgttcgacgccatcaagagcctccgtcttgatgttgtctcggtgcaggcgtcggcaccggatggtcttctcggactgaagatacgagctaagtatgccagttctgccgccgtggtgcctgcgatgatcagtgaaactctccggacagccgtagcaggctactaa

SEQ ID NO: 5655 - DNA, 732 bp, Oryza sativa
  Predicted polypeptide sequence is orthologous to G585
atggagatcgacgatgatatgatctacagcctgatcaggaactgggataacgacagcagcagcagctggatcgagctcctggaccacgtcgttgtctctcccgcctcgtgctttgtgccttggaagagaacggagctggacaagcaggcggtggccggcggcggggaggcggcgcagaggttgctgaagaaagccgtgggcggcggcggcgcatggatgaatcgtgccgctggtagcagcatcaagaaccatgtcatgtccgagagaaggcgctgggagaagctgaatgagatgttcctcactctcaaatcactggtcccgtccatcgacaaggtggacaaagcatccagccttgctgagacgatagcctacctcaaggagctggagaggagggtgcaagagctcgagtccgggaagaaggtgtctaggccggccaagaggaagccgtgctcggagaggatcatcggcggcggcgatgccggagctgttaaagagcaccaccactgggtgctctccgagtcccaggagggcaccccaagcaatgtgcgtgtgatcgtcatggacaaggatgagctgcacctggaggtgcactgccggtggaaggagctgatgatgacacggttgttcgacgccatcaagagcctccgtcttgatgttctctcggtgcaggcgtcggcaccgaatggtcttctcggactgaagatacgagctaaggttgtctctctcacttaa

SEQ ID NO: 5656 - DNA, 1983 bp, Oryza sativa
  Predicted polypeptide sequence is orthologous to G585
gtggggttgcagaagagtgaacttggatagttggcagctagagcagccagctagctagctggagtccttcttgcattggtgggcagactggaaagagaaattaaacagctagataggtttctagacttgtgtggtgatggcatctgctcctccagttcaggaagaacccctacagccagggacgaaccacttcaggagcctgcttgctgctgctgtgaggagcatcagttggagttatgcgatcttttggtccatttcaaccagttgcccaggagttttgacttggaatgatgggttctacaacggcgtggtaaagacgaggaagatatccaactcagcagacctcacggctggtcagctcgtcgtgcagagaagcgagcaactgagggagctttactactctctcctgtccggcgagtgcgaccaccgggcgaggaggcccattgccgcgctatcgccggaagatctcgcagacacagaatggtactacgtcgtctgcatgacctactccttccaacccggccaagggctgccaggcaaaagctatgcaagcaatgcatctgtttggctgcgcaatgctcagtctgcagatagcaaaacatttctacgctcgctattagctaagagcgcgtctattcagacaatcatctgcatccccttcacgagtggcgtgcttgagctggggaccactgatccggttttggaggacccaaagttggtaaaccgaatcgttgcatatttccaggagcttcagtttccgatatgcttagaggtactaatgagcactagcccttctccgaacgaaacggaagatgccgacatcgtgtccgaaggcctcatcactcacaacgccatcgaagaggggcagatggttgtctctgatgagtgcgtgtccaacgccaaccgcgatccaatcaccatggagatcgacgagctctacagcatctacgaggacctggacctggacatggacctggacctggacaccgtgcgctttctcgaggataatggctggcctgtgaaccccagctcttttcaactggtcccggcgtcgtcaacggaggcggtggcggcggcggcggcggctaatgatgtcgacggtgttgcgaattctcaagtgtcgtgcttcatggcttggaagagcgcgaagtcaaacgagatggctgtgccggtcgtcaccggtatagagtcacagaagttgctgaagaaagttgtggactgtggtgcacggatgagcactggtcgtggtagtagagcagcgctaactcaagagagtggcatcaagaaccatgtcatatcagagagaaggcgccgagagaagctcaatgagatgttcctgattctgaagtcaatagtcccctccatccacaaggtggacaaagcatccatccttgaagaaacgattgcctacctcaaagtgttggagaaaagggtgaaagagttggagtccagcagcgagccatcacatcagcgcgcaaccgaaacaggacagcaaaggcgctgtgagatcaccgggaaggagctggtctctgagatcggtgtcagcggcggcggcgatgcagggagagaacaccaccacgtgaatgtcaccgtcacggacaaggtggttctcctggaggtgcagtgccgatggaaggagttggtgatgacacgagtgttcgacgcgatcaagagcctctgtcttgacgttctctccgtgcaggcgtcggcaccggatggtcttcttggactgaagatacaagctaagtttgcttgttctggttcagtggcacctgggatgatcagcgaagctctccagaaagctatcggtggctagcgtcgagagcggcacacgtacgttagatgaatttgaaatgcaagaagcagaagcagaagtgcagaactacaatacgatcctcgtgaaattttatttattatatgctcgctggtccagaaaaatatttgtttcggaagatagcttcaatcacatcctcatgttcatgc

SEQ ID NO: 5657 - DNA, 1893 bp, Oryza sativa
  Predicted polypeptide sequence is orthologous to G585
atggccggcggcgaggcgcatgcggcgctgcaggcggtggcgcagagcctccggtggacctacagcctcctctggcagctctgcccccaccaagggagctcgctggtgtggggggaggggcactacaacggcgccgtcaagacgcggaagtcgacggtgatgcagccgccgccggcggaggaggaggacgacgccgaccacgcggcgcgccaccggagccggcagctgagggagctctacgactggctgcagcaggccggggagaactccagcggcggcgtgcagacgtcgtcgacgacggcgagccggcggccgggggcggctctgtcgccggaggacctgacggagacggagtggttcttcctcatgtcggcatcctactccttccctcccggcatcgggttacctggaagggcatttgcaaggagaggccatgtatggctcactggagcaaatgaagttgacagcaaagtattcctaagagcaattcttgccaagacagttgtgtgcattcctgttgtcgatggcgtcctggaaattggaactacggaaaaggtggaggaagatatgggcctgattcagtatgcaaggggcatcttcatggatcaacatggcatccacatgaagcctaccctctcacagcactcaacatccaacccagtcacccactgtactcatcagcatccaatccaggttcagatgcaactaggtatcaccagccaaacaaagtttgattattcagatgagctcaatgcagatgaggagaatgatgacacagaagaagagggcatgtcaggttcagacactaacaacactgacactgaaaggaattcaggccagctgcaacttcaaatgcaagaccaactgaacatggtgagcaatgaccaccagacaataccaaataatgcagtttccagtgagctaatgcagtgtgagatgtcagaagtggtaagagatggctgctcaaataatattttagaggatgaaatccaaatgctgatggattgccaaaacagtaattgtcagttaaatttgcaagggccagatgagccttgtcactcttggcattttctctgcgaggagttacaaaatgattaccagccagctactgaagatcaagtggcatcacctgaaaatacccattacccaaaaacactcatgacaatcctacattacaacacgctgcgacagcaagagatgaacatcaagaactacttgccagtttcagagaaatcatcattctccagatggactactcctgaaggaagggagcagaaacacctgaatcaaggggcgggaaaggcgcaagtggatgccatccaaggtgatttcagtgccaaccatgtgctgaaagagaggagaagaagagagaagctcaatgagaagttcataattctgcgatctttggtacctttcatgacaaagatggacaaggcgtcgatactaggcgacacgatcgagtacgtgaagcagctaaggaaccgcatacaagagctcgagtcgtcgtcgtcgtcgtcacgagcagccgcccgggcgccatcggcggcggccgccgggaggcggaggaagagatccgccgccgccgccactgccacggcggcggaagggatgagcagcagcaatggccgcaatggcggcgaggcggcggaggtggtgcaggtgtccatcatcgagagcgacgcgctgctggagctccggtgcggttgcggcggcggcggcggcggtgtggtgctgctccgggtgatgcaggcgatgcaggagctccagctggaggtcaccgccgtccaggcctcgtgcgccggtggcgagctgctcgccgagctgcgcgccaaggtcgtcgttatgatcctgatctgcatgaaaatgcaaatgcaaatgcaaatgcagaattaa

SEQ ID NO: 5658 - DNA, 714 bp, Oryza sativa
  Predicted polypeptide sequence is orthologous to G590
catcaatgaacctctccacctcaccccgcgacgcgacgcgacgagccgtacaccgaccgccccgcgccgctgctgccggagccggagagagaagctgaagccgaagcagaggcagccgcagcggcaaaactcaaaagacgtcgtcaaaagctctgccgcgcttgcagctttctcgggctcaaggaaaagccatcacaaaaccagagacacagagagagagagagagaaactgaagaaaggtggcaactcctgcagcagctgcagcagcaagcgctagtgtttgtggtttgctggtgctgtggcgaggcgatgatggatgggcgaggaagccaggaggaggagcacctggatttgatcatgcgacaccacgccagcatggggctggatcgctgcgagagcgaggaggcgctggggtcgtcggagtcggagcagcccaccaggccggcgcggccgcgcggcaagaggagccgcgccgccgaggtgtacaacctctccgagaagaggaggaggagcagaatcaatgagaagatgaaggccctgcagagcctcattcccaactccagcaagacggacaaagcctccatgcttgacgatgccatcgagtacctgaagcagcttcagctccaggtccagatgttgtccatgaggaatggtctatatctgcccccagtgaacttatctggggcacctgagcatctgccgatcccgcaaatg

SEQ ID NO: 5659 - DNA, 536 bp, Oryza sativa
  Predicted polypeptide sequence is orthologous to G590
acgggcaccgcgcgcgccgccggcgcgtcgtcatcgggcgggtcggggagcaggagcgggagctacccgccgttcaagcgggggagggacgagcttgttgacagccttagcaagtttgccgacgaaacccggccgtcgaagcggccggcggcgaagcaccggactcgcgccaccgaggtccataacctgtcggagtgggtaaaacctcaagaacaccaaccaaccattgatggatagatggtgttgcctcatttgcaacaaggtgaatgttacttgattttttctgttcttgctgcagagaagaagggatcggatcaaggtaaaatattttttgcgaaaaattgtgggaaattttgttattctgtttctgaaagggtttttgtctagagcaattatatggtctatgaggtaccaaaaatttagtgtaaaatttggtacctcatagtacttgggtacctaagaggtactaaatttacaatagaaaaaatgatacctcatggtatcttcttaaggactgtaaaaaaaaaaaaaaaatt

SEQ ID NO: 5660 - DNA, 1102 bp, Oryza sativa
  Predicted polypeptide sequence is orthologous to G591, G793
atgagggccctgcaggacttggtccccaacacaaacaagacagacagggcagctatgctagacgaaatccttgattatgtgaagtttcttcggcttcaagtaaaggttctgagtatgagcaggctgggtggtgctggtgcagttgcgcagctggttgctgatattccaatctcagttaagggggaggcaagtgacagtgggagcaaacaacagatttgggaaaagtggtcaaccgatggcacagaaaagcaggtagcgaagctgatggaagaagacatcggagcagcaatgcaattcctccaatccaaagcactatgcatgatgccaatctctcttgcgatggcgatctatgacacacagcattcgcaggacggacactcagtgaagcctgaacccaacactccttcatagtatagtaacaataacactagcatgcacacctactactactaggcgtcgacctatccaaagtgtaggatatactggacattttgatttgctaactggaaaaggcctaaggatcctctcctcaaagtagtacccatggtatatgatgtcgtctcctcttttcttcttttcttcaaaggtgctttgattgcaaagatatggtaagcgatgttctcatgctcctacatctttcaatgcccctatcgagtgtgagtgatgggtagagctaccaaagagtctggcatgcgctcatatcatttccttttgggtctgtagtgcactagccatacactttgtggtggggtcggtcagtcttttggtagtggacgtttggactaatgaaaagaagctgatgtatgtgtgttaagtctgcacaaatggttgacacaatttaaaagaatgttcagatggaagatgatgttgacggtgaatggtggtgctatttcttgtctatttttccaaagcggcaacggatgttttagtcaatggaggcgaagcgtgtattaatctggttgctagtgggagcgtgctccttatgtgctttacttttctgtctgcaagtcatagtcttgataagaacctgccctcttaaagtttttagcctcttgtattattggttcactcatgaaactatatatatcatctgtgctgactt

SEQ ID NO: 5661 - DNA, 1636 bp, Oryza sativa
  Predicted polypeptide sequence is orthologous to G591, G793
atggccgggcagcagccgcagcagcagggcccaccggaggacgactttttcgaccagttcttctccctgaccagctccttccctggcgccgcgccgggcggccgcgccgccggtgaccagcccttctccctcgcgctcagcctcgacgccgccgcggcggccgaggcgtccgggagcgggaagaggctcggggtcggcgatgacgccgagggtggcggcagcaaggcggatcgggagaccgtgcagctcaccggactcttcccgccggtgttcggcggcggcggcgtgcagccgccgaacctccgccccaccccgcctacccaggtgttccacccgcagcagtcgaagcagggcggagcagccgtcgggccgcagccgccggcgccgaggccgaaggtgcgagcgcggcgtgggcaggcgaccgacccccacagcatcgcggagaggctaagaagagagagaatagcagaaaggatgagggccctacaggaattggtccccaatacaaacaagacagatagggcagctatgctagatgagatccttgattatgtgaaattcctgaggctgcaagtaaaggttttaagcatgagcaggctgggtggcgcgggtgctgttgcacagctggttgctgatattccactttcagttaagggggaagcaagcgatagtgggggcaaccaacagatttgggaaaagtggtcaacggatggcacagaaagacaggtagcgaagctgatggaagaagacatcggggcagcgatgcaatttctccaatccaaagcactctgcatgatgccaatctcgctcgccatggcaatctatgacacacaacaaacacaggatggacaaccagtgaagcacgaacccaacactccttcctagtatagtaatagcaactgtaagtctgtaacatgaatcgttacaacccctagtagacatcaacctatcaaagtgtaagataaaacagctcgttttgattcactaacaaggaggcaggaaaagacctaagagatcctctccacttgaagttgtaccaatggtatatgatgtcacctttcgttatcatcttttgttcaaaggtgctttgattgcaaggatatggtaagcaatagcctgctcatcctcctacacctttcaatgcccctatgagcgcgggtgattgagagagctactaaagagtctggcatgctctcacattgtctcttttcgagtctgtagtgcaccaaccatacactttgtggtggggactgcttttttggtagtgggtgtttggactaatcaaaagggattgatgtatgcctgtgtctgcagcctgcacaatggttgacggaatttgaacacaagatgaaatggaagatgattttgatggtgatgttcatttatctccatttttccaaagtggaggcggaggctttggtcaatggaggctgagcgtgcgctaagctgatcgctagtgggtctgctatctacatctacatgcactactgttgtatctattgtgacatactcttgataagaaactgcggtataaagtttaatctttctattggcgattaatccatagaattactttgtattttctgccatgagttctcaactacccacattatttgtgaagaacagctgttcttgt

SEQ ID NO: 5662 - DNA, 663 bp, Oryza sativa
  Predicted polypeptide sequence is orthologous to G592
gacggtttctcatcgagtgctagaccagcaggatcatcactcggtgaggttcgccatggcgccatgagcagcagcagcaacaacaacaagaagatgaaggccccactgagcttcgctagcagcaggcagggctccggcggcctctcccagatatccgaggacggcatcccggacctcactgacagcatccatggcgccgctcatcatcatgggcgctccgaggagaacgtctccacccacgaccacgtcgtccgctccttctcctccggtgggttctcgatcgggtcatgggaggactccaactcatcgtgttctccacgtcgacgggcaaatcaggagcgcacggcaacgacgacatcatcgccacccttacaactacgaatctcagctttgttgcgcccaaggagatggtggcgtagagaaatacctgcagatgcagcacgacccaggtgcattcagagtacggccaagcgtgggatgcgcgacgcacccacggagcatcgcagagagggagaaaagacgaaggatcagcgagaactcagggaagtttgcagcccctggtgccccacatggacaagcaaccaatactttaaacttctgactttaacaggttgatcacattaaggggattgcaaaaccgcttgcaacttttaaaggaaaaca

SEQ ID NO: 5663 - DNA, 2033 bp, Oryza sativa
  Predicted polypeptide sequence is orthologous to G592
ggcatccccccgcaaaagcaatccgccgattaaactaacccaaaaaaaaaagaaaaaaaactactcctcctcctcgcccaaccccgcaaaagcagcggcgacctcgcgaagccaagccaccaccacttcttccttcgctcgctcgcgtattttcttttgcttttttgtgtgctcatttcctcgccgtaaagaagcgaggaggaggaagcgtagcttgagaggctggagagatcgatcgagagagcttagcaacagcagcaaagtgattggagttgagcttgtccgtcttgaaaagtcgctgatcttttcttgtttactttcttctttttatttctttcttgtgttgctgaattgaggttgtgtgggcggccatggcgaggaggcggagataggaggtgggtggttgttgttgttgtttgatttggtgggttgaggtgggagaattggagttttgttggagaagagaggagagaaggggatgtacggctcgccggtttccaaggatctgaacctcccggtgcagccgccggcgatgagctcgtcgggcttgctgcggtacagatcggcgccgagcacgctgctcgccgagttctgcgacgacttcctcccgcccgccgccgcgccccgcgccgccagccccgacgccgacaacgtcttctcccgcttcctcgccgaccaccagatccgtgacaagtctccccccgccaccgccgccgccgccgccgctgccgctcacttccccgacgaccccaccatggccacccagcaccaccaccagcagcagatgatgttccagcaccacccgcagcagatggcctctgtcgaggggctctaccgcaccgtcagctccaccgggattgacgccgccaccgccgccgccaacgccgccggtggcggcggcggcgggctgctccggcagagtagctcgcccgccggattcctcaatcatttgaacatggacaacgggtacgggagcatgctgcgggcgggcatggcggcagccggcggtggggtggggttcaggaacggcgcgaacgccgccgccgcggccgactcccccggcggcagcgggggcaggctgaaggggcagctcagcttctcgtcgcggcagggctcgctcatgtcgcagatctcggagatggacagcgaggagctcggtgggagcagccccgagggcgccggtggcggcggcggcggcggtggccggggttacctctccgggtacccgatgagctccgggtgggaggagtcgtcgctcatgtcggacacgaacatctccggcgtgaagcgccagcgcgactcgtcggagccgtcccagaacggcggcggcggcggcggcctggcgcaccagttcagcctgccgaagacctcgtcggagatggcggccatcgagaagttcctccagttccaggacgcggtgccctgcaagatccgcgccaagcgcggctgcgccacgcacccgcgcagcatcgccgagcgggtgaggaggacaaggatcagcgagcgaatcaggaagctgcaagaactcgtgccaaacatggacaagcaaaccaacactgctgacatgctggatttggctgttgactacatcaaggatcttcagaagcaggtcaagggattaaacgacagccgagctaactgcacctgctcagcgaagcatcagcagtactctggctagaaagctttgtacaagtcatggagacttcagaaaagaacacaagattgttttggagattaggcaggactgagacgatctctgaagatgtgtaatggttaatttcatttgtttgggggggtttaattagagaggcacatggaagaaaaggctcttgtgtgccaaagcactgtataagcaaagggcaatggagcagtggcatcatcaggattcaagtgataaaaagaaaaaggaaaaacaagggagaaaaagggtgggagatgggtgaaacaattgtatagttttcttgtaacttttgccatatatacccctgcatgccccatgtccagtgcattttcgatagaaatttattactgcc

SEQ ID NO: 5664 - DNA, 1921 bp, Oryza sativa
  Predicted polypeptide sequence is orthologous to G592
gactcacctcctccctacctctcgccattattaaatcctctcctctcctctcttctccacatccacaagaaatttcgtagcggaatcacgagccctcgtctcgatcgtagcttgagcttgagctgagttgctggtttggtgtgtggagagatcagtggggtgggtgggggtgggtgatgtacggcgcgccggtgtccaaggacctgagcctgcagccagccggggtgcggacgccgccgcagatgagctcgccgggcttgctgcggtacaggtcagcgccgagcacgctgctcggggaggtctgcggcgacttcgtcctccccggtggtggtggtggtggtgggcagctgcagctgcagctgcagcagcagcggcctgggagcccggaccacgccgcggacaccgtcctcgcgcgcttcctcgccggccatggcggccacgacaacaagcctccccgccccgccgcccacttcgccccaccggaagactccatggcctcgcatcagcagcagctcatgtaccagtcgcatcagcagcagcagcagatggcttccgccatggagggactctaccgcaccgtcagctccggcggcacggagtccaccgccgccgccgccggcaacagcctcctccggcagagcagctcccccgccggcttcctcaaccatcttaccatggacaacggatacgggaatatgctaagagcgggcatgggcggcggcggctggtggcggcgacccgcggctcaaggggcagctcagcttctcgtcgcggcaggggtcggtgatgtcccagatctcggagatgggcagcgaggacgaggagctcgccggcggcggcggcagcccggaggctggcagcaacggcggtggcgccgcacgcggcggctacggcggcgggtacgcgatggggtcctccgcctgggaggagccctcgccgccggcgacgtcgctcctcccggacagcagcctcccgtccaagcgcccccgcgacgacctgccgcggcagctcagcctcccggcggcgtccaagaacagcagcaagcccccctcctccgcctccgccgccgcgtcgccggagatggccgccatcgagaagttcctccagttccaggacgccgtcccctgcaagatccgcgccaagcgcggctgcgccacccacccccgcagcatcgccgagcgggtgaggaggacgcggatcagcgagcggatacggaagctgcaggagctcgtccccaacatggaaaagcaaaccaacactgctgacatgttggatcttgccgtggactacatcaaggagctccagaagcaggtcaaggtgttaaacgacagccgttccagctgcacctgctcggcgagcaagcagaagcacttcgccggctaaatcaatcaagtcaatcaatcgccatgaccggtgcagcagtgcgcaacacacgaacggccgcaaaaggcatgcagcagaagcatctgcaccggcagtttttctaagcttcgtttccttctttgttgatgaattcgctggtctatctggtaaattgaacatgagggcattggattttggagcagtggcatgcattcttcagagttcacaaagatgatgggttggggtcccacatggtagtggtagactactgtagctgcaaagcttgattaattaattagcctgttcttttgataatgaaggagaggagagtaactcacaagtgtatagatggttgtctcatctctgtttgtcatagtacacaccaagtgcaagttgcagctgtgtctgcttgcaagaatgcatgcccatgtacattgcatccccctttgcttgacaaatgacacatccagacagcctccatatcctgtttcctctcgttgctacaccctgtttttgtgaagtacatgcatcgcaacaatgttcacgaataatcctggtc

SEQ ID NO: 5665 - DNA, 900 bp, Oryza sativa
  Predicted polypeptide sequence is orthologous to G594
atgcctactccccattccccagcgttagggttccaggccgcgacttctccgggccagtggaacgaagttgccgcatcaatcgacaaggttgttgagatgagagcagcagcgccaccagcggacccaaccgtggtgatggcttcgtcgtcgccggagaagaagcatccacctggttgtggctctcgggactcccagcccatcgcttgcacggacgatccccccttgtctgaatccccaacgacggacctaggctgccacgatccgcgcgaggaggacgccgaccacccggcaccacccatgggcagagaggccggagatataaatcattttaattatctggaaaattcagattcagacgacatctttgcctcaaccaactcagacaatatgaatatgttgatcggtgacatcgacgaggatagtgatgatgatggttacgtagacgaggagacaacttgcccagggcagaacttcacgaaggagcaggaaaaggaaataatgcgcaagtggctggaaacatacgacaagaagaatagagaattcatggtggcgtgcgaggagttccaaaagcagggaggagatgagacgagtgcttctcgtccggtatttccttttaaaccgctccccgagacaacagatttttgtatcaccaagagtttatgctatcaccgtgaatacaagaccaatgatacttctgagactgcatccactattgggtggcgtgaacccaaggagatgctccagatcttctcaaagaagttgtccagctccatgtcctatcctattagtgtttacggaatctttgcagtacgtgattacttggaccctttgcggaattatgtcttcaaccgtaccagagatgatcctgtcatagttgaacagtgctacattttggtataa

SEQ ID NO: 5666 - DNA, 483 bp, Oryza sativa
  Predicted polypeptide sequence is orthologous to G594
atggcgccgaccaccaaaggcagaggggcctgtggagcggaggagggggctgagttagtggaggagttcaagtttggagaacatggagagagagagtcaactgttgttgccaatgctgcctcttgccgaatagaggaagaaggaaaaaaagggagggagaaggcaagatcatatagaaacgaggctcatatggagggaaaatggaagaatcagcaaagaaagaaaatcaaatgtggagagcctcatatggagggcgattttctgccaagcgtgaccatcatcatcatggatggtggtcgcagagcagtgccaggccagtccaccgtgccaaggcatcggcccaggcatgacccaactatcgggccgggccagcacaggcccgacaccagtcgtgccatgccgtgcttgagccgggccaaatggccgtgccatgggtcaggccatcaggcctcggaccatatggctatctataccaatgattaa

SEQ ID NO: 5667 - DNA, 2184 bp, Oryza sativa
  Predicted polypeptide sequence is orthologous to G597
ggcttcacctcacctgctcattttttatttcccaaattataaaaccttttcttttttgttccccaaagattacgtgctagtaggggcgttaagaaaaaggaaaagaaagagaaggaaaaaaaaaacggagagagaaaaattggagaggcgggcgagttaggggaatttacgtaggagacaagcgaaatccctaaattttctctcctctcctcgcgagttgttttgagtgagtttctgcgagtgctcttgagcttccatctttccgcataaggctttgcaagctttgctctagccttttttttttgttcagattattttcttgcggtttgttcttaagtactcgctagtgtccctaatttcctggtaatttcttggtaatttttggctgcttactttgctcgagctgggatctgtgtttcagtgctcacttgctaaatccgaaccaaattaaaccttggattttaaaactccttccagctatttttccgtttttatttgggaaattgtgggtttaccatttcttcctccgattttcttttccattttctcccctcatttgagcttccttctcacccattccaagaaatcaccatccttccgctgtaaaatcgttgaaaaaaaaattgttccacagctttgagcagcgcggggtttatggtggtttttgcagctctcgtcttcttcctcagctcgccttgaaatttcggtccaagaaatcactgagctgagtgagctgctgagctgagcttctgcgagagaaggtgtgggaatgatggaggtgactcaggtgagggcgtcgtcggagatggcgggaggaagggagccgttcgtgctgcccaagagcccgccggcggcggcgcctgcgccgccgccgccgtcgtccggcggcatgcagagcgtgcgcatggcgtacacggcggacggcacgcccatcttcgctccggtgaactccgccccggccccggccccggcggcgacgtacccgcccgcaggaggcaatggcgcggcggctctcgacgccggcgagccggtggtcaagaagaagcgtggccggccaaggaagtacggccccgacggctccatgtcgctggcattggtgcccgtgtccaccgcggcggtggcggcctccgggcctttctcgccggcggctgccgcgaagtcgccggacgccgtgtcgtcggcgccgccgccgggggcgaagaagagggggcggccaaagggctccacgaacaagaagcacgtgccctctttcggaattggagatatcgggtcagcaggagctggattcacacctcatgttatttttgttaaagctggagaggatgtatctgcaaagatcatgtcattctcccagcatggaactcgtggagtatgcgttctgtcagcaaacggcgccatatcaaatgtgacacttcggcaagctgctacttccggtggaacagtaacatacgagggacgatttgagatactgtcgctgtccggttcattccttctatcagagaatggaggccatcgtagtcgaactggtgggctcagtgtttctctagcaggccctgatggtcgcgtcttgggtggtggagttgctggacttctgacagctgcttcaccagtgcagattgtggtgggaagcttcaacaccgaagggaaaaaggggccaaagctgcaagctccttcagacccaatgtctgcaccgctaaagatggtgccgatgagcgggacggggccaagcagcccgccatcaaggggcacattgagtgaatcatcgggcggcccggggagcccgctgaaccaaggtgtcacggccagcaaccatggccagccagggctacccagcttatcctggaagtgagctcctcctcctcatcatcatcagtgaccagaccttggtcccgtctgaccgccgtagaacttgcgaaaggaaatgtcgtggcggtggtactcgaggtactccggtgcgacgccatggatcctaactagcccccctatctagtgtaatgtctgaacctgaatcagggaagaaaactgtagccgttgcatctctagctagctcttctggtgtaggtgctgttactattggagactagactcaatgtgttatttaggtggttaaattgtttttttatcttccagacaccgatgaaaaagctcattgcttctatgtaactatgttggcatgttgcggtt

SEQ ID NO: 5668 - DNA, 1794 bp, Oryza sativa
  Predicted polypeptide sequence is orthologous to G597
gtcgcctcgccacctccccccctgttttctccatttctcctcccaatttttttctccgcatccgcagaaattctgtcccctcctcctcctcctccatttccgatgtattttattcgatttcgagatttgttttccggtgcatagagctcacgtacaaccgccgcgccgaacggtgcatgtgaactgttcggcgaaacgcgcaggtgaggagaggtcgcgaggagcggctgctgcggcggcggcggcggcttcgattcaggtgggggtgggtgccctagggtttcgctgccgggatggatggccgggagcagcagcagcagccgcgcgtgagctcgccgccgccggccggcggcggcgtgatgatgcctcagcacccctacggcgccgcgccggcgatgccgccggggtcggcgaatgttatgcacggggtgccgctctcgttcaaccccatggcgtcgccgaccgcctcgtcgcctatgaagcccgcggatatgtcggggaccatgtaccgcaccgatcccgtcgtgcagggcatgcagcagcagcccggttccggcggtggcggcacggcggtcggcggaggggagctcgtgaagaagaagagggggaggccgaggaagtatggtcctgacgggaacatcgggttgggactgaagcccgcggctgcagcagggacggaggccggcggaccttcaggtggtgcaggatcgaactcgaaccctgacgggaagcgcagagggcgacccccaggatccgggaaaaaaaaacagctagatgctttgggatcttccgggacatcttttactccccacataataacagtgaagcctaatgaggatgttgcttcaaaaataatggcattttcacaacaaggccctcgcactacatgcataatttcagcaaatggcgctctttgcacagcaacactacgtcaaccagcaacttctggtggtatagtaacatatgagggccactttgatattctctctctgtcgggctcatttctgctcgcagaggatggcgacactcgtagcagaacaggtggtttgagtgtggcacttgctggaagcgatggacgtatagttggaggttgtgttgctggaatgctgatggcagcaacgcccgtgcaggttgtagtggggagtttcattgctgaaggtaaaaaaggcaaggaagaacatctgaaacgtgagccaacatctgccccgacgccgaaccacgcagctggctttggcgcagccacggctgccagtcctccgtctgatggatcatcaagcgaccactccgatgacccagggagtcccatgggacctaatggcagcacattcaataattcaggtcatcccatgcattcttcgtatgctcctgttagctggtcgctatctgggaatcaaggccgttacgatcccgacctgaagatgatgaccgactagataatcctgtgtttttaagctctgttagctgttgacccagtagagtgtagggatcagggattcagtgtttcctgcaccgacaccaccggcagcgttggccaataatccggtgcgctagtagtaatcagtatcacaatgcctgaacaaaagagatcaggaacaaataagtagccccagcgcatggcttggcctgtcaggtagctaatttttatttttctcaatcggtagcttatttagcatgctttgtcagttgtcagcctagttgtacggttttcttatgaatgtttgtacacctttttcttttctcgctagtattcggcgtgtacgaatcttaattaagattggaatgacatgttattgg

SEQ ID NO: 5669 - DNA, 1526 bp, Oryza sativa
  Predicted polypeptide sequence is orthologous to G597
gtagtgctttacttaccagctgcctgttttttcttctctttccttgaaaaaaaaaaccatctttatttttgttaattagggaaaagaaagagtgcatgtgaagtcaggagtaggagaggttggaaaaaaatagggggaaaaaaaggagatatatattgatgaaggatagttgagatataagcaagaatttgtgagaggctagtaggttcccaaatccctagccctaatctcctcacgtgctcgtgagctctcatcggtggatacgaatttccgcggctttgtgttagagtttttggtgatacaagaagaagcgcgggcggccgaggaagtacggccccgacgggtccatgtcgctggggttggtgacctcgccgacggccgccgcgtcgacgccggtggcgcagggcgtcccagggccgttctcgccgacgcagccgaagccgccggcgagcttcttgtcgtcggggtggccggacggggtgaagaagcgtggccggcccaagggttctaccaacaagccgcgcatcgacgccgtcggatcggcgggagttggatttacaccacacgttattacagttctagctggagaggatgtgtctgcaaagattatgtcgtttgctcagcatggaaatcgtgcggtttgtgttctttcagcaaatggtgccatatcaaatgtaacacttcgccaaactgctacttcaggtggaacagtaacatatgagggccgattcgagatactatcgctgtctggctctttccttctaaccgaccatggaggccagcgtagtcgaactgggggactcagtgtttcactggctggtcctgatggtcgtctgttgggaggcggtgttgccggacttctcatagcagctactccagtccagattgtggttggaagcttcaattctgaagggaaaaaggagccaaagcagcatgctcattcagaacccgcatccgcgccatcgaaagccgtgccgacggccgggatgggacccaacagcccaccttcaagaggcacattgagtgaatcctcaggtggagctggaagcccattgcatccaggcattgctcctcccagcagcaacagccagccgccattcttgtctagcatgccatggaaatgaaatgagaccttttcatccttcaccaaacctggactctgaatctctgatagactttgtcgatgaactgcatcttctgccagaaagtagtagcaaccgttgccacacgttttctctaactagctcctatgatgtagtgtaaatctgaagtttaattaggggagaatttgtagctggtaagtgtagctgtcgtgtaggtttcaccctggatttattatgtattaggtaggtagtggtatcttgagagacatatgatcatgttatcctaatgtcctatatgcaatgttatcaaagattattgttattattatggcctctagttacatcaaattttctcatgggttcatgcatttcaatggatgaaaaaaaaaagaaatagaaaaaggcttgcctagaatgaattgc

SEQ ID NO: 5670 - DNA, 1602 bp, Oryza sativa
  Predicted polypeptide sequence is orthologous to G597
cctccacctttgccctcctgcattttgcttgcaaaggataggagttgcagtactagtattgctctctcattgcatgtgaagctagcaagcaagcaagcaagagagagattctaggtgagtggtgtttggtgtgaagggaaggagcatggtgatggtggcatggctgatctgctgctaatagcaaggagtagtagtaataataatactactagtcactcatcatccttctccctcccttgagcttagctatagagtggagaagaaagaaaggagagtagtcaaagcgactctttctttgttttcttgcgcttcctcctcggctgagctcagcagcaagcaaacctgctcctgctacagcagcgagcgagcgctagatctgaccaaatggaggccaaggacgtctcgccgctcgtcaccgtcccgcccgcgcccgccgccgccgcgccgccacctgcggcagcgcccgcgccgccgccgtcccagccgccgccgccgccgctgccgttcgcgcagcaggcgccgccgccggccgccaaccccgcggcggcgcccatgcggctgtcgttcgaccagatggcagggaaggcgcccgggggggagcagcagcaccaccaccacccggggcccatgctgtacgcggcggcgcccgcgggcggcgccgcgccgccgccgcagggcggcaatgtgatgggcatgggcgagctgatgcgcaagaagcgcggccgcccgcgcaagtacgcgcccgacgggagcatggcgctcgcgctcgcccccatctcctccgcctccggcggcgccgcgccgccgcctccgccgccagggcaccagccgcacggcttctccatcagcagcccggcgtcggatccgaacgccaagcgccgcggccggccacccggctccggcaagaagaagcagttcgaagccctaggctcatggggcatcgccttcactcctcacatcctcaccgtcaaggccggcgaggatgttgcttcaaaaattatggccttctcacagcaaggccctcgcacagtttgcattctctcagcgaatggtgcaataagcaatgtaacacttcggcagccagctacatctggtggacttgtgacttatgagggccgatttgagatcatctctctatcaggttctttcctgcttgcagaggatggcgacactcgcagcaggactggtggcctgagtgtcgcacttgcaggatctgatggccgagttcttggtggatgtgtagctggaatgctgatggccgcaacccctgtccaggttgtcgtggctagcttcatcgcggaaggtaagaaatcgaagccagtcgagacaaggaaggtcgaaccgatgtcagcgcctccacagatggcaacctacgtgccagctccggtggcgagcccgccatcggagggcacatccagtggatcgtccgatgactcgggcagcccgatcaaccacagcgggatgccgtacaaccactccgggcagcagcagcaacaccagcagcaccagcacatgccccctgcttacgcatccggtggctggtcgctctcagctcatcatcagaacaggcacgactctgacatgaagatgatgtcgaactaa

SEQ ID NO: 5671 - DNA, 1597 bp, Oryza sativa
  Predicted polypeptide sequence is orthologous to G597
gtattgtgcgcggagggggtagctgggcgaggtcttggggggtgatttttgcggagaaattctgttgttgttggatgcaaggaggggccatgtcggcggcggcgacggcgacggcgagcgaggcggcggcgtacggcggcgtgggcatgagcaagagcggggccctgcagcctcagccgccgcacggcgccgccgccgcggtgcgcctcgcctacacccacgacggcatcgcggtgtacaagcacacgccgccgccgccggtgtaccagacgccggccgccgtcgccgccccgtcgccgcccgtccgcggcaatggcggtgcgcccgcgtccgccgagcagcacaagcgcaagcgcggccgaccgcgcaagtacgccgtcacggacgtgccgctcgccgtcgtgccaccctcgccgcgaaaggctgcggccgccgccggcgccagcgccgcccagtctccggcgacgcccacgctgccgccgggcttctcgtcgggcctggccgcgtacggaggcgccgcggcgagccagccggcgccacgtcaggctccgccggcatccgggcgcgtgctacctcacaagaagaggggccggccgccgggctccggcaacaaacagcagcagcggcctcagcacaagaaggcagcagctccaggatctagtgtgattggattgaagcctagcgtcatcacagtgcaagttggagagggtgtagtgtccagggtgatgtcctttactaagaatggatgggctgtttgtgttctcccagctaatggtgctgtatccaacatgacactgcgtcaagcaggttcttctggtgcaacaacagtaaattatgagggccattttgagattctttctttgtctggctcatatctgctgtcagaaagtgttggcctgagcagtcgagctgggggacttagtgtttcacttgctggtcctgacggacgtgttttaggtggcggagtagcaggacctctgaatgcagctacacctgttcaggtggtcattggaagctttctggctgatgtgaagaaggggcacaaacaggccatgccgagtggggctccgtatccaggtgtgagcactccaacatccagagggactcccagtggatcctcaggtgggcctggtagccccctaaaccaaagtgcaagtggctcatttaacaccagcaaccaacaagccttggctgacttcccatggagatgagcttggtggttctgatgatctttcagccttcagctaaagtcattggtggttctgatgaggggattggggtttgtagctattgggcctcaagaggtaaacataatttggtggtttcggctgtcgcttcgtttattagacaggttgttatctctcaagtttaggtgctgaaaatgtcagctcttagtttaggtgctcctagacacctagtgttcagagaaatcagcttgaaaggaaaagctgagaaaaaaatttgttggcttcaatgcacccctggatgtcatgtggttaagttaccatgtcgaaatgtgtggtgctgttttaaggtacacctgttcttattactctttgtttagtgagggaatgctgcatggttgcttatgcacacg

SEQ ID NO: 5672 - DNA, 1234 bp, Oryza sativa
  Predicted polypeptide sequence is orthologous to G598
gcaccacctcagctcgccagcagcaaccacggcggcgcttcggatgcacggcggcggagcctccacgacgaccaccgccatcgccgccgcgcgggtagcacatgttgcatgagcagcacgcgccgccgccgcagccggagccggaggtttcgctacagctgtcggcgcccgccaccgccgccgacgatgtcgctgcaggcgacgacgaggaggtcaccgtcgtcaccacgtaccgcgacatccaccctctgacgccgccgtcgccgacgacgacgacgacgccacccacgcggctcgggtccgccgcgtactcgtgggacacggccagcagccaccggtccgtgtcgtccgaggagcagttcatgacgatgagccgggagttcacggccatggtcgccgccgggacgaccatgcagactggccccaacgacggcaacaacggcggtgaccagctcaccagcatcggcgaggacgagctggaggagaccaacccgctggcaattgtgccggacagccacccgatcgccacgccggccaggagcagggcgtcccagctggaggttgtccccgcggcagggccatcgccggcgccgccggtggaggcgaggcaggtgaagaaggaggaggtggagacgaaggtgtcggcgtggcagacggcggaggtggccaagatcaacaaccggttcaagagggaggaggttgtcatcaacgggtgggagaccgagcaggtcgagaaagcatccgcatggctcaagaagatcgagagaaagctggacgagcagcgcgccaaggcgctggagaggacgcagaacgacatcgcgaaggcgcggcgcaaggcggaggagaagagggcgtcggcggaggcgaagagaggcctcaagctcgccaaggtgctcgagctcgccaacttcatgaaggctgttgggagggtgcctaccaagcgatccttcttctagcttcctgcagccagcctctgcaaaccttcgatcttgatcgatctgctgctgctctgtttctttcagtgccttttgtgtgctggattaatctagctgccgttcttcgtgtgatgtttgcttagctgtgcgcatccgagaacctaattgtaaaaaagattttaaaacaagttgtatatttgctgttgctgctgttgccctctgctgcttgtgatcacagagtggcccttgtttttcccctggcttgtattatccatacggcataaatggtttgtttgctc

SEQ ID NO: 5673 - DNA, 982 bp, Oryza sativa
  Predicted polypeptide sequence is orthologous to G598
ggcttccactcttctcctccacctccaagtactccgcatccatccatggccaccaccgccctctgatccgatcgatactgatcagccagtagctatgctgggttcggaccagctcgagcaccgcccggcgccgtcggctccccgcgccgagccggacgatgtcgccgacgacgtggaggtggaggcgttccgggacatccacccggagccgtcgcctccgcatctaccgccgccgccgctcaggcagccgtcgtgggacgccgcgagccaccgctcgctgtcgtcctccggcgcgggcggcggcggcgacgtcgagctgttcgccaccatgagccgcgagttcaccgccatggtggcggccgggtcgtcgtccgcgcccagccccgacgttcccggcgacgcccccgccgccgccgacctgaacctgctgcagctggcgcgcatcggcgagaacgagccggcggccgaggcgaacgcgctcgccatcgtgccggcggcggcgggcagcggcccgccggcgccggtggagcaggtgaagaaggaggaggtggaggcgaaggtggcggcgtggcaggcggaggaggtggccaagatcaacaacaagttcaagcgcgaggaggtcgtcatcaatggctgggagagccagcaagtcgacaaggccaccgcctggctcgccaagatcgagaggaagctggaggaggagcgggcgaaggcgacggagaaggctcgcaacgaggcggcggcggcgcggcggaaggcggaggagcggcgggcgtcggcggaggcgcggcgcgggaggaagacggcagaggtgctcgaccgtgccaacttctgcaaggccgccggcagggtgccatccaagcgctccttcttctccttctaaagttctaaccaaagctagctagccttgctcaattatatcatctctagctagctaattatgattattacttgttttctacttaattgatcaatcaatttc

SEQ ID NO: 5674 - DNA, 1528 bp, Oryza sativa
  Predicted polypeptide sequence is orthologous to G598
gaccactcaccaccacagctcagctcggagaagcgaagaggaggaagaagagcaagacgccgatggttacgcgtgtgtgctagtggctgagcactagctgcggcggcggcggcgacggcgacgacgacctcacccacggcggcgacacatgttgagtgaacaaacggcggctagtggtagcagcagcagcagccgcggcgccgacgaccgggagattgtcatcagcaccggccgggagatcgtcgtcagaagcagcgggggtgaggagagggaggaggaggtggtggtggaggaggagctcgaggagccggagttcagggacatccacgcgctgagcccgccgccgacgccgacgccgagccagccgtcgtcgtcgtaccaccggcggaggagggagtcgtgggagtccgcggcggggagcaggcacacgtcgatccgctccgtggggagcgacaccgccccaagtgagctcttccctactatgagcagggagttctcggccatggtcgccgcagcagccaacgccaacgccgccgccgccgcagccgcgaacggcggcgactccagccgcgccggggtggacgacgcgctggggaggatcggggaggatgagctcgaggagacgaacccgctcgccatcgtcccggacagcaaccccatcccgtcccctcgccgcgcccacctcgcgctccccgcccccggcgacgtgtcgtcggcgggcggcggccacggcgacgaggtgtcggtggggcaggtggagaagtaggaggtggagtccaagatcgccgcgtggcagatcgccgaggtcgccaaggtcaacaaccgcttcaagcgcgaggaggtcgtcatcaatggctgggagggcgaccaggtcgagaaggccaacgcctggctcaagaagtacgagaggaagctggaggagaagagggccaaggcgatggagaaggcgcagaacgaggtggcgaaggcgcggcggaaggcggaggagaagcgggcgtcggcggaggcgaagaggggcaccaaggtggcgcgcgtgctggagctcgccaacttcatgagggccgtggggagggcgccatccaagcgctccttcttctgagcgaccgcgccaccctcttcccctcctcctcctcctctctgctttgctcgccgccgtcgccgtcgtcgtcgtcgccggcgccggcggctgatcgttcaccgcttcgcttcacacgcagggatcagtgctgtgatgtggttgctgtgtggaactctcgttttagtgttgtatccacatgtatgatgtactgtcatcatatcctctcttttttttctttttttcttgttctctttactttcttgtgcttgataagggtattgcaaagttgggagggacagacagaacaagtaaatagcataagttggatggtgctctgccccttatagcttatggtgagggggacaagagctgcctgtaatttgttttttgtcatcatcaaggattgtgtatgtcaatatgaacaagatatggagctacctgttttgtgtt

SEQ ID NO: 5675 - DNA, 982 bp, Oryza sativa
  Predicted polypeptide sequence is orthologous to G598
tgcttccactcttctcctccacctccaagaaccccgcatccatccatggccaccaccgccctctgatccgatcgatactgatcagccagtagctatgctgggttcggaccagctcgagcaccgcccggcgccgtcggctccccgcgccgagccggacgatgtcgccgacgacgtggaggtggaggcgttccgggacatccacccggagccgtcgcctccgcatctaccgccgccgccgctcaggcagccgtcgtgggacgccgcgagccaccgctcgctgtcgtcctccggcgcgggcggcggcggcgacgtcgagctgttcgccaccatgagccgcgagttcaccgccatggtggcggccgggtcgtcgtccgcgcccagccccgacgttcccggcgacgcccccgccgccgccgacctgaacctgctgcagctggcgcgcatcggcgagaacgagccggcggccgaggcgaacgcgctcgccatcgtgccggcggcggcgggcagcggcccgccggcgccggtggagcaggtgaagaaggaggaggtggaggcgaaggtggcggcgtggcaggcggaggaggtggccaagatcaacaacaagttcaagcgcgaggaggtcgtcatcaatggctgggagagccagcaagtcgacaaggccaccgcctggctcgccaagatcgagaggaagctggaggaggagcgggcgaaggcgacggagaaggctcgcaacgaggcggcggcggcgcggcggaaggcggaggagcggcgggcgtcggcggaggcgcggcgcgggaggaagacggcagaggtgctcgaccgtgccaacttctgcaaggccgccggcagggtgccatccaagcgctccttcttctccttctaaagttctaaccaaagctagctagccttgctcaattatatcatctctagctagctaattatgattattacttgttttctacttaattgatcaatcaatttc

SEQ ID NO: 5676 - DNA, 1287 bp, Oryza sativa
  Predicted polypeptide sequence is orthologous to G598
cgcaccacctcagctcgccagcagcaaccacggcggcgcttcggatgcacggcggcggagcctccacgacgaccaccgccatcgccgccgcgcgggtagcacatgttgcatgagcagcacgcgccgccgccgcagccggagccggaggtttcgctacagctgtcggcgcccgccaccgccgccgacgatgtcgctgcaggcgacgacgaggaggtcaccgtcgtcaccacgtaccgcgacatccaccctctgacgccgccgtcgccgacgacgacgacgacgccacccacgcggctcgggtccgccgcgtactcgtgggacacggccagcagccaccggtccgtgtcgtccgaggagcagttcatgacgatgagccgggagttcacggccatggtcgccgccgggacgaccatgcagactggccccaacgacggcaacaacggcggtgaccagctcaccagcatcggcgaggacgagctggaggagaccaacccgctggcaattgtgccggacagccacccgatcgccacgccggccaggagcagggcgtcccagctggaggttgtccccgcggcagggccatcgccggcgccgccggtggaggcgaggcaggtgaagaaggaggaggtggagacgaaggtgtcggcgtggcagacggcggaggtggccaagatcaacaaccggttcaagagggaggaggttgtcatcaacgggtgggagaccgagcaggtcgagaaagcatccgcatggctcaagaagatcgagagaaagctggacgagcagcgcgccaaggcgctggagaggacgcagaacgacatcgcgaaggcgcggcgcaaggcggaggagaagagggcgtcggcggaggcgaagagaggcctcaagctcgccaaggtgctcgagctcgccaacttcatgaaggctgttgggagggtgcctaccaagcgatccttcttctagcttcctgcagccagcctctgcaaaccttcgatcttgatcgatctgctgctgctctgtttctttcagtgccttttgtgtgctggattaatctagctgccgttcttcgtgtgatgtttgcttagctgtgcgcatccgagaacctaattgtaaaaaagattttaaaacaagttgtatatttgctgttgctgctgttgccctctgctgcttgtgatcacagagtggcccttgtttttcccctggcttgtattatccatacggcataaatggtttgtttgctcaaatcttgcaaacattcagttcgacactagtactagcacttcatttttcttc

SEQ ID NO: 5677 - DNA, 2308 bp, Oryza sativa
  Predicted polypeptide sequence is orthologous to G600, G2768
atcgccatcaccacccaccctcacgcataccatcgtgccatcaagaacaactcgttttccatcgagcccggctcagtaagtcagacacctgccggtaaccgcaccgcgcgcgcacccgcgagcaagcaacgagggcgagacatagggagcatcaggaggcgctgggagcacgtgcagaaagaaagacaagaagaagaagaaagacgaggtcgagacaggcgctggggagcagtagttggccgcgcagactgacccacagattgtccctattgtcccagacagagactcctgaattgaaaagacgagccttgtttcttgcaggcatttgagacttccgtgcgcttttggctgcctcctcaatacaaaggcctcagagctctcgctgtacattacttgctctcccccgtataatattatccctacttgcactgaggatatctgaacccgcgcgcactctgattacacataccacgacaatcaccgctcagctcatcttggcagctgaaccacaggacatctgaggacgtaaggcagaccggttcttcggtgtactttctcgccagaacagccgccaccctcgccgcacaacaatgtcttcctctattttcttcaagttcaagtcgcagaaagaaccctctcagataacatttgatggcaccagtctgtctgtgtttgaagtgaagcgcgacattatcgccctctccaagctcggtgatggcaccgactttgatcttgaaatcaacacctccgacacaaatgaacgctacgacgatgacacagttcagatccctcggtcgaccaccgttatcgcccgccgattgcccgcgaccaaaccaggtgccggtagagccgcacgctacgtctccggcaagatgcctgtgaacgctaagaagcctgaggctgtggacgagaatggcaaaatcgatgtctctcaattgccggccggtgccatgtacacagctaatggcgagtgggtcattgcaaagccagacgaggcttcgtgggacaaatttcagcagacacaaaaggtagcggctgatcaagccaaagaactcgaagcagacaaagaagtcatgcgtgctcgtggtcttgaatgctctttagatcataagatgttctccgatcctgtcaagacgccttgctgtggtcagatctactgccgcacttgcatcgaaaatgcattgatcgattctgacttcgtgtgtccgaattgtggcgaacagtgtctgcttgagagtcttgaatctgacgtcgagactttggataaggtgaaagctttccaagaggaaatgaaatctgaaaagcaaaagaagcaagccgaagaggcgaacaagaagagcccatctgctgcgcctaactctcctggcaagtcgccccaaccttcagactcgcgccctggttctgccaacggcaagaaacgtgctgccgacgaggaacttgagaacacccacaagcctaccggacccgccgagatgaagcgagctggatcaaaggaggccactcctgttcagcctgcccagcccaacgcagccaaaaacaacgcggcacctgtcatgcccatggcgaacaacttgcaggatttcgccatgcagatggacatgatgtctcgtatgtccggcatgcctggaatgcctccaggtggcatgatgaatcccatgatgatgggcatgaatccgatgatgatgggcggacccggcgccggcggcatgaacccgatgatgaacccgatgatgggtcaaatgggtatgggcggcatgaacggcatgaacggcatgaacggcaacatgaacggaggcttcggctttggtcctcagggacagcaaggcttcggaggccacaacggtggtggaccgcccgcaggcccgagagcttggcagcagcaacagaatcagcaccaccagcaacagcaatggggcatgcacaacggccagaacggcgcgcctcaagggcccgcggccaacggcgcctacttccgccagccagtcaacccgggcagggctcagaacagaggtcgcggacaaaggagcgtggactacaagcagcttggccagtgatgaagatattggtgggcatcagcatggtgagagatttcaagcatgggcttgctggaagccggcagcatgggaggatgttttagcgatggcgttggtggtttgctgatcccatgatggattggctgtgttttgcatcttgcagcggaggactcatgatgtcgttgaatatgcatgggacttttgcttttagtggtccaggactgttctttatcttaaccctactctcgtatacaaccacaataaatcatccaaac

SEQ ID NO: 5678 - DNA, 1555 bp, Oryza sativa
  Predicted polypeptide sequence is orthologous to G600, G2768
gttcgatctcacaatcactgctgctgcaccattcgtccattcctttcctcctccgttctccgacgatcgctgctgcacaattcctttcctcctccgttctccgacgatccagctcgaggaacgatccatggcggtgttctacaggtacaggagcggggtggacaccttctccgtgcccatgcaggagccttccgtctccgtcgccgagctcaagcgcctcatcatggccaccgcgcgccacggccattgacgttcgcgcggccgcggccccagggagagcgtcgcgctgtacagcgacaacaccggcgaggagtacgcggacgaggccgagctgatcccgagcggctgcacggtcgtcgtgcggcgccgagtcgcggggccacctgcagagacgatcgtcgagttgacaacaaagaagccaatgtcgcagggcggtggtggttcttcgtcggactctggagcgacgtcgacgggagctgaagtcgacgacgaggagaaagctatcagcgccgtgatcgacgccgcacagctcaagtgggaggccccgacgtcacaaggaggccactgttacggtcaccgcggcgcacacgcgggcagggcgccgccggccgggtacgtgtgccaccggtgccgcgtcccgggacacttcatccagcactgccccaccaacggcgatccaagattcgacatcccgagggtggcgccaactccagcgtcctcaccggcgccggctgagtccggggaatctggcggcgtcatcccggcggagctctactgcaagatttgccggaacgtgatggccaacgcggtgctggcgagcaagtgctgcttcgacagcttctgcgacaggtgcatccgggaccacatcgccgccaagtccaggtgcgcgtgcggggcgcaggcgcgcgccggcgacctgatccccaacacgacgctccgcaccaccatcgccaacctgctcgccaccaccaccggcgccgcagcaagcgcctcaagtggaaccgacaagacgaggagctccgccggcagcaacgcgccacagccggcggcgccgcagagcccggccgcttcgcaggcgagccgcagcaacgtgtcttccaagaagagcgccacgatctcatcgggtgtcctcggaccaagaaaggcgcgggagatggtggtgccgggcgaccactcagcacaatccggggctctcgccgtcgacggcgatcgccacggcagctacggcttcccgttcggcccggcgccaggctacgtcgaccccttcttcgccgtcggcgtgccattcggagccgatccttacatgtactacggcggcgcgccttacggctgtggcggcgctgcttacggctactacggcggcgaggatcgccgtgacacgaagaggacgcgcctgcgatgatcgcacgtcaccggtcaattgttgcctgctggctgcgctcaacgctagcttggagatattttcttctctcctttttgtgttctccgatgattcggaagacaagtagcgagtcaaaacatgtatgattcttgtatagttgtatgtgtaaatgct

SEQ ID NO: 5679 - DNA, 1621 bp, Oryza sativa
  Predicted polypeptide sequence is orthologous to G600, G2768
ttaaagcatcagttttccgctcaatttaagggcgaaggcaaaattttttgttatttactgctgttctctatcgaataatctgctctattacagaagaagagggggggggggaaaagccaacaaaaaaaatagaaagaaaaacaaaaaaaataaaaagataaattcagaagaaaagaaaaaaaaactgagtgggcattatggctgtatattacaagttcaagagtgccagagattatgactcgattccgatcgaggggcaattcatctcggttgccaacctgaaggagcggatttttgagtccaagcatcttgggagaggcacagattttgacctcatgatttcaaatgcgcagaccgacgaagaatatgctgatgaagctactatgataccaaagaacacatcggtgttgattcgtcggataccaggaagaccaaggaagcctattgtaacagaaccagaagagacaaaagccatggaaggtagggtagaagaaaccatgccttctggtagtgcttttcttgctgatgcatctatgaaatatcctgaagaatctgagtgggatgacgagtttggcaatgatttatatgtttctgattcagtcccttcacagctcggtagccaggcggttgatgcatctgaaaataaagttgatgaagatagtaaaataaaagcacttattgatacatctgcactcgactatagtcaaattcctgatgggtatggtggtggaagaggctatggaagagggatgggtggaagaatgatgggtggtcgtggttttggacgtggtggtctggaacgtaggacacctcctgcaggctatgcctgtcatagatgtaaagtgcctggtcatttcattcaacattgcccaacaaatggtgatgctagatttgacatgaaaaggatgaaacctccaactggcattccaaaatctatgttgatggcaaccccagatggctcatatgcactaccaagtggggctggtgctgtcttgaagccaaatgaagctgcttttgagaaggagatagagggattacccacaacccgctcacttggtgatcttccaccagagttacgttgcccattgtgtaaagaagtaatgaaggatgctgttctaactagtaaatgctgctttaggagtttctgtgataaatgcattagggactacattataaacaagtcaatgtgtgtctgtggtgccacaagcatattagcagacgatcttctccccaataaaactctaagagaaaccatcagccggatattagaggcaccaccaactagcagtacagaaaatgtgggaagcatggtgcaagtacaggatatggagtcagctattcctgtacagcccaaggttaggtctccagctgtttctgctgcttcaaaggaagaaccaaaaagaacacctgcacctgtagaagagtctccagatgttgagagccatagcgaagtgaaaactacaaatgttgatatgagttcttcagataagaaggtccccgcattaccagatgttgttgaaggaaccatggagtctaaaattctgaaagaaaaaacaccagaagcaacacctgttgtgaaagagtcacaggaaaaaatgcctgttgtgggcgaacaagtcgt

SEQ ID NO: 5680 - DNA, 678 bp, Oryza sativa
  Predicted polypeptide sequence is orthologous to G600, G2768
atgagtgccgaatggaggacgccgtccgggggatctagcggcgtcatctcatcggaactctactgcaagatttgccgaaacgtgatggccgacgcggtgctggcgagcaagtgctgcttcgacagcttctgcgactggtgcatccgggaccacatcgccgccaagtccaagtgcgcgtgcggggcgcaggcgtgcgtcgacgacctgatccccaacccaacgctccgcaccaccatcgccaacgttctcgccaccaccagcggcacagcgagcgtttcaagtggaaccgagaagccaaggagctccgccagcagcaacgcgacagaggcggcgccgcagagcctggccgcttcgcaggtgagccgcagtaacgtgtcttccaagaaaagcgccacgatctcatcaggtgtcctcggaccaagaaaggcgtgggagacggtggcgggtgaccactccacagaatatggagccctcgccgtcgacggcgatcaccacggcagctatggcttcccgttcggcccggcgccaggctacgtcgaccccttcttcggcgtcggcgtgccattcggagctgatccttacatgtactacggcgtgccttacggctgttgtggtgctgcttacggctactacggcgacgaggatcgccgtgacacgaagaggacgcgcctacgatga

SEQ ID NO: 5681 - DNA, 3201 bp, Oryza sativa
  Predicted polypeptide sequence is orthologous to G600, G2768
atgacaaagacgcagccgcaactagtggagtcggagccggtgaagaagctccaacgcttgccaccagtgtttagtcgtgtgttggagcttccattcccaagggataccaatgttcgtaagctctttaccaccaacgctgacctcttttttgtgccacatggtgtcggtggtgaacctgatgttgttaaggtacacattgtgagactcgagcgctgggatatgactagggtggtggtgcacattggacctggggagccagacttaaggaatgatctagtctatgacaagtggcgcttccccctagctgagacatccattctatcgatggttatggcagggatggatgcaagcggtgatggtgggaatgaggggatcccaatgtggcccaacattgataaaagaggaggaggaggaggaggaggcggcggattcgggcttcttgctggtgcaagctacattcctaccaagttttcaaggcctcgaaattctcagaaagttgaaaagtgtgtgttggataaggtgaaagcctctaagttcaagagtgccagagattatgactcgattccgatcgaggggcaattcatctcggttgccaacctgaaggagcggatttttgagtccaagcatcttgggagaggcacagattttgacctcatgatttcaaatgcgcagaccgacgaagaatatgctgatgaagctactatgataccaaagaacacatcggtgttgattcgtcggataccaggaagaccaaggaagcctattgtaacagaaccagaagagacaaaagccatggaaggtagggtagaagaaaccatgccttctggtagtgcttttcttgctgatgcatctatgaaatatcctgaagaatctgagtgggatgacgagtttggcaatgatttatatgtttctgattcagtcccttcacagctcggtagccaggcggttgatgcatctgaaaataaagttgatgaagatagtaaaataaaagcacttattgatacatctgcactcgactatagtcaaattcctgatgggtatggtggtggaagaggctatggaagagggatgggtggaagaatgatgggtggtcgtggttttggtcatttcattcaacattgcccaacaaatggtgatgctagatttgacatgaaaaggatgaaacctccaactggcattccaaaatctatgttgatggcaaccccagatggctcatatgcactaccaagtggggctggtgctgtcttgaagccaaatgaagctgcttttgagaaggagatagagggattacccacaacccgctcacttggtgatcttccaccagagttacgttgcccattgtgtaaagaagtaatgaaggatgctgttctaactagtaaatgctgctttaggagtttctgtgataaatgcattagggactacattataaacaagtcaatgtgtgtctgtggtgccacaagcatattagcagacgatcttctccccaataaaactctaagagaaaccatcagccggatattagaggcaccaccaactagcagtacagaaaatgtgggaagcatggtgcaagtacaggatatggagtcagctattcctgtacagcccaaggttaggtctccagctgtttctgctgcttcaaaggaagaaccaaaaagaacacctgcacctgtagaagagtctccagatgttgagagccatagcgaagtgaaaactacaaatgttgatatgagttcttcagataagaaggtccccgcattaccagatgttgttgaaggaaccatggagtctaaaattctgaaagaaaaaacaccagaagcaacacctgttgtgaaagagtcacaggaaaaaatgcctgttgtgggcgaacaagtcgtaaagaaaaagaagaagaagaaggtgcgcgcaccaggaaatgctgaggactggaaaccctatcaggactttggagctgaaaattttgctggaatgcctatgggtccggcaggaggcttcaacccttactggggaggggggatgccattgccaatggattacatgggtgcgccatttcctggtcccatgccatacatgggttatccaccaggtcctttcgacccttttggtgggggagtcctcccacaagatccatttatgcccccaggatacatgatgccagcagttcctagggacctttctgaattagcagttaacagtatgggaatgaatatgggtccaccggttgttagcagggatgaatttgagctccgaaagcctgataataggaggagacgtgaaatggagcgattcaatgaaagggagagggagcgtggacattcccgcgagagagaaagagaaagggagagggagagggagagggagagggagagggaaagggaaagggaaagagagagggacagagaccaaaatcgagatcgcgatcgagaccaagagcgggatcgggatcgggagcgagacagggaaagagaatctcgaagggaagcgagggaatcatccggagccaataacgatagtactacctcaatgaggccgaaggctaggtcaaggtcgtcgcagccggcggacaggtcggcgccgcctccgccggcgagccccgaccgccactcccggcgctccccgcaccgctcctccggctccggcaagaagcgctcctcctccgaccgctacgacgacctgcccctcccgccgcctccgccgcccgcgtcgcgccacgaggcggccgagcacgcccacgcgaagaatacggcggcggcggccgacgcgcggtccaaggccaagggcagcgtcttctcccgcatcagcttccccggcggcgacggcaacccttccgacgccaagcgcagccgcaggtcctcctccgacaagcccccggcgtcctcttcttcctcctccaagaaagcacgtgccgctgtggcggaggacaacgacggccgccaccaccgccgccaccaccgtgaggcggccgccgcggcggaagagaggcggaggcccgcggccggagactactacggcgaggaggaggaggacgacgagagcgaggaggagcagcatttcaagcggcgcccctcgtcgtcgtccaggcgggagcgggagcatcaggaggcgcaggaggagccgcggcggtccagggagcgccgcggcggcggcagcgacggcaaccaccaccacaaccatggcggtggcggcggccacaagcgccggtga

SEQ ID NO: 5682 - DNA, 2874 bp, Oryza sativa
  Predicted polypeptide sequence is orthologous to G600, G2768
gcgcggatttctcccccaaattccaccccccccaaaatccccttctattcggcgaacgcgacggaaaccctagctctccggccgcctccggcgaggactccgcctccgcatccgcatccgcatccgggccagcgacgccggcggaagtcgaccgcccgcccgcgcgcgctcgcccccccccctccccgccatcgcctcgactcggcgccttcctctactccgcccgcctctcgcgttccgactccgggcaggcctccttcgtcgggactcgggactcactcgcgcggggttcgtcttcttcctcctcggcggcgaagggacacgccggccgccgatcgacgcgattccccccgtagatcgattcgatctgtaactctctatctctgtgtattatttgtgtattttgatatctgagggaaaaagtctcagcctctctcgccgaaagaaaaaaaaataattgtgcagaagaggcgagaaggggaaaaaaaacttgatatcaacaccatgggtgttgtgtattacaaatataagagttcaaaggaaactatttctgtgcccgtgccccattcttttgtctctgtttctgaactcaagcagctcatcttgacgagcgacaaacatggccgtggccgcacccgtggccgcggccccagagaagatattgtcctctccaacgcccagaccggcgaagaatttctagatgaaaatgccatgataccgcagaactcgactgtgttggtccgccgaacttctgggcaacaatcagagaaaatcgtcttgttctcctcgcgggaagttatagaagatggtgctatagcttcaaacaagtcagagattactgaatcaacctcaaaatcttgttcctctacagaagtacaggatgaggatgctgcaatcgcatctataattgatgcagctgaactcaaatgggaagacaagccatctaaaagaggacagactggtggaaggtttacgtcaggacgttatggtcatggaccggtcgaaggggagacacctccaccaggctatgtgtgccgcagctgtggagttccaggccatttcattcaacattgccaacaggagagaaagacacctccatctggctatgtctgctacagatgccgaattccagggcattttattcaccattgcccgaccattggtgatcccaaatttgacgattacaagaagccccatactcttgtgccagaagtatctgcatgtcctattgatggcattccatcagctcttgccccagctgcatctgtgagtgttgttgacgacttgccagctgagctccattgccggctatgtaataaagtgatggcagatgcggtgttgacaagcaagtgctgcttcgacagtttctgtgataaatgcattcgtgattacatcattacacaatccaagtgcatttgtggagtcaaggttcttgcagatgacctgattcccaaccaaacacttcggagcacaatcagcaatatgctggcaacaagggctagcagcatcactagtggtacagggaagcacaggagctcttcaggcagcaacgtggatcctaattcagcaagccaaactccttcagctgccttggaaaagcaatctaaggatcaccacatatcatcagctgctcctgatgctggcctccaagttgctacagaacatgttagccatcttgagcataaattgacaacaggtgttgatctcgaagtgaaagatgaaggcaattctgcagggatattggtagagaagattgtaccaactgctgatgccagattaaaagatgtaactgactccacttcaaagccggccactatttcaggaaccatggaacccaaagcttccaagactgatcaattgaagaagaagcgcaagaaggcagattcaactaaaattgttcatcctaacaatgctaactatggttacagcattccatttgaccctgcgtattgcaacccttacgtcagtgggtatccttggttaaccgatccttacatgtacggcccagcgggcatgccttatggtggctatccgatgggcccttatggtgtcaattccatcggcaacatgccactgcaatttccatcagcaatgcaaggcaatttggcaaatactcactgctgggaaactcaatctatgattcactgggcaaacgaagacgctgcacgtccaaggctggcggcgaagcccaaagaacctgaacctgccaatcagtctcgatcatcagagcgtaaccagcgtctgagctcttctcatggcaccgatcccagttacaagaccagcaggtcaagctctgacaggagggaccataggcgctccattgattacgtcgaggatcaccgctctagtgattacgccgaggatcaccgcagcagcaagagaatgcgcgcgtcttctccatctccaaccggtggtgacaggcacagcagagcgaggtccaggtacagttccaggaagcttacttacgaggattcatctccaaccggtggtgacaggcacagcagagcgaggtccagtcacagttccaggagccttacttacgaggattcaagcgatgatgagcgcaacttcaagaggagatggggaggcaaaagatagataggtcaccgtggacgcaacacaaggccgtgatacctgaatgaatgaagctgatgaacatcttgcatcattccatatcaaatgcttgttgatggatgtatgtgttaattgtaagctgaggagaaatctccgaaagcgattttcctcttaacggaattgtaattatgagctactattaatgtaaaatgaatgagagcaattctcatcccctctatgtaatgacaatgtcctccaaagatgagtggaacaatccttgacctttaatagtcgtttact

SEQ ID NO: 5683 - DNA, 907 bp, Oryza sativa
  Predicted polypeptide sequence is orthologous to G602
gtatcagtcggtattcagtacgcactacgcagcagcccgtgagtcgtcgtgaccaaacgtatagtatactagctaccaaaagcagtacggtgcctggtttcattgtaagcagccgcgccgagtcagtagcgtagcgtgagcgcggtgaagatggccggggaggcattgaaggaggcgggggcgacgcccgccgcagcgaacgcgggggaggagaaggccgtcatcccggcggcttcgacatcgccggtgatctccaagaccgatgatgacacggagccgccggccgatgactccaaggctctcgtcgtcttcgtcgagaaggttgctgataaacctcatgctgagaaggcaacagcaacagcaacaccaacaaggacctcaaatgacagagatattgcccttgcaaaggtggagacagacaagcgagaatcgttgatcaaagcatgggaggagaacgaaaaggcaaaagcggagaacagggcctctaagaagttattggatattatttcatgggagaacacaaagaaggcagtaataaaaactcaactgaaaaagaaggaagaagagttggaaaggaagaaggcagagtacgctgagaaggcgaagaacaaggaagcaatcgtccataaggaagctgaagaaaagagagcaatggtgatggcccggcgcggtgaagaagtgatcaaggccgaggagatagcagctaagtaccgtgcaaccggagtgacaccgaagaaacatatcgggtgttttggggcataagaaacatcgatccgagccatatacttgtttttctttctctttcgaaagttatttgtgttgggttgtaacttgtaagtgtgtacttttttttctttggaaaaattggaaccatgccattataattttgtaaaatttgagatatgct

SEQ ID NO: 5684 - DNA, 1022 bp, Oryza sativa
  Predicted polypeptide sequence is orthologous to G602
gagttcgtgtgcttctctcatttgttccttgatatatttgctacgtcgtcagagaactcgtgcagatagcttctttggctgagttgttggagatggcggaggtggcgccgccggcgccggcgccggagccgaccaaggacatcgccgaggagagggccgccgtgccggcgccggaggagtcgaaggccatgaccgtcgtcgatgatgctgagaaagctgcagcaacaggtggctcacacgaaagagacgctctcctgacgacggtcgccacggagaagaggatatcgctgatcaaggcgtgggaggagaacgaaaaggccaaggccgacaacaaggcggccaagaagttggccgacatcgcctcatgggagaactccaaggtggccgagatcgaggccgagattaagaagtaccaagtaagttcagctcagctaagttcatcaacaagcagaacaaggagagatcaattatgtgtgtgtgaatcattgagttgatcgatcggttcatatatatgcaggagtacctggagaggaagaaggcggagcaggtggagaagttgatgaacggcgtggcgaaggtgcacagggcggcggaggagaagcgagcggcgacggaggcgcggcgaggggaggaggtggtgaaggccgaggaggccgcagcaaagtaccgcgccaagggagagccgcccaagaagttgctcttcggttgaatctcttctcggtcatctccattgatcgtcgtcgtcgtcgtcgttgttgtaaatgtgtgtgcgacagtgtgagtgtaccggtgtcaagttcagatagctagtggttggatgtattttctcagttgtttgttttcgtttaatttcatgtacagggcagctattgcagtctcatgtgaaaaagggaacatttattatgtacagacatgatgttttggggtctttattcggattcggcggtgaaattgtaacatttttgtgcctgtggtacttggctagtactcatgtataagaggcttacccatttgacattatt

SEQ ID NO: 5685 - DNA, 1847 bp, Oryza sativa
  Predicted polypeptide sequence is orthologous to G605, G1944
ggctcttgctgctcctcttctcctcgcttcgtcttcttcctcctctcgcctcttcgttgcgagtagagagatttttgttgtgatttttgagggaatatttttggatttttggtttatttttgtgtgggtttttttggaggtgtatttattttgtttttttggtggtgatttatttttgagaggttttaagggattaagggaggtgtgtgaggaagatggggttagtgtgtgtgagctccaatggcgagagctcgtggcggaaaccctactaggttgaggaggaggaggaggtcgtcgtcgcgctcgcgtgtggaccatggaggccaagtcgggggaagcgagcgttgcgccggtggccgtggcgaccgaggcaacggcggcgacggtgagcttccagccgcaggcggcggtggccgagcagggtagctcgagcggtggtgtgctggtgccgccgccgcctatggcggcgggaggaggaggagttgtggtggcggcggcgccggtggcgggggtggtgaaggtggggaagaagagggggaggccgaggaagtatgggccggacgggagcctgatccggccgctgaacgcgacgccgatctcggcgtcggtacccatggcggcctccgcggtggggccctacacgccggcgtcggcggtgggcgccgccatgaagcgcgggaggggtcgccccctcgacttcgcctccacggccaagctccatcaccaccaccaacaccagcaccatcaccagcagcagcagttcggcttccacttcgactccattggtgaaatggtggcttgttctgctggtgcgaattttactcctcacatcatcactgttgctcctggagaggatgtgactatgaaggtcatatcattttctcaacaaggaccacgagctatctgtattctatctgctaatggtgtgatatcaaacgttacactgcgtcaacctgattcctcgggtggcacattaacttacgagggacgttttgagttgctatctttgtctggatcgtttatgcctactgaaaacagcggaacacggagtcggtcaggtgggatgagcgtttctcttgccagcccagatggccgtgttgtcggtggtggagttgctggccttctggtggcagcaagtcctgttcagattgttgtcggaagcttcctaccaagctatcaaatggaacagaagaataagaagcctagggtggaagcggcacccgcccttgcacagactcctcctgctgttccaatctctagtaccgatacgcacagcagcgagcaagggcagcacagctccgtcgccccaagaacaacaaacatcgtaacctcagcatacaacccagaccagagctgggcatctcctgctcagtcgatacctgacagcgcgagaacaccatcgggcgatgtgaaggtcaccgcctctggagcctgaaactgagatgaactgaccaggatccatgaaattcctggtctgtcactgctgcagccgcacaccatgatcgccggtggcggccaaagatggcttcatttctttctgacttgtaaaagatgtatctgagttccagtaggttttccatcttcaggcagaagagtctaactgcaattgctgtagctgtcccgatattagtcactgtttaagcatcaggctaccctgcttccttgtaacaccatgtcggtcttattggagattggagagttctgtagttacaaaattgtactattagttctgtgtgtgtgtgtgtgtgtctctaggcttctttttcattttgttggattactccacttaatttgctcctggtgtaccccttattaaattagcattagaattttttttcactctaatt

SEQ ID NO: 5686 - DNA, 1167 bp, Oryza sativa
  Predicted polypeptide sequence is orthologous to G605, G1944
atggagcccgcgacggagaccacggcgacttcgccggctgcggctgccgctgcgcagccggaggcggaggcggaggcggaggcggagtcggcggcgacgccggtggcagtggcggcggcggcggcggcaacctatcagccgccagcgccggtggttccagtcgccgtggcaggtgcggcggcggggagagggaacgggaagaggaagagggggaggccgaggaagtacgggccggacgggagcctgctccggccgctgaaggcgaccccgatctcggcgtcggtgccggacgactccggcggggggcagtacacgccggcggcggcggtgggggccgtcatgaagcgcggcaggggccgccccgtcgggttcgtcagccgcgcgtcgccggtgtccgtggccgtgacggccgccacgtccaccgccgcggtggtcgtctcgtctccggccacccacacccagacgccgctcgggccgctaggtgaattggtagcatgtgcttctggtgcaaacttcacacctcatatcattaacgttgctgctggcgaggatgttaatatgaaggtcatatctttctcccaacaaggtccaagggcaatttgcattctgtctgctaatggggtgatttcaaatgttacattgcgtcagcaagatactttaggtggtacagtgacttatgagggccggtttgagctgctctccttatccggatcattcacgccaactgatagcggtggaacgagaagccgctccggtggaatgagcgtctcgttggcggccacggatggccgtgtcatcggaggcggagttgccggcctccttgtggctgcaagccctgttcaggttgtggtaggaagcttcctgccgagctaccagctggaccagaacgccaccaagaagcccgtcatcgagatcacgacggtgccgccgccgccgccggccatcggcttcaccatctccagcggcgaccctatggaggactcctacagcggcagccatggccagcaccgctccggcgccgccgcggcgacgacgacgacggcgaaggccaactcgacgtcggcgttcagggtggagaactggacgccaccggcgccgccggcggcggaggcggcgaggacgaagacgccgtcgtcggaggccaaagtcccagtccccggagcctga

SEQ ID NO: 5687 - DNA, 575 bp, Oryza sativa
  misc_feature (496)..(496): n is a, c, g, or t
  Predicted polypeptide sequence is orthologous to G611
ataaaagcgttattataacccattttattcatagatcagcacaaattacaatactacaatacctgacacaaaactacaactgacaacaccaaaggcacggatgttgcgtacctatagcttttgtttaaaaacatatacatacatacatacatactaactagccgggggtacccagtttacacacagcaaatgcaatcctttattgaccaagcaaacagctttagggataattaagtagctttacaagcacattatcatgcatgtttagcaaatacatatatttgtaagggtttatgggggcgtttttatttggcataatccattattcgttcgggtcttgcctcgtcgggctcatgaacaacaaccggggcacttgcctttccacttgcaacatgggccgttatggccgctgcaataactcatgcacttgccgtcatagtcgcagcagcctttacagttgcaaggcccccacttgccgtcgggaaaggcgacgttnacaacgggagatgccgccaccagcctcaggaaagcgaacacaacgaaagccttgttggaccccattaatttgggcaagc

SEQ ID NO: 5688 - DNA, 685 bp, Oryza sativa
  Predicted polypeptide sequence is orthologous to G611
tttttttttttttttttttttttttttaacacaaactccaaactgtggacaaaaaaacttacgggggcttattttttttttattcgcctactagctatctcatattatttaccacggaacttaggaatatagaatatgcttattatgccaccgattggtcgaataagggactaggattgaaatatgggtttgaatgacagtataattacacagctgaaaatatcatttggagctgctggtggactatctagcaactttgtgcgctcgggggtgagagacagatgcttcatccttttttagacccttccggtctcctagcccaagctggggctaggccaggtccataccggggatcataatagagatcctccctagccctaatgcggtcctttgcatgagataccaactcgggggagcgccagccaccaacagatccttctaataggagacaggactgaacgagggatttgtaaactatagtttatcccccgtgagacaagcatccagccaatactgctcatttagatccgaacggaccgaggaggttggtcgagtcagacattttgccacccttaaccagggctatatgagaagaccaattgccggggggttccccaagggaattcacttctattcactgggatcttattgaggtggccccaacctggaacattagatatttcaa

SEQ ID NO: 5689 - DNA, 3133 bp, Oryza sativa
  Predicted polypeptide sequence is orthologous to G611
cggcggggtctcatccgattggaaacagattgggaagggggagggggtaggaatacgtggcgtcggcagtattaggtatagagagaaaccctttccatcctttgtctcttagccccgaaggagagagaaaaatcagaaaaaaaaaaaccctccgcgtgtgggggaagcagagctccggacgctggcgccgctcgcgccaccgcacccgcaccgccatggcgtcgtcctcgtccaaggcctccgattcctcttcccaacgccccaagcggccggatcaagggccatcgggcaaggacgcggccggcctcgtcgtgctgcacgggaagctggcgcagctgaagcgtcaggtccaatccacccgcctcgccgcgatcaaggagagggtggaggcgaacaggaaggcgctgcaggtgcacacgtgcgctctgttcgacgtcgccgcggcggcggaggtggcgtcgcggggcgccgagggcggcaacgcgctgtcgcggggcgcggcggaggggcactgcaggctcgtggggtgggactcggcgagcgggccgggggagagggagttggtgcatgtgcaggaggagaatctggtcgccgggacgctcgtgctctcgagctctggtggtagcggcgcctcgcataggaccgtcgtgcagcttgcgaagctgcctgtggtcgacaagattccgccctacaccacgtggatcttcctggacaaaaaccaaagaatggccgatgatcagttagtttgtaggaggagaatttactacgacccaattgtcaatgaggctctgatctgcagtgaaagtgacgatgatgttccagagccagaggaagagaaacatgttttcacagaaggagaagatcagctaatatggaaagctactcaagatcatgggttaagtcgagaggttttaaatgtcctctgccagtttgttgatgcaactccttcagaaattgaggaaagatcagaagttctttttgagaaatatgagaagcagtctcaatcttcttacgagacagattttcaactttttcttggcaagaccatggatgtggctttagattcttttgataatctcttctgtcggagatgtttggtttttgattgccgtctccatgggtgctcccagaacttggtattccctagcgagaagcaaccatatggtcatggacttgatgaaaacaagagaccgtgtggcgatcagcgctaccttcgaaggagagaagtatatcaagatacgtgcaatgatgaccgaaatgcttgtacaacatataatacggattcaagatcttcctcactcaaagttagtgctaccatattgtctgaatcagaagattcaaacagagatgaagataacatcaaatccacttctattgttgaaaccagcagatcaaaaataactaattctgaatatgctgacaaaagtgtgacaccacctcctggagatgcttctgaaactgaaaatgtgtcccctgacatgcccctaagaactttaggcaggcgtaagatttcaaagcatgcctccaagtctaacgatcattcacctgataaaaggcagaagatatatagctcaccgtttccttttgcaatgagtgtactgaacaagcaatctgttccagaaattggtgagacatgtccagattccatagaatctgcagttgatcaacttccaagtctggatgaccctaacaagaaaatttctaccaaagatatgtgtgctggaagcacaactaacactactgaaaatacattacgagataataataataatttgttcatctccaacaaggagcactctatttctcattggagtgctttagagagagatttgtacttgaagggaattgagatatttgggaaaaacagttgtctcatagctagaaacctattgtctggcctgaagacctgcatggaagtggccagctacatgtacaacaatggtgcggcaatggcaaagagacctctatctggtaaatccattttaggtgactttgcagaggctgaacaaggttacatggagcaagatttggtggcaaggacaagaatctgtcgtcgtaagggccgagctcgaaagctcaaatacacttggaagtctgcagggcatccaactgtaagaaaaagaatcggtgatggaaagcaatggtacactcagtataacccatgtgggtgtcagcaaatgtgtggcaaagattgcgcctgtgtggaaaatggaacttgttgcgagaagtactgtgggtgctcaaagagctgcaaaaataggtttagaggatgtcattgcgcaaaaagtcaatgcagaagcagacagtgcccgtgttttgctgccagtcgtgaatgtgatccagatgtttgcagaaactgctgggtgagctgcggagatggctcactaggtgagccactggcaagaggtgatggctatcagtgtggaaacatgaaactcctcttaaaacaacaacaacgtatattgcttggaaaatctgatgttgcaggttggggtgcattcattaagaacccagtaaatagaaatgattaccttggtgaatacactggcgaattgatttctcatagagaagcagataagcgtggcaaaatatatgatcgagcaaattcatcgttcctatttgatttaaatgagcagtatgtactggatgcttatcgcaagggggataaactgaagtttgcaaatcactcgtcgaatcctaactgctatgcgaaggttatgttggtggctggcgatcatcgagttggtatctatgcaaaggaccgcattgaggctagcgaggaactcttttatgattaccgctatggacctgaccaagccccagcttgggctaggagaccggaagggtcaaaaaaggatgaagcatctgtctctcaccaccgagcgcacaaagttgctagatagtccaacagcagctccagatgataatatcaactgtaaattataccgtcattgaaacacatagttcaatcctagtccattatacggccaatcgttggcataataagcatattctatattccttagttccttggtaaataaactgagatatcgagtatgcgaataaaagaaaaataaggcactgtaagtttatttgtacaaagtttggaatttatgctatgtatagttttgcc

SEQ ID NO: 5690 - DNA, 3205 bp, Oryza sativa
  Predicted polypeptide sequence is orthologous to G611
gcttccctttcctccacccacgccgcgacgacgagtcgccgccgcggcctcgccggcgaccaggtctccggcggccccgccgcccgccgtgacggggctccggccttccgccctcctccccgcaccgcccgctatctcggctccccgactcctgcattcccccgactctcccccggccgccgccgccgccatttctgactctttctccgcggcgcgtctctcctccgagagcacgccgaccgcctcccgaagcggcgtcgcggccgcggcggccgccgccttctcccgcccctgatggctggcgattcccgaaatgagccgatgttttgcgaggaagggagcagtgaatcgggctatgttctatgtgttattgattcgctgaagaagaaaatcacatcggaccgctttgtttacatccagaaaagggtagaggagaatagcattaagcttagcccgattacactgcactctcacaatttgtcaaaaaataggcaaactagtacatccaacagtacagatttagtctcgaatttgctcacaaagaggaaagaagatgccctgtgtgctgtgaatagtcgtgagtcatctcctgatgaaagtgaaggtgccaattgccaagatgagtgttcatcgactgttattgtgggtggaaatctatccgcgaggaattctgtccgtccgattagactaccagaagtggcaacactccctccatatacaacttggatatttttggacaggaaccagcggatgcaagaagaccaatctgtacttggtcgtcgaaggatttactatgatacaaactgtggcgaagctttaatttgcagtgatagtgaagatgaagctgttgaggacgaggaagagaaaaaggagttcaaggattctgaagattgcataattcggatgaccattcaagaatgtggcatgtctgatgctgtgcttgaaactctagctcgagatatcgaaagggctcctgatgatataaaggccaggtatgagatcctacggggagaaacctgagggttcttccaagaaagtgtctgaacttaatgtcaaaatggaagacgtgtacggtgataaagatctggatgcagcattggattcctttgacaatctcttttgtcgccgatgtttggtttttgattgcaagctacatgggtgttctcaagatttagtatttccgactgaaaagcaggcaccattgtgcagctcggatgagggtacaccatgtggtattcactgttacaaactggtctctaaaccagatgctatcatggagattgattctcatttgcttgttgatgttgaggagccaacatcggacaatctaaaggatcagatagggtcaaataagaaaaagcttggttctagtgggcagaaaacaaaatctcaacaaagtgaaagttcttcaactgcaagggtttcctcagaaagcagtgagtctgaagtacaactgttaagcaataaatccccgcaacactctcctggcctctcaaaaaataagcttggcgcaaaaggtggaatcaagaaaagtactaacagaagaattgctgagagaattctaatgagtgtgaaaaaggggcaacaggaaatgtcaccggactctaattctattgttaatggatgccattggcctagggatatgaagcttagatctgatactaggagtggtattaaggattctgttgtatcctcacagtgtaattctccaagcacaaggagtttagaaagaagggcacacttcaaatggagaataactcatcttttgtggatgctcagagtgattcaatggaggatacaaataatgaacattcagcaacagatggttgtgatagttcaaggaaagaggaatgtgttgatgagagtatatgcaggcaagaagctcatggcaggtcctggaaagtgattgagcaagggcttctattgaaaggattagagatttttggaaagaacagttgtttaattgctcggaaccttctgggtgggatgaaaacatgcacagatgtttttcagtatatgaattacattgaaaacagcagtgcatctggagctcttagtggtgttgattctcttgttaaaggatatatgaagggtaatgaattacggacaagatcaagatttgtgagaaggcgaggaagggtccgccgtttgaagtacacctggaaaactgcaggctaccattttataaggaaaaggattacagaaaggaaggatcagccttgtcgacaatacactccttgtggttgccagtctgcatgtgggaagcaatgtccatgtctcacaaatggtacctgctgtgagaaatactgtgggtgcccgaaaatgtgcaagaatcgcttccgaggttgccattgcgcaaagagtcagtgtcgcagccggcagtgtccatgctttgctgctgacagggaatgtgatcctgatgtgtgtagaaactgctgggtagggtgcggtgatggtacattgggagtccctaaccaaagaggtgataattatgaatgccggaacatgaaactgctgcttaaacagtaacaaagggtcttacttgggagatctgatgtttctggctggggagctttcctcaagaatagtgttgggaagcacgagtatcttggcgagtacactggggagcttatctcccataaagaagctgacaagcgtggaaagatatatgaccgtgagaattcatcgttccttttcaacttgaacaatgagtacgttcttgatgcctacagaatgggcgacaagctgaagttcgccaaccattcccctgatccaaactgctacgccaaggtcatcatggtagcaggcgatcacagggtggggatcttcgccaaagagcggatcagcgcgggcgaggagctgttctacgactaccgctacgagcccgaccgggccccggcgtgggctcgcaagcccgaggggcccggtgccaaggacgacgcccagccttccaccgggagagcaaagaagctcgcccactgaagaagaagaagaagaagaagatcagccgttgattcttttgttgtcttggttgattctttcgttattggtgagggggaccgagaactctgacggtgattagcgccgtaaggaaaactttcctgccattcgttggccccctcgattcgattcgttgattttccctgaattctgtaactgctgcacctgtcgcctgttcaacttcaaaagatttttctgattctgg

SEQ ID NO: 5691 - DNA, 1363 bp, Oryza sativa
  Predicted polypeptide sequence is orthologous to G616
ggcacgagcagggtgagggcgacgggggggaaggacaggcacagcaaggtgtacacggcgaagggaatccgcgaccgccgcgtccgcctctccgtcgccaccgccatccagttctacgacctccaggaccgcctcggcttcgaccagccgagcaaggccatcgagtggctcatcaacgccgcctcccccgccatcgacaccctcccgtccctcgaccccgccgccttcgccgccattccccacgccgccgccgacgccgcgcccacgcggcggcgttcgcagcagcagcagcagcagctcagcaacaagtccggatgcagtagcacgtcggagaccagcaaggggtcggacaaggaggtcaccgtggcgagcgccccggcgcaggccgcgtcgttcactgagctgctcattgctggggtggcggcgtcgtcggcggggggtggcgccattggcaacggcgccgactgcgtgggcatcgcgcaccccgggaaaggaggcgcggagggggcgtccacgtacggcttctccgccgcctcgagcttcggcgacgcgccaccgatcggcatggtgccggcgccgccgttcaacttctccgcccccggcgccgacatggcggcgcactactcgctcgcccaggaccagctggcggcgcctccgcctcctgccggaggcgactacaacctcaacttctccatgtcctcgggtttcttgggtgccaatagggggacccttcagtccaattcgccgtcgaacatgtccggccaccaccaccaccaccatcagcagcagctccagaggctggacggctccaccatttccttcctgcttggccacgccgccgcggcggcgcacccggcggcgtccgagggccagatcaccagcaccgccgcgttgcagctgtgggatggattccgccactccggcatgaaggagaagagcaagaactgatcgatcccagcaacgcatcctccaaaggaactgaagatatcatcatcagattaattgttgtcacctttccagcaagagctcaccgtggggagctgctacaagtttattgcgatgactgcccgtgttcttttagctgggtcatcgttctgctatgctgttttttggccatcatgaacaccctgccgctgctgctacctgccattgccatcactcagacaatcttgtgaatttccttctttttcctagatgaagctgctgtacaaatttttgtgggagacgtgagtttcgaacaagaataagcgtgtcccgtagccagcgttaaacctttcccttccagaaatatttttcgagtgaattgaaattcatatgtgcctctggttattggagtggcaaaaaaaaaaaaaaaaaaaaaaaa

SEQ ID NO: 5692 - DNA, 1248 bp, Oryza sativa
  Predicted polypeptide sequence is orthologous to G616
atggagctcgccggcagcaacaacaagcgggggagggtgagggggcccaacgacgacgacgacgacgccggggagccggacgccaagcgccatcaccaccagctgctgttgccgtggccgcagcagcagcagcagcagcatccggcgtcgcggatctaccgggtgtcgcgggcctccggcgggaaggaccgccacagcaaggtgtacacggccaagggcatccgcgaccgccgcgtccgcctctccgtctccaccgccatccagttctacgacctccaggatcgtctcgggtatgaccagccgagcaaggccatcgagtggctcattaaggccgccgccgccgccatcgacaagctcccttcgcttgataccgcttccttccccaccaaccccgcctcctccgccgctgttgctgctgctgctgctcctcctcttccccatgccgaacgcgagcagcagcagcagctcaccaagtccggatgcagtagcacgtcggagaccagcaagggctccgacgccggggacgacgccgccacccccaccgcgcccaccgccgcgcccgcctcctcgcaggcggcttccttcaccgagctactcaccgggatggccgcagccaacgcctcacccgctgaccacaagcagcagcaggcgtggcagccgatgaccgtcgccgcggccaccgccgactacatcggcttcgccgccgccgccgcgccgcatacgcagccgcggaaatccgccgcgggccatcactccgcgatgccgcacaccttcgcatcacccgctccccacctcgccaacatcacccccatcgccatggcgcccgcgcagcacttcaccctcacacccgccgccgccgagcaccacgcggagatgacgcactactcgttcgaccacttcatgcccgtccacgcggcagcagcggcggcggcggcggcctccaccccggccggcggcgactacaacctcaacttctccatgtcctcgggtcttgtgggtgtccacagtagggggacccttcagtccaattcgcagtctcacctctccagccatcaccaccaccatcaccagcaacagcagcagcagcagcagctgcagaggctgtctgctccgctggatgcgcccaacattccgttcctcttcagcccggccgccgcgcccaccgccgcggacacccagttcgccgccgcattgcagctctgggacgggttccggcacgccgacatcaaggagaagggcaagcactga

SEQ ID NO: 5693 - DNA, 497 bp, Oryza sativa
  Predicted polypeptide sequence is orthologous to G616
gcacgaggccgatcgcctcgccgccttaacccccacccccgatctccttcctcaccgacgacgcgcgccccactccccccacctcaatgcgcgcttcctagggcatatgaccggtactacgacaaccatcacctctcgccgtcaccgtcatcgtcgggatggagctcgccggcagcaacaacaagcgggggagggtgagggggcccaacgacgacgacgacgacgccggggagccggacgccaagcgccatcaccaccagctgctgttgccgtggccgcagcagcagcagcagcagcatccggcgtcgcggatctaccgggtgtcgcgggcctccggcgggaaggaccgccacagcaaggtgtacacggccaagggcatccgcgaccgccgcgtccgcctctccgtctccaccgccatccagttctacgacctccaggatcgtctcgggtatgaccagccgagcaaggccatcgagtggctcattaaggccgccgcc

SEQ ID NO: 5694 - DNA, 1674 bp, Oryza sativa
  Predicted polypeptide sequence is orthologous to G618, G2057
tcttgttttaattttcgctcttctcctttccggttaactgtgggtgagagggagctcaagctggaggaagacaagaaccagttgtccaagggcttagacccttggacgagcaaccctaccgccagcgcgagcaccttgcactacctgctccaggagaaggagagggcgcagcaagcgcatgagcagcttcagatctaccagcagcagcagggattcggcagcttcctgcaacaccggatcaggcagccggcgagccgggggccgggaggtggaggcggcggcggcgatggcggcggcagcagcggcgagtcgacgcccgtcgaagcgctggccactgcattcggggcaggccgcatcgtgcggtccgcggccgggcgcaaggaccggcacagcaaggtgtgcacggcgcgcgggctgcgggaccggcgcgtccgcctcgccgcgcacaccgccatccggttctacgacgtgcaggaccgcctcggctacgaccggcccagcaaggccgtcgactggctcatgcgcaacgccaaggccgccatcgacgagctccccgaccgcgccgaggccccgccgccgcccgccgcggcgtcgacggagcagcccgaggccaccgagcaggcgacctcgacgtcctacgggttcggcaacactaccggcggcaccatgaccagcgccgcgtcggccgctgctggctccttccttccacattcgctgggggcagatcgagtctccgacagcgtcaagtccctgttcccctcctcgtccacagccagcggcgccgcctccgccggacacgacgagtacaggggatccccgccggacctcctgtcgcgcacgacaagcaaccagcagccgcaggagctgtgcctcaccctacagtcgaaccagcaccagatcttcagccatgtctcgtcgaaccaccacggtatgatctcgagtgcaggcgttccaggttggcccgaccacagccagagaatgcaggcatggcatgccccggagaacagcacaggagacggccgcggcggcggcaatggcgacggctacatgttcgccatgccgtcgcggcaagggctggaccagagccagctcttctcgcatggggaaccccttcagtccagcggtcgcgggtgggcgtcagcccgcgcatggctagaccccctcgcagtcgcagccatccaccaccagccgtcgacaatggctgccggacaggtcggcttcggccatctcgttggcggcgccggtggcggcggcgggtttatggggtttctcgcgccggcggcgcagcggcttgagggcgaggaggagcacggaagtgaggtgatcaggtgatgagaagagactgaagaattgatgcatggcgcgcatgcaggaggtgtgtgctttctattaattaacacacttcactgatctgcttaagggtacgtgtatgtcatttcatgtaggattttggctgatgaaatttccctcattattatctgctgtcttcatgcatgtgtaaccaaggcttaattaattattaagagtacgttcccttggaactaggcagctgttgctgttgcattagttgctattgctgttttcccctttattctcggcatggacaagatgtgatgatgaagagatgatatggtctaaaaaaaaaaaaaaaaaaaaaaaaaaaaaaaaaaaaaa

SEQ ID NO: 5695 - DNA, 2442 bp, Oryza sativa
  Predicted polypeptide sequence is orthologous to G618, G2057
cgagcggccgcccgggcaggtcacaaacccaacaagagagtgagagaggagcaaaagctttggctggccgtcccccctgttaaaatgtgatgtccaatccatgggattgcgtctagtttagtcccccactcctctcctggttatgggatccggcgaggtggatggacgcgcattggagcagcaacagtagcggcggggaagaaggcggcgggggatctggatccgaggcaccaccaccaccgggtcacccacggcggcgacggcggcggcgtaggaggaggaggaagcgggggacaggaggaggcagatgagcagcagcagcagcagcacgaccaccaccggcttctccagctccaccaccaccagggtgtgcagcaggaccaagaaccgccgcctgttcccgtcttccacctccagccggcgtccgtgaggcagctgtcgggctcctccgccgagtatgcccttctctcgcccatgggcgacgccggcggccactcccaccaccaccaacacggcttccagcctcagctcctctccttcggtggcgtcggccaccaccaccacctgcatcagttcacggcgcagccacagccccccgccgcgtcccacactcggggtcgtggaggtggaggtgagattgtccccgcgacgacaactccacggtcgaggggcggaggcggcggcggcggcggggagatcgtggcggtgcagggcgggcacattgtgcggtcgacagggcggaaggaccggcacagcaaggtctgcacggcgcgcgggccgcgcgaccgccgcgtgcggctgtcggcgcacaccgccatccagttctacgacgtgcaggaccggctgggctacgaccgcccgagcaaggcggtggactggctcatcaagaacgccaaggacgccatcgacaagctcgacgtgctgccggcgtggcagcccactgccggcggcgcaggcgcgggcaatgccgccgcgccgccgtcctcctcgacccaccccgactccgccgagaactccgacgaccaggcgcaggccatcaccgtcgcgcacaccgccttcgacttcgccggcgggggcagcggcgggaccagcttcctcccgccgtcgctcgactcggacgccatagccgacacgatcaagtccttcttccccatgggtggcaccgcaggcggggaggcatcgtcgtccaccacggcggcgcagtcgtcggccatgggtttccagagctacacgcctgacctcctgtcccgcaccggcagccagagccaggagctccggctgtcgctgcagtccttaccagaccccatgttccaccaccagcaacatcgccatggcggcggcggcggcggcggcaatggcaccacgcagcaggcgctcttctccggcgccgccaattactcgttcggcggcggagccatgtgggccaccgagcagcaggcgcagaaccagcgcatgctgccgtggaacgtgcccgaccccggcggcggcggcggcgccgcctacctgttcaacgtgtcgcagcaagcggcgcatatgcaggcggcggctgcggcgctgggtggccaccagagccagttcttcttccagaggggaccccttcagtccagtaaccagccctccgagcgaggatggccggagaccgtcgaagccgacaaccagatgagccaccaccaaggagggctgagcccctccgtgtcggcggccatcggttttgccgctcccggcatcggcttctccggcttccgcctccccgcgaggatacagggcgacgaggagcacaacggcggcggcggcggcaatggcgacaagccgccgccgccgtcgtctgtctcctcggcttctcaccactgaccgcagcagtggcgagcagatgacttcaccaccaccaatccaccatgagcaaacaccacaccatgtaccagactatcagctagctcctccacttccatcacggaattgtcgattgcattcgggaggagcaaagtttggaggtagcacaagtgcactactactgatgctactacatatcggttggttggttggttggttttccatcgatctcttctgctgctgcgcatgtcattggtttttgtttcaagaattcactcggagcttcttagaattaggcttgtgagaatgcagcaacacgatggcaagctttagcttagcttagcaagcctctgtgtctgttggctgttgcgttgcgctaggtgtagttgatcgatgtaggttcgagcttgctttgctttgttttgatttttactcttttgttgctgatgcatggacatgcttttgcttcctcctgtgggttcaggagcagttgctactagaccgatgttgttctcaaaactgataagtgggatggtgatggattgggagaggagcctatctttcatcttttccaaaaaaaaaaaaaaaaaaaaaaaaaaaaaaaaaaaaaaa

SEQ ID NO: 5696 - DNA, 663 bp, Oryza sativa
  misc_feature (32)..(32): n is a, c, g, or t
  misc_feature (54)..(54): n is a, c, g, or t
  misc_feature (66)..(67): n is a, c, g, or t
  misc_feature (82)..(82): n is a, c, g, or t
  misc_feature (162)..(162): n is a, c, g, or t
  misc_feature (170)..(170): n is a, c, g, or t
  misc_feature (180)..(180): n is a, c, g, or t
  misc_feature (246)..(246): n is a, c, g, or t
  misc_feature (353)..(353): n is a, c, g, or t
  misc_feature (623)..(623): n is a, c, g, or t
  Predicted polypeptide sequence is orthologous to G618
cggggtcaaacttttcttgtgttcgccccttnccgtctgtcgttcctgagtccncgagtggtccannctcatatgatggtgnctctatataaatatgggggacacaaatggtaaatttccaccattgccgttctgatatatttgggattcgattgcttatcntattgccncgtcggattngattaatgtaaactcccggtatacgatgatgcggcctcatgaacacctcagggacaagatctacanggcatgcaatggtgtattggtcgtggaaaccttcatggcacaagcggtgacggatacgcacaccgggtactagatgacaacaatgcccatgcgaactatcaagttgnaccatgagtttgtatcggattggccatgtgagggattgttgccaatgatgtgaaccatggtgtggtgacatgtgacatgaatgttgtgtgtgcccctgctgcgttgggatgctgcatgaaaccagctgctgcccttggctgctgtgttggactggtgatgtatgactgcagagcatgcattggctgatggacacttggacacttataaactacacaagtgtagggtggtgttgcgactgagactgactatgccccagctaatgcttaccntgcttaatgtgattctacctaatgcaaaaaaaaaaaaaaa

SEQ ID NO: 5697 - DNA, 398 bp, Oryza sativa
  misc_feature (211)..(211): n is a, c, g, or t
  misc_feature (318)..(318): n is a, c, g, or t
  Predicted polypeptide sequence is orthologous to G618
tgtaattgtgatgctcagagggagatctgtactctgtctgtgcacgctgtctacccctcttgccgcgaatatggcctgaagatggaagagggaatactgcctgtctgatgcccagtgatatgcccaccctgagagtgtggagtggatgaaatgtaaatgaatggaggacgcccgcaggataatgtgtgcccaatgtgtctgtcgtggcgtnttgagtgccgtgagagtaatgttcgtggcttgtgaagtgttgtgggttgtggtttatgtcgcctttgctatgggtcgtgattgcagtggttaaagttgatgcatgtnttggcttgcatcaatggggtggaataaagagaggccaagtctgaatgtgttctgctaaccaaaaaaaaaaaaaaaaaaaa

SEQ ID NO: 5698 - DNA, 705 bp, Oryza sativa
  misc_feature (652)..(652): n is a, c, g, or t
  misc_feature (678)..(678): n is a, c, g, or t
  Predicted polypeptide sequence is orthologous to G618
ttttttttttttttttttttttttttaagtcggcgaacgtgtcttggggtatattagctagtaatcatccgagtctaaatcactcgtgtccgtaaggctatgcgacgaagcttcttcctcttcctctaatcgagctcgttgggtttcctttggtctagcgagatactcctcaagcccttccgcagtcgcccacggtggaataccgattgcgtcgtcatcttgtttaacgccaaaaagtacgggctcatcaatgcgtacgacgtcctcaccaaagtgtaagtccagctccgtcttcctgagccacttaatgattctttcggtctggcccttggaagaaatggttgggaaaagtctttttaacttggacctgtcctcgccacatatttctgcctcgaccaccaagcgtatggagttcagtcgaaggtccgggagcgcttgcaaccatgacatcgatggggagtaatactcgttgcgatcatgaacgaaatgctttttcagctgcttgatatacttgcgcgcgtccggctcgtccgagaattgggggttgagcacgatctggagatctttgagacctgtgaactttcgcatggcttttttgtctgggagacgcccgaatcctaagaatctggtgaagtcttcgggtaggccgaantagatatgttcgagcacgattcgcangcgcttgaatgctctcaactggggcgg

SEQ ID NO: 5699 - DNA, 516 bp, Oryza sativa
  Predicted polypeptide sequence is orthologous to G618, G2057
cggcgccatgaccagtgccgcgtccgctgctggctccttccttccacattcgctgggcgcagatcgagtctccgacaacatcgagtccctgttcccctcctcgtccacagccagcggcgccgcctccgccggacgcgacgagtacaggggatccccgccggaccttctgtcgcgatgacaagcaaccagcagacgcagtcacgcaggagctatgcctcaatctggtgagcaattttaggaccgacgaagtgacacttctctgtgttggctgcctctacaggggtttggatattctgcaaaatatgtaactagaagtatatatgcaagtgatgtatagttcctgtaggttcttttgtaagtactctgggagtgattgaattatgatgaaagtgatataaaggtcctctgtgcttttattaagtactctgtaagtgattttccaaatgcaatcaaaagctgcctcaaataatttgtttccaaaaaaaaaaaaaaaaaaaaaaaaaaaaaaaaaaaaaa

SEQ ID NO: 5700 - DNA, 1078 bp, Oryza sativa
  Predicted polypeptide sequence is orthologous to G620, G1821
aatggaggccggctacccgggcacggcggcgaacggcgctgccgccgacgggaacggtggcgcgcagcaggcggcggccgcgccggctatacgtgagcaggaccggctgatgccgatcgcgaacgtgatccgcatcatgcgccgcgtgctcccggcgcacgccaagatctcggacgacgccaaggagacgatccaggagtgcgtgtcggagtacatcagcttcatcaccggggaggccaacgagcggtgccagcgcgagcagcgcaagaccatcaccgccgaggacgtgctctgggccatgagccgcctcggcttcgacgactacgtcgagcccctcggcgtctacctccaccgctaccgcgagttcgagggggagtcccgcggcgtcggcgtcggcgtcggcgccgcgcgcggcgaccaccaccatggtcacgtcggtgggatgctcaagtcccgcgcgcagggctccatggtgacgcaccacgacatgcagatgcacgccgccatgtacggtggcggcgcggtgccgccgccgccgcatcctcctccgcaccaccacgcgttccaccagctcatgccgccgcaccacggccagtacgcgccgccgtacgacatgtacggcggcgagcacgggatggcggcgtactacggcgggatgtacgcgcccggcagcggcggcgacgggagcggcagcagcggcagcggtggcgccggcacgccgcagaccgtcaacttcgagcaccagcatccgttcggatacaagtagtaacagcagcagaatggcgatcggtctgcacctgcatgcacacgtatcgcatgcagatcgagctagtagtgcaactggctaacttgaaccagttaaaaacttaagacttagtgatcgtgtgtggtttaattaatttgctacgttcaggtagtgatcgatgagattttaatttcctactgtcagtttaattcaccgttcatgtactcgatccagctagtactactcctagttacccttgttctaatcttaacgcaattgtgtcgatcggacgatcgcacgtttatcttcaagtggaatttgtcttataacact

SEQ ID NO: 5701 - DNA, 1072 bp, Oryza sativa
  Predicted polypeptide sequence is orthologous to G620, G1821
gtcgacccacgcgtccgaatggagcccgcatttcccaacggaggtgcggctgctccaccaccgcccatggcggcggagcagctgccgccggcggcggcggtggtccgggagcaggaccgcctgatgccgatcgcgaacgtgatccgcatcatgcggcgcgtgctcccgccgcacgccaagatctccgacgacgccaaggaggtgatccaggagtgcgtgtcggagttcatcagcttcgtcaccggcgaggccaacgaccggtgccaccgcgagcaccgcaagacggtcaccgccgaggacctcgtctgggccatggaccgcctcggcttcgacgactacgtcccgccgctcaccgcctacctccgccgcatgcgcgagtacgagggcggcggatcaggtggtggtggtggtggtgaccgtggcgccgccgccgcccccgccgtcgtgccgccgccgccgccgccgcctcccgaggacgcgttccgctacgtgcaggtccatcatcccgtgtacgcggcgccaggtgagccggtgcaggggtacggttaccccgtggccatgtcgtctgctctgccggcgccgcacgtgcacgtcggcgtccgcggcggcgggcagcacgaggtgttcggtggcgggccggcgcccctggctgtctactacggaggagcgccgtacggcgaggccagcagccgcggcggctgctctgccgccgacgaggggagctcgtcgtcgagcgcctcgccggcgccggtcggccccaactatgagtaaaaacaaaagaagaagaaaatcaaactcttccccggctgacaggtgatcgagctcgtcgtctacaaattatcaatcgtctgtcgatcgattagcatgtaatctaataaaaaaacttaagctagcttaagacttaattagacatgttctgttcatctttccgccaccgtttcatcgaaagagattaagaatgtggtagtagctagaaatcatttcgagctcgaattacttaatcgtgttgattaattgcaatgatgaactaacaagaggaaatgatgtagtagtattaaaaaaaaaaaaaaaa

SEQ ID NO: 5702 - DNA, 932 bp, Oryza sativa
  misc_feature (190)..(190): n is a, c, g, or t
  Predicted polypeptide sequence is orthologous to G620, G1821
ctgcaggtacggtctggaatcccgggttgagacttgagagagcatggcaggaacaaaaagcgtggtggcaggaacatggatcaggtcgagaaggcggcagtgagatcggatggggtgggaggtagtgcgaccaacgccgagctgccgatggccaacctcgtacgcctgatgaagaaggtgctcccagggnaaagcgaagatcgggggagcagccaagggtctcacccatgattgcgcggtggagttcgtcgggttcgtcggcgacgaggcctccgagaaggccaaggcagagcaccgccgcaccgttgcgccggaagactacttgggctcattcggcgaccttggcttcgatcgctacgtcgaccccatggatgcctacatccatggttaccgtgagtttgagagggctggtgggaataggagggtggcgccgcctcctccggcggcagctacaccgctgacgcccggtggaccgacattcaccgacgcagagctgcagtttctccggtcggtgatcccctccagaagtgatgatgaatatagcggctcatcaccagccataggcggctatggctatggatatggctatggcaaaaatatgtgaacaacttgatgcatgtgtgtgtgtacactgcatgcatgcgtggagggtcaaacagagtcaagactcttgtggtggtgtcataagtctctagtgaacatataagttgtgtatcgtgttccttgtaaaaaaagtcagtatgtgtgtgctcacgggaacctacggggtgggtatggaaaagaatgcgtgctaaaaaacaagggcgctaggcaagagacttgagaagcttaggcgaaaacggcgaagagagacggcactcggacctagggaacgacaggtggggttgttcctctttttgaagtgcacaaagcaccacagcaaacgagacgac

SEQ ID NO: 5703 - DNA, 2844 bp, Oryza sativa
  Predicted polypeptide sequence is orthologous to G622
atgtcgtcgccggcgcagccgcccccgacgcggccgccggtggccgccccgcccccatccctcgcggcggcggcccccatctcggtgcagccgcccccgctccagccgaaaccgccgccgcatccgcagcagccgcctcaggcggtcgtctcggttggggttgggccgccgccgccgacgccgcagcatcagcagcagcagcagggcccccccggtcacgcgccgccgcagcagcggcccaggatctgcttcaacgcgcactgcaaggaccccaaatccgacggcccgcgccgccgcggatggcgactccgcaacggcgacttcgccgagctctgcgaccgatgctatcactcgttcgagcatgggggcttttgcgagactttccatttggaggttgccgggtggaggaactgcgaatcctgcgggaagaggctgcactgtgggtgcattgtgtcggtccatgcatttgttcacctcgacgccggaggggtcgagtgcgtcatgtgtgctcgcaagtcgcatgctgcaatggcaccaagtcagatatggtcatcttccatgcatatggctcaaaatgtagctgatagaaaagacaattttgtcaagagctggagacctcctgccgggcaattttcaagccagtggcggcagaataatatgtggagtatgtccaccatgcagtctgacttgcagcagcgcctagcttttgagtttgataggcctagtggcagtgaaaaattgcttccagggcgcacttttattcatgcccatgagaagaaatttgatgacatgcatgacagatcaacaacacctgctggcatgaaccagattatgagggagaggtatgccaatgggcatactcagcacaccaccctggatccgacgtacgcttacactctctatcacagagaaggaacaaatccaaatcttcatgaccatagtcaccatgcaggagaaaatgaccatttgactgcaaggaaaggagtaacttcagatccttgttcctctgtatctactaccttcaagcttgattcacaccatccgtccattttgaaagatgatccatcagccgtaccagctgggttgtcttctaatttttcatcagcaaatggcccaaaagaccatatcagaattggaccaactcagcagcagcagcaaatggcttcctcctcattgcagaaacaattctattcccatagtgtgattgataacgattttcaagcgcaattgcgcaatggaaggcctagaatggatgcaaaggcgagatctcagttgcttccacgctattggcctagaataacagatcaagagctacagcacctatctggagactcaaattctgttattacccctttgtttgagaaaatgttaagtgctagtgatgctggacggattggtcgtttggtgttgccaaagaaatgtgctgaggcagaagggcttcccttaaaagttcaggatgctactggtaaggaatgggtgttccagttccgcttttggcccaataataacagcaggatgtatgtattggagggtgtcacaccttgcattcaatcgatgcagttacaagcaggcgatacagtaacctttagccgaatagatccagaagggaagctggtcatgggatttcgaaaggcaacaaatctttctgcagaacaggaccaacctacaaagcctgccaatggtgtactaccccctccagaagcaaataataaagttgttgtcccagattctagtcctaatgctgctgtacctcgaccaattaaagtcaacacagagagcaaaagttccagccctgtggaacaagccactgcctgtaaaattgacaaaggtgcattaccacaaaaggaagggccaggaacttcaagttcctccccactacctgtcaagagaaaggcaacttctgttggtccgaagatcaaacggttccacatggacagtgaggaatccatggaattgaagataacatgggaggaagctcaagaattacttcgtcctcctcctaaggccccttcaattgttgttgttgatggccatgagtttgaggaatatgaggagccaccaatacttgggaggaggacatattttgtgacagaccaatcaggtgagaatcatcaatgggctcaatgtgaggattgctctaagtggcgtaaactgccggtggacgcccttttgccctctaagtggacctgctctgacaataaatgggattctgaaaggtcttcctgtgattctgcccaagagataaatatggaggagcttggcgaaatgattcctatcaaacctggtgctgcaaaaaagaccaaagggaaggtagatactgacaatattgatgtttcagatgggctggacacactcgcaaatcttgcaattcttggtgaaggtgaatctctcccttcccagccaaccacaaggcatccccgccatcgccctggctgctcatgcatagtctgcatacaaccacccagcggaaagggaccaaagcacaaacagacgtgcacttgcaacgtctgtatgacagtgcgacgccgtttcaggacgcttatgatgcggcgcgagaagcgccagcagtcagagaaggactctggggtgcctcgcaaaagagagccaggtcaatccagcgagccagttccacaatctggctctggtgctcatccaaccagtactagctctcctcaccagagagcagataccaacggcgaaggtcctgaagacatgtccattgacaacaagaggacctcctctcctgtcaagaaccagattgacctgaacagtcagcctgagcgggaagacgagcagtcaccgaaatccgatgcgacgagactcctcagggacaacccaacctag

SEQ ID NO: 5704 - DNA, 2023 bp, Oryza sativa
  Predicted polypeptide sequence is orthologous to G634
aatctcccttctgcatatacagcaccctcctccttgcctcctcttcgccattgtcctaattcccatctccttgtccctttctccccgggagaaaaaccactcatacgcagtcggccaagcacttgatgcttactatgcctctgcgttagatgcttctcctgcccgtagaagctcgcggagttgggctacaagagaagcgccaagaagtgcaaggagaagtttgagaacgtccacaagtactacaagcgcaccaaggaagggcgcgccgggaggcaggacggcaagagctaccgcttcttcactgagctggaggcgttgcatgccgctgcgccgcagacgccccagccgcagcagcagcagcagcagcagttgccgccggttacaagcagcgcacccgcgatgcacgccttcgcgccgccggttcccgcgccaccgccgatgagcgcaatgccaccgccgccggggccgatccagccggccccgatatcttctgcggctcccgcggtgcccctggagctgccgccgcagccgcccatcaacctgcaaggcttaagcttctcgtccatgtcggggtccgagtcggacgatgagtctgaagacgacgagatgacggcggagaccggcggcagccaggaccgcctcggcaagcgcaagcgaggcgccggcggcaaaaggccggcgactttcttcgaggggctcatcaagcaagtcgtcgacaggcaggaggagatgcagcggcggtttctggagactatggagaagcgagaggcggagcgcacggcgcgggaggaggcgtggcgcaggcaggaggtggcccgcctcaaccgcgagcaggagcagctcgcccaggagcgcgccgcggcggcctcccgcgacgccgccatcatctccttcctccaacgcatcggcggtcagtccgtacaggtcccacccgccgccaccgtcatccagatgcccacaccggtgcagctccagacccctccgccggtcaagcaacctgccaggcagcaccagccacagccaacgccgccgccgccgcaggcggcgccaatcccagccgcgcccctccagcagcaaccgccgcagccgcagcacaaggagacgattcaccacgaggcagtgacgccgcgcagggcgccaccgacgtccggctcatcactcgagctggtgcccgcggcggagcagcacgtcgagagcgggctaggaggaggggagggcgggtcggcgtcgtcgtcgcggtggcccaagacggaggtgcaggcactcatacagctgcgcatggagctcgatatgcgctaccaggagaccgggccgaagggcccgctctgggaggagatctcgtcggggatgcggcggctggggtacaaccggagctcgaagcggtgcaaggagaagtgggagaacatcaacaagtacttcaagaaggtgaaggagagcaacaagaagcggcccgaggactccaagacatgcccgtacttccaccagctcgacgtcatctaccgcaggaagcacctcaccggcggtggcggcggcggcgcttccgcggccaatgtcgccgccacggcaatcgagcaccagaacccgaaccggcacgagatagaggggaagaacataaacgacaacgacaagaggaagaacggcggaggcggcggcgcgcaggtgcccaccagcaatggcgacacggcaccgaccacggccacgttcgacgtcgatagcggcatgaagaagccagaagacattgtgagggagctgagcgagcagccgccccgggagttcacaacggacgagaccgacagtgacgacatgggcgatgactacaccgacgacggcgaggaaggcgaggacgacggcaaaatgcagtacaggatacagttccagaggccgaacccgggcggcgccaacaccgcacctccgccggcaacaaccccggcgtccgcggtgccaacctcgactccgacgagcaccttcctcgccatggttcaataggcgcgcgaacgatgcatcaccaagtacgtacttgttc

SEQ ID NO: 5705 - DNA, 3478 bp, Oryza sativa
  Predicted polypeptide sequence is orthologous to G634
atggccatttattacctggaaagggagggattaacccacaacatgccaatgcatggccatttttatactcctctgcccctgaaccattggcacgcggataccaccaacgcggctgacatgacacgtgggcccatgcgcatgtgggccccacatgtcagtggcatgaattttatatttttcatctcaaaagaaaaggtattgatgagagtagaaatggtgagctctcctgatgtactgatcattccatcacctccattccccagtggtaacactcgtgggggaggaggaggaggaggaggtagtagcatgcagcagcagcagccagggggaggagggggaggggtgcagcagttcggcgcggtggcgccggagatgtcgccattctcgccggcgggaggaggcggcggggggcggatctccatggcggaggccgcgtcgcccatcagcagccggccgccgccggcgcagcagcagttcgacgagctcggcgtaggcggcggaggcggaggcggaggtgggtttgacgccgaggcgctggcggcggcggcggtcggcgaggagggagccagcggcggcgcgggggggaaccggtggccgcggcaggagacgctggcgctgctcaagatccggtcggacatggacgccgcgttccgggacgccaccctcaagggcccgctctgggaggaggtctccaggaagctggcggaggagggttaccggaggagcgcgaagaagtgcaaggagaagttcgagaacgtgcacaagtattacaagcgcaccaaggagagccgcgcggggcgcaacgacggcaagacgtaccgcttcttcacgcagctcgaggcgctgcacggcaccgccgccggcgtcgtggcagcgccatcgccggtgacgtcgctggccccgccgccggcgacggctgtgggggtgtccggcggggtgcgcgcccccgccgagccgccgcccgcggtggtgatggggaacgtgatgagcttctcgacgtcgaacacggaggagtattccgacgaggaggactccgacgacgaggggaccgaggacatgggcggcggcggcggtgatgagagggggaagaggaagaggttgtcggagggtggcgccgccgcgggcgtcggtggcggcggcggaggaggaggagggagcgggaagatgatgaggttcttcgaggggttgatgaagcagaagatcaccgggcagaccatcccaatgccgcccatcatcgccgcccccgccatcaccgtcatgcccccaccggcgccatcccagcagcctcagccgccgccaccgccgtctcaccccacccccatcacctccgtcgcgccagctccgccgccgccgccaccagcagcagcagcagcagcagcatcccagccatcgccgcaggccaccaagtcgccattgccggcgacgccgcagacgcaaagcagcatggacattgtcatgacggccgccgaggcgcacgacgcggggtacgacgggtccggcggcggcggggggcagccgtcgtcgtcgcggtggcccaaggcggaggtgcacgcgctgatccagctgcggagcaacctggacaaccggtaccaggaggccgggccgaagggcccgctgtgggaggagatctccgccggcatgcggcggctgggctacagccggagctccaagaggtgcaaggagaagtgggagaacatcaacaagtacttcaagaaggtcaaggagagcaacaagaagcgccccgaggactccaagacctgcccctacttccaccagctcgacgccctctaccgcaacaaggcggctctcaactcctcctcctcctccgccgccgccgccgcaccggccctcccgccgccggagcacgcggagccggcggtgacagtcgccgcgccgatctcgcagacaccgccgccgccgccgccacagcccgtgacgacgaccaagaacggcaacggcaccagcagtacaaacggcgcgaacggcgaaggaggaggaggcggctccgggggcatgcaaatgcaggcgagcaacggcagcgtcgtcgccggcaacaagttcttcaccggcgcggcggcgaagaagccagaggacattatgaaggagatgatggagcagaggccgcagcagccggcggcggcgaacaacgccttcaaccgaacggacggcggcggtggcggcggcggcgtggacagcgacaacatggacgaggacgacgaggatgactacgacgacgatgacgacgacgacgacgacgacgtcgacggcaacaagatgcagtacgagatccagttccagcatcagcaccaccaccagcagccgccgcagcaccgccaccagcagagcgtcgtcagaccgaacgccgccgcctccgcggccgccggcggcaacccgcccggcaccgccgcccccgccacggcggcggccgcaacgacgaccaccggatctttcttggcaatggtccagtgatccatccatccatccggtgactctctctccttcctacacatgcatacctccatgcgcgtcaatggcttcttcttcttcttcctcctccatctcttgtaccatttgtatctacctacctgtcgcctcctccatggctcgtccatatctcaacaccatcaaaaagctcaaaaacctaaaacctcaagaattctcttcctcctccggcatatttctccattgattcctcatgcaagctagcagctatacatctccatgccaagaaagaaaaattcgcccatttcaagctgcatgcatgcccatcgatcgttcgtcgctggatgttcctagcaagaaaaagctagtagcatcgatccatttcttgattcgttcttgtgttaattacagtggtctctcccatctcgcgtctcctcttagctagtgttaaaagcaaaaaaaaaggaattggtggcgtggtaatttattgatttgttgtggtaaatttaataaggaccctccattcgtgagggttcacggagagggtttaaaacttggtgcggtgaaaaacggcacagaggagcggtaataacacctcgctctcgcggttaaaaaaaaaggaagacaagggtatatatgcaaaatgttgcggtggttgtggttgttacaaattattacacctcggtaaaaatttgtttggctatgtgtactactgctcgatctactgtggcatgttgcaagggcgcggtgaaaaaaaaatcgaaggtgaaaaattaaagatgtgctcatcaagtgaagtggcagtgaaaaagcaagagagctggtgctggtgtatgccggaatttttcccatttctcttttttttctcttttctctccttcttttatatgttttgttttgttttttctaattacctaaactgtccattatgtattacctgagtttttttttcttcctttcccaaactgttgttaccgaagttttacagtgtatactcgcgacatattatatgttacattcttgctattcttatacc

SEQ ID NO: 5706 - DNA, 1623 bp, Oryza sativa
  Predicted polypeptide sequence is orthologous to G634
gaagcgcaccaaggaagggcgcaccgggcggcaagacgggaagagctaccgcttcttctcgcagctcgaggcgctccacgccgcggcgccgccgccgccgccgcagcatcggcagggcatgccggtggaggacccgcagccgctggcgatggcgtggatgatgttgcccggggcggcggacctcgggttcttgtcgatgtcgtcggagtctgagtcggacgatgagtccgacgaggaggaggaggaggaggaggcggtggcgccgggcggcggcggtcgggaggggcttggcgatgatggtgacggtgatggcgaagggggcagcagcaccaggaagctgatggccatgttcgaagggatgatgaggcaggtgacggagaagcaggacgcgatgcagcgggtgttcctggagacgctggagaagtgggaggcggagcgcaccgagcgggaggaggcgtggcggcggaaggaggtcgcccggatcaaccgcgagcgggagcagctctccaaggagcgcgccgcggcggcgtcccgcgacgccgcgctgatcgcgttcctccagcgcgtcggtggcgccggcggggagcccgtgaggctctccccttcgtccgccggcgccacccgccacgacgcggccgcggcggggctgcagctggtgcccgtgccggcgccgagagcgaaggcggaggacgcctgggcggcagcaggaggagacggcagcgggacgacggcgccgtcgcggtggcccaaggaggaggtgcaggcgctcatcgacctgcgcatggagaaggaggagcagtacaacgacatgggacccaagggcccgctgtgggaggagatcgccgccggcatgcagaggatcggctacaaccggagcgccaagcggtgtaaggagaagtgggagaacatcaacaagtacttcaagaaggtgaaggagagcaacaagcggcgccccgaggactccaagacctgcccttacttccaccagctcgacgccatctaccgcaagaagcacttcgctggcagaggcggcggcggcggcggcgtcacgatcgccgcctcccactccagcctcgccatcgtcaccgtctccgagcaggacaacccgagccagcgtgagctcgaggggaagagcagcaacgacgtcggcaacgtgcagctggcggtgcccctccttgtccacaacgccccagacaagaaggtggaaggctccgaaggcgaaccaaatgtcacagcagcagcggaggagacggacagcgacgagatgtgtggagaatacaccgacgatggcgacgacgacgacaaaatgcagtacaaaatagagttccagaagccaactgcgggcggcggcggcgacggcaacgacgcacccgtgccggcgacaactgcggcagcgacgagttcagccccaaccagcaacaccagcttccttgcggttcagtaggtggcagtgcgcgcagagtgagggggctaaagaaagccaggcaggcatcaccgtcttctttttcagttcaagagggtcacaattgccctattatactttttcagttgttttgctgtgatgttggcaacatcccgtataccatttgttgatttctttctgtggtaactagcaaactatcc

SEQ ID NO: 5707 - DNA, 1335 bp, Oryza sativa
  Predicted polypeptide sequence is orthologous to G635
taaggattgcatctgatggcgttatttttgtcagcatggaaatcttccgacctcagaaggaacttgcttcatcacagtcaggattgaaagggaagttcaaaataacaacaagatgcctatggcttgataatggaagactattagatgcactttacaaagctgcatatgctgcattatcaagttgtccagtgaattgtccacttagtcacatggagaggatggtatctgaaatcttgaggaaaatggtaaggaagtatagtgggaagaggcctgatgtcattgcggttgctacagagaacacaacagtgagttttgtagaagactcagaaactaaatcatctggaaagtttggatctttctcagctcctaggcattcgagcaggagttcaggtaggggtcttgaagaaagtgataaatcatgcccagagaatacagagggagaggctaaagaaaatcttcctgatgtcctgggaacaacacgtgatgatgcaaccacaagctccaatggcgaagcatttttctcctcagatttgcataagcctaaaacactagagcatttttgggactcattcaaatcccctacagctgtaaaaattgcaagaattgtcaatggttcagctcaagggagtaaatcaaagattggcaagatcagcatagtgggtaaggactctagcgatccttcttctgctccagttaaatcttcaaaaaagaacaagtggaagcctgaggaaattaagagcttaattcagatgcgtggcgaaatgaatgagcaatttcagactgtgaaagggagaatggttctgtgggaagagatatcttctagcatgttgagccaggggataagtcgtacaccagcacagtgcaagtctctatggacatcattggttcagaaatatgaggagagcaagaaagatgaggaaagcgtaaagacgtggccgtatttcttggacatggacagggttttatcaagccaaggggaaatggcaacccaatgatcccaaggccgtagtttagtggttgtaattttggagggtgatggcataatcaatcaagtggcaggatgagatggctgcagcgtgttcttctccagagaatatacatgccataattcattccacgaaaagggaggcaggcacttggaatgactaagctgctacgtattcaccatgagtgtgctacagggctagggatagctgatattatttgatcaactatactagattaagtaattgaatagctaagttttgttgtgctattatttttggtgtaagaagacaccaaatgctaatccgaaggctttcaattgagctacccacatgcctatgcgtgtaaatt

SEQ ID NO: 5708 - DNA, 1239 bp, Oryza sativa
  Predicted polypeptide sequence is orthologous to G643
atggccatggatccggacgccgcggagtggccgtgcatcatccaggcgctcccggcgttgccgccgtcgccgtcgtccaccggggtcccgaggctgccgaccatggtgcaggcgctcccggccgccacggacccgccgcccgccgccgccaggctcaggcgcggcgccgagccgcccagcccgcgccgcacgcgctccggcggcgcgccggagtggacccccgcggagacgctcgcgctcgtggccgaggtcgcggccgtcgacgacgggtggtcccgctccgtctccgccttccagaagtgggccatcgtcgccgagaacctcgccgcgtcgcgggggagggcggcgcgggggagggggagggggagggcggcgagcgagtgcaggcggcggtgggaggcgctcgccgcggagtacggggtggttcgccgatgggaggtgcggggtgcgggcgggtactggcggatgagcgccgccgccaggaggaaggccggcctccccgccgacttcgacgccgaggtctacggcgccatggaggctctcaccctcgtcgaggaggcgcttctcgccgatgccaccgccggtgctggtggtgctgagattggtgaaaagagcgccgccgccgctgaggtcggagaaggcgacgaagttgaggctggggaagaggatggaaatggagatcgcggcgaggttggagaagaggatgaaggtgaggttggagaagatggtgaggaggaggatggcaatgaaatggtggaggtggaagacgatggcaacgccgacgacaaagacgcgcaaccagatggtggaaatgctgctgcttctgatgatttggaagtctgcgaaacgggagcaaacaacgagggcaagaaaagccaaaccgatgcatgtgaactggccaacaagttacaagagaacgcgcagcacatccatatgctactcaaagaggaggcaggcgaaaatgagaaccataaccttgctatctcatcggattctatggaaaccactcgccaaaaaggtgatgagctgatcaaatcgctaggtgggcttgtgagctacctgaaccaattcactgatctgatcaaggagaatggattcgagaatgtcgtcggtttgtggcagacattgctacctgcattggcatcaccatttctcagcgccattgtgtacttcagtgtctggcaatctgctgttctggggcgtttctctgcactgtacagcagaatcccaggattttag

SEQ ID NO: 5709 - DNA, 2316 bp, Oryza sativa
  Predicted polypeptide sequence is orthologous to G646
tgcagagatagggaggaggcataattccactcactgccccaaccacaggacattctcttctctctctcccttctgctcaagaaatccaccagctgctgcatcaggaggtggagctcgctcgtcgtcttcgtcttcgttgcgcttcgtctcctcaggtgcccggaggagcaagaattgttgggggggcagcgaggtagacgcagttggagagccctcttgcatggatgcagcccactggcaccaggggctagggctggtgaagcccatggaggagatgctgatggcagcgaacgcggccgccggcgcgaatccgaatccggcggcgacggcgccgtcgtcggtgactgggggcgcactgaggggcggcggcggcggcggcgcgccgccggtggcaggtggcgcgggggcgggtagcacggagcggcgggcgcggccgcagaaggagaaggcgctcaactgcccgcggtgcaactcgacgaacaccaagttctgctactacaacaactacagcctccagcagccgcgctacttctgcaagacgtgccggcgctactggacggagggcggctcgctccgcaacgtccccgtcggcggcggctcgcgcaagaacaagcgctcgtcgtcgtcggcggcatcggcgtcgcccgcgtccgcctccacggcgaattccgtcgtcacgagcgcgtccatgtccatgtccatggccagcacgggcggcggggcgtccaagaacccgaagctggtccacgagggcgcgcaggacttgaacctggcgttcccgcaccacggcgggctgcaggcgccgggggagttcccggcgttcccgagcctggagagcagcagcgtgtgcaaccccggtggcccaatggggaccaacggccggggcggcggcgcgctctccgcgatggagctgctccgaagcaccggctgctacatgccgctgcaggtgccgatgcagatgccagcggagtacgccacgccggggttcgcgctcggtgagttccgcgcgccgccgccgccgccacagtcgtcccagagcttgctcgggttctcgttggacgcgcacggctcggtgggcgggccatccgccgcggggttcggctccagcgcggggttgcaaggcgtgccggagagcacgggcaggttgctgttcccgttcgaggacttgaagccgacggtcagctctggcactggcggtggaggcgcaagcggcggcggcgccggcgtagacggcggccatcagtttgatcacggcaaggagcagcaggccggtggcggaggcggcggcccaggcgggcacgacacgccggggttctggaacggcatgatcggcggcggcagtggcacttcttggtaatgcggcggcggcggccatgcatgcatgcatggctcatgcaaaagcctccgcgctgtggtggcgtgggttcaaattggagataggcagtagagacgacgagggttttaataagaggttggcattggcgataatccatcactgattcactgttactccgtataaggtgttttgatctctcttcttcttctttcccggtgttgcatcatcatcttggtgttctttcttctcccttttgctgtctttcatgtgattgttgatcggctttggtgctcaacacaacaaccgagctcacatgattcctcaaaaggatcatgatgcatgatcgatctctttctgaattctgatcttccagttctctccattgatcactgttactactagtcatcgcttgatcgatgtgtggttagagagctgcatgcgtcagtgcagtactagactagtagagcatgggaagcttctttttaggctggcttcgagtccgatggcgtgtacgtacgtggtacacaggcatgcatgtggtgtgtagctcattggttttgcaggggcattgtgaagcgaaggatgaagggaaggactcggttggggaggaagaaagaaaaatggacccccatcaccatgcatgtatgtcaaacttagctacagtatgtttggtaacggcaatgcatcaagcttttggttgtagatgtagatcttgggaagggtttgcagctgatctatgactttgtgttgatccaaacagtagtgattccatccttttctagcttaacttgttattgttgttaacttctatgggatgtgtagaggtcatataaagttatagtagtagtagttgcaaaaggggtttttgagcgcatgtaatttaatttgtatagtactcctactatcttattgttatatttacagccaaactataatgcacatctttttgctccttgtttctgaaaaaaaaaaaaaaaaaa

SEQ ID NO: 5710 - DNA, 518 bp, Oryza sativa
  misc_feature (55)..(55): n is a, c, g, or t
  misc_feature (73)..(73): n is a, c, g, or t
  misc_feature (150)..(150): n is a, c, g, or t
  misc_feature (159)..(159): n is a, c, g, or t
  misc_feature (254)..(254): n is a, c, g, or t
  misc_feature (451)..(451): n is a, c, g, or t
  misc_feature (467)..(467): n is a, c, g, or t
  Predicted polypeptide sequence is orthologous to G646
tggagagccttgaaaattgggccacataatggtgaaccaataaatgggtgggccnactgctgtgtggccgtgnggcccccttgtgaaaattgtgaaggcgaatataagcgcgacttttgaattcttgacggcgcccggaataggccctanttgtggtanacgattgcgggggatgcaaggggctaataagcttgtagtaacccttgccttgtgtgcaatgggcgcaatttgggcctacctgttgaggatacctntctggcgggaacctctggtaacggatgggtgatttggaaataagaaagtgggaagctgaccatggattgggaaaccacatgctgtgttgttgctgcttgctgtggtaccataagtggttgtaatacttaatgatcgcaagtatgatgcactgcaaggctgtgtaacccatggcttatgattgctactgtagaacctngtaatcatgggtaatncccagtcaaagcagataatattactatctagctaaaaaaaaaaaaaaaaaa

SEQ ID NO: 5711 - DNA, 1744 bp, Oryza sativa
  Predicted polypeptide sequence is orthologous to G646
gatgttcttgcttcttggttcttgctaattgtctagtattgcataacttagttctaggtttgtgttgatacttgcaattgcaacatctaatggagtgcaacgacatgtgtcaatcaccaggggctagggctagtgaagcccatggaagagatgctgatgggtgcaaatccaaatcctaatgggagctcaaatcagccaccgccaccgccgtcctcggcggccagcgcccagcggcctatcgccccaccggcggctggagcggccgccggcgcgggcgccgccggagctggggctggcacggagcgccgcgcgcggccgcagaaggggaaggcgctcaactgcccgcggtgcaactcgacgaacaccaagttctgctactacaacaactacagcctccagcagccgcgctacttctgcaagacgtgccgccgctactggacggagggcggctcgctccgcaacgtccccgtcggcggcggctcacggaagaacaagcgctcgtcgtcctcggtggtgccgtcggcggccgcgtcggcctccacctccgcggcggtgtccggctcggtccccgtggggctggcggccaagaacccgaagctgatgcacgagggagcgcaggacctcaacctagcgttcccgcaccaccacggccgcgccctgcagccgccggagttcacggcgttcccgagcttggagagcagcagcgtgtgcaaccccggaggcaacctggcggcggcgaacggcgccggtggcaggggcagcgtgggcgcgttctcggcgatggagttgctgaggagcaccggctgctacgttccgctgccgcagatggcgccgctagggatgccggcggagtacgcagctgcggggttccatctcggcgagttccgcatgccaccgccgccacagcagcagcagcagcaacaagctcagaccgtgctcggtttctccctggacacgcacggcgcgggtgcaggcggcggctccggggtgttcggcgcgtgcagcgctgggttgcaagagagcgcggcgggcaggttgctgttccccttcgaggacctgaagccggtggtgagcgccgcggctggcgacgcgaacagcggcggcgatcatcagtacgaccacggcaagaaccaaggtggtggcggcggcgtcatcggtggccatgaggccccagggttctggaatagcagcatgatcggcaacggcagcagcaatggcggcggcggcggcggttcttggtaaggtggtgcgagctgctactgcttgcccgccgccgccatgcatggctcatgcatgcacgcgtggtggtcagcagctagcagcatgtggagatagagaaacgagatagagacaaggggggttaataagcctgtggtgattagtgttacatatggcgttttgtttctctttgctttgtttggtttttcggtttcatggtgttgcttctttgttgtttgttcatgtgtgtgtggttaattatcggcttgggggctggctaacacagcaggatacacagatttttaagggtggtgaacttggtgatattatacagctgctgatctattcaccaatcaatctctcattttgtgatttaatcatgtcatgtagaatctgcactgaagcatgatactcttatcatttttttagttttgatggctgtgtgtgtgtccacggacggtacgtacgccgtttgagttactgtatgtagtctgaacaaacaacatgttggttagttgcatatgtc

SEQ ID NO: 5712 - DNA, 1083 bp, Oryza sativa
  Predicted polypeptide sequence is orthologous to G646
atgctgatggcagcgaacgcggccgccggcgcgaatccgaatccggcggcgacggcgccgtcgtcggtgactgggggcgcactgaggggcggcggcggcggcggcgcgccgccggtggcaggtggcgcgggggcgggtagcacggagcggcgggcgcggccgcagaaggagaaggcgctcaactgcccgcggtgcaactcgacgaacaccaagttctgctactacaacaactacagcctccagcagccgcgctacttctgcaagacgtgccggcgctactggacggagggcggctcgctccgcaacgtccccgtcggcggcggctcgcgcaagaacaagcgctcgtcgtcgtcggcggcatcggcgtcgcccgcgtccgcctccacggcgaattccgtcgtcacgagcgcgtccatgtccatgtccatggccagcacgggcggcggggcgtccaagaacccgaagctggtccacgagggcgcgcaggacttgaacctggcgttcccgcaccacggcgggctgcaggcgccgggggagttcccggcgttcccgagcctggagagcagcagcgtgtgcaaccccggtggcccaatggggaccaacggccggggcggcggcgcgctctccgcgatggagctgctccgaagcaccggctgctacatgccgctgcaggtgccgatgcagatgccagcggagtacgccacgccggggttcgcgctcggtgagttccgcgcgccgccgccgccgccacagtcgtcccagagcttgctcgggttctcgttggacgcgcacggctcggtgggcgggccatccgccgcggggttcggctccagcgcggggttgcaaggcgtgccggagagcacgggcaggttgctgttcccgttcgaggacttgaagccgacggtcagctctggcactggcggtggaggcgcaagcggcggcggcgccggcgtagacggcggccatcagtttgatcacggcaaggagcagcaggccggtggcggaggcggcggcccaggcgggcacgacacgccggggttctggaacggcatgatcggcggcggcagtggcacttcttggtaa

SEQ ID NO: 5713 - DNA, 909 bp, Oryza sativa
  Predicted polypeptide sequence is orthologous to G646
tggtcctgcaggtacggtcggaattccgggtcgaccacgcgtcgcccacgcgtcgcgacacctccaaccgcgccggccgacgttccaggaccaccaacagctcctccgaccgcagcagcagtacaccggcgcaccgttcggttacggcaacctgcagcaagccggcggcgccggcaccggcgccggcgacatgttcagccacgcgctgagctcggccgaggacaggttgctcctgcagagcctccagtcagctcagatgcctacttccgccgctaaccacagcgctaatggttacttcgcctaattaaccaacggttaatcgaagacacatcacaagcaaagaagattcatggaccagttgtgtttaaccccctacaagttaattttaccctctcctcgatcgtgtgcaatttcttttcttcttattactttcacatgtttgttcagttaagagagaagatcactaaaatcagctgatcagctatccatgctgcagcgatgtaaatactcctaattttttcttcaattcgatttcgctctttggtcaaaaaaaaacacacaacaacaaacaaacacaacaacaaccacgaaaacacaacacaccacataccagaccaccaccaccaccacaacacacaggggggccgctctaagggactcaagctacgtacccgtgattgcacgtcaaagcctctatagggtcccaaactcaatccctgggcgaggtttacacgtcggactggaaacctggcgttcccacttaatgcttgaggcaatccctttcccacgggtatacaaaaggcgccgtgtcctcccaagtggcccgagtataggagcctatggggaaaaggggttgtgtcccgacgaattacgcagcgcatagtcacttcacggcccaaagaccggtac

SEQ ID NO: 5714 - DNA, 581 bp, Oryza sativa
  Predicted polypeptide sequence is orthologous to G646
tagtgctacacaactaaacaagaaggaggttcagtcaaacaagtcaaggagaattagaacttggattgataagctacgcaaggggaagcgcaacaatcctaaatctgcaaaaccaacaaaagggagtaaagaaaaatgatgctttacagccacaggtacaagttaaggatgatggcagccacaaagaaagagacgtggagcttcaacaatacaatatcattagcgattttacccaccttgtgacagcaccaagttgtgatgatgatattctctgtgatcaagatctgttctaatctttgcaagatggttagatggcttgtggacagcatggttatatggcttttgtacaggatagtttgatgtttttggacaggaatggttagatgccttctcgacaggactaactatagtattttgtggtctctgtttagtattttggacagggccaacgatagtattttgtggccaaattgtacaagtgaatatggcctacccttggaatagttttctatatgctccacatactagtttgaatgacatgtacgatccaaaaacttatctcacaacattatcaacttcta

SEQ ID NO: 5715 - DNA, 1682 bp, Oryza sativa
  Predicted polypeptide sequence is orthologous to G651
acttgttttctttcagtctttctttcttcttcttgtttgctgatcttgttccttggtggaaggatgcttgtcacctactcctttttgagttccccactctcctcacacttgttctacctctcttccccataaaactattatcatctttggagccaaaagccaaccaagaggagaaagcaaagggaggagaaaagaagcaagcaaagcaaagcaagaagcaagaagcagctgctcagctcagctcaagcaagtaagtgaattcttgcttgatcgatccatcgatcgatcgatcggtttgctggtgatggacaagcacacttgcaagctctgcttccgccgattccacaatggccgcgctctcggcggccacatgcgctcccatgtcatggccgccgccgcggccgccgcgtactgtccgtcgtcgccggcgatgtcactggcgtccacgtcgtcgacggagatcgagatggatgagaagaaggagatgacgaagaagacggagcaggagaagacgctgacgtcgtacgtgttgcgcgagaatcccaagaggagctacaaggtgagcgccggtgaattctccggtggtggtggtggtggtggtggcggcggcgagtcgtcggtcgtgcaggacggcgagagcgacacggagtcgtccccgccgcgcggcggagcggggtcgttcttcgccgtgagccggaggcggtcgaagcgggcgcggcggcggcgtcgcgcgccggatcccgaaccggcgagcagcgtctccgacgcgacgacggaggaggacgtggccatgtcgctcttgatgctgtctcgggactcgtggacgcgttccagatccgagcacgagacccaccaccggggggcgagctcggaggccgagcagaacaacaacaacgtcgtcaacgtgttcgacgaagaagacgaggacgcccgcgacgtggccggcgaggatcacgacgaggagctcagctacggcggcggcgaggcggcggcggcgcgccaccgcaccagcaggttccagtgcggcgcatgcaggaaggtgttccggtcgtaccaggcgctcggcggccaccgcgcgagcctcaagagaggcaagggcggcggctgcgtgccaccgccacgtccggcgccggcgagctccgccgccgcgccggccatccacgagtgcccattctgcttccgcgtgttcgactccggccaggccctgggcggccacaagcgcgcccacatgccatccggcggcgcgcggtcctcgccctcgccgtctccggcgaaatgcggcgagagctccggctccatcgatctcaacatgccggcgacaatggaggacgacttcgagctctccgccgtgtacgacgccgagttcgccagcacgagacagtgaccacacaccaccaaccagctgatcatccatggctgccgactccagatcaccaagaaatcggtaggacaaactgcttcctagctgcatgcaaggatggattcattcgaggtaagaagctctgcatctcttgcaagaaccagaataccagatcatggagaattctctgtcttgttgcttaagcttcagttactgttgctgttgctgctattgctagagctgaaaattcagttgagcagctgaaaattctttttttcattttgggcgctctgtatctaaatcaaattgatatttttgctcc

SEQ ID NO: 5716 - DNA, 1792 bp, Oryza sativa
  Predicted polypeptide sequence is orthologous to G651
ctgcgtactactttagctccccgtttgctccatggatcctctcctcctcctcctcctccagctagcttgctgctagcttgaccgcttcttcaatcttgatccgtccctctcactagctcgattgccttttcatcattcacattgttcttcttcttcttgatctgatcgagtattcgacttctctcgctggttggttggtttcttgatccgccatggacgacgacgatgtggtggtgcttagtagtgctagtgcgacgcggcacagctgcaaggtgtgcgggaaggggttcgcctgtggccgctcgctcggcggccacatgcgctcccactcgctcacggaggtggacgcggtggcggcggcggtggcgccggcttacgagcgagccgatgacgatgagggcggcgacgggaagacggtgcggcggtggatgcagagcggcggcggatatgggttaagggagaatcccaagaagacgcgccggctctcggcgggctccggcggcggcggcggcggcggcgacaacgacgatggagacgcgtgccatcaccgcggcggcgatctcctgtcgtcgtcgtcgtgccggccggtgctcggccgcgtgcgcagccatgcgccaccggcaggcggggcggcgtacgccgacgactccgaagatgtcggcgtggacgtggacggcggcggcggcgacgatcgttaccgggaccgggagatgctggtgatggcggctccgaggcggcggccgcggtcgatgcgcgtgccggcgcccgtgcgcgacgagttcgtcgtcgacgaggagccggaggacgtcgccctctgcctcgtgatgctgtcgcgcgacaccggccggccatggaactcgagaccaagcgacgagtactcatctctcatgtacaacagcagctaccaccaccaccacgacgccgtctccgacgacgatttggagttgtccctctcctccccgtacgcggacaccgagatcaggaccaagaagaggaggaagacgacgggtgcggcgagcaccgccggcggcgagaagcggggccggtacgagtgccacggctgcggccgggctttcctgtcctaccaagctctcggcggccaccgcgctagccacaaacgtataaacagcaattgcagccttgtcaaacctccggccgatcagccggagccgagcatcgaaacatcgttcagctctgcctcgacgtcggtgtcaccagctgacaccatgatcagcgcggccaccatctcgaagacggtgaagaaagcaactaaattcgtgtgcccaatctgctccaaggagttcggctccggtcaggctctcggcgggcacaagcggtcgcactcgatcgcaggcgagctctacgagcgcggccacgccgacggcattgtcaagctggagcaacctttgctcgccgacaggtttcttgatctcaatctgccagctccaggaggagatgatggctgaagcttaattaggaggagatgatggctgaagcttaattttggttcctccaagttttgacattttttggggagagcatgggtatgtacagattcagattcaattcattcttttggagtttcagcttagttgatcatgagggattaaataattatattgttaggtctttagttaattactccagatttttcgaccagttttgttttgaatttagtgctttttgttagctctgttctgtttttgctccacattgggaggaaaataagaacatcatatgatctcaattgagaactggtacaatgaaatgcttccagaaaagatttcagttg

SEQ ID NO: 5717 - DNA, 1473 bp, Oryza sativa
  Predicted polypeptide sequence is orthologous to G651
atccactgcgtgcgtttgtaacttcctccgcagctatctcccttgctctcgccatctcgccattctagctcccgcaaagctctccccccccgaggcgagctctctctgctcccgagcgagagctctcgccatggcgaagaacgcatgcaagctctgctaccgccgcttcgctagcccacgcgccctcgcggggcacatgcggtctcactctgtggcggccgccaacgcagccgcggctgcggcggcggccgcagccgcgaagctgcagatctcatcggcgtcgtccgcgtcgacgtcgttcaccgcggccgatggggaggaggaggaggaggaggaagaggagggcgtgggattcaagaagcccctttccatctacgcgctccgggagaatcccaagcgcagcctccgcgtctccgagtacgcgttctccgaccgcgagagcgaggccgagtccaccccgacgcccgcagccaagggcttacgcgccggcggcggcggcggcggcggcgatggcgagcccatgagctcgttgtcgtacgcgggaacgccggaggaggaggtggcgctggccctcatgatgctctcccgcgacacctggccgtccgtcgagcgcggtggcggcgggggcgagtactcggacgacgggagcgacgacggctacgcgctccctccgccgtctcccgctccggcgccggcgccggtgccggagaagcggacgcggttccagtgccccgcgtgcaagaaggtgttccggtcctaccaggcgctcggcggccaccgcgccagccacgtccgcggcggcaggggcggctgctgcgcgcctcccgtcgctcctccccctcagccgcatccgcagccgccattgccggagcacgacgcgggcgaggaagacatggacgggaaggcgccgccgcacgagtgcccctactgctaccgcgtgttcgcctccgggcaagctctgggcggccacaagaagtctcacgtctgctccgccgccgccgccgcggcccatgcacagacacccggcggcggcgctcctccgccccagcccaaaattctcggcatgatcgatctcaacttcgcgccgcccgtggatgaggtggagctctccgccgtgtcagatccccacttcccctccaatccaccaggtccttgaagcaagaaaaccagacttggcaatggcggagatgatgatctgaggtgaggcataaatcgaagaaacagaaagaataacaaaaagagggaaaaaaaaagagaagagaaggataaacacaagaacatattttttagccccttagttaatcttctggtcgtaccttttagtattccattccattgatttgtgttcagaatgtttaattaatatgttactaccatgctgttgctttgtttttttttgcctgtttaagctatggaatcgatgtagatttgagcaactgacagtgcaacaagaactagcccctgttcttgatc

SEQ ID NO: 5718 - DNA, 1339 bp, Oryza sativa
  Predicted polypeptide sequence is orthologous to G651
gctccgtttcctctgaaagctcgtatttttagctctcctaagctctgtgcctcatcaagctctatccaagctctcgccatggccaagaacacatgcaagctctgctaccgccgcttcggcaacccccgcgccctcgccggccacatgcgctcccactcagtcgccgcctcgaggtcgcagatctcctcgacgtcctccgcgtccacatccgtcgcggtcggcgacgacgacggcggcggtgatgccaagaggcccatccagggatacgtgctgcgggagaagcccaagcggagggtccgcctcgccgagtccgacttctcggatcgcgagagcgagacggagtactactcctcgccgcctcacggcaagcgcgcgaacaccggatcgggcgatgtcgagcaggtgagctcggtgtccgacgccacgtcggaggaggacgtagcgctgtccctcatgatgctctcccgcgacacctggccagccacgccgccgccgccgccgccctaccgtctccgcggcgcaggctacgacgacgggagcgacggtggcgacgcacctccggctccggccgcagcggccgcgcagaagcggacgcggttccagtgccccgcatgcaagaaggtgttccgatcgtaccaggccctcggcggccatcgcgctagccacatgcgcggcggcaggggcggctgctgcgcgcctccgcctaaccctcctccttctcccgctacgcctctccagccattgccggagtgcgacggcggcgaggaggagggcgcgaagccgcatcctcacgagtgcccctactgcttccgcgtgttcgcgtccggccaagctctgggcggccacaagcggtcccagctgtgctcagccgcggcggcggccgcatcgggcgacgatattccagccatgattaaaagcaacggcttcattgatctgaacctcccggcgccgttcgacgacgtggagctctccgccgtttcagatcctttcctctcctcgaagccaggttcttgaaagcaagcagagcatgagagagcgagcatactggctgttcagtgctctctctcctttcggttgattccaaagaagatggttagagctatggattcgagagaaagagctgcttaaccaggcagccgaaaaggtaaagaaaatatcataaaaaggagacatctttgctttggtagttttttttttctcagttgttttgttcattcagctacaaaaattgcttgatgctgtcctccattctgttctgtctttttgtttgtttcaagctacccgaacagtgtacattggggcaactagcagagcttagcatcttgcttacttcttgatc

SEQ ID NO: 5719 - DNA, 984 bp, Oryza sativa
  Predicted polypeptide sequence is orthologous to G652, G1335
gattcgcttccactcccacaccgatctagggtttctagggttttgggttgcggcggcggcggcggcgagagggcgagggcgaggtcgagatggcgtcggagagggtgaaggggacggtgaagtggttcgacgccaccaaggggttcggcttcatcacccccgacgacggcggcgaggatctcttcgtccaccaatcctcgctcaagtccgacggctaccgcagcctcaacgacggcgacgtcgtcgagttctccgtcggatccggcaacgacggccgcaccaaggccgtggacgtcaccgcgccggggggcggggcgctcaccggcggatcccgtcccagcggcggcggggaccgcggctacggcgggggcggaggcggcggccgctacggcggtgaccgcggctacggcggcggtggcggcggctacggcgggggcgaccgcggctacggaggcggcggcgggtacggcggcggcggcggcggaggcagccgcgcgtgctacaagtgcggcgaggagggccacatggccagggactgctcccagggaggaggcggcggtggtggctacggtggtggtggcggcggctaccgcggcggtggtggtggcggcggcggcggcgggtgctacaactgcggcgagaccggccacatcgctcgcgagtgccccagcaagacctactaggcgctgctcgcggcgtcagatccagctccctcccatgatgcgttttgctccccctccctcactgaatcaccgagcagcgggtgatcagttctatcttattagtagtcgtagatctcgttaggaaagctatggatctatcggttcgtcgtcgtcgtcgttctatgtaatgggatgggagtcttggagtggtttaatctttttgtttcgttgggtcggtttgagagacaagccatggatttgcactgtctgatctatctatgaatctatctattatgaaccgagaagaaaatattcatcagct

SEQ ID NO: 5720 - DNA, 963 bp, Oryza sativa
  Predicted polypeptide sequence is orthologous to G652, G1335
gattcgcttccactcccacaccgatctagggtttctagggttttgggttgcggcggcggcggcggcgagagggcgagggcgaggtcgagatggcgtcggagagggtgaaggggacggtgaagtggttcgacgccaccaaggggttcggcttcatcacccccgacgacggcggcgaggatctcttcgtccaccaatcctcgctcaagtccgacggctaccgcagcctcaacgacggcgacgtcgtcgagttctccgtcggatccggcaacgacggccgcaccaaggccgtggacgtcaccgcgccggggggcggggcgctcaccggcggatcccgtcccagcggcggcggggaccgcggctacggcgggggcggaggcggcggccgctacggcggtgaccgcggctacggctgcggtggcggcggctacggcgggggcgaccgcggctacggaggcggcggcgggtacggcggcggcggcggcggaggcagccgcgcgtgctacaagtgcggcgaggagggccacatggccagggactgctcccagggaggaggcggcggtggtggctacggtggtggtggcggcggctaccgcggcggtggtggtggcggcggcggcggcgggtgctacaactgcggcgagaccggccacatcgctcgcgagtgccccagcaagacctactaggcgctgctcgcggcgtcagatccagctccctcccatgatgcgttttgctccccctccctcactgaatcaccgagcagcgggtgatcagttctatcttattagtagtcgtagatctcgttaggaaagctatggatctatcggttcgtcgtcgtcgtcgttctatgtaatgggatgggagtcttggagtggtttaatctttttgtttcgttgggtcggtttgagagacaagccatggatttgcactgtctgatctatctatgaatctatctattatgaaccg

SEQ ID NO: 5721 - DNA, 1224 bp, Oryza sativa
  Predicted polypeptide sequence is orthologous to G652
agaagggttcgtctccatcctcgaagctagggtttaaggcgaggaggggtgaggtgacgagattggaggcgaaggctaggagaggcttgcgattttcctctggattcacagattcccgaacttttgcggaagtggtgagagaaggtatggatcgtagaccgcaaggggggtggcagccggtgaagcggcgatttggggaagaggggaggggatttcgtgacctcaccgaaggggagttgagggagagattgcagagggaaagggcgagagaaggggagagagagggaagcagggagcgaggtggtgaacagcgcggacctcggtgttttggatcaccggtgggacgccgggaggggggcaggggagctggtcgcggcgacgagaactggcaaggaggtcgtccagatgtggcgcggcagggcggcggtggagatggtggctggcatgggggaagaggggatgggggcagacttggaggaggaagagcagaagttatcaaatgcttcaagtgtgctcaagagggacaccttcaaatcgactgcccgaaccctccaatctgctatacatgtaagaaatctggtcatattgctgcagaatgttcaaatttccatcgcaaggggattcatctgtgcggatgtgggattgctggccagtgctttaatagcatgacgattgagactgatgggggagaagatgatcagattcctatcagggggatattgactgtaattagtggagaaggttctgtggatcagatagaatggaagctgaagtacaaattgtttaagggagttgtgggactggaaggtgactgcaatcagtgagaaaactttcctgatatctttcccttcaaaggaggctaggagagagctgacaaaatttgatggttttgatttaagttcctctatcaaagctaaggtggaggagaccaacaggacagaggaatcttttgctgagctaagagaagtttgggtcaaagcttatagggtgcctagaattgctagaaaggaggagttgaaagatctatcatatttggttggggagccaattgaggttgatgagacaagtttgagaggtttgggaccggttagggtcaaggtggcagtatgttcaccggaggaaattcagggaagcacctctgtgttcataaacagggtgggatatagaatcagatgggagactgaagaaggaaacatggagcaactgaatccttctccaaagaag

SEQ ID NO: 5722 - DNA, 1398 bp, Oryza sativa
  misc_feature (1308)..(1308): n is a, c, g, or t
  Predicted polypeptide sequence is orthologous to G652, G1335
acgcgttcgcccacgcgttcgcgccgcatcacctccgccgccgccgtcgccgccgcatcgcgcctcctcgtccgccgcgcgccgccgcgcctgctgcgccggttaccccgcgcggcgctcgccgcctctcgcccgtcgccgccgtcgtcgtcgtcgtacggtgcagcagccgtcgccctcggccggcagccgctcggccaccgcgctaggatgggacacaccgccgccgccgccgccgccgcgggccccgcgctcgggctcaccaagcccaacgccgtcgagccgccgcaggtttcatttgctgctaaagacgtcgagatggcgtcggagagggtgaaggggacggtgaagtggttcgacgccaccaaggggttcggcttcatcacccccgacgacggcggcgaggatctcttcgtccaccaatcctcgctcaagtccgacggctaccgcagactcaacgacggcgacgtcgtcgagttctccgtcggatccggcaacgacggacgcaccaaggccgtggacgtcaccgcgccggggggcggggcgctcaccggcggatcccgtcccagcggcggcggggaccgcggctacggcgggggcggaggcggcggccgctacggcggtgaccgcggctacggcggcggcggcggcggctacggcgggggcgaccgcggctacggaggcggcggcgggtacagcggcggcggcggaggcagccgcgcgtgctacaagtgcggcgaggaaggccacatggccagggaactgtcccagggagggggggggcggcggtggctaccggtggtggtggccggcgggcggcggcggggttgttacaacgtgcgggcgagaccggggccacattcggtcggcagatttgcccccaaggaaagaaccttacttagggcgcgctgtgtcgcggggggtacagattccaagggttcccttccccattagttccgtttttgggtccccccccttcccctccaattggaattcacgcggagacaggggggttgaaccgggcccaaccttaattaaggcaagccagaacgctccccggttcggaaaacagctatgcggatccaaacacgcgttccagcccgaccggcacggccggcctatattgtacccgcgcgactggggaagcccttcggagagtggggggttaaaaccccttttattagagttccgaggatggggagtcacggggtttagaaaaaagagaacaggggccattgggagatttttgcgagccgttgggtagaggcctctaattctttagagaaaagatcatcagcttgaatatantatgaagccgccggctgaataagaagaagttatttttctctatgacggggcgagagagaaggagaaacagacacaacagacgaaacagag

SEQ ID NO: 5723 - DNA, 673 bp, Oryza sativa
  misc_feature (510)..(510): n is a, c, g, or t
  misc_feature (539)..(539): n is a, c, g, or t
  misc_feature (583)..(583): n is a, c, g, or t
  misc_feature (606)..(606): n is a, c, g, or t
  misc_feature (622)..(622): n is a, c, g, or t
  misc_feature (627)..(627): n is a, c, g, or t
  misc_feature (633)..(633): n is a, c, g, or t
  misc_feature (639)..(639): n is a, c, g, or t
  misc_feature (644)..(645): n is a, c, g, or t
  misc_feature (660)..(660): n is a, c, g, or t
  Predicted polypeptide sequence is orthologous to G653
cttttccgtttcataaatttctgattaaatttgaatcatgccattcaaaccaccagaggcttccaaatgcccaaaatgcaaccaaagtgtctttgctgccgaagaagttccagcagctggcaaaaaatggcacaaaatgtgctttaaatgtggtctttgcaaaaaaatgttagaagctatgaccatggctgaacatgaaggtaacatcttctgcaaacaatgttacggtcgtaaattcggaccaaaaggtgtcggtttcggacaaggtgccggtgccttaggtatggatactggtgaacatttgggaaacaaaagtggatccgagatgagcaacaaacccaactatgctccaccacctggcgttggtcaacaagaagaataaactggacaaattcgatcttaacatcttagtccattgattctcatgtaaaaacagtctctgttcagatgaaacagaagtttatttctctttttcttttttcatatatcttcactcgttttttttatacnattccctttagaaacatcctctctttaanaacctgtttctttctattcttattaccctcataatttcattatnattattaattcataccagatatnatatttgttatattanagacnagaccnacactnatatnnatcaaagaacaaaanaaaaaaaaaaaaa

SEQ ID NO: 5724 - DNA, 962 bp, Oryza sativa
  Predicted polypeptide sequence is orthologous to G653
aaaatcccattgctcacccgcgttatataaccgcggccggccattgggagggacgccgcgaggggtgctcgtttcagcgcgggaggagatcagatcgggctcagatcttccagctcgccgcgccgcctccgccgccgcagcaggaagagagagggtgaggagaggaggaggctacgatgtttagcgggacgcagcagaagtgcaaggtgtgcaccaagacggtgtacccgatggaccagctctccaccgacggcgtcgtcttccaccgctcctgcttcaagtgccaacactgcaagtccaccctctcccttggcaactactcctcgattgaaggagtgccatactgcaagccccatttcgagcaactgttcaaggagaccgggagctacaacaagagcttccaatcacccgcgaaacccgcatcggagaagttgactcctgagctgacaagatcacctagcaaagccgcacgcatgttttcagggacacaggagaagtgtgccacttgcagtaaaacagcgtatcctctagagaaggtgacagttgaaggacaggcctaccacaagtcctgcttcaaatgttctcacggtggctgtgccatttcgccatccaattatgcagctttggaaggtatcctatactgcaagcaccatttctcccaacttttcaaggagaaagggagctacaaccatctgatcaaatgcgcatcagtcaagcgcgccgaagcacagccggcaccaccaccggccgctgcagattcctcctgaatgtaccatatctccagtgaggcttgagggcgaaaattcggaagccctctgttttacaacctgcttgtatgccatgttccagttctgaggataccgggacctatcaatttcgtgtcctctgctgtgctagactcgatcacattggtgaaccatgaatatcatgtccctttcaaagaaatcgttgtgcaagtactg

SEQ ID NO: 5725 - DNA, 2367 bp, Oryza sativa
  Predicted polypeptide sequence is orthologous to G657
atgacaagcgataacggaaaggctccagataaggatggagagccttctggacctccgtcggctcctcaagaaggagaaatcagcaatgaaccaaaaaggcgacgacctctcaatgggaggaccaccggtccgacacggcgttccaccaaaggaaattggacccctgaagaggatgccatattgtccagagctgttcagacatacaacgggaagaactggaaaaaaatagcggaatgctttccggatagaaccgatgtacaatgcttgcacaggtggcaaaaggttctaaaccctgaattagtcaaagggccatggtccaaagaagaagatgaaatcattgttcagatggtaaacaaacttggaccaaagaaatggtcaaccattgctcaagctttgcctggacgtataggaaagcaatgtcgagaacggtggtacaaccatcttaaccctggcataaacaaggaggcatggacacaagaagaggaaattaccctcatacatgctcatcgaatgtatggaaataaatgggccgagctgacaaaatttttaccaggaaggacggacaattcaattaaaaatcactggaacagttcagtaaagaagaaagtcaattcatacatgtcatcaggtttacttacccaagtttcgtgtctccctctaaatgaatattctgcaaattgtaattcctcaccagcgatgacccaacaaaacagtgaagatagtggttgttttgctgtccgagaggttgaaaattcatcagggtgtagtcaatcatcacttgccaaggtttcttgctcccaagtgcatgatactactgtgccattgggctgtgatttgcaagtaaacgcgaattttgacaagaatgaagcacatgattctcaatcttccatgggtccccaagcatgctatacttctgcggaggctgttgcatctgctttgcctgctgtgcattgccatgtttcttcctctaacttggatccagatcaacacttgcaagaggactttgctcaaggactgaatttggacatgactatagatgaaatgccaactgttcctagttttgcagacaaccagactgtttgtagtatagaaaatcatgaaagatctctggagccatatgatgtagcaatggaggtgcctctctctatgttatcaagtgattctggagctgagcaaaaactacatttcatgtctgaggctgacttcaacagtcctaactgtctgaaatctgaactctggcaggatatttccttacagggccttctttctggacctgatgcagttgaagctgattcaatttcaagatcaaatcaccaatcggatgtatattcctctgaagcagatacccattttttagcaccaccctacatgccacagacatcaaattcttcaagtgtgatggggcttgctgatgaccagagtccacagatgtcagtacctccatctcttatttgttcaaatgctatgactgatgatgcacctttcgataatagaccagggcggaaggaaatgccactttctcaggcagaagtggttacccaatcttccagttcttctggtgatgctgaaatgtttgctaaccctggttgtagcaatgacagacatgttccttcttcaacgatggaaagcatacctgaatgtggggaccaacaggttactaatgcggaagaacctgaagccagtctagagaaagaaccatcgcttacacagagtgtgactgcaccagatgaacaggacaagggagccctcttctacgaacctcctcgttttccaagcctggatgttccatttgtcagttgcgatcttgtaacctctggtgatctccaagagtttagtccccttggcattcggcagttaatgcattcaaccatgaatgtctgcacgccaatgagattgtggggctcccctactcatgatgaaagcacgggcgttttgctgaagagtgctgccaaaagcttcatatgcacgccatcaatactgaagaaacgtcacagagatctcttgtctcctattccagataaaagaatcgagaagaaatatgggactgaaaaggatcgtggggtatcagacacatcctccaccggcattcaaacaagttgtatcaatgccactaaagatgatgcacttataactacagttttgcgtattgagcgatctgcttcttctaaatctctggaaaagaaacttgttttctctgatgaaaacaaggaaaatttgggctacacaactgaacagacaaaagatggacagagtgctggaaatgacgaacacatggacgagcagacaacaggggaacgcagttctgcaacaaatgtagctactaatgatgacctgtcaggcaatttagtaagtacttccagtttctga

SEQ ID NO: 5726 - DNA, 908 bp, Oryza sativa
  misc_feature (326)..(326): n is a, c, g, or t
  misc_feature (897)..(898): n is a, c, g, or t
  Predicted polypeptide sequence is orthologous to G668
tgacgcgtaggtcggtcggaatccgggtcgaccacgcgtcgcccgcgtcgaatgcgcaatgtttgaggagtgttggaaagatgtctaggactaagccatcttagataacagaattgatgtgttgtccgatatatcttcactcttgtccggttaaggaatcaccgaagacagcattcctggaaagcactgccaatgatgtcatgttgatgtactaacagtagctgatagctgcttggagagcacaatgtttactggcagctgaatatgctcgacgcatcccaccccatatctggattgcaaagtgcctctgagttcagatttaattnggtctggagacgtttaactcctttagaacttttagaatgataagaattttttagaacattagtgttcatagatttgatgtatttttaacagtgcatggttttgatgtctctgctgctgttgtgcgccatacccagatattcatacctgagggatgctagtcgcatcttgtgttgtccttctggaatctgacatcacctagcgcgcttccaagatctttagtgaatgccattttgagtgtcttttggctgtgcatctgtgaaattattgccagttcatgacaactaatagctttgtaaaaaccttctatttcatggttatcagtaaaagttattgatggttcttttaaaaaaaaaagggggcgctggaataaaatcggggcgtcagaggtcaagtagtagcgtatggagtcttagtctatgggtcctattaatcgggcggtacagtctgaggaaacgggtccataagctggcacctgcagggtataaggccaatgctcaatcagagaaggcctagcaaggagggtacgccagaccagcataccaggcgcagccttgccattctcatatctanngggagaggac

SEQ ID NO: 5727 - DNA, 777 bp, Oryza sativa
  misc_feature (647)..(647): n is a, c, g, or t
  Predicted polypeptide sequence is orthologous to G670
ctctgtcccagctccttctttcgtcttcgtcttcgccatcgtcgtcgggacatcgccggcggtttggtttgttctctctcggtcgtcgtcggcggcaattgcgacattgagcacggtggtggtggtggccatctatggcgaagcgggcgggcggcgcgaggaagaagctgaggagagggctgtggtcgccggaggaggacgagaagctgatgaaccacattgccaagtatggccatggctgctggagctccgtccccaagcttgcaggccttgagagatgtgggaagagctgcaggctgaggtggataaactacctcaggccagacctcaagaggggagcattctcacaggaagaagaagacctcatcatccatctccattccatgctaggaaacaagtggtctcagattgcggctcagctgccgggtcggacggacaacgaggtcaagaacttctggaactcttacatcaagaagaagcttcgccagcgcggcatcgatccggccacccacaagccgctcgccgaggtcgtcgccgccgccgcctgcgcccgcacgccggcggtgttcagcgacgccgagctcatcctgtcctccatcggcgcccagccgccgccggagagctatgatggcagccggtacagcacnggagtgcggcgccgcgagtgtcggcggcgacgggtcgctgtcgtcgctgtccgggtacagccaagcgacagcggagttcgcggtggacggcgccagcgcgagcgcgctgctgcactgcggcggcggcggc

SEQ ID NO: 5728 - DNA, 3716 bp, Oryza sativa
  Predicted polypeptide sequence is orthologous to G670
gagagaaggtcaggctgtcaccagaaagtcctttttccccggctagctcctgcatgcagctgatgagcgtcctgcatggagaagaaaagaacagatggtgacactgaattccaagaaaaaaacatatagtacaaatgcatatataccacaacagacaatgcaagcctccagaacggatgggatccgtctgcatgaggaatcaaaggacaaggatgatcagctggaaaccagattataaaatcatcaatcaatgccttttgattcgccgcgcgcttgtttaatgtttaatgggggggatgagtatccgctgtcacatgggcacaggaggggggatggatgccattacaatcctaatcatggaatcatggattaaacttttcccccttttcctttcatcaggataccaggccataatacttgcattgactagctcatttgggatgaatactataactccaaatgtttttgtctctgtcctccaggcccttgcatcttttcttttctttttttccagtacttctaaattccaagaaacacaaccggcctctccacaatgatcaatcgatcgaccgatcggtgttcccattgacggcagagacagtcagcagacaaatcattattcctgtacctgcgcaattatctgtgcaattatggggaagctcaccgttctgaagaactgatcaccacagacacgctcaacgtgcttcatctcggattggagaagcagatacggatttccgaatgaaaattgctagggtatctagctgcatgcccatggtaaacaaaggggagaagatgccctctgtcctggaataccaacatctgatgccaccacttctttttccccaggaccccaactgtgatgattgacggggagcttttccacagagacaagtgatccagtgacttacctgaaaagcaagagaaataaaggacaatacttaggtctgacacataaaatcttgcaggtgggagaaaatgaggtgcacatgcacgcacgcacgcacagcacaacacagcacagcagctaacaaaattgggacttaattggcaacagaagaaaggtggacatggcctcccagtcccagcactccagcagtagtctgctgctttctttgcccctgcatgaaacactcgtgatgtacaagtagctgcaggaaagaaaataaaaggagaggaaaaaaggatttaaaagagagaaaatttctgatttctagtagaaaatggtgtactggctgggtcgcagtcaatcaacatgggagcaagaacatcagtccttgtcctaataatgtaaaccctgatggactggttttactttcacttgctgactgattctcatcaaacaagtacactggaaatgggaaacgagataaaaggaaaaaaaaaaaggcgaagaaggaagaagatggaacagttttttgtacaaggccgcgacaattaaaatatcggtggagacggacggcaaccccaccagttttggcaccggacatagattcttaggagatgacgagacagaccccccacacgcacagccaggaagcaaccaaggcaaggggttaaacctcccttctcacaaccaccaccaccaccaccaccacctttaaaagaaggtgctaaagggggtgtcctgcaaagaaaaggagaggagtgccccctaacctttccctgctttccactgaaatctcctatccgcaaccatacagttgctcaattctggtctcagccaaagccccaatcattcatcgttatataggtcactataccctcccttgcatttcccaccaccaccccttgaagccatgaatcgctgaagaagtcgtctgcgctactgctaccaccggggaaggattagctgcgcagaattgtgcgagcgaagcctgccagccgtgcgaatttcaagctccgaggtcctgcattgcactgaaatggggaggcattcttgctgctacaagcagaaattgaggaaggggctctggtcccctgaggaggatgagaagctcatgaatcacataaccaagcatggccatggctgctggagttctgttcctaaacttgcagggctccaaagatgcggcaagagctgcaggctgaggtggataaactatctgaggcctgacctcaagagaggtgcattctctcaggaggaagaagacctcatcattgagctccatgctgtccttgggaacaggtggtctcagattgcagctcagctgcctgggaggactgacaacgagatcaagaatctctggaattcttgcatcaagaagaagctccggcagaaaggcattgatcccaacacccacaagcccctcaccgaggctgatcgcaggggagcagcacccacagtcagcaccgagaggacctcagggtccagcgacgtcaacccgtcaagtgctggtgctctagggaacttgagccacctcctcagcgagacagcacaatcatcaatgctgctgccggtgtatgataagaatcaccctgaaactgcaagcttgccacgccctaaggtgccaccaaaggagttgtttcttgaccagcttactgccggtcacgagagcccatcaagttgccgctcatcaggtccaaccctgtattttcctttccagcaaccattaggctacagtaatgaatgtggcactggggatggtgcgagtatgaattcactctggttcaaccagaatgatttcaactgcagcacaatctccaccgtgatgccaccagtttcaccatcagccctctcaacatcaatggggctgaatcttcccccagaaaatcctcgtcacggaggcactggcattggcaacaccccgttctactgggatggttccaatcctagcagcagcggcagtactgggagcagcggaagcaacagtatgggattcgagccacagagcacaacctcaattttggagaacagtgtattcccatggacagatatcggacaagagaaagataccagagttcacttagtggaggaactcaagtggcctgatttgctccatggaacctttgctgaggcgacgacagccatgcagaaccagagccaatcattatacgatgatgtgatcaaggcagagagccaattcaacatggaagggatatgtgcctcttggttccagaatcagcaaccacaacaacagctgcaagcagcatcagacatgtatgataaagacttgcaaagattgcccttgtcttttgaacatatctaggtgcaatgctacgccatgcatggaacagagcagagatcagaagaagcagaaacttgtaactctcgcatattgattggcaggcaaaacactgaagtgtttgatgttttgacacagaatcgacctcaacactttctcctcacttaaagatcctacagtgtcatggaaaagacagctctggccttacgagtagcagaagaagggatagaaaagtacgttctagagtctccctcttttctcttgaaatttgctgttttttgtacacgacaactcaacttttggatacttgagttttggttcactctgtttatcaaataaatatagacacgcatgggcaaaacatgtgtcggtagctctcacaaaccatacaagtagtcccaagcttttcaactgctaccatgcacgtacatgcaaattaattattgcatgttgtatttttatttcttttgagaagttgccgacaaagtgcagttgtatatttgtaaaggaaaaaaattggaacattgaccc

SEQ ID NO: 5729 - DNA, 1760 bp, Oryza sativa
  Predicted polypeptide sequence is orthologous to G670
aaagaaaaggagaagagtgccctctaacctacctatgccttcctccaaaatcctgatatcttgagccacttgttgctgccactctgccataagcttccaccctatcaagcaccaatatatgagccactatagactgtacactcgcagcaatcccactcttgagcactgaatcaccaagaggattacctgtgtaggtgttgtgtgctgtggaaagtttcttgggagggcaagctgtgcagattgcatagcttcagtttctgcattgattcaatggggagacattcctgctgctacaagcagaagctgaggaaggggctctggtcacctgaggaggatgagaagctcatgaaccacataaccaagcatggccatggctgctggagcaccgttccaaaacttgcaggacttcagagatgtggcaaaagctgcaggctgagatggataaactacttgaggcctgacctaaagagaggtgcattctctcaggaggaagaggacctcatcgttgagctccatgctgttctgggaaacaggtggtctcaaattgcaacacggctgcctggaagaactgacaatgagatcaagaatctctggaattcatgcatcaagaagaagctgcggcagaaaggcattgacccaaacacccacaagccccttgccgaggttgatcgaagcaaagcaactcccaccatcagcaatgacaggacctctgaatccagcgatgttgacccatctagtggcgttgctcttcacaacttgagccatcttctgagcgagacggcgcaatcatcagagctgctgccagtgaaggtaactaaacctcgcacacaagctccgggcttggcacgtctgaaggtgccaccgaaggaactatttctagaccagcttacttctggccatgagaacctccctagctgccgttcatctggcccaattcccaatttcccgttccagcagctgttgtgctacaataatgattttaacagcatggacgttggaaacaggaattcactctggtataaccagaatgaatccagtagcagtacaatttccactgtgatgcccccagtttcaccatcaactctctcgacatcaacaggccttaatccatcaccagacaatgcaaactctcgaggcactggcatccacaattcccaattctattgggacaccaacaatcctagcagcagtagcagtacagggagtagtggtaacaacgggttgggattcgagctgcaaagcacaagctcccttctggagaccaacatattcccatggacagatttagcaccagaaaaggatagccaagcacaactagaggaagaactcaagtggcctgacttgctccatggaacgttctcagagatgccagcgcccatgcagaaccttagccagtcactgtatgaagacgttgtcgaagcagagagccaattcaacatggaggggctctgtgcagcttggtctcaaaacctgctgccacagcaacatcttccagtagtatcagatatgtatgacaaggatttgcaaaggatgtccttgtcttttgagaatatctaggaaccatgttccagcatgcagggaacagagcaccagatgaaaattgagagttgaaagcttaggaagcacaatgtttcttcagagatacgtttacagtgtactcagttgtttgtggataaattattgtgagtgttcacatagatgcattcttttggtgagacatgaatgaacatcaaagagcaattcctcaaaaaaaaaaaaaa

SEQ ID NO: 5730 - DNA, 6305 bp, Oryza sativa
  Predicted polypeptide sequence is orthologous to G675
gatatcgttgccgtctcgctatcctctccagcggatccaggtacccagaggagagggacgcaagccgctgccgcgacacttctcccccttcatctccatgccaccaccgcctccctcttcctcgccctccactcctcttggtgaggtgccagatcttgttcgagggtcgttggaatcgatggtatcggtctccccaacggtggatccggtcacccggagcgacggacccaagcggttgccaccgccctcttctcctctcccgctctgccctcttcctcttgccctctgcacctctaagtgccaggactagctcaagggctgccggcgttgggagtgtagggtgggcaaggctgagaaaaagaaggatggatagcggtggttgctggcttcatggatgtgcccggttggttccaatctcctcttcccccctaggtttcttcgtgttgtcgcctatatcttgcttcttcctagagttcaatcgatctggtgtggtggttgctctattgtatatttgtattgtctaactcaacagatttggagggcctcttttgagctcaaaataatgttcatgcggtctaatcaatttgtcaaggggtatatatgtttactctagaagatcatgagaggttgcaaagaccggacaagattatcaagccgacgatggggtatgccatctgcaatgctatggataatttctccgtgctcttatcctgagaagatcctctcatcctgtgtgggacaagaacaacatgttcttcaaatttatgaacatggcattttttaggagacaagttcagatcacataatacacataatggagctatgtttcaggtcagaacttccaatctacatcctttattgttatgttcagcctcaaatttgcatgatgttcaaatgtgcttagaaatcaagaaccataaatggaatacattattaagctagaaacaaattacagccttacagagttatagacttaaagtagttgaccatgtctcaagacccaacacttttatcttagaaatgttaattcaaaactttctcaatgacactattttccatatatcaattactccaactcatctgctactagctactgtatatgcatagtgaacagttagtattgcttaaataatgtctgggactgccacgtgtacgccacgtagactaaaaccaccgcggattgggtcgagaggggtaattcgtccggtattcatagttggggatgaaaaatgtcggttttgtggttcggggggtaattcggacgactgcgatagttcgagggtgtaattcgtactttttcctttcttaaaacaaaggggaaaaaataaatatgcaccagcggggtattgaacctaagacgttaagcattccctcctaaaatgctcaccgtgacctcacctaaccatccgaacatatgctacttaatgatcatggtttgcaaaactacattattattattatcgttgttatctaatgacaacaaaaaccgtatttttagcactatcgttgaaccatcagcccactgggctcaacctgcaagtcccaaagccgtcgataattttggactgaacgaataggccttgtgcttagtgtgaacagttcccattaaattaaaaattaaaaatggaataagttcactggccgtccctcaactttacatctagtctatatgacatccctaatccataatatcaagaaatctttacccctaaactatgcaaaaccgtataatttgggtcctatagcgctgaatctctggttacgctgatgtgacatcctagtcagaaaaaaatagaaaaattatgggacccacatataagtgagtaggaaaaaaattatagtgtccgcatatcttctttcttctcttttcttttttctcttctcttctcttctttagcgagcgcggcaattggcagcaaaaggggtagacgccgggtggggtggcgggcgaagcaggcaggcgatataagctatagcacttcagggaggtcaagctttgtagcgacgacggtgtggcattggcgtttctccgataagatgagcttcgacggctcaacagagccgaggttctgtgcaatgatgatgggggcggcgacgagcccgttcgtgttgtggaggcaatgtatgtcatgctatatggcaacgaggacggagcagcgatgactttcagcaagctaattcctgcaacaatagcatggtgggttggtggcgatggacccattcacgttgcgggagcgtaggttgtccagacgacatgcgaactgtgctgggtgataacaaagatgaatatgcagaaatgattggttaagattgttaattatgaaatgtggaacttcgaataaatctaaaattattttagttttgtattacttaaaaataaattttactactgcatttataaaattgtaaaactagttttaaggcaaattttgctacaggacactgcgactttgcggttttagctataggacaccgcacgaagtgacttttggggaaaaacactctcaaaagttggatatttgctggtggacaccgcacccattaaaataataatttctgtatgagaaggagagagaaatcacgtgaaatgtcaaaagtgcccttaggcccacatgtcagctcggctattcccctctctccagccacaggaacgggcggcggcgggacgaccccgtcgcgctacaccagtccaacgagttcgtcgtcgttgtcacgtcgaagagatcggcgagcagcggcagggagccaccgtggcatgcgaacgcgtcggcgccgacgccgcagccgaggagcctcaagttggcctcgacgtcgtcgcttgtaatcaccggcgcctcggaaaacgcgcacagcgcctgggtctggccaccggaatggtctatggccgtcgccgtgattgggacagagctgcctgcagacgacgatgagcaagtcgccacggcgagagccgcgtcgtcgtcgtacgcggacatggcgccgccgccgcccgacccggccgaggcgatggtggaggcggcggactagaggaggcactgtaggtactgcatcttggcgccctggatggcaatgtcggcgccaccaccaccggcgccctgcatgatctgcgccgccgccgccgcatgccatcccggcgaggtggtcccggagggtggcgagcgcgatgagctgcggcagcgcggcgaagaagtcggtacgtggccggtgcgtcatggggtcgaatcccatctgtatgagacgcttcttgaggtgcgtgttctcgttgtccgtcctttccgaaaggtgcgtcgcgatcgccgccgctgttccctggtgctgctgcctagcagagctgacatgtgggcccaagggcacttttgacatttcacacgatttctctctcctcctcacccgtaaattattattttaatgggtgcggtgtccaccagcaaatatccaacttttgagagtgtctttccccaaaagtcacttcgcgtggtattttacagctaaaaccgcaaagtcacgaggtactatagcaaaatttgcctagttttaactgtttctcacgaaaataaaataattccaacaaaaataaaatgtgtagaaccagacaaatcgacattaaataactgtccctcaattcttcccctcttgttttttaatctcacaatttttctcaataatctttcgctagagaaaatcaagcttaaatatagttgatctaaatttaacatttcgtttttctccaaaaattattttgctctccctccattatttccctctttttttcactcttagcaattcttttcacgtcttttgtgatcgcgccatttattccctccattttaccccctctaagaaaacaaacgatagctaaccgcccatgaaaatctctcccctctctctcatgagcaaatagatcctggatttcctcttttcccattatcatctcttcctctctctcctgccattctgcacttcttctcctcccctcagccggcgtcaatctggaggtaaggttctaggcactctgctgatttgctggccaactgcaccgagcaggcgagctcgatccccacggctgctgaggcccatgcggtgaagccccatgccagtggccgtgtgctgcactgctggtgaggttttgcctccgcggcgccggccgtctactccgtgccgcgcagcccgtgccctgaggccttgctgccatgcccctgcatctccatctcccttcctagttcctgcatattttactgcctcgcagagttgtcaaatcgcactcaagccttattccccttcagcattaaaatatattacggatttgatatattcagtattcaggttctggaagagatgcacccttacttgctggaccctggtctacaaacgattaggcttgaacagcacagtaagcaatccaatacgtaatcttgttttattcctctctcctagatgctgcaatctagccttaaccacttttgctttaaatcgttcactgtccatctatgtttgtttatctccgttgcagccaattaaataatgttctttccatcaattacttattcaaattgttggtctattaaaatggacaaaggaattagtgattggcaaataaatccaaattgaactcaataaatttattgttaagtttttaatgttttcacacctctatttgaaaattattcactagctaacagaagaatttagtaagctccgtagtggtacttttaggatagcatcacagcagtagagtaaaatgcctaaaattgtagtcaattctgaaattattcttctgtaggatcactctgttgttcctctttccatatccaactatacagaagaaggtaagtattcactttactctttggtagtcaaagccaacgtcaagcatcaaagttatttgataccaatgtttgaaaatagctttctgaacatatagaattagcaatgttttgttttttattagcaaaatgacactaacaaatagttaccaaaagaacccacctaataagtacattagctgtagaattctctgtttggtctatctgttctatttcatagttaaattgcagaatcaggatccaaaaactatgtttgcatagaaacaggcagtgcagcgcaatggactttatcactgacaaagtgacaattcgatggaggtaaaacatgttaaagttcttactgtgatgttcttttcgattcttaaattacttgaatgctgatcgatatgtatttatgcactagattggaaatagaatattcttaaaaagctggaaaaccttaaacacaaatgtggctcttcctacagttgtaagctgtgatccaacttgcaaagttggatgttttgagctaggaagtgaattcttgatggtccatgtggatgttccataggtgagatttaaagaattgattaggccatacaaaaactacaaaatcgttggttatgtcataggacttgaattgcgtggccttcaattatggtaagctgttatttctttagttcttactttagagatgtgatcttttttttcctcctgacggtgcatcagtggttctgttttttttttcttttatagtttgatagataagtggggtaagatgatgacttcaaggtagagaatggtggcaactgtagatgttgtatgtatatagtttagatcctattttctttgcgtatgatgttctgaacaacgtttttagtacatgaattatgaggatgattatctatgtaataaaaaaattctttgtacaattggttattatgattgattggtcttttctaatttgtgcatgctttgattttgtgggtccctaacaaaacataatattgggcaaaagccagctggagcatgtcaagaccatcccggccctcggctgccttcatctcagactgactgaaagcacgaattgtttccataagtgaaaggaaagaatttgatctagacacaagctcttgttgctgaatgacaaattgggacctactgacaatccttttgtcaagtacttatgttactcatgtatctggacatggttggttcttcagtttctggaaacttgatcctcacctttccacctctagccctttctttctatctccatcattttcatttgttagatcaactggattaaggtagacagttgaaatagtgaagcagtggtggttcacgaaaactgaaaagttgtgggtgatggaggaagcacagcatgccacacagggatctctatctctctctagagtttaattgattcatctttattctagacttcaattttcttaaagattaaagagtggtgctaccatttatctataaactaggtgttttctg

SEQ ID NO: 5731 - DNA, 1134 bp, Oryza sativa
  Predicted polypeptide sequence is orthologous to G675
atggggaggtctccttgctgcgacgagaacggcctcaagaagggcccctggaccacggaggaagatgagaagctcatggagtacatccagaagaacggccatggcagctggagagcgctgcctaagcttgcagggctgaacaggtgtggcaagagctgcaggctaagatggacgaactacctgaggccagacatcaagagaggaaagttcacctctgccgagaaggataccatcctccagcttcacgccgttcttggcaacaagtggtcagccattgccaagcacctcccaggtaggactgacaacgagatcaagaactactggaacacacacctgaagaaggatctgatccagaagggcatcgacccgacgacgcaccggccgaggaccgacttcttcgccgcgctgccgcagctgatcgcgctcgccaacctccgccagctcgtgggccagctgccgtgggacgaccccgccgccgcggccgccgggctgcagcaagccgaggcggcccaggcagcgaagttcggacagtacctgcacctgcaggcgctgctccagcctccgccgccgtccgccgcgactagccccagatcaggctgcatcggcggcgccgccgccgccatgccgggcggcgacatggagcagatgggcgcgggactgcttagcccgccggcgatgtcgtccgcggccttgtcgccgatgtcgacgtcgtccttgtcgccgctgccttcgccgatgtcgtccacggccttgtccccgttgcctccttcgagcttctttggcaatggtggccaaggctcattcctcgctggacaattgcctaacatccaaatgcatggcagctcgttgttcgaccagtcggccgccatcatcaacgacgccaaccacaaccaagattacgctgcaagcactggcgagagggagatcatcaatggcgccacgaagacgacgacgacgacgctgctgccggaaggctctcttccgccgctcgccgactaccccaccatctccaacctcggtgatgtctacagcaccccaagctgcgatggcaacatcactgaattccctctcttgcctgacgccttattcgacgagttgatgagagactatgtatctccttcttcctctttttag

SEQ ID NO: 5732 - DNA, 826 bp, Oryza sativa
  misc_feature (2)..(2): n is a, c, g, or t
  misc_feature (51)..(51): n is a, c, g, or t
  misc_feature (813)..(813): n is a, c, g, or t
  misc_feature (819)..(819): n is a, c, g, or t
  Predicted polypeptide sequence is orthologous to G715, G1646
tngggccgaggacgagacaagggggctcatcgaccacaccataaattggtnacctgcttcaacatcttgatataagaaaggagtaaagaaatggcgattccaacaaaggaggaggtggagcagaatgaggaggacaatacattttcaaggttgcaattgcttgcacaacaacggcatgccatggaggaattctggaggaggagccaggaacaaattgaggcatctgcaggcaaccatgagcatatactaccaattgactgcgtgaagaatgtcattcgaccaaagaatgatgctatgatgctatctgctgacacaccaacttttgtgacaaaactttgtgagctcttcgtgcaggagctcaccctccgtgcatgggtatgtgccaactctcacaaccgtgacatcatattaggcacagacattgctgaggcaatcaccaccactgaatcctatcactttcttggtaatgtacttcgtagccacaaggcactaggaagtactgctcctgacatagatacttctgctaggaagcatattaagctagaccaaatgacctcactctaccatcctacccaagaaatgcaggcctcacgtttagctgggtatccaccccatgttcctatatatcctcctataggtcaaatgggaactcaacacaagctgtctccattcgctttcatgatgcaagggagaatctcttctcaacatgaaaagagaaaattccctagttaatgaagtgatggtatgcaccaacaaggatgagcataaacaactttgatggagctactagtattggtggtggtagtagtaagnggatgntgctatt

SEQ ID NO: 5733 - DNA, 962 bp, Oryza sativa
  Predicted polypeptide sequence is orthologous to G715, G1646
gctccgcatcggcagcaaccgttgcgaccaattcccccaattccattccattcccctcctcccccggagagaaaccctagcaatggagcccaaatccaccacccctcctccgcctcctccgccccccgtgctgggcgcccccgtcccttacccgccggcgggagcctaccccccacccgtcgggccctacgcccacgcgccgccgctctacgccccgcctccccccgccgccgccgccgcctccgccgccgccaccgccgcctcgcagcaggccgccgccgcgcagctccagaacttctgggcggagcagtaccgcgagatcgagcacaccaccgacttcaagaaccacaacctccccctcgcccgcatcaagaagatcatgaaggccgacgaggacgtccgcatgatcgccgccgaggcccccgtcgtgttcgccagggcgtgcgagatgttcatcctcgagctcacccaccgcggctgggcgcacgccgaggagaacaagcgccgcacgctccagaagtccgacatcgccgccgccatcgcccgcaccgaggtcttcgacttcctcgtcgacatcgtgccccgcgacgaggccaaggacgccgaggccgccgccgccgttgccgccgggatcccccaccccgccgccggtttgcccgccaccgaccccatggcctactactatgtccagccgcagtaacattttcctaccgtatagcttcaagtttatttagcgatttttatttatggaatgcttttctgctgttgtcgtagttgttattatgttttgcttgttgttgccgtgtaataactagaagatgtgattatcattgtgaggagcctcctctcggtgtataaacaatccgatttgaggattgggcgagctttgttgcgattgaggaaggctgtatggtggttttgatgcatgtctaacttatatcacaatgaattatttattaccc

SEQ ID NO: 5734 - DNA, 921 bp, Oryza sativa
  Predicted polypeptide sequence is orthologous to G715, G1646
aagtgaagagaagcagcaaagagagagcttttccatccccaaatcccctcctcctcctcaaaccctagctaagctccgctcgcagcagcagctgcagatgttctgggcggagcagtaccgcgagatcgaggccaccaccgacttcaagaaccacaacctccccctggcccgcatcaagaagatcatgaaggccgacgaggacgtccgcatgatcgccgccgaggcccccgtcgtgttcgcccgcgcctgcgagatgttcatcctcgagctcacccaccgcggctgggcgcacgccgaggagaacaagcgccgtacgctgcagaagtccgacattgccgccgccatcgcgcgcaccgaggtgttcgacttcctcgtcgacatcgtgccccgcgacgacgccaaggacgccgacgccgccgcggccgcggcggcggccggcatcccccgccccgccgccggtgtgccggccaccgatccgctcgcctactactatgtgccccagcagtaatgtatctgattaacccctttcaagccttttctaagcgaaggatgtgttgttgtttgttgttgctgttgctgttcttgttgttgttgttgccgcgtaataagatatgttgataatttatggcttcccctgagcttaaagaatttgagcttttggttctagaatctgggtaaaattgttgtaatggggaagactgtatgactgtatttgtagtgcatgtcttaacttgtcggatagtgtaatccgataattattatgcggttagctggttacctctcatgattactgtgctcatgtgctgtgcaatttatgttctttgttttggatgtacaatgctgtaaccagaatttggttgtgtaaggaaactattaaaggttgtgcgagggcagtgtggctatcgctgcattttagcttac

SEQ ID NO: 5735 - DNA, 1476 bp, Oryza sativa
  Predicted polypeptide sequence is orthologous to G715, G1646
cagagcaacgaagggaaggaatggagcaaactttggacgtacctagatcgttgagactactggcgccaaaagctcaacaacaaatggatgaattttggagggatcgacaaaaggagattgaaacaacaaaggactttagcgagcatgcgatccctatggcccgcttgaagaagatcgtatcttctcaaaagggtaacatgatgatgacctttgacatgccagcattcttatcgaagatgtgtgagctcttcgtacaagaacttgctgtgcgtgcatgggcatctgctcaatcccataatcgttgcatcatactagacacggatattgctaaagccattgcctccacagagtcttatgactttcttgttgatatcctccataatcatcgtgtgaaacacaaatccactccttgttctacacttactacaaagcgttgtaggttagtcgatcaaccttccacatctcacatgccctaccaacatcagctgccacaatttgctcctacatatactccggccatccctattactcctagtttaatgccaccaatttctcactatataccgttccaatatccatccttatcacaagaagtgtccccgatgatggcttctgcacccatagtgaatagatcaatgttgctcattcacaacatagcaaggggtctaggcttacaaggaaacaatatcagcacgttcgccaacaataatatcccagacaatattgttggttgtagtagccccacagttcttgcaagtatgatgagtcctgctttactagaagttgcagggacatcactaaatccaccaaactctcattccatctgcacaatgaacatgatcaactcgagtgatcctagtggatctagtattggtgacattaatgttgcaaatcaagcaagtcttgctccctctggacgttttaaccctgctatccttcgagagtcatcatgtccttcgttcttacatagtaacaatgacacaattgttgctataccggagggtgtagatattagtggcaccatggatgttgctagtgatgttgctgctatagttatcaatggtcaagaagaacatgagagggaaacaaatgttgagcatcatcagcaaaatgagatatatgaaagcattgatataggaataatcaatgcaagtgttgcggatgataataaatatagtattagctgggatgaattgggaatggctgatgattcattgctagacaaatttttggaggagtttcaagtaagaaatgacggtgttttgcgcactgggattgagttgcatgaagacccattccttggtgacgtgatgttagcaaacccaagtacaagcaatgccaataagtaatttagttggcaagttttgtttatatctcttttgtaagaatgaggttggtaactttttcttgttgaatataatgtttgcagcggcggacctatgtggggtgccgggtgtgcaccggcataaaaaaaaa

SEQ ID NO: 5736 - DNA, 1266 bp, Oryza sativa
  Predicted polypeptide sequence is orthologous to G715, G1646
atggagcaaactttggacgtacctagatcgttgaggctaccgacaccaaaggctcaacaacaaatggatgaattttggagggatcgacaaaaagagattgagacaacaaaggactttagcgagcatgcgatccctatggcccgcttgaagaagatcgcatcttctcaaaagggtaacatgatgatgtcctttgacatgccagcattcttatcgaagatgtgtgagctcttcgtacaagaacttgctgtgcgtgcatgggcatctgctcaatcccataaccgttgcatcatactagacacggatattgctgaagccattgcctccacagagtcttatgactttcttgttgatatcctccataatcaccgtgagaagcacaaatccactccttgttctacacttactacaaagcgttgtaggttagtcgatcaaccttccacatctcgcccgccctaccaacatcagctgccactgtttgctcctacatatactccagccatccctattactcctagtttaatgccaccaatttctcactatataccgttccaatatccatccttatcacaagaagtgtccacgatgatggcttccgcacccatagtgaatagatcaatgttgctcattcacaacatagcaaggggtctaggcttacaaggaaacaatatcagcacattcgccaacaataatatcccagacaatattattggttgtagtagccccgcggttcttgcaagtatgatgagtcctgctttactagacgttgcaggggcatcactaaatccgccaaactctcactccatctgcacgatgaacatgatcaactcgagtgatcccagtggatctagcattggtgacattaatgttgcaaatcaagcaagtcttgctccctctgaacattttaaccctgctatccttcaagagtcctcatgtccttcgttcttatataataacaacaatgacacgattgttgttgtaccggagggtgtagatattagtggcaccatggatgttgctggtttagttatcaatggtcaagaagaagaacatgagaggaaaacaaatgttgagcaaaatgagatatatgaaagcattgatataggaataatcaatgcaagtgttgcggatggtaataaatgcagtattaggtgggatgaattaggaacggccgatgattcattgctagataaatttttggaggagtttcaagcaagaaacgacggtgttttgcacagcgggattgtgttgcatgaagaccattcctag

SEQ ID NO: 5737 - DNA, 1283 bp, Oryza sativa
  Predicted polypeptide sequence is orthologous to G715, G1646
atgccgatcccggaaaaggacggggtggaggacaatcaagaggatgatacattttcaaggttgcaattgcttgcacaacaacgacatgccatggagaagttctggaggatgagccaggaacagatcgaagaatccgcaggcaacgaagagcttatactgccgatttcccgtgtcaagaatatcatccatgcaaaggagggtggtatgatgttatctgctgataccccagcttttgtaacaaaactttgtgaacttttcgtccaggagctcatccttcgtgcttgggtgtgcgccaactcacacaatcgtgaaatcatacttggcacagatattgctgaggcaatcaccaccacagaatcctatcactttcttgctaatgtagtccatggccaccaggcgctaggaagcaacataccagagataggggtttctgcttggaagcgccataagctagatgaaatgacctcactctgccatcctccccaagcagtgcaggtcacagatttagctaaccatccacccaatattcctgtttgtcctcctataggtcaatcgggtactcagcacacaacatctacacatgttttgatgatgcaaggagaatctattcacaaggcaagtaaagaaaaatccccactgaaggaagtgatggtgccgaccaacaaggtgggcatgaccaacagctcttatggagttcctaatggtggtggtgctactagtagtaaagttgttattgatagcccgaaaggcgaaacagcacaagttttctcttcccagcatgcatgtccttccctagaagataactatgttattcccattcctgctggacatggtgatagttttcgtactcttgatgaggccaatataccccagctacatcaggagcagaaaaactttatttcacaagatgctattgttggtgaaaacattccgctgaatgagtctttggaaaagagcaagcataaggatgaggacttactttttcctgacaaagatcttcctgagtgatctacaagacagaagatgaatttcatgacaatactaggaatacaaaataagcaacgaactgaagaaggatgcatcctggttaatccatcgaccatgtcttagtagagttttcttctgtgtttctgtgttgaagctttatgatttaccttatactttagtcaagatgaataagaaataagtatgtgtttccgtgtgaggcggtaatatgtagtaccttgtatttccatccatcttcgtatggacaataataataagacctctgtttgcttcatgat

SEQ ID NO: 5738 - DNA, 1095 bp, Oryza sativa
  misc_feature (775)..(775): n is a, c, g, or t
  misc_feature (822)..(823): n is a, c, g, or t
  misc_feature (825)..(826): n is a, c, g, or t
  misc_feature (828)..(828): n is a, c, g, or t
  Predicted polypeptide sequence is orthologous to G715, G1646
tttttttttttaatcggctatatattacaaattgaaattaattagtagattgtacatcccttaattagcttgagcgtccattacgtacatcggttaagttaatacgtaccacattaattaattaccgacacattgagcatttgatttgagcagctatagtagctagctagcacctcagcgatgcatgcatggaaccatatggatcatcactattcggagcttggaggtgcaggagggaagccagctgccgcaccgccatggcctgcaaaaccttgctgcccttcctcgctgaagctgccggcggcgccctggtccacatccggcgctgctccttgctgccacgccgggtcccacgccggaacatgccacgccggcatcatcggcgccggctgccccatcggcgggtagtagtacggcagccccgcggcggggccggccgctccaacggcgccggcgggccctcccgccgcgaacccgagcgcgctgccgggctcctccttggcctcctcccgcggcacgatgtcgacgaggaagtcgaacacgtcggtgcgcgcgatggcggcggcgacgtcgttgcgctgcaggtgcggcgcttggcccctcggcgtgcagcacgagcggatgtgagctccgaagaaaagccgcagcctggcgaacagcaggcgctcgtcgaaaatagccgtccgtcgagtagatatgaagggccggagggggtgttaataacgcgcgcgcccctccgggtggtgcacccaagggcgccgtgagagtgatgccnccccactcccgccgcgctctgtaccgcgcgccagcgcccgcacgccnncnnangagacagagagaggcacacagcagggagcaagagagacaggggaaagaggcaaagagagagaagcgaagcgagagaagcgagaacggagaacagcgaggagaagaagagagcacgaacgcgaaagggcgacaaccagacgagacaaacgcacgaaacgaaagcaagaacgagaaaggagaaacgaaaaacaggaagaaagaagagagaagaagaggacgagagagatagaagcaagacgacagagaaagaacagaagcaaacagaaa

SEQ ID NO: 5739 - DNA, 2507 bp, Oryza sativa
  Predicted polypeptide sequence is orthologous to G718
gatagtcactactcactacactaccagttggtgtttgttctgagcattattggagtgtcagggaagggcatgtgcttttgttggttgctgtaggaggaggcagccatccactgggcctcactctcctcttgttgctgcctcctcctcttgttactgttcagtctcaggctctcaggctcacaggtggggttttgggagatactagttaggagggaaaggttgccatcttgtgtgtgttggatctttaatacaacggggataacgattctctctcagctaaaggaggtgagattcttggtttcacatcaagtattattgttctttcttttacttccttcaaaatagtttctttgctttttatttcatatatggtttggtttatttatgctccccaacaagcaactggttcatgtgcggtaacaaggagcaaataatgcagctctgattgacttggggtagttgttgtggtgatagattggaaagggtttaaatagcgggtggttgtggtgatgaatgggggccagccttgatggggttgatgctgtcgtcttttaggtcggggaaacaagtgggataggatctccctcaagtcgaggtgagtgagaactcagccaagaacaacaatggagtctctgttgctttagttctgccagccaattggtttcaactttcaacgctgctacttgttattcatcacctcctcggatcggtttgatttatgctcaaggttgtgctatgcatggtcatgctgattgagggcaagatttgcagggagaggaaggatccactgtgtttcttttctgggagaaaggaaagttgagatttgcaatatatacaagtgtgagcagcagcagttgagatccttaattcagccatggcttcttttgggatgaactggaatcagaagagccctgtgttttgggactgggaaaatccagcgcctttcggtccgaatacaatggaaaatcccaagagcatacctcaccctgaaccaagaggtgtagttgtcgcggccgcaaatcatggatccaccaattcatccggtggcacgttcacttctagctcggagctagccaatggttcatcgaagagctccttgtcagcgtcgttcgattcctcatccaagctggggaacagcttagagttcaggtttgcttctgtcaaagggcatggcaagaacatgtgcaaggatggcgaggccggtagagttgaagactcgggcacttctccagctgtggcagttagccatggtgagccggtaataggactcaagttagggaagagaacttactttgaaaatgtttgtggagggcagaatgtcaagagctcctctgcagcttcaggtgtgacttgtccatctactgtggtcaagaagatgaaggtgtctcagcagagcacacaaagctcatactgccaagttgaaggctgcaaagtcgatctgtcctccgcaagagaataccatcgcaagcacaaagtttgtgaagctcattctaaggcaccaaaggttattgtttctggtctggagcgccgtttttgccaacagtgtagtcggtttcatggtttagctgaatttgaccagaaaaagaaaagttgccgcaggcgtctatctgatcataatgcacgaagaaggaaaccgcaacaagaggcaatttcatttggttcatcaaggctcgccacgatgttttacgatgcaaggcagcagacagatatttactttggccaatctccttttggccaagtgagaagcaatgcaatttcttcatgtgacaacctgggaggcttcaaatttacagaagcaaaactcccctggatgaagccaatgaaaactataggccttgaggatctgaatttctctaccctgcagatgccaggcaatgttgtgtcgcatacggtgcatcatcatgattttgatgggctcataccattcaagggaaacaccccgaaggtcctcaaccaaggtgtggatccagcctgtgccgtcgtgtcctccaactcgaatggagccccggatcttcggcgtgctctctctcttctgtcaagcgattcctggggcccggccgacgttcaggccggctcccaggtgcatcccggtggagtgatgccgcccctcgccgttgccgccgccaccgtcaccgccccgacgaaccctgtcagtgtgatgcatgctctgcacccgtccaccggaggaggaggattctggcaagacggcgacgacccgcctccgctcgatcatgcctcgcaggctcaggcgttcatgcatcctggcaatggcagcagctccggctatggccatctgcactgattctgctgcatctatttggaacgggttgatgactggttactccgttcatgatcttaccctgtcagtgatggactctgaataatttgggggcgaattgtcctgcaaccccaggatttattatttctatttttgaaaccaaaccaccaggatatttgccattggatgagaagtgttcatgatcatgaaatgatctgttttgttccac

SEQ ID NO: 5740 - DNA, 2903 bp, Oryza sativa
  Predicted polypeptide sequence is orthologous to G718
gattccccaatgacttcttcttcctcctcctctccacagtccacactgttcatctcctcctcccctccctcccaattcgattcccaaatcccaaaattgaccacccaaatccgcgccaatccatggattggatgcctcctccgaagcccacctcgccgcgctcccctcccctcctctgggactgggccgacgccgccgtgccgggctcctcctccggcgaggtatccgccgccgccgccgccgccgcggctcatccgggaaggcggcggaaggagaagcgaggcagggcggaggaaggaggaggtggtggtggggaggtgaggtgccaggtggaagggtgcggggtggagctcgtcggcgtcaaggactaccaccggaagcaccgcgtgtgcgaggcccactccaagttcccccgcgtcgtcgtcgccggccaggagcgccgcttctgccagcagtgcagccggttccatgcgctctcggagtttgatcagaagaagaggagctgcaggagacgcctgtatgaccacaacgctcgtcggcggaagccccagaccgacgtgttctcctatgcatcggcaaggccgccgtcgtcattattatttgatgataaccgacaaataagttttgtctggaacaaagctccactcagccatgtaaggcctttcgcaatttctccatgggaaagctcatctgaagttgggacaactgatggacatatttatttggataaatctcacatatccaaatctctcccagcatttaacaccgacatagatgagctcttaccaatgaaaggtatgattttccaaagatgtaagttttcgtgaaaaatgtcatcaattaagactactttcatggttcagcacattgcatagatctttgaaaaaattcaacctatacactgtaccaaatgccaaattcagatgctgttttgtcattgttgttgtttgttaaaaaaagtatcctggagttgtgcacacccatgaaaaaaaattagacccttgagcacatttgggtttagaaaataagatggtgtgcagtgtgctgctaagcttatgtcactatagttgacgaagtgtttcaaacataaaagacaacagagtttttagtaagattctaattggaaaagaaaaaaaataccgtgttttgtgtgatagtaaacatcctacagtttcaactatataagtagttctcttgtggtcattgggcagagaattacttctccagttagcaatacaagttgttttgatttaacttgcaggtatacaacaaagaatgatgttgggcattcttttggtcctttgctctcttttgcccaaattagttatgttagatgcttttaactacagttaatatgtgcttggaagtggagcatgcaccaaaaaatggatagcaaatgccacaagtttccatatgaggctttggcgctaatatcgcatcaatgatgtgttagtttttgtgtttggtacaagtatctgtacaaggttttggtgccaacattgcatcattaatgcgcagctagttgtttcatttggtgtgagattgtatataacggcagcaattattttcatgtaatagtattccaacagggatttaacaggggcagtattgtaccaaaaaccataacttaatgctatgtgcttattagtctacaacgacttcgaagtgctgactagagggggtaattatatttatgctatgttttgttagataatggaatgctatggattttgataacaagaaaaaaaaatgcaaagtgattccagatagctgtgattcttatctctgacaaaacgagggaattccaatacttagcacaatatgcgaaagtcagctcaggaatgccctaaatttaccttattatgcctgttccctaaactctccgcatgcgggagaactagttaccatgctaaaattctacatactaccaagcatactgcaatttcttggataaccttgctaattttatgctaaattctcaaaatatatttcaaatgaatatgagccattcaatccatttccattgcagacttctctgcagccactatttggatgttcttcggtgtcctttttatccgaactgcgcaggagagctgcatgtcatttcattaaggagaaaacaatgtacatattttgatggaagaatgaccattattccattttgcaggtccggacgcatctttaactgcttcaaaatttgatggagcaccggatcttcagcgtgctctctctcttctgtcatctagttcttgtggattacctgatcctgtacagcaagcatctcgcgtcatccaattcacaggcgccagccaaaacaaccgggaacttcctccacttaatggagggaattctgcttcagcatcatgtgccaatgtacaaactatagcacaaccggctcagctggttcgttttaccatgaatgctagcagcaatgcttgtcagtccaatttcttcggtttaaaccagataaactaaaggcctggactgaaagcccgtcgtcgatttcgaccaatatccaccaaggtggccttgagaagatacaagaattgcttctatcaactatcagagtgcaaacaatgtcacagttaatgttgtcatcataaatatcggtattggtctcccctgaactaaaatcgaacggagtgatggcttgcttgtgttttcgataatcgttatgcagttctaattttttttctattgttttctgccaatgtaccgattttcaaactgtgggtcttgtcatttatacttgtacaacctaatgtcaaaatgtcatgtatctttgaaactgtttttgatggatttgggacatggtttcgcttgtatgattgttgttttggcagcggcatgtggtttcagtggtggtggtatgctttggcgccataacgtgctgttttttcccc

SEQ ID NO: 5741 - DNA, 1164 bp, Oryza sativa
  Predicted polypeptide sequence is orthologous to G718
atggactggaatcagaagagctcggtgttgtgggattgggagaatatgccgccgataggaaatagcgcgaacgagaatcccaagaatgtgatgctggctgaatcaaaacttgcaggtgttggggttgacataggccatgaatcaggccattcttctggtggtactttctcttctagctcagagattgggtatggttcatccaagagttccatatccgcgtcgatcgattctccgtccaaagtggggaacaccatagagctcaattttgcatctgcggaagagcatgataagaacatggacaagggtaagagtaaagttgatgacaccggaacttctcgatcaccggtggtagcagccaatcgtgtagagcccttgattggcctgaagcttggcaagagaacctattttgaagatgtctgtggagggcagaatgtcaagagttctccatctggtgtgagtgtggctaccccatctcctggtctggccaagaaggtgaaggtggctcagcagaacactcagaacccacactgtcaagttgaaggctgcaatgttgatctctcttctgctaaaccttaccatcgaaagcaccgagtctgtgaacctcacagcaagactcttaaagtcatcgttgcgggtcttgagcgacgcttttgccaacagtgtagtcggtttcacggtttagctgagttcgaccagaaaaaacgaagctgtcgcaggcgcctccatgatcacaatgcccgcagacggaagccacaaccagaagcaatttccttaagttcgtcgaggctctctacattactctatggtgatgcaaggcaacaggcaagttttctatttggtcaagctccttatggtcagatgggaagctgtgcaagttcttgggataacccagtaccaggaggcttcaaatttacagcaacaaaagctccttggtcaaggccaacaatagctgccggtgttgatgggacgcatgtatctaatcagcaggcatcgggcaatgtactgccacatggagcacatcatagttttgatggtctcatggcgttcaaagaaaccaacgcgaagctgatcattggtgtttctgtgaagttattagatggtatggaactctatgcacttaggacgtatggtcgtatcatttcattagataagtttttcccatga

SEQ ID NO: 5742 - DNA, 1496 bp, Oryza sativa
  Predicted polypeptide sequence is orthologous to G728
acccaccaccaccaccgcctttctcctcctcctccgctccaatccgcgacccttcctccagttcttgttcttgttcttgttcttgttgcaaagattcgagagagagggagagagagttttgtttgttgttgttgttgtacatggggctggacgtgggggagatcgggatggggctggatttgagcctggacctgaagatgttcgcggcgaggagcgccgtgaggatggcggcggcggcggccaaggaggcgacgggggtggaggcgtgcatcaggagcctcgaggaggagcgccgcaagatcgagatgttcaggcgcgagctcccgctctgcgcccgcctcctcgccgacgtgatcgagctgatgaaggaggaggccgggaagaggaggaaggacggcgacgacgcggaggcgaaggcggaggacggcgacaagacgaaatggatgagcaccgcgcagctctgggtggacagccgcggcagcgacgccgattccgagaatgaccgacggagcgggagcacctcgccggcgtcgaggttgctcggcggcgcggaggagtcgtcgtcgagggccgtcgcgccgccgccgtactttaggagggaggaaagggtggttctacgacccgctatgccgttgctgcctccggcttcccacaggtcgcctcctccggcggcggcggcggctgccaccgccgccggcgatgaccaccggcacgttgtcgcgtcaagctttgccaccgccgtgccgtcacccgtcccggcggcgcttagcttgcaggctcaggcgcagcagcagcagcagcaggcgaggaagtcgaggcggtgctggtcgccggagcttcaccggcagttcgtcgccgccttgcagcagctcggtggcccccaagttgctactccaaagcaaatcagggaggtgatgaaggttgatgggctcaccaacgacgaagtgaaaagccatctccagaagtatcggctgcacaaccggaaatcaccaggcacagcttcagcgagccattcgattgtacttgttggtgatctctgggcttctcaggaagtaagctgctctcaatccggatcacctcaaggtccccttcagctctccggctcaggggtggccgtctcggcggccaccgccggcgacagctgctgcgaggatgatgacaagtcggaaggctatgtccgaaaatgatcgaaagatcgtgctcgtggaatcttgctagacagagaggtagattgatggattttcggcttgcgcatcgatgcaaaattgccaataatggattcagaaactctgaggaggatggtagtgttggccatgtatacagggaagattgagctgttgagagctcaagtgatgaactgatcatgagctgggttgttgtggatgtgtagatgaagagctgctaccacccatgaggcttgcaaagtgtcgggcagaccccaaattttcgccctgagatttacatacatattatacataaatatatacaagattcgc

SEQ ID NO: 5743 - DNA, 633 bp, Oryza sativa
  Predicted polypeptide sequence is orthologous to G729, G730, G1040
ttttttttttttttttttgtgccttcacacttcacagtcttattggcttcttatctagccaagctagtcatttcgggcaaatgacactatatactactaactgggtcaagctagctatagcacaccgaaatcaatcaacttagttatgcatgcttggacttcgcggttctgatgtatcattgtgaagccttcccaatcccaagtgtgaactcaaggttcggccgacctggtaacctcaacatagatgtctctaagtccacgctcagttttgtattcttgagatatcttctgtaaatttcattagctggttctctgatgggtaagcctaccttgcctgacgagttattgctccataaaccactgtaaatattggtgtcgttctgttcagatgctagcatacttttgttttgcctcagaggaccgtcagtaaaactgtcgtcggagatatctccagccgatgcattgtcaaacccatcgttattttgtcctgcatttgagaccggtctgtcggtatttttaattgtgcgatacatctgcaggtgagacttgacatgagccagcgttagatccttgacatccatcagctccagcactgacttgggcgttgctcccccttgtctcgtcgctcaccta

SEQ ID NO: 5744 - DNA, 1526 bp, Oryza sativa
  Predicted polypeptide sequence is orthologous to G729, G730, G1040
tcacaccagaaccaccactgctataactctcctcttcctcttccaccaccaccaacaccacaatatatggtcctctactatcataattctagaagtgtatgatcagtttgatccaagaagtggtagagagtagttggtgttgtattctcttccattgatcattgagctaagctatagctgtagcagcagcagcagcgacaacctcccatagctttgatcttgcaatgctgcaaaggaacctgccgaatctctccctccggataagccctccggccgtctcgtcggcggcggcgccggtatcctccggaacaccgacgacggcggcgaggacgactctgccgaccggagtgattacagacgcagaaggaggaggcgaagtagcagcgttctttggaaaccctagctccggcagcgagccccccggtctgagcctggggctcgggccgacgacgccggcgcacgcggacgccggcggcggccgccatggcgaccaccacctgcagccgcaggggtgcgcgccgttcaagcgcgcggcggccagggcgtcccagctgccggcgggctcgaagcggagcgtccgcgcgccgcggatgcgatggaccaccgcgctccacgcccgcttcgtgcacgccgtcgagctcctcggcggccacgagagagcgacgccgaagtcggtgctggagctgatgaacgtgaaggatctgacactggcgcatgtcaagagtcacctccagatgtataggacagtgaagagcacagacagatcatcccacattgcctcaggagaggcgcagctgcagcagcaggcaggaatggaggtggccatggaggcggcagctggaggaggaggaaatggtggtggtggtggtggtggggtggtgctaccgatgatgccggcatgtgacgacatggttgggatctgtagctcccctgcgccgcctgccgcagcgactagttccgctgctgcctacttcctctgcgcgacgacgacgtcaacagcaactgctccactggcagtagtgccatcgcctcctgctccaaccattcccacaaggaggactgaccaaacgccagcgctggaaaagggtgtcgcgattgttgactcgttgcaccggtgtcagaagcataactactcaccagtgcttcaagatgctcttcatcagggagctgaagaagatcatcttattaccgggaacctaccaatgggaggagcatcagcacaagcgagcattgaggccatggcgactaccaactcttcaagccctgcaagctcatctccatcacttgcaagcctggagcagctgctacctgaagactcgtttgcgcccaacctggagatctccctcgggagacataactggaacatggaccatcctgaagaactcagcctgaaatacctgtgaaaaaagccaaaaaaaaaaagaggtttttctctcctctgggtttcactccactaaccattgatgattgctcgatcagatcgttgtgatgatgactgaaaaatatattcagtaaccgcatccatc

SEQ ID NO: 5745 - DNA, 478 bp, Oryza sativa
  Predicted polypeptide sequence is orthologous to G729
tttttttttttttttggcattgacgtggcgcttacatgacaattcgatttgaaaaataatagtcatggacccacacgttagttacaaaaagatagtaatttaaaatggtggggccacatgtcattcttactcccctcctcatcttcctcagctcttccaatctcccctctcttcatcttgtcttgttcctgctcttcttgatgatggttgttatgcaggaattcagagacgaagaattagtgccctgcagctgctgattatgatgatgatgatgagcagttgtggatttaaggctggatatttgtagcaggagatatgcataggccgagagtgttcttaggataattgtatcatctcgatgtaattgactgagttaaataaaaacttccattatctaaaaaggatactctgctgctgctactaccgttgacggtaaaagagtaggcggctcgcagatgctgccgattggtggttgaat

SEQ ID NO: 5746 - DNA, 969 bp, Oryza sativa
  Predicted polypeptide sequence is orthologous to G729, G730, G1040
atggagctcttcccttcgcagccggatctttccctccagatcggcctccccaccggcgcagccgcggcggcgcatggccacggcctcaacgcgaggttctttgccgccgccgcgggagcgggtggccacaacccggcaatggcgtcgtcgccgccgtcgtcgctgcagcttccgcttcccatgccgctgcccatggctccagccggcgccggcggcctgcagttctaccccgacgccgccgccgccgccgccgccgccatgctgaggcccatacgcggcgtgccgctgtaccaccaccaccagcagcagcacgccgcggcggcgccgttcgtgggcgcggcgccgctgccgcaccacccgagctcaggcggcgcgtgctactgcgagccgtgccacgtcgccggcgcgtggcgcaggggtggctgcggcggcggcggcgcccgcggcgtgctcccggcgaagcgcgccccgcgcgcgccgcgcatgcgctggacgtccaccctccacgcccgcttcgtccacgccgtcgagctcctcggcggccatgacagggcaacgccaaagtcggttcttgagctgatggatgtgaaggacctcaccctggctcatgtcaagtctcacttgcagatgtacaggacagtgaagaataccgaaaggccggcagcttcgtcagatcaagctgatgggtttgagaatgggtcggccggcgagatctgcgacgagaactcgctcgacctgcacggcggatgcaggccggaggcgatgtcggcggcggcgcgacatggaagggaggactggtctggcttccatgagtccaacactggaaccatgcaaactctgaaggatatgcaatccaagagcctagagatcatatcagacatgaactcctgcgtttcggagacgacatcgagcaccagcgagctgaacctcgagttcacgctagggcgaccacaaaaccgaccaaactaa

SEQ ID NO: 5747 - DNA, 573 bp, Oryza sativa
  misc_feature (51)..(51): n is a, c, g, or t
  Predicted polypeptide sequence is orthologous to G729
tttttttttttttattttttttgcaaaaaatgtctcaaaatagtacttcangtatataaccatttacctgcatcaatagcacagtgctcacaaatagtacttatagtatataacctttacataattccacagccagtgcatatacttctatagtgtgaccagtagaagtttatatggtatgccaaccatagaggtttatatctcagttactcttaggacattgtctcataatagtactccagtccattcttatcggaatagtgctcgacgtccttgtcttaaggggtatcccctagagcatgtacatcatcctagcagatgggcactggcagggatttcccactgggcatgtccctacatactaagcataactgtccaaaaatactgcacaatctcgggttctaactaatatcccagtcattcgagggttatccctcgtaaagttggtttaaattgactttgaaatcttgatttcaccgaattttgtgaacaaaaagcccatactgttactggaacaacaatgaagtatttttggcactaatgtttggttcacatcatttgttgaggctaaac

SEQ ID NO: 5748 - DNA, 1278 bp, Oryza sativa
  Predicted polypeptide sequence is orthologous to G729, G730, G1040
atggcgtcggcgacgtcgacgacgcccgacctgtcgctgcacatcagcctgccgagcggtggcgcggcggtggggacgacggcgccgccggggctggggaacggcggtgcggttggtggtgccggcggcggcaaggcggcgggtggtggtgacccgtggcggaggctggatggctccacagcgtcgacggagctgtcgctgtcgacgccgcagcagcagcaggagggcagtacatcggcggccgatgtgctgccgtggcggctgcggcagccgacggcggcggcggcgtccgtgccggtgacactgccgacgataccgatggatggttcggcggcggcggcgcgcgcgccgatccgtggggtgcctgtgtatagcggcggcggcggcggtggccacccgttcctcggaggcggcggcggcgaccaccggcacaaccggctctacaacccctaccactccacggcatggccctcgtcgtcgctgtgctcgacgtcgccggcgccggctcctcctcccccaccagcagctctcgacccgacgacgtcgtcgctgctgtcgccgtccgcgtaccaccggatgctctccagcacggggcgcctccacggcgtgctcgccgacaccctccgcggctacgccggcgccgctgcggtggcgggctccatcggctacggctccgcggccgccgccgccgccgccatgggcggctacggcggcgccggcgccggcggcgggttcgcctcctcccgcttcatgccgcgcctcctcccggcgtcccgccgcagcatgcgcgccccgcggatgcggtggacgagctccctccacgcccgcttcgtccacgccgtcgagcttctcggcggccacgagcgagcgacgcccaaatcggtgctagagctgatggacgtcaaggatctgaccctagctcatgtgaagagccatctgcagatgtataggaccgtgaagagcactgacaagccagcagcagcctcagggccgatggacggcagcggctccggctccggctccggcgacgacgagctcctggccggcgatggaaggcaggcgacgtcatcgggcgccgatgcggaccggcggatgtcgttcaccgagcaccggtcctcctccgagggcgcggcgagccatgccggcggtggcggcgacggcgactgctcctcctctgccgtcaactccgacaccatcagagcgcgcagcaattcgccgagtacatcaatagaaacttgggattgtgtttggtgctgttcgttaaaagaaaagtcttag

SEQ ID NO: 5749 - DNA, 1095 bp, Oryza sativa
  Predicted polypeptide sequence is orthologous to G729, G730, G1040
atggagctgttcccggcacaccctgacctgcagctccagatcagccctcctcctgccaccaagtcaatggacttagggttttggaaacgagctcttgaaacctccacgaccaccaccacggcggcggcggcggcaagtacaggtccttccgtcgctacttcctcctcgccgccggtagcgagtggcggggttggcggcggtgccggcggcttctaccagcaggcggccgtcgcgcctgcagctaacggccacggccatggccatggccatcaccaccaccaccaccaacatcaccagctcggcggcgcactccagttcttgcaccgcacccagcccatcccgccgcaggacgcggccgccggcggcggcctgcaggacctggcgttcgcgcggcccatccggggaatccccgtgtacaacacctcgcggccgctgcccttcctccagagccaccacctccagcaccaccagcattgctacgccgacacgatcggcgtcgcgccgggggccgggccgaggtcccccagcaagcaggcggcggcgctgcggctcgccgcggcgcccgccaagcgtggcgcccgcgcgccgcggatgcggtggacgacgtcgctgcacgcgcggttcgtccatgccgtcgagcttctcggaggccacgagagagctacacccaagtcagttcttgagctaatggacgtgaaggacctgaccttagctcatgtcaagtctcacttgcagatgtaccggaccatcaagaccactgaccacaaacaacctgctccaccatatgggcaaactaagactatcatagagatcccagacgacaatctgtttgacatcaacaacactagtgggtcagagtcttctgttcagcaacaatccaattttgacggcaatgaacaaggatccagcatgtgtgctctacggagcaacaactcctcaagtagaggggcctggttccatgacaaatcaagagatgctacccatggagacatcaaatccttcgaggacgtgcagtcacagagccctgaagacgacgacgcctccgacctgaatcgccgccgttccaaataccggagacgactgtcagcgccatga

SEQ ID NO: 5750 - DNA, 762 bp, Oryza sativa
  Predicted polypeptide sequence is orthologous to G729, G730, G1040
cattttcttagctttggaagaagctgaaaaatcctttcagttttctcccaagaaacagcaatggcgactactgctgccaccgcgccggatctgtcactccacataagcccgccttcgccgccggacatggccgccggcggcgagacgatggagcagttggctgagccaaagctgtgcctagggtttggcacggcggcggcggcggcggcggagcagtacaacaatggcggctgcaacctccagcagcagcagcggctgcaccaacctagccagatccagagattcaagaagagcgccagcggcggcagccctgtgtgctccggcggcgccaccggcaccggcggcgttgcggcggcgagatccgggaatggcggtggaggtgggaagaggagctctagggcgccgaggatgcgatggacgacggctctccatgcgcactttgtgcaagccgtcgagcttcttggaggccatgaaagagcgacaccaaagtcagtattggagttgatgaacgtgaaagatctcacgctggctcatgtgaagagtcacctgcaggcaacttatttgcttgacctggtgcagatgtatagaacagtgaagggaaccacagacagaacatgtgctgaaggccatgggcagatgagagatatgggctttctgaggagaggaggtggtggagtggatggctttgacgtgcttggtaacacctcttcaattgcaatcgccaatattagggccttcaatctcaaggatgcaaatatataa

SEQ ID NO: 5751 - DNA, 847 bp, Oryza sativa
  Predicted polypeptide sequence is orthologous to G732
ggtgttaagaaattgttagtgaagtaattaatcaagtaattaagtctgcttaattaatcaactactacacaaagaaaaagatcgatggcgtctcccggcgttgtgtgtactactgtaacgccgacgtcgtcggccgggtcggaccaggtcgtggccggcggcggcgaggcggcgcggcggccggtggcgccggcggtgatggaggagcggaagcggaagcggaaggagtcgaacaggctgtccgcgcagcggtcgcgggcgcggaagcagcagcagctggacgagctggccgggcaggtggcggcgctgcgcgcccggaacggcgccctgggcctcgccgcgcgcgaggcggcgcgccggtgcgccgccgtgcgcgccgagaacgagctgctccgcgcgcgctccgtcgagctcgccgcgcgcctcgactccctcaccgacctggcgcagtgcctgcacgacgccgccgcggcctcctccttcgccgccgcgcccccgatgatgatggcgggcgccgccaccgccttccccaccggcgccgtcggcgccgccgccggcttcatgatgccccagctgccgccgccgctcctcgacgccaccaccatgggcatgcattgcaactactactactagtctactatagctatagctagcgtgtcaagtcttcattaagttagctctagtaagctctctctctctagtctctctacatgtgtccaaagtgtttgtgcctcttcttttgtgttgttattaggtgacctaatcaaagggcaagaaggacatttcatgtgtgtatgagactttattataaatgtgaaatggacatcaaggacaattttatgtggtt

SEQ ID NO: 5752 - DNA, 1407 bp, Oryza sativa
  Predicted polypeptide sequence is orthologous to G732
cacacaatcttgtgtatccgcaaaaccacaatcaacttcgcaaacctaagcaccactactactcttctgcttccccattcctccctccctttcgatctgttcgtcctcctagctctagctagcctctttggtcaggttatagattacatagcaccatgaattattctcctcccggttggctcgatcgattcagctagctgagcttctcgatcgatcaaccgatcttggttgcttcttcttcgatcctttcactccgtgtagttcttgatttgaaggatcgacgacgaactccctgtggcttcttgttcgccgggttcagccgcatccatgtcgatcacggaggctagcctccacttctgctacctccactcgctctccgtcgtgttcctctacttcttctacgtgatttcctgattcgcctcatccgcttcctctccaaacctgatcaaacaaagcttcgtgcacgatccatcttcgttgaaactaaggaccaaaaactgaagctttgtttgatccaaaaaaaatatatattctactaaatgtgttctagcttgttcctttcctagtatcgccttgttcctgcacgcgattgcccaacttggagcacgaaatatttctgcctagtacgtgttcgatcggtgttccacggtgagtgttagtttctctttgtgctctgtgatacattcaagatgtcagttgcgccggcgacggaagggtccgcacgccgctcggcggcggcggcggcggcggaggaggaggagcggcagcgcaaccggaagaggtcgaaccggctgtcggcgcagaggtcccgcataaagaagcagcagtacgtggacgggctggccgtggaggcggagcagctccggcgggagaacgacgccatgcgcgccggcgccggcgccgtgctgcagcggtgccgcctggtcgagcaggagaaccgggtgctcgccgcgcacgcgcgcgagctgtgcagcgcgctccagctccgcgcctcgcagctccgcctgctcggggaggtggcaggcgtgcccctcgacgtgcccgacgtcgccgaccacctcgtgcagctctacggcggcgacctggggatgacgccgctctcgccaccgccgctgctgccgccgctgccgccacagatcgagatgctgtacttccagccagactcggtcatggatccggtcagtatgctgcagggctacgaaaacatatgaaactctacattgtgtacttgacttatgattgttgccacatgcgtgtcttcggtttgtatggtgtgatctagctactgtacgttaatactgttgttgattttacgatccatattcctgttttgattgtgtagtaaaaagtatagcttgttgcgaggtacaagagtggagaaataaataaagtgtgtgaacattgtat

SEQ ID NO: 5753 - DNA, 2210 bp, Oryza sativa
  Predicted polypeptide sequence is orthologous to G732
ccctttttccccttctcccctccttcctcgctaaggttcccttgcttcagcagaacccctgctgggcatcctcctctttcaaaacatcctttgctctccaaccacttcatcttgatgttcttaatctcctatagtctttccctgtgcgaattttttctttgagaaccaaagtttcttagggaaattctgttgaatttttcctttgagaaccaaggtttctcggggagactctgctaaaatttttatcaactagcaagttgaaaatacatcattgtacatatattttgtctgcacatttatatacagtagcaaaacctgtttgtagagggaattattatagtgtttctggctggttgatccatgatagattaaacaaggggaggttgtgacttggtagatgtcaccaatcctctccgaggtcatcctctccggatttatgatcagctcgacgctccggcgaggctctcatcttgtcctctctttctccgtcgtcttcctttactggttctatgtcttctcagtaacatcctagctactgttctcttttatttgatctatccaataccagagaatagaccaccatattctacaaaatacttctcattggaaattatagcttatagacaaaactgagggtgacaatactgtaaggtattttcctgagtgttgcactaaggagggtactcaggacttttattaggatgaccctgtcaggtgggaccctgtcaagcgggataacctctggctcaagccatgggacccggagctcagggtcagagggtgatatccagctgcaggtccaaatggacctgaagcggaaaagaaggaaggaatcaaaccgagagtcggcaaagaggtctaggttacggaaacaacagcacctcgatgaccttacctcacaggtatgtttgaattccttttttttccctatctatatacatatatatataatatggttgcatttgttatgtagattttaatatgtttgtagttcctagctttaattagtttgctttatggattgaagcttgcactcatgtgcaggtgaatttgatacacaaaagcaaaatcagatgaaaaaggacacttgagctgaaggacttgctcaaggaaactccaataatgcacacggtgcccttttttcaaggggccccaactaattgcttcgtacataatacttgaaaaacattaaactcgctatcacttccaaagaaaaaggtgataggcaactagttaccaacaattgctcccaactgtcaaatctggaaataagagcaagctcatcgaaatttcttgatgccgatcaagaccggatcaagcttatgttttgctccggaaatgtgaaggcaaatttctatgaactgtcagatatcgcaagaaaccttcatccagaatttcattcatttttccagattaatcgtaccaacaatagtaggaaaagatttcagaatgttgcttgaacaaattagcaaaataatacataccagtgtaacataaataaatagcacaattcaccagatgcacatggtagatagtaattacttgcacaatctaaaatctgttctgttcatcacagcttccttcagcaaatccaaaaaaaaaatgtttatgttaaaaaggaatgttatcttgattatataaaataggtgaaccagttgaagatggagaaccagcagctcaccacaacattgaacatggtcacccaaagctgtgccttcgcagagtctcagaactcagtgctgcgcactcagatgatggagctggatagcaggctatcagcgctccgtgagataatcttctacatgaacaatggaaaccaatcaccttctaatcctacaatagcagcgactacatacccatccaccactacaatgactgcagcaactactggccattacgattattatgatgttttcactgcaaatgcatggggctcagggatgcaaatgatgcagcagcccatagatcagtttctgtaccagtgctagctagcttctagccaggaagtcgatagagatagtggaccaaattaagaaacagggcattgagatattgggcgtggtgaatgttgtagctaggtccatattaattatattgtgtcaccagtggttgtttatcttttgctttgatttgtgatcggttgtgggggcaggaaaaaaatggtgttgtacctttctgctgttggtggtaagaggccaaatggctattgg

SEQ ID NO: 5754 - DNA, 1647 bp, Oryza sativa
  Predicted polypeptide sequence is orthologous to G732
gcccttttcccctcttccccagctcctttgttaggttttcttccagtgagctctttttgctcatattcagatcttcacttatttcctagttgttactactgcctttgagtattgacagcttcatcctgccaactcagctcaatcttcctctgaagtttcagtctttgtttctgaatctcttcagtgttcagaggggaagttctgccaaaaaatttctctggccatccattttccaaggggagattctgccaaaattttcatctctgtccatcaatattcctggggaggttctgccaaaattttctctgaaatcggttaatttataaggggaggttctgccgaaattttcgctggtcatcaatcttccctttgttgacataccctgcataagtatatacaacaaacatataactttttgcaaggtaagaaggagtttttatctgttcttgatgatagactcctagagaagttgtcctagttgtgtagatgttgttgctcatcatccctgagcacctcctctctagatttatgactggcccagccataacccagcttgttcagtccttctctgttgtcttcctctactggttctatgtcttctcagtaagctccctgtttgtagccttttgaaattacaagacttatttatacaacataattatcaaggcatccacatataaactacaaggtatatatatatatatatatatatatttacaaaaagaaaaggaataagagggagtaaaattgttgccggtgcgaaaaaaaattgttgagaggtgaccatgtcgagtgggacctcgtccgggtcgagccagggaacccggagctccaggtcggaagatgacctgaacctccaggcccagatggagaagaagaggaagaggaggaaggagtcgaaccgagagtcggctcggaggtctaggatgaggaagcaacagcacctcgacgaactcacctcgcaggtgaaccagctgaagaatcagaaccagcagctgagcatggcactgagcctgaccacacagaaccttgtggcagtgcaggcacagaactcagtgctgcaaacccaggagttggagctgcagagcaggctgtgtgccctaactgacatcctgatgtgcatgaacaacaccagtgctactcctactcctacaattccagccaccactacaagtgcttgtgatatttttggtgccagctcatggaaccagccacccatagacttgtaccagtaccagtgcttctgatctaggaataagaagagggttgttgtggtagtgtgggtaggaccagaagccatcaagtaatgtttcaatcatgtagggccattgttgtcactgttaatgtatgcaattcaatcttaattgcctgctgtaggggacagggatatttgctctttcttgtagctgttggtggtagagggattaccagatggcaaaatggtgctttggcaatgtgttaggtggggctggttttggttgttaagggtagggaggagaaaattggtaggtttttcttgagcatgcaagaggggaggcaaaggattttgtgtaatgatgctcttcaaggaaagtattcataattatgattataatgtaatatgtggatttggtggatcttcataggccaagtgcttctttgtgctcc

SEQ ID NO: 5755 - DNA, 549 bp, Oryza sativa
  Predicted polypeptide sequence is orthologous to G732
atggcgtctcccggcgttgtgtgtactactgtaacgccgacgtcgtcggccgggtcggaccaggtcgtggccggcggcggcgaggcggcgcggcggccggtggcgccggcggtgatggaggagcggaagcggaagcggaaggagtcgaacaggctgtccgcgcagcggtcgcgggcgcggaagcagcagcagctggacgagctggccgggcaggtggcggcgctgcgcgcccggaacggcgccctgggcctcgccgcgcgcgaggcggcgcgccggtgcgccgccgtgcgcgccgagaacgagctgctccgcgcgcgctccgtcgagctcgccgcgcgcctcgactccctcaccgacctggcgcagtgcctgcacgacgccgccgcggcctcctccttcgccgccgcgcccccgatgatgatggcgggcgccgccaccgccttccccaccggcgccgtcggcgccgccgccggcttcatgatgccccagctgccgccgccgctcctcgacgccaccaccatgggcatgcattgcaactactactactag

SEQ ID NO: 5756 - DNA, 838 bp, Oryza sativa
  Predicted polypeptide sequence is orthologous to G735
gctgggtaccgggccccccctcgagtttttttttctttttttttagggccaagacaatttataactttatatgactcaatacaatgatactccctccgtttcacaatgtaagtcattctagacatatatatcacaatgtaagtcattctagcattaccaaaaaccttaatacgccagagcaccagaagctggttttagagcagtatcagtatacctgctgttactacttattatcacaggcagtagcttcaggcaatgacaaggctgatgctgcctcaaaatgtgtcacatctccagcatggattctcttctgcaggttctccaagcttgcgacacgccgcacggacggtgacctcaaggccattgctgcacttggcacaggaattgcttcatctgggaggctacagtttgtccagtcgtcttcgacgagagcagcagcagcagcagcagaagctgcgtctgatacacctgaagaaacgggcatgctgcttgcaggcatttcagatgtagtgaacaattgaagtcctattccagttactctcctcaccgcttcttcagctatattcacctgaacacaaagcacttcgttacaacgtaaacgatatgaaaccataagattattagcaaccacaagctacattaatataaattattttgagaagaacaatagtataaatcagtgtctcagttgtagctccacaacagatctattacagtaaacattttacagaatttaagttaaacccgagctgatgtttttgggaaaacaaattcaactttatatataaagggacagaacaataggttcttatgtatacatgttccttttgatatctct

SEQ ID NO: 5757 - DNA, 528 bp, Oryza sativa
  Predicted polypeptide sequence is orthologous to G736, G2432
atggcgaacctcccctccaccgccgccgccgccgccgcagacgcctccgggttcaagctcttcgggaaggtgatccagcccgacggacagcggggcgtggaagagagcgcggcggcgcaggcgccacctcatccgcatccgcctgcgccgccggtgatggaggcggcggcggcggcggcggggacgtcgcagactctgcaggcggcgggcggtggcggtggcggaggagggggaggagggggagagccgctgccgtgcccgcggtgcgggagcagggagaccaagttctgctacttcaacaactacaacgtgcggcagccgcgccacctctgccgctcctgccgccgctactggacggccggcggcgcgctccgccgcgtcgcctcggcgtccccgggaaggcgcaggccccgccccagcgccgcccgatcggccgccgccgccgccgcctccgcctccgcggcgtctccccccgccgccgtccccgccgcctccgagggggcggagagcgttgactcgcggtcgtag

SEQ ID NO: 5758 - DNA, 1250 bp, Oryza sativa
  Predicted polypeptide sequence is orthologous to G740
gatcgggcacacgcgtagcgagacgaggggaaaaaaaaatcaatcaaaccctaatcagatcagggagaggcgagggctagggtttcgactcctcggcgggcgatccatggcggcggcggcgaggcatcgggggacggtgaagtggttcaacgacaccaaggggttcggcttcatctcccccgacgacggcagcgaggatctcttcgtccaccagtcctccatcaaggccgacggcttccgctccctcgccgagggcgagcaggtcgagttcgccatctccgagagcgaggacggccgcaccaagtccgtcgacgtcaccggccccgacggatccttcgtcaagggcggcgccggcggcggcggcggtggcgggggaggcttcggatcgcgcggtgggggcggatctggcggtggcggccgcagctatggcggtagctggggcggggggaggagatccggcggtggtggacccggtgggggctgcttcaagtgtggggagtctggccacatggccagggactgcttcaacggcggcggtgtcggcgttggtggaggcggtggcggcggcggcggcgctggtggtggctgcttcaagtgcggcgagatgggccacatggctagggactgcttcaacagcggtggtggtggaggtggtggtggtggcggcggcggcggcggcgcctgctacaactgcggcgagaccggccacctcgcgagggactgctacaacggcggcggtggaggcggaggcgggcgattcggcggtggaggcgaccgctcctgctacaactgcggcgaggctggacacatcgcccgcgactgccacaagtgatggattcacaacaccatctcccccccccctcctcttagatctcgcctaaatcttcatcactcctaagtcgaattattgctttagttttgccgccgatctgggtcacatggagagcgcgttgcctgctataaaggaaccgcttgccttttgtttttacctctttttctttttttgctattgggatttcggtttagttttaacttctgctgctgctgctcgtgtgatgatgcttttgctgctatgagttggtctggtcctctggttcaggttaagaagacgtgatgtctggattggttttgtgtgttgggcgaggagattgacaaaatctctctcctttttgtggtttccccgagatgaaaaagatgattattgtcggttactctataatttttaccaccttgtcgattccatcatcagc

SEQ ID NO: 5759 - DNA, 531 bp, Oryza sativa
  Predicted polypeptide sequence is orthologous to G740
atgacaatgacgacaaggagggaggcgggtacggcagcgggttggcgagcatacgcaaagagggagaagggcgggggacggtggccagcccttctcgccgtcacttgtggcggccgcggcgagacctgcaagtgttgggcgggctgcctcgagtaccctgaactgcccgagtcgagcggctggccaacggagcggggcggcgggcggcttctagggttcggcggcgagggcgagatggtgtcggagagggtgaaagggatggtgaaagggttcgatgccactaatgggttcagcttcatcactcccgacgatggcagcgaggatctcttcatccaccagtcctccctcaagttcgatggctatcggagcctcaacgacgacgatgtcatcgagttatctgttggatccagcgacgacggccgcactaaggccgtggacgtcacggcgccaggcagtgacgcgcacaccggcggatcccgtcccagctgcggccatatccctacggctggtcgtcccctagtcgtctcctag

SEQ ID NO: 5760 - DNA, 1056 bp, Oryza sativa
  Predicted polypeptide sequence is orthologous to G740
atggcccagcaaccgcgcgctctgtgtgcggtccgtcggcgaggaggtcgaggacgaacacttccgcaccatatcttccccccgccgacgtgtcacgtgcctcgccagcagcgcccaatcaacttgcgcgaggggaacagcaaagacgtcgggtcgcggcaggctacgggctacggccaccgggaggaacttcggcagagggcccttccagacttcccgtaccgggcggcgtcgagggcaccgaccgcaggaggagctagcgcgagcccgggcgaagacatgcggcaggcaacgagatgttcggcgtcggcgaacgacctgagcccaaacgacgaggagcgcctcgccaccatcttccgcgcggacgtgcctctccttcgcatcaggggaggcacgcccatctggacaaactgcggcggagatccccccatccactcgccgtcgacgtcgagggcaacgacgcgcgcggaccgcggacgcggcttgtggcgactggcgagcgaacagccgcccaccgccgccggagacgatgtgctcgtagaaaggtggcaatggcgcgtgcgctgcgtcctgtgtcgcggggagcacgatgcagctctcgccctcggccggcagcgaacggagttggaggaagaagggtgccgtgcagatccctcgcttgcgggcgagcacgtgaagagagggagaaggatggcggctagcccttctcgccgtcgcttgtggcagctgcggtgggacctacaagcactgggcaggccgcctcaaggagatgtaggaatcgaggtcgccgcaagcaaaggggagcgagaagggcgaatagggcagcgggcagcggaggacctcttcgtcaaccagtactccctcatgtccgacggctaccggagcctcaacgacaacaacatgtcgagttatctgtcggatccggcaacgacggccgcaccaaggccgtggaagtcaccgagccaggcggcggcgcgctcaccggcgaatcccgtcccagcggcaatggggattgcagctaggttgggggtgaccacggctacggaggcagcatag

SEQ ID NO: 5761 - DNA, 606 bp, Oryza sativa
  Predicted polypeptide sequence is orthologous to G740
atggaagctggcctggatgtggatttggcggcggagggaggtcgccggagagaggccgtcgtccccgctcccctgtcgctgaagccagaggaaactggagcgagtcgccggagggagtcgtcgctcgcgcacacggttgacggatgggtagccgataagcgcacacagagagggagaagggcggcgaccagcggggcgaagggcagggggcggcggccagcccttcccgacgtcgcttgtggcggccgtgacaagacctgcaaagcactgggcgggccgcctcgaggagatgtaggagtcgaggtcgccctagttcaacggctactagagctcaactacagcaatgagttatccatcggatccggcaatgacggccacaccaaggtcgtggacgtcaccacgccaggtggcggcacgctcaccggcagatcacatcccagcggcggcggggacggaggttacggcgagggcgaccacggctatggaggcatcagcaagaacaatagcggaggaagcggttgtgcgtgctccaagtgcggtgagaagggccacatggccacgaacatctcccagggcggcggcacacaggaggagtacaacgggtga

SEQ ID NO: 5762 - DNA, 447 bp, Oryza sativa
  Predicted polypeptide sequence is orthologous to G740
gtttgaagtatcctttttcggtgtctcaatacctacctattcatatttttgttctacaaaatccacttattggatcatcgttattttttacttttccgttttcttactctacttacccatcaagctccctccgagtccataaagacctatcttcaaaatgtcttccctctctcgacgtgcttgctacaagtgtggcaatgttggccactacgctgaggtctgctcttctgccgagcgtctctgctacaactgcaagcagcccggccacgagtccaacggatgccctcttccccgaaccactgaggccaagcagtgctaccactgccagggtcttggccacgtccaggctgactgccctaccctccgcctgagcggcactggcaccagcggccgctgctacaactgtggccagcccggccaccttgctcgcgcctgccccaaccctgt

SEQ ID NO: 5763 - DNA, 1891 bp, Oryza sativa
  Predicted polypeptide sequence is orthologous to G744
ttggcgaaacaacagcgaaaagaaaagcaaagcttggagagagcttcacttcacgtcttcaccttcctctgctcccggagagcctctccctctcctctcctctcgcctcggcctcctctctctctctctctctctctctctctctctctctctctctctctctctcatcaccgcctccccacgccaacccgcgcgacgcacgcggcataccaagaaaccgcgcggcgcgcgcttcccgggggggcgcctgccttcgatggaggtcgcggccgcggaggacgcgctggaggagagcggcgtggcggtgtacctccccaggcttctcgccggcgtcatctccggcgctctcaccggcctcttcgctctcgctggggccttgaccggagcggtgaccggcgcgctggccggaagggcttcagacagcggcgtgctccggggagctggattgggggcgttcgccggagctgtgctctccattgaggtcctcgaggcttctcgtgcttattggtgctcggaccggctgggctctcatggcacatcctccatggcagatttcatagagcagctcctccaagcgcggtttgtgcaagagcaaattgtaccttcaggatatgcaacgcatcgttggcaggtcagcatttcagattttggtcatgatgatctgtatgatatttttggagattgttcatccaaagggctttcacgggagtcactgaataaattaccacactatgtggtcactgaccaaacacggaactcgtttggtgaagacctctcttgcactatctgcctgcaggtacatttatcaaaattagctttatgttgtcgacaaacctgcctggctgccttgcacaattttgcacatggtttaggttcaacaacgataataaaagcaaaacaacatccatttcatgattgcagacaatatagtgaatgtttagttagcatatttgagctttctcctttttggcaaagtttgttaagaaaatcaagatcaccagtgatttgaaaattggtgatagcataccactacaagtctccatctggttgttagtgatggctgatcacatatagtagtaactgttctaaacataattgccaagggggtaaatgggaagacatcttcaaattattcatgaaattcttttgaccttcttcatagaacgttttaaacctaactcgtcctgaccattgaatacggtctattacttgatcaatgatttccaaccagaaaccaaagcttttcccgaccttgttgaaccaggaaatgcggcccattttttagattgataaatgaaacattcaagtacatatatatagctggatagtagatatgacatgattgttatggtgtgatatgtagagcagggagatgcaacgacctccgtttttatgttccccttttgtggcaacttgcataccaaattatgcctgctactaaatgcaatgtggttaggatttgctttgcaacttgctcactccctacacacactcaatgtcactgcttaattaccgctttgcaggatattgtaaccggtgaaacggcgaggagattgccgaattgctcccacactttccaccagccttgcgtggacaaatggctcgttggccatgggtcttgccctgtatgtaggcaatgtgtgtaacaacagaaggtaaaaaaaaccctgcattctgcaggctctccatcttattagaagagactagttgtgcaaatgtttgctcttgatagcacccaccacagagttaattatacacagtagctttgtaatttactgtactactagataggcgtatcttttaccagcgtaaacagaggctgtaaatcagaggatttgacactgtttcttacgctgagtttcaatgtaaaatggaataaaggtttctctgt

SEQ ID NO: 5764 - DNA, 1174 bp, Oryza sativa
  Predicted polypeptide sequence is orthologous to G748, G1900
tttttttttttttttttttttttttataaatgtctcctttatttattattgatattaccatccagtatgcatgtatacactccccaatttatccatgcaagttctataacaaaacacacactgacacacatgtaaggtgtatagatagtctacagcttgcaagaacatgagttatatgtgttccgatgtatctatgtcctttttcttccatcggtcggccggcttgctaggcgagttcggcaaggtcatcatgcagtgcggcgtttccgaggggacacaggacaaggcgcagggcttcgtcgtggcccgggagaaggttgaaccggaggaggaggaggaggaggagcagcgtgtcccggctgctgctacgtcggggcagcgcgcgtcgatcaagcgggaggccgcggaccgcgacgaggagcaacggcaagggggcggggacgcggcggggcagccgacgcagcggcggttgcaggactcggccgaggcgcgtgcggccgccgcggcgccgctgccgtgcccgcggtgccggagccgtgacaccaagttctgctacttcaacaactacaacgtcaaccagccgcgccacttctgcaaggcctgccaccgctactggacggccggcggcgcgtccgcaacgtccccgtcggcgccggccgccgcaagaaccgtcccctgggccccctcgcggtcgcccaccataaccaccaccaccgcgcggccgccggcttcgtcctcggcttccccaacccgtcctccccaacctccccgtcgccggtctacaccgaccggtggccggtcaccccggaccgcccgttttgatcccgccatgcatccagtcgaaccaaccggcttggatatagcttccctttgacttgctgcagctgggttgcggaggctagcttggcttgcttgtacgtgaggcttacacaaacacatggtagatggagatatcgaatgggcttttctttcttttttttcttttctcctcttgctagtaccaccatcatagcatgcagcttctctctccttactactactatcctgctagtagtttgtttcttcctctttctccttttgttgttttctaaggttgcgggtgtaatgtaagaatggaagtgatgaggttgcggaggcaagttgcgaactccgtgcaaaaaaaaaaaaaaaaaaa

SEQ ID NO: 5765 - DNA, 1170 bp, Oryza sativa
  Predicted polypeptide sequence is orthologous to G748
atggagaacggcgactccagatttgttagggatttggtgtcgccgatgcctggaccgccgctactgccgacgcaacaagcgctgagggcactgtcatctttgcagattatccaggggcttagagtggcatcgccagagcggttgccacaaccatcaagcggccagcgtcgtatcttgccgatggccccacaggcacgacggtggcgtgctgatggcagcacaactatgtctgtggcatcgttgccgctaaaccaggtccgtgctattgggttgtttctcaataccttcttggtggccacaatgaggcgccaggaggggcccctttaccacaatgctattgtaatccctacgatagcaccggcaccggcgccggcaccgccgaccacccagatgctcgccatggagaacactatgccagctaccgtggaaccggttaccaaccacaggatcatcaaccatgatatcatgcatttcatgagggaaactccagatatccagaggctccacggcgttgtttcacctgtggcggtccatggtaacgggaatcccctttcatgcatctattgtgggctggtgtttgccctcaggtcatcggaaatcccggggttcctccctcctcctggatttagctacccagaacccatgggaccaccaccattactgtcattgtttccaccagcaagagatgcttctcggatagcagcggtgtgctcagacccacatcattttgctgtcaccatgcaatatatgcccaagcaggaaatggctgatctcatttggtcatccgagataccaagcatccacattccgtcagctgcaggtggccagcatgttggaacggtgccgtctctgaccggtatcactagtgccaccacatcaatggtgaacctcatgcagatgccggctatccacatggagcagcacatgctacatccaaccatgttaaactcatctgcttctccggaatgtatcactagcactgccgtaccatcaacgctgaacatgatgccaatgcgggatatcctcatagatcagctttcactgcctcctgccatatctagctcatctgcttctggtgttctctgtgagtacgtgatgcctgagcacgaggacatggtccgcctcaccttgggtcagtcatccaccatggacctagatcttagcttctag

SEQ ID NO: 5766 - DNA, 2525 bp, Oryza sativa
  Predicted polypeptide sequence is orthologous to G760
gctattattattttctttctcatcacgcggctgcgtccgtatcgcgacttttatcctctcctccccaactaactcggcgttcgccatctcgtgtcgacttcctcctcaaaaccctaattccatccaccgctcgatccaatctaccctctctctcgattctcaattctcaattctccctgcaaaattcccaatcctccgtgcagaattagaattatgcgggattgatcccctcccacgggatctccaatatcatatccatccagaaattgaaattcccctcgccgccgatgagccaatcgccgccggactcctcctccgcggcggcggtgcccctggcgccggggtttcgcttccaccccaccgacgaggagctcgtctcctactacctccgccgccgcatcctcggccgccgcctccggatcgacgccatcgccgaggtcgacctctaccgcctcgagccgtgggacctcccctccctctcccgcatccggagccgcgacgcgcagtggtacttcttcgcccgcctcgaccgcaaggtcaccggcgccggggccggcggccgcggcggccccgggaacaggaccaaccgcgccacgccgcgcggctactggaagaccaccgggaaggaccgcgatgtccaccaccgcggcaagctcgtcgggatgaagaagacgctcgtcttccactccggtagggcgcccaagggccagaggaccaactgggtcatgcacgagtaccgcctcctcgacgccgacggcacccaggatctgcatgtggtgtgtagaatcttccagaaaaatggatctgggccacaaaatggtgcacagtacggtgcgccatacttggaggaagattgggaagaggaggatgatgcaattgagaacatgcctgccagtggcgctttcgctgaaatggctgcagtcacagatactgcagatgagtcgactgaggaagatgggaatttctcccttaaaactaatgatgagcctttacaaacccaagaataccagccagagataactcctgtgaaagctcaaggttcaaatgaggagaccaatggcggtggttacagttgtgatgttttttctctggatgagattttgcaggaacctgaaaatgtctgcaaaaatgaagagcagaatgccattgatgacaagttcactatcgcagagttatctggatacccaaggcaagatgatggctatgtaggcgagaatggtcctgtgaattggattgacccttcaaatggtgataatacaaactggcctttgagagcatatagtactcagaaccatgtcaatggaacacttagcgctgatggtttctttgacacggtgaatggtaccaactcatattcaggtccttcagataaccagaacctgtatttgcaagatgatggcttgacttcttctcatcaagtgggcgataacatgccattttatgacgcatcatctaatcacaaatgggtagatggaaaggatgattatttgaatttgaatgacctcctctacccgccagcagaaaatcaacccctgtttgatgctggggatgacctgatggcttacttcgatgccacggaggatgatttcaaatttgatattatgggcacagaagattctaattctcaacttccagacatgtcgaactttgtccaaaaggatgataacaacaataagtttacattagatgggatctctaataccgctttgtatggtgcttcttcatctggatcccatggcaatatgtatccagacactgcagtaccagatatgccgatggatgacactgttgacaaaagtttcggaaagcgccttgccagcatgctgggttcaattccagctccacccgcaatggcttcagagttcccgccgagcacaggaaaatctgttgtcccacttagtgctgtcaacccgagtagctctatccgtgtcactgcaggcattatccaactcggtggtatcacttttactggtagcaccgagcacctgcagaagaatggagatttcaatttgctcctctctttcactgtcgagggcgacgtctcaaccaaatccattggttttgaaccggatacgcagatgagcaccacgccaatggtgttgcgcagcggcatgtatcttttcttcgtatcggcgatgattctcatgttgagctacaaagttgggctgtgtatctacagcaggtaagttatagtagtttttgttgccccaggctgtttattaaattgaaggagtcatacagagtccactcgacgtagagggaactgcctgcgatttggacagtttggttctttacattgttatagttggtataccgttctgacagttgaaagatacatagcaataaactctggaattggagaaactagagttacacgaatttggtgctgaaacttttgttggtggcatgtactgtataatttactctatttatttatttcacccaattctgggaggctgtaagcgttccccgatcgatgtaagctgatctgaaacctgaatacgcgctcttcatttttcataccc

SEQ ID NO: 5767 - DNA, 1857 bp, Oryza sativa
  Predicted polypeptide sequence is orthologous to G760
gacccgctcgcgcaattcgcacgctctcctcgcctcgcctcgccttctcttctctcctcacctcgcccgcgtcgtcgtcgtcgtcgtctccgcggcggcgggggaagcagcgggaggcggaggcggagcagcagcagcaccaccaccccggggcggggccgcggcgcggtgctcgcgcgcgtcgactccgtgtggacaatcatgtcttctaaagttcctgggttagcattacttaacaccagcataagcaaattttggagcgatgaggagcttgtccgattcttagcagagaggaaagaagcacactctctgccagagaatgtatttgtgggaatgaacatttctctcattgatccacgtaactcagaggacatatggtacatgaatttttcagatgatccacaatcccctaagaatggagaaaatgctattataaagtcaaaaaccggatactggaaagttgttggcactgttagaataccgacaagtactgttattgtgggtatgaaagtttctctggaccattatgaaggcgaagcaccatctggtaagagaactgggtgggtgatggatgaatatctgattgaacagaatgacgaagctaatctaccacaggactacaagaatttgtgtacaatattctttcagggagacgacatattaaatgctggagataagcagatatgtctgaatgcaaatgttcctaatgaacgcaaggaattttaccttcaatatcttgctgaactagaagagcaaaatgctgcatggagcaaccaggctgtatctgtaaacgagcaagatgtctcttccagcaaaggactggacgggcaaaaaactagtgctgctgatgaccaatctgttaatcatgccccttctagggagggctacatagaattgaatgacttcttaaactcagattcgtccgcatcaacttcggaatactcaagtcaacgcactatgatttctgaagagtacttcgattctgatgcatttctgagggagattaggaatgaccataacgcagctgatgaagaacatacagacagcaagttcagcgtagctgcagctagtaaatcagattgcgtggttatcagtccacctgaacaagggtttgttaacaatctcgataaccatgccaccatagctggagattcaccgcaaaagtcagtgaaaaatgataaagtagacgaacactcaagtgaggagcatccacagcacagtcctacaacttcctgtttcccaagtcatgtgaaacgaagcctttctagtagttccagtagctctcagggtaccagcaacagcaagtctccccagagacagagagagcgatctaccaaaaaaattggaaaattaggaaagtactggtgttgtggatcattatagtccattgcatagcatttctatactctgtacaggaagcatgacattacgccatgctattttgatacggactggtcgcctcaacagatttatgccagatcttctgatagaacatagtcaaagaagactgcaagttttgaagcaacaatgaccaacaatactacaaactgtggaaagttacatttttgttttgttcatagtgtgaagatatcatgaccttgatgattctgtcaaactgaagtgagctaccttgattccattcttgattgatagggtcagatattcactgatacctgtgttagttcagtgaaatgaggatggcagtagtttctgattatcaccaggtgctctcatttgtaaacatctacagtacagtttcatatgatagaatttcacattttagtaagtactaatactgattgctcaatacttagttatcctgcttgcatttgaaggagtataagcttttgatttacg

SEQ ID NO: 5768 - DNA, 298 bp, Oryza sativa
  Predicted polypeptide sequence is orthologous to G760
ttttttttttttttttttttttttttttttttttttagaaacaatttaacaacccaagggtgcaaccctcccccttaattttaaaaacaaaactcaacgggcccaaccaaaaaatttttacagtaatcagcaagcccttaacaggaaccctttacccaaaaaaaaaaaattcgaaatcgacgggggaacttcccccggtgccatggactcccttcaacaaaaaccaaaaaaaaattccccaaccccttctacccttaagcccctaaaaactggggaacttggggacggccttggggcc

SEQ ID NO: 5769 - DNA, 2626 bp, Oryza sativa
  Predicted polypeptide sequence is orthologous to G760
ggctgcgtttcgtttcttccccaaaaaccaagggggaaggcaaactttccccaaatctcaaccccaatcccaatctagggcacatgagccacccctcgtcgtcgtcctcctccgctcccccggcggcggccgaggccacctccctcgcaccgggattccggttccacccgacggatgaggagctggtgtcctactacctgaagcggaaggtccatgggcggccgctcaaggtggacgccatcgcggaggtggacctgtacaaggtggagccatgggacctccccgcccgctcccgcctccgcagccgcgactcccagtggtacttcttcagccgcctcgaccgcaagcacgccaaccgcgcccgcaccaaccgcgccaccgccggcggctactggaagaccaccggcaaggacagggaggtccgcaacggccccaccaccgtcggcatgaagaagaccctcgtcttccacgccggccgcgcccccaagggcgagcgcaccaactgggtcatgcacgagtaccgcctcgacggccaaaccaccatcccaccacaggattcattcgtcgtgtgccgtatcttccagaaagccggcccaggtccacagaacggggctcagtacggagctccttttgttgaggaggagtgggaggaggatgacgaggatgttggtttgctaccggtggaggagaaggacaactctgatgaccaggaaaaggaaatttctggtgctatggagaagggctatctccagatgagtgacctcgttcagaacttggttgatcaaaatgagaatggtaccattgccttgccagtttctgacaattcaaacaacagcaaccattctgaagacgtggatggaaattcaggggacattttaagtgaccaaaaccttgggtctaactttcttcaccatgttgagcctgtggagcaaaatggcctagtgcttaatgaaaatatgttttctagtgccaatgctggagacctttttaatatatctagccccaatgatggattcctagaactgaaggattttgcagatattgcagatttggagaatcctttagccaatgaatccaccatctggccttctgatggttggccctggaaatcaactgattccatggaggctgtgaatggggctagcaatgaattttctcccttagctggtgaacagatattccagccagaagaattggaacagttgttacagtcactgcaagaagactctcatatgggttcaactatctctgatcccccacattcatctataacaaatttagctaagccagaggaagattgtctaatgttctatgatgcaccctttgattcttcaatgtgtgatgatggttttagacagctcaatggatttcttggctccccatcgaccaatctatctggtattgacatggtggacgatggtatgccgtactatgatgcgatggatgataacttgtttaatgatcttctgagctcagtacagccatcagctggtagcagttcccatgcttttagtgggccagtccttactcaagaggtcaacaattcaacctatacatatagtccaactcaaaaggttttagaacctaattttgtagttggtgccccatcatctgctaggttacctgaagcgggtagtcagttaaattatgttgttttaccagattcccagaccaagagtagtctgatcgggaagcgttttgtaaagatactggattcaatctctgctccccctgcttttgcagcagcagagttcccagctagccttcgcaaatccttggctcctatttctggagctcatcacaacactatccgtgtctctgctgaagtaatcagcataggaagtttaactcctgattctcaagataagtggtcccttgagaaggatgaaggcatggagctgctcttctcggcaggttttgagcctgatacccgtgtacactttggctgcaacacaataaccgcagtactgcgtggtggcttctgcctcttcttcttttcagcaataatgctcttggtgagctacgaggtgggcatgtgcatctatggcaagtaggcctgctggtattggagacgttaagaacatgacgttaggtaatcctatctgtatttgaggcaaactagggacctcctgctgctggcttaatgtattgcactgcatgacattacatgacctccatgtgttgaacaagggctgaggctgtttaactatagcactagcagtaccgttttgcagctcgagagagctagtagtgtatgtatgaattcctcaggtgctattcgtagtagtaagcgcgaattgattattatcagttcatgatggtgctactattcatattcatgtttctggttggcatgggcggtgctagtgcaaactgcagagtgctgtaaatattccccaaatctgcaatgaattgaacgagggtgcatttgcccttatgactgttgcggtgttgcaggtttttgaatgagaaggaaagattactatgtagaaaacgctgtgttgtatttgtcggtcgcaggcatctggtggtaaattctgttactgaagaaagtccttgtcgctatatatttgtgtgtttacttatgctcttgcctggaataaaactcgaggatcttttcctttgc

SEQ ID NO: 5770 - DNA, 765 bp, Oryza sativa
  Predicted polypeptide sequence is orthologous to G773, G1412
cattccaaaactttcgaaagcttccattagcgactaatccagccttcgttaagggtgattagaatttgattaatttcaaggcctcagatcggagattgaatggagtgcggtggtgcgctgcagctgccgccggggttcaggttccacccgacggacgacgagctggtgatgtactacctgtgccgcaagtgcggcggcctccccctcgccgccccggtgatcgccgaggtggacctctacaagttcaacccatgggatctccccggtaagcaagagtaaaagcagatcgaatcgaatcgaggaaattgaagtcgaattcaaattcaattaattggggatttggaattgttgcagagagggcgatgggaggggagaaggagtggtacttcttctcgccgcgggaccggaagtacccgaacgggcagcggccgaacagggcggcggggacggggtactggaaggcgacgggggcggacaagccggtgggtcgccgcgggcggtggcgatcaagaaggcgctcgtcttctacgccgggaagccgcccaagggcgtcaagaccaactggatcatgcacgagtaccgcctcgccgacgtcgaccgctccgccgccgcccgcaagctctccaagtcctcccacaacgccctcagggttagtatttacttcttttaattacttacttctcctaatctaatcatctcttgctttcaatcatttctcctcaccaacgaatttacccccattttattttttaaaattctacaagg

SEQ ID NO: 5771 - DNA, 951 bp, Oryza sativa
  Predicted polypeptide sequence is orthologous to G773, G1412
atggccgacgacgacgagatcgctcttgagccaggctacgtcttccacccttccgacgacggcctcatcaccctcttcctccgccccagcatcgccaagatccccttcgaggaccgcctcatcaaccacgccgacgtctactccgccaatccggccgagctcgtcggcgagcacagaccggcgccgggcacccatgggagcagcagcgtctggtacttcttctgctccccgcgcttcaccagcaagcgcaagacctccgggaggcggcagcgcgcggtcggcggcggcggcggcggcgagagcgtgtggaagtcggagggcggcaagaaggccgtgatcggcgccgatggccgccgcgtcgggtacctccagaagttctcctatggcgtctacgagtcgtcgtcgtcggggtcggcgcgcacgttcacgaggctagggtggtgcatgacggagtacggcctcgacgacgacgccatcgacggagcagacaagcaggtgctctgcaaggtctaccgctcgccgcgcgcggtctgcgcggaggcgcgcacggcggcggcggcgaagtcggccgattcgccatgctccggctcgaagaggaaggcggacgacggcgcggatcacccggaggcgccgcccagcgcgcggccgcggcaagaggaggccgggagcgagcagccggcgatcctgccggagttggacctggatgcgttgctgtcggcgccgatggacgacagtttgggagtggaattcgacacggccacgacggagcagtacatgaggtatctgatgaacgacgagccattgccgtgggctccgacgatggaggttgccggcggcggagacgaattcatcgagacgacgaacggaccttgcatgggcgaagaggagatcatccagcggctggcttccggagaaaccctcgacgacattcttggctcgaaccctaattaa

SEQ ID NO: 5772 - DNA, 951 bp, Oryza sativa; identical to SEQ ID NO: 5771
  Predicted polypeptide sequence is orthologous to G773, G1412

SEQ ID NO: 5773 - DNA, 1548 bp, Oryza sativa
  Predicted polypeptide sequence is orthologous to G773, G1412
atggcttacgccgttgtccgcaacccgatgcccgatggcggcgagttcattcctcgtcacaccacgcgcgagcagccggcggatggggacggcggcggcagcggtggaagcaacaacaacaatgggaagttgaaggggaaggagaaggtggtgccggagtacggcaagaaccggcacggcatgcctgtcggtttctacttcgtccccatggacctagagcttttcgccatcctcatgtgcaagctcgtccgaggtgaggtccccggcgccctcaataacgtctttgagcatatcaggatacttgaattccaccccgccctcctccgtgagacgtatatcgagaacatggaggacagatgcatctacttctttagcaggaggctattcgcagcgaaggctaggaacaagaggcagccgatgagggtggcaaacggtgggacgtggaaggcatctggtgggagcaagacggtgaggagcaagaaggttggcggcatcgatgttggtcagaagctcaccatggtgttctacgagcgtaggttcgagggcgaccaaaaccctgtcaagaccaactgggccatgcacgagtacaccaagatcattcctagctccaaaaaccagaaggaaggaggacacagagccggtgaacgctgccgccgcggcgtcgagcacggacaagccctccacgccggaggcactgccaccgcctacgccaccgccacggccattgctgaacatggccggatcatcgtcggcaacgtcgctactgccaccgcaattgccaggcctggctgggtcgtcgtcgacgatgccgctggcactgccactgcagctgcctggcctgcccgggtcgtcggcggcgatgtcgctctgccgggcttggctggagagatgacgtccatggcggaccaggcgaacatggcctcgacgtcacaggcgtcagcaccgtcgtcggagctcccgcaggactggtacgacgagtacgaggtcgcgtacggtgccgcggcgccgccgtctcctagcacgatcagctgcgcggcgctgccgagctcgccgacggcgtggtggccgtcatcgatcggcgggccggtgcagcacgacggctacctcgggatggcggatcctgcgtcgtgtaatacgttggaacacctgttgcccagcgcggcgatcccaccagagccaatggcgccgccgaagaactcgccggcggcgccaccaccggccgacgccggcggcaactacgaccacccggagctcgccgactacggcggcggcgtccaggcgcagcacgagcatcatcagccgcaggagctgacggatggcgcggacggcgacgcacagctagagctaggcgccgcggagtttgattccgaacgagtagccgaaatgatatcccaaataatggatggtgaattcgtgtttaaatttgaggacgacaccattgttagcttcaacgaggtggcggcggcgccgatgttgatcgacggcggtggggacggcgacggcgatggtgcagatggaggtgtcggagatgatccattcgataattag

SEQ ID NO: 5774 - DNA, 866 bp, Oryza sativa
  misc_feature (636)..(636): n is a, c, g, or t
  Predicted polypeptide sequence is orthologous to G778
ccttttttgagacgaaagtcagacaagatgatgaattgacccccacctggtccatcagaccaaagtgcaattgcttgcctctacaaaaacacagctgtacatgaccatctgccggtttatacaggtcaagacaatataaatatactgtgcacctctaaagaaaagagggtagaaaaatatacaccatgccacggttgttgtgacgccgtactatttcatatctaaccacaagattaggaatttactccctccgtctcaaaatataagcatttttagccgttgtccagattcatagccaaaagttgttatattttgggacggaggtagtaggcaaaataatattcagtgcaaatacaacaactagcattttacatgtactacttgtagtaagtaccatgtcacgatcattgtctggagttgcttggctggtcctgctgctgctgctgctggtggtttagcttctggtacattgccatcatccggttgtacgcctccatgccgttcggttgctgtgcgttttgctgcgccgcttgggaggcgaggaaggcggagaaggcgtcggaggtggcggcgccggtgggctgcggcggtcggtcggcggcggcggcggaggaggaggatgcggcggcgtcccangagacggggaggaaagggggcgtgtgcatatgcatgggcgcgtatccgccggcctggcccatgttcatcatgctgaggccgatctgagccatctgggccatctgggccatgacggacatctgcagctgtggcatggccatgcccatgggcatcatcatgctgcccatccggctcatcacctgcacctgcgcctgcagctgcttcaggtagtcgatcacctcgtcaagcat

SEQ ID NO: 5775 - DNA, 433 bp, Oryza sativa
  Predicted polypeptide sequence is orthologous to G779
tgctaacatatagcaatttttgaagaaaggaaagctagaaatacccaatatcttgctgaagcaagatattgggtatttctaaaacacggcatcagtcccttccacaatacctgatcctcatcatattatgctagtccctccggctacagatttgctccatcaagatcacagccaaagcaatggctaacaggatacagcaggaactccaggcttccacaagatagtgctgaaactcaagctctagcagtagcagcaatccatccactgcgaaagtagaaaaatttcaccccaggtgtactctagtctcgggcttccgttgtccagctccaaactgaattttgctgaactacaaccactgattgcgagaagttaatatctacctggagggatggcaagctcttttcatgaataaaaaaaataaaaaaaaaaaaaa

SEQ ID NO: 5776 - DNA, 1643 bp, Oryza sativa
  Predicted polypeptide sequence is orthologous to G782
gaaacccacctcgcgtgctctgtgcacggcggggacgctaaggggaggcgaggcgaccacgcgccctccgcgtcaccatggatccgcgcagcagccaggcgcaagaggacggcttcttccacccacgcgacggcgcgtgccccgccgactccagcggaaagacagaatgtaaaacccagggttcaattgccacgcgcaaggttcaaaaggctgatcgtgagaaaatgcgaagagatagattgaatgagcagttccaggaacttggaagcacacttgatccagatcgacccaggaatgataaggcaactatccttagtgatgcaattcaaatgctgaaagatttgacgtcccaggtgaacaagcttaaagctgaatatacttcactctcagaagaagcacgtgagttgactcaggaaaagaatgagctcagagatgagaaagtttcactgaagtttgaggttgataatctgaatacccagtatcagcaacgaatgcgtgtgctgtacccttggactggaatggagccttctgttgtcattgggccacccctgccatatcctttttcagtcccagtcccagtcccagtccctataccttcaggtgctgttcctatgcacccacagctccaggcatacccttacttccgaaatcaaacttctggaaccgtctccaatccatgcacaccttacatggcatacactcaacccatccatcctcctactgatcaactatctaaccaattcagtgctccagttcagcattcaagtagtaatcgatctcactctatggcccaagactctagaagcaagtcctctgcactgcagcaagtaagttgtagagggaaacatgatgactttgatgacgttgcaactgatctggaactaaaaactcctggttcctcagcccctctacaatcagagattgccaacaaggattcctcttctgacttgaaaaaaaagcagcagttcatacaggaaactaaaggtagttctcttacagaaggcagtagtagttcaagcagatgctcgtccagtggtcctccagatgtctctaacagtattgaaggtggatcagttgctgatgatcaacgatcgacagtacagacatagactaatatatgacgtatagctatcttttccgacattcctaggcctgcatgtgtggtgtaatctgctggcacatcaacctttgctgcttagctgtgcccacttgatatcggaattgacaaattaggaggcctataggcaaagtagaactggttagtcgaagccaaagccatattccatggctatgattatgaatggtcggtagttacccacactcttctatggcagtttgaaatgctttcggcgactaggtatgcttgcgactaacttctgcggtttgtcatctaagatatgcgtcaagtgccaaccagatctgttgagatagttctatcctggagtagcattttctacgaatatatggtaaattaactagtgattaaccatagaatttatcatggttcaatagttacctggtagatcagctacaagttgtacatcatacactatattaccattaattggaatatgttcttaagtatattatttgacatgattgtcagtatccacattttactatatataggcggcatgttattg

SEQ ID NO: 5777 - DNA, 1216 bp, Oryza sativa
  Predicted polypeptide sequence is orthologous to G783
ggtggcgtccacgcgcccaccccacgcgcgtcaccgtcgctcgcccaaactgcgggcgcgtcgcacgccgccctcccatcgttttctcccattctttccccctcctcctcgtgcaaccacccaaccactgcagccagccacgagccgaggaagccgaggccgaggaggaagacgacgaagacaagtagcgcaaggaaccctcgaaccgggaggccgccgcggctccgatctgggagggggaggtcgagatggtgcccagggacagggtgaatgccgctgccgctggtggcggcggcgaggggaggctggtccagagcggtatagtgaacaagaagtgtgataagaaggctccaaagagaatccataaatcagagagggagaaacttaagcgggacaagcagaatgacctctttaatgagctgggaaacttgctagaacctgacaggcagaacaatgggaaggcatgtgtactgggtgaaactacacgaatactaaaagatttactttcacaagtggaatctctccggaaggagaatagttcactgaagaatgaatctcattatgttgcattggagagaaatgaactgcacgacgataacagcatgcttcgtactgaaatcttggagcttcaaaacgagcttaggacgcggatggaaggcaatcctgtttggagtcatgtaaacaccagaccagctctcagggtaccttatccgacaaccggagtgttcccagtacagcacctgccacatttaccagtcaccacgacggcagcatttcctcagcagctaccggttatcatcgagcagcactatgccgccacgccaagagaacttcagctcttccctgagtctgcgaccagcgaagacagcgaaccgtcacaagaacacgggatttctgaccatgtaacacggcctcagccaaggtacccaacaccaacggccactttgccagtaaacctgtttccagtgtttccaggaagacaagatcaacaatgtagcagtggtacttctggcactaacgaggaagaccgtataggtagatcttaggtacactacataacgagaggtccacacaatgatttgagaattcctttagtttcaacgtttaactttgcaagtttagcaaatgtgaaacagagatctgcgactgtgctcatgggtagcacctaatctgtatatctgaatctcagttttaagtggtcaaataggtgacattc

SEQ ID NO: 5778 - DNA, 1135 bp, Oryza sativa
  Predicted polypeptide sequence is orthologous to G783
gaatcttcgccctcctcctcctcctcgtacgcgcccacgcggttctctttctgccccctcgatcgatttgagcagggaacggaagggggaggtttttggaggaggccatggtgccgtcggagaggggggacgtcgccaccgccatcagacccgccgctgccgacaagctcgtccatgggcctatctctgacaagaagtgccggaagaaggtcccgaggaaggttcacaaatctgagagggagaagcttaaacgcgggcatctcaatgatctgttcggcgagctgggtaatatgctagaagcggataggcagagtaatgggaaggcatgcatactaactgacaccacccggatcttaagagatctgctttctcaagtaaaatctctccggcaagaaaacagcaccctccagaatgaatctaattatgttacgatggaaaggaatgagttgcaggatgaaaatggtgcgctacgcagcgaaatctctgacctccaaaacgagctgaggatgcgtgcgacagggagtccaggttggggccatggcgcgactggatcacctctccccgttcctccctctccaggcacggttttcccatcgcagcagccaatgcagccatctcccatgacaacaagcacagtgttccccttgcagcagccactgccacaaccaacagtcattgagccctctgcaagacagccactggaactgaagctcttcctagaagcaccccccgccgaagaccctgaaccatcagaagaccaggaggctccgaacaatgtggcacgaccgcagccgaggtacccaacagaggcatcttcttggcctattagcctgggacttccaagaatggaagatgagcaaatgtagtggtagcacgatagatgatagcacaggtagagattgagagggtctgtttttaatgcatgcaggaattccacacgaaaacacttctgtccttgcatgaaaactggaaaatttcctgcattccaagtaagacctgagtagatcagctccaaccaatcagaaactcactttgagcctagaggatatactactgaatgatgtgcatgtaaatatttcaatctcccttttgtttctgtaaactctagtgagaatagaacccgttttatcccctt

SEQ ID NO: 5779 - DNA, 1485 bp, Oryza sativa
  Predicted polypeptide sequence is orthologous to G783
ggcctccctcccctctcctccctcctccttccaaatctgcagctcaagctggtgttggtggtgttggtggtggtaggcggcggcgtcgccttctcctcctcttcttgctgaccccgcctgactggcttccttccccttccacacctgccggatcgggtggctgggttggttgagggtccaagaaagaaagattttgggggttcgggggtgaacccccctccccatgccccaagtgaggaaccagaatctgggcatggtggctgacacggagagctcggggtcactgggtggcagctcaaatgctgcttctgacaaggctgttgatgggtctcttgacaaaagatctcaggaaaaggctccaaagaaaactcataaagctgaacgagagaaacttaagcgtgaccagttgaatgacctttttgttgagctcagcagtatgcttgatcctgaacgacaaaatagtggaaaggctactgtgttaggtgatgctgcacgagttctgcgggatcttgtttctcaagtagaatctctcagaaaggaacagtccgctcttctaactgagcgtcaatacgttggttcagagaataatgagctgcaagaagagaatatcatgctcagagcccaaatattagaactgcataatgagatttgtgcaaggatgggaaacaaccgcctcaatcaaagcaatcttgcgatgtcacaaccagtagccaacaatggcagtaactcagcaactcaacccgttccacatcacatatggggcaatggtccgaatttagctatggtgcacccaacaaacacattatctccgttgcacaatcagcaccatcagtctgctggtgccagccaggtttatgcgtcacggcctcaggagctgcagctctttccagggacctcagtatcaacagagcgagaacgatcccgagctggaagtggaagcaccccggctacttcttcaggcctgacggattctttgccagggcagcttcgcctcagcctcccgcaatcttctcaagaagaaaacagcagcggcagcaagaaaggtcgaaaaaagggctagccggccagttgacacttgacagttgctaaaaaagaatcgataaatcgatacttggtgaatggtgatagttacacactcctgtaaatactgcgaagcgcttactgatacctactgtgatagttgccctctgttgtaatttgtatttgtagtgcttgctctgaaacttagatcacgtttgactatagttttccacttccagtccttttacggatatatgttgccatattacagagttgtttaccaggaagagagaaaaatgatgcaattcgatagcagtgttaactgatgataattatatgatccctgtcaccaagtcatgaaaatctgatcttgtatgttcatgggcagcttgtttcagcattacaagttgaagaaatatttgtaatctgttgcaaactgcatgtttatggctatgagaaatgatc

SEQ ID NO: 5780 - DNA, 1216 bp, Oryza sativa; identical to SEQ ID NO: 5777
  Predicted polypeptide sequence is orthologous to G783

SEQ ID NO: 5781 - DNA, 2008 bp, Oryza sativa
  Predicted polypeptide sequence is orthologous to G789, G1494
gacgcagcccacgggccttgttcccttctcaccacctccaagtacgctttgcgggacactcgcggcagcaagagttcgtatactcgcctctgctgctgctgcactgccgcgcctaaagctgagcaagaagaggagactttgcagcaagagttgctactgtttggtttggttcaggtgagagaggtcaacaatagctgttggcgtggctagttgcttgtgcagaaaaggattctcttttggttttgccctttctgagaagctgatgatgatgtggtggtgggctatggttgtgcaggttggggagctactagaagaaggaggaatagctaggttgtgaatttcttggggggacacaagaatcgtgggatggatggcaatgcgagatcggcggcgaatcagacgaagcaaatcgtgtagagatttcatctgaaacccaagaacggattcgtcttgtgttgttgccgaatggtagtgacctgacctgactctgtgtgcatttgctccaatggcgatttgcagcacggacaacgagctggtggagctgctatggcacaacggcggcgtcgtggcgcagccgcaggcggcgcaggcgagggtcgtctcctcctccggccgcggccagagcgccagcgtgctcaccggcgacgacacggagaccgccgcgtggttcccggacaccctcgacgacgcgctggagaaggacctctacacgcagctctggcgcagcgtcaccggcgacgcgttcccggcggccgcggcggcggggccgagctctcaccacgctccgccgccggacttgccgcccccggcggcgaggccgccgatgaggagcggcatcgggtcgagctggaccggcgacatctgttcggccttctgcggcagcaaccacatcccggagacggcggcgcagcgctgccgggacgccggcgcggcattgccgccggagcggccgcgccggtcgagcacccacgacggcgccggcacgtcgtcgtcgggcggctccggcagcaacttcggcgcttccggcttgcccagcgagagcgccagtgcccacaagaggaaaggcagagaagattcagacagtcgcagtgaggatgctgaatgcgaggcaaccgaagagaccaaatcgtcgtcgcggcgatatggatcaaagaggagaactcgtgcagctgaagttcataacctgtcagagaggagaagaagggatcggatcaacgagaagatgcgcgcattgcaagaactcatacctcattgcaacaagaccgacaaggcatctatattagatgaagcaatcgagtatctgaagtcactccaaatgcaagttcagatcatgtggatgactactgggatggcaccaatgatgttccctggtgctcaccagttcatgccaccaatggccgtgggcatgaattctgcgtgcatgcctgcggcacaaggcctaagtcacatgtcaagattgccatacatgaaccattctatgccaaatcacatccctctaaattcatctccagctatgaacccaatgaatgttgcaaaccagatgcagaacattcaactgagagaggcaagcaatcccttccttcacccagatggctggcaaacagtgccaccacaggtatcaggaccatatgcttctgggcctcaagtagcacagcaaaaccagataccgaaagcgtcagctagcactgttctgccaaattctggggctgaacaaccaccaacctctgatggaatttagaatgaccagaaacatgataaggaattcaatgtaggctttgcacaaagggtcgtctttctggagatagctgaaaatattgacatgatgaacagattgcatccatattgctgttatgtatctcaatcagtatctgtctgacataaatgctacaagtgtctgtaaatgcacatagcatttccccccttccctaagatgctaattcccagtgtatgtactaataatccttataatatgaagtgccagtggcaatctttgcccttctttaaaaac

SEQ ID NO: 5782 - DNA, 2081 bp, Oryza sativa
  Predicted polypeptide sequence is orthologous to G789, G1494
ggctctccggcgagtcctcttcctgccctgccctgccctgccctgcattctttctttctccaccaggggaatccagttcacccccagtgctgcttctgctgctgcttctgcatcatcttgccctgttaaaaagacacagtgcccttgttctttcgcagttgcaactagcatctcctcctctacttgtactcacttcacacctcagctcagctcagctcatctcctgtcatctcagctcaaagagaaagagctgaaggtgtaagctgatcaccaggaagcagaggctttttttcagattacagttatctgaaacaaccaacttcagaatcaatcagcaaaggtagaaacaagacagagctgctgtgcttctgtgattaattagggttgttaatgccatgaaccagttcgtccctgattggaacaccaccagcatgggcgacggctttgcgccattaggcgaagacgacgggctcgtcgagctgctatggtgcaatggccacgtcgtcatgcagagccaggcgccgcggaagccgccgaggccggagaagacgacggcggcggcggcggcggcgatggcggaggatgagtcggcgtcgtggtttcagtacccggtcgacgacgtgcttgagaaggacctgttcaccgagctgttcggcgaaatgacggcggccggcggcggcggcggcgacgtccgcagggcggcgtgcaaggaggagcgcggcgcggtcgccgcgttccagagcaggatgatgccgccgccgtggccggcgagggggaaggcggagttcggtgacgtcgacgacgtgtgcggcgtctcggaggtcgtcatggcgaagatggacggggcggcggcggcggagacggtcggcgagtcatcgatgctgacaatcgggtcgagcatctgcgggagcaaccacgtccagacgccgccggtggggaacgggaaggccggcgccggcaccgccggcgccgccagaagggcgcacgacacggcgacggtggcgtcgtcgtcgatgaggtcgaggtcctgcaccgccaaggccgagccgcgcgacgtcgcagccgccggcgtcggcggcaagcggaagcagcgcggcggcgccgccatggagtccgggagccccagcgaggacgtggagttcgagtccgccgccgcaacgtgctcgccggcgcagaagacgacgacggcgaagcggcggcgcgccgccgaggtgcacaacctctccgagaggaggagaagagataggatcaatgagaagatgaaagcattacaggagctcatacctcactgcaacaaaacggacaaagcatcgatgctggatgaagcgatcgagtatctcaagtcactgcagctccagctacagatgatgtggatgggcggcggaatggcgccgccggcggtgatgttcccggcggccggcgtgcaccagtacatgcagcggatgggcgccgtcgggatgggcccaccacacatggcgtccctgccgaggatgccgccgttcatggcgccgccgcccgccgccgtgcagagctcgccggtggtcagcatggccgacccctacgcccgctgcctcgccgtcgaccacctccagccaccgcctccgatgcattacctgcaggggatgagcttctaccagctcgccgcggccaagaaccttcagcagcagcagaacacggcggaggcgccgccaccgccaccggccggaggcaaccgcgcagccgctgactcctgacgacattctgcacaaaaaatacgacaactgtagtaagtctgagagcaagggtggcaccagttgattgccgtcaatctgaagatatgtatataaggctctgatgcaattgagttgagaggctggatcatgatggctacctaatcattaaggggaatttaagatcatcccttttactgacgtctaaattcggtaggcagtgtagatcgatcagcggttaagagttaacaagtcgtgaattcttttttgctatgtatgtagtactattttttcccctttggggagacattggttatgtatcagttgttgatgtacctgttcaaatttatgccaaccagagcaaattgtatt

SEQ ID NO: 5783 - DNA, 2134 bp, Oryza sativa
  Predicted polypeptide sequence is orthologous to G789, G1494
aagcccggtcccccttgctctgcctctgcctcttcttcctcctccttgctctgcttctgctctctagctagccttcttcctattggaagcttcttctcaagtgaaaattaagaagctagtattggctgagctgagctgagcacccagccaaagtcttgggcctacttaattagtgaggtgaaggggagatcgtcgtgtcgtcatccatggttgctgccatctgatgagcgatgaaccagttcgtccctgattggagcaacatgggtgacgcatccaggacactcggcgaagatgacaacctcattgagctgctctggtgcaacggccatgtcgtcatgcagagccagaatcaccaccggaagctgccgccgaggccgccggagaaggcggcggcggcggcggtgcaagaagacgaggccggcctgtggttcccgttcgcgctcgccgactcgctggagaaggacatcttctcggacctcttctacgaggcgcccgtcgcggcgacggcggaggcggcgcctgctggcccgggcgcgggcgccgacggcgaaggaaagacttgcaagggcgacgcggcaatggcggaggaggagcgtggcgggccgggcgcggcgtccgaggcgccgcgcgagctgatgccgccgcccaagtcgacgaacgcgtcctgctcgaggcagcagacgatgagcctggcggacggcggcgacaacgccggggacctgtcggagctcgtccgggcgaggaggtcgtccggcggcgcggctcggcggaaggcggaggccggcggcggcggcggcggcgcgtcgtcgtcgatgctgagcgcgatcgggtcgagcatctgcgggagcaaccaggtgcaggtgcagcagcgcacggcgagcgagcccgggcgccgcggcgcgccgccctcggcggtggggagcgcgaacgccatcccctgcggcgggcgcgaccacggccacggccacgaggcgaccaccgtggcgtcgtcgtcggggcggtccaactgctgcttcggcaccaccaccaccacggagccgacgagcaccagcaaccggagcagcaagcgcaagcggctcgacaccaccgaggactccgagagccccagcgaggtaggcgtcctcccgtcgaacaccaacagagacgcacactgacactgacaccggcggcgcgtgggatgcaatgcaggacgcggagtcggagtcggcggcgctggcgcgcaagccgccggcgaagatgacgacggcgcggaggagccgcgccgccgaggtgcacaacctctccgagaggaggagacgggacaggatcaacgagaagatgagagccctgcaggagctcataccacactgcaacaagactgacaaggcgtcgatgctggacgaggcgatcgagtacctcaagtctctgcagctgcagctgcagatgatgtggatggggagcgggatggcgccgccggtgatgttcccgggggtgcaccagtatctgccgaggatgggcgtcgggatgggggcggcggcggcggcgatgccgaggatgccgttcatggcggcgccgcagccggtggtgcccacaccgccggtgaaccaccttgacctgggcgtcaaccacctgcagccgccgccgacccagctttatttgcagggagtggggtattatccgttgggggccaaggccgtgcagcagcagcaaaatccaccacttcacgtgccaaatggaagcattatgcctcctcctgaaaatgcacccaacacaggatcaggataattaacaaaaaagagtgagagcaaagaggaagaaaacattcatggttgcattgatcctgaatgagtatatatggcaataaaggtaactgagctgcacagcaggacggagcagaggaatttgacagggggacgatttctttagctttttcccctctttgggaagccaggaactagctgtgatgtgcagaagatgttagcaaaatctcttgaagatctctaactgattgtaattaggggtatgatggcatgttcaaagcataaggctggtctggtcttttgtaccattggaattaacattagagacagaaattgtgccatacatttggaacaagagtagttagtataaattgacacacttcttttcaaaaagt

SEQ ID NO: 5784 - DNA, 1254 bp, Oryza sativa
  Predicted polypeptide sequence is orthologous to G789, G1494
atggatgcgggtgcaactgcaaggtcgtcgtcgtcgtcggcgatgatgatgaaccagaagaagcccttgtcggatggcgagctggtggagctcctgtggcaggacgggggcgtcgtcgcgcacgcgcagacgcgccaccgatcgtccgacgtcctcgcccggagcggcgtcaccggcgaggaggagacggcgtccgcgtggttcgcggatggcggtggcggcggcggcggcgacgacgacgcgctgggcctgggcatgggcagggacatctactcgcagctctggcacagcttcgccaatgtcgacgggcacgcggcgggcgcgctcgcgctcgcgacgccgacgccgacgccgcgggcggcggcgaggagcgacgacgtgtcgagccgtctcgacgaggccgacctgagcatctgcggcagcaacgcggtcgtggcgccggcgctgcccgcggacgacgacgacgacatcgacgccgccgcgccgcgcgaggaggaggaggaggaggaggaggggccgggcgccgcgcgcgccgccggcgcgtcgtcgtcgggcgggtcggggagcgggagcgggagctacccgctgttcaagcgggggagggaggagctggttgacagccttagcgaggtcgccgacgagacccggccgtcgaagcggccggcggcgaagcgccggactcgcgccgccgaggtccacaacctgtcagagcgtagaagaagggataggatcaatgagaagttgagagcattgcaagaactggtacctcattgcaacaagactgacaaagcatccatactagatgaagcaattgagtacttgaagtccctgcaaatgcaagttcagatcatgtggatgactaccgggattgtgccgatgatgttccccggtacccaccagctcatgccaccgatgggcatgggattgaacacggcatgcatgcctggggctcaagctcaaggcctgaatcagatgcaaagaacaacatattacatgaacaattctctgccaaaccagatgcctcagatcccttctccagctatgaatgcacccagtgttccagacgatatgcagaatgataatcgcatccgcgggccaagaaatccttttcttcattgcaatgatacactgacagcaacagctcaggtgccaggtttgtttacctatggatctcaaattgcagaacaaaatgagattcaggagttactctctggcgctgtcattccatcctcatctgatgggaccataaaataa

SEQ ID NO: 5785 - DNA, 1578 bp, Oryza sativa
  Predicted polypeptide sequence is orthologous to G789, G1494
atggcgatttgcagcacggacaacgagctggtggagctgctatggcacaacggcggcgtcgtggcgcagccgcaggcggcgcaggcgagggtcgtctcctcctccggccgcggccagagcgccagcgtgctcaccggcgacgacacggagaccgccgcgtggttcccggacaccctcgacgacgcgctggagaaggacctctacacgcagctctggcgcagcgtcaccggcgacgcgttcccggcggccgcggcggcggggccgagctctcaccacgctccgccgccggacttgccgcccccggcggcgaggccgccgatgaggagcggcatcgggtcgagctggaccggcgacatctgttcggccttctgcggcagcaaccacatcccggagacggcggcgcagcgctgccgggacgccggcgcggcattgccgccggagcggccgcgccggtcgagcacccacgacggcgccggcacgtcgtcgtcgggcggctccggcagcaacttcggcgcttccggcttgcccagcgagagcgccagtgcccacaagaggaaaggcagagaagattcagacagtcgcagtgaggatgctgaatgcgaggcaaccgaagagaccaaatcgtcgtcgcggcgatatggatcaaagaggagaactcgtgcagctgaagttcataacctgtcagagaggagaagaagggatcggatcaacgagaagatgcgcgcattgcaagaactcatacctcattgcaacaaggtaagaaacattattatatatgcatcttttttctgatcaggtgcaagtccatggactgatacagctatgttgaccgacaaggcatctatattagatgaagcaatcgagtatctgaagtcactccaaatgcaagttcagatcatgtggatgactactgggatggcaccaatgatgttccctggtgctcaccagttcatgccaccaatggccgtgggcatgaattctgcgtgcatgcctgcggcacaaggcctaagtcacatgtcaagattgccatacatgaaccattctatgccaaatcacatccctctaaattcatctccagctatgaacccaatgaatgttgcaaaccagatgcagaacattcaactgagagaggcaagcaatcccttccttcacccagatggctggcaaacagtgccaccacaggtatcaggaccatatgcttctgggcctcaagtagcacagcaaaaccagataccgaaagcgtcagctagcactgttctgccaaattctggggctgaacaaccaccaacctctgatggaatttagaatgaccagaaacatgataaggaattcaatgtaggctttgcacaaagggtcgtctttctggagatagctgaaaatattgacatgatgaacagattgcatccatattgctgttatgtatctcaatcagtatctgtctgacataaatgctacaagtgtctgtaaatgcacatagcatttccccccttccctaagatgctaattcccagtgtatgtactaataatccttataatatgaagtgccagtggcaatctttgcccttctttatcatcctc

SEQ ID NO: 5786 - DNA, 406 bp, Oryza sativa
  Predicted polypeptide sequence is orthologous to G789
ccaacgccaaggccaaggttaccaccgaggtctaaatctgtggtacatgagactgagctttggagagatggggacggaccagttcttccaccagcaatttttacggcatctgtcactattcgataaacgaagccagcaagaggcacgattgggatcagacagcccaggatgcggtggatgtgaactcggttggaaggaaaagaaaaatatttcctggcggaagttgtggtgtttcccggccggttattactcattgggaagggcagcatggactttgctgtttctggttgcagatcgcaaagggcgaaaagggacctgcggctggctttgcatggatttgcggatcagacgttctctggcaatgtatgtttggttgctagaggaagaatatgacgcacctgaaatg

SEQ ID NO: 5787 - DNA, 1325 bp, Oryza sativa
  Predicted polypeptide sequence is orthologous to G791
gccagcatcttcctcagccaccaacctattctcacttttacacccaacccctccaaaaaagtataaaatcacaacatcacccctctccaccacagctaaaaactactaagcgaggactcgttagacattacagttatatccagggtgcaatctgcaaaagtctcatccccaaatccccaattcttccccgacctctcgctcgcggaggaggagcgagaatccccgaaccctaggcccgatctcccgcacccgccgcgggcgatggacggaggcggagaccccgttgacgagttcctcatcggcggcggcggcgaggacggcgacctcggcgtcttctgcgacggtgtgccgacgctgccctgcgatggaggacttgggattgatgatgtcagtggagatacttgttgccttgaccaatctgttttagggaaaagaggtagagatgaatcatcatcatctggtccaaagtccaaagcttgccgtgagaaaattcggagggatagactgaatgacaggttccttgagttatcttccgttatcaatcctgacaagcaagctaagttggataaagcaaatatcttgagtgatgcagctcgtctgttggcagaactcagaggcgaggcagaaaagcttaaagaatctaatgagaagctacgagaaacaatcaaggaccttaaggtggagaagaatgaactccgtgatgagaaagttactctgaaggcagagaaggagaggctggaacagcaagttaaagcattgagtgttgctcctacaggatttgttcctcatctccctcatccagctgcattccatcccgctgcattccctccatttataccaccttatcaagctctgggcaacaaaaatgctcctacgcccgcagcattccaagggatggcaatgtggcagtggttgcctccaactgctgtggacacaactcaagatccaaagctttggccaccaaatgcttaattaggtgcagactagctatgctgctattcatccattggcagatcaaaatgtgttcggtcttcctggagagtaaaatagtccgcgatgctgtccattacgtggtaaactgttcttttattggagttctgtttttaactcgtcctattgaggggcgatgcctgtaattaatctggatcgtaaccctcttgcctggtgaatgctccacaaactctcatgtccctcgcatgagtttgttcaagtgtggaagttgtgactgtgctattattttagcattggcttggcagtacttgttctgtttctagcaagagtttcgcatgtgagcacatgcatagcaatatagtatgttctaaatt

SEQ ID NO: 5788 - DNA, 1082 bp, Oryza sativa
  Predicted polypeptide sequence is orthologous to G791
ggaggcgaggcgaagctcctcgtcgtcagaatccgcgaaaacatcgccaccaccacgagaggaggaggaggagagcgcggcggcgatgtccggtaccccggcggacggcggcggcggaggcggcggaggcggcggagggagcggggacgactggttcctcgactgcggcatcctcgaggacctcccggcggccgcgtgcggggccttcccgtgggacgcatccccgtcctgctccaacccgagtgtggaagtaagcagctatgtgaacaccacctcttatgtcctcaaggaacctggcagtaataaacgtgtaaggtcagggtcttgtggtaggccaacatcaaaagcttccagggaaaagatcagaagagataagatgaatgataggtttcttgaattggggactactttggagcctgggaagccagtaaaatctgacaaagctgctatcctaagtgatgccactcgcatggtaattcaacttcgtgctgaagcgaagcagctaaaggatactaacgagagtcttgaagataagattaaagaactgaaggcagagaaggacgagcttcgtgatgagaagcagaagctgaaagtagagaaggagacattagagcagcaggtgaagattctgactgcaactccagcctacatgcctcaccccacattgatgccagcaccgtacccacaagcaccacttgcccccttccaccatgcccaggggcaagccgcggggcagaagctgatgatgccttttgttggatacccggggtacccgatgtggcagttcatgccgccttccgaagtcgacacctccaaggacagcgaagcgtgcccgcctgtcgcgtaatgcttcatcggttgcgttatgtgaattaatcgtaacctgaaaccgcttagttgctcaatccattggttgggcatcgtcgtccctgattcacattcactattgttcttgtgttagtagttcgtttttgtatggaagtaagctgacatttgtggcgctctatagaggctactgcccccttttaatgtacaatacaatttttccggagaaaggaagaatgctcattcttgttctctgc

SEQ ID NO: 5789 - DNA, 2597 bp, Oryza sativa
  Predicted polypeptide sequence is orthologous to G791
gaccgccccgaatccgcccccaaatctcctcgcgacctcgaaaccctagcctcctccggccaccgtcgccggccacggtgagcggccccacccccccgcagccatggcctccccggagggctccacgtgggtcttcgactgccctctgatggacgacctcgccgccgccgccggcttcgacgccgcccccgccggaggcttctactggacgacgcccgctcctccgcaggcggcgctacagccgccgccgccgcagcagcagcccgtcgcccctgccaccgcggctccgaacgcctggtaattgcggggtttacggcctccgatcgcgctccagccagccctggctgggcccggtgccgtggtctggggtgctacatttttttttcgtcctgatttgtcgcggcagcgtgttagtgcgtaagttgagactgggtatatcgtgatcgttgctattgattgttcgattggaggtcgatagaagcgtatcatatcagactatcagtgggattcggattaggggattagccattgagtgtgtctgaacatgtagaactagttacgtactccctccgttttctaaaatatgacaccactgacttttcaaaatacacttgaacattcatcttattcaaaaaatttatgtaattattatttgttttattgtgacttgatttatcgtcaaatattctttaagcatgacttaaattttttatatttgcacaaaaattttgaagacgacgaatagtcaaacgtttatcaaaaagtcaacgacgtcatacattaacaaacggaggtagtataacttagtaggagccgtcagcctgttttactgaacagagggctcaattcctggttatattgaattgtcagcttcattttcaaatctatttatttgtgtgcatacgtaatgtatttaaacctaatttagggcctcttcatgatttataattctcattttaattgtgatgcaaatgctgcatagcatagcatatatagtttgctaagcatgcattgtgtcatgtttatctggtgtcatgtcatgggatagttgaactgaagaaaacatacaccataattgatgatgtttatgatgccactattgtacaagattcagtttgccgtgtaatattacaatataagaactgataacaagtaaaccaaatggtgtcaaattggcgtggtggtgggagggtggatggttgtgatttgctgtaggtccaactgtctgagataccagattttaaaattttttgtatctatatgcaagtaaattgcattgacatgatattttgagccaggtattgagatttgtcctgagctttccagtggatttttcaatgaatgatctatgaaggatcagaaacggggtgagagaagtggttaatctgtatcacttgggttccagcacgaagcttactgtggaatggaaatttattgaagaacgtgttcatgttaggatattgtttactgcaactctttgatttaagagtattcttttatttatgataccttgtagtcttgtggtgctagtacattttctttatgcaccaggaagtcatctcatgtgtttttaaatctgtcctggtttttgacttgtgcttccaccttctggtgccataggttgtggtgttatgaaccacacagtgcatcttaactgatgtattgttctgttgtgttaaatttgcttgattcttttgttgtcattgtatagttttttatgtacttattgctgtatattatcgtgacatatggcatactgaagtacaagtttatttttttcaccagtgctgaaatcaatggctctgtggactgtgaacatggcaaagaacagccaacaaataaacgtccgagatcagaaagtggcactcgaccaagctccaaagcatgcagggaaaaagtaagaagggacaagttgaacgagaggttcttggaactgggtgctgtcctggaaccagggaagacacccaaaatggacaaatcgtctatattgaacgatgctattcgtgtaatggctgagctgcgtagtgaggcacagaagttgaaggaatcaaatgagagtctccaagagaaaatcaaagagttgaaggctgagaaaaacgagctgcgtgatgagaagcaaaagctgaaggcagagaaagagagcctggagcagcagataaagttcctgaatgctcggccaagcttcgtaccacaccctccggttatcccagccagtgcattcactgctcctcaagggcaagctgccgggcagaagctgatgatgcctgtgattggctacccaggatttccgatgtggcagttcatgccgccttctgatgttgataccacagatgacaccaagtcatgccctcctgttgcataagtcaaagcaaagatcaatttgcctcgccttgtaggaaagaggtgaaactgccttccattcaagcccagtttggtcgtcagtgtttaaactacctagctaatcccaggattaaaccgaagcttcgctgtatcgaagtatcaaccggtgacatgtgaactgacgaaagatgacaccgttgtatattacatattagtaaataaattccatctgtccaattaaatgagaattagatgcc

SEQ ID NO: 5790 - DNA, 1325 bp, Oryza sativa
  Predicted polypeptide sequence is orthologous to G791
cccagcatcttcctcagccaccaacctattctcacttttacacccaacccctccaaaaaagtataaaatcacaacatcacccctctccaccacagctaaaaactactaagcgaggactcgttagacattacagttatatccagggtgcaatctgcaaaagtctcatccccaaatccccaattcttccccgacctctcgctcgcggaggaggagcgagaatccccgaaccctaggcccgatctcccgcacccgccgcgggcgatggacggaggcggagaccccgttgacgagttcctcatcggcggcggcggcgaggacggcgacctcggcgtcttctgcgacggtgtgccgacgctgccctgcgatggaggacttgggattgatgatgtcagtggagatacttgttgccttgaccaatctgttttagggaaaagaggtagagatgaatcatcatcatctggtccaaagtccaaagcttgccgtgagaaaattcggagggatagactgaatgacaggttccttgagttatcttccgttatcaatcctgacaagcaagctaagttggataaagcaaatatcttgagtgatgcagctcgtctgttggcagaactcagaggcgaggcagaaaagcttaaagaatctaatgagaagctacgagaaacaatcaaggaccttaaggtggagaagaatgaactccgtgatgagaaagttactctgaaggcagagaaggagaggctggaacagcaagttaaagcattgagtgttgctcctacaggatttgttcctcatctccctcatccagctgcattccatcccgctgcattccctccatttataccaccttatcaagctctgggcaacaaaaatgctcctacgcccgcagcattccaagggatggcaatgtggcagtggttgcctccaactgctgtggacacaactcaagatccaaagctttggccaccaaatgcttaattaggtgcagactagctatgctgctattcatccattggcagatcaaaatgtgttcggtcttcctggagagtaaaatagtccgcgatgctgtccattacgtggtaaactgttcttttattggagttctgtttttaactcgtcctattgaggggcgatgcctgtaattaatctggatcgtaaccctcttgcctggtgaatgctccacaaactctcatgtccctcgcatgagtttgttcaagtgtggaagttgtgactgtgctattattttagcattggcttggcagtacttgttctgtttctagcaagagtttcgcatgtgagcacatgcatagcaatatagtatgttctaaatt

SEQ ID NO: 5791 - DNA, 1278 bp, Oryza sativa
  misc_feature (971)..(971): n is a, c, g, or t
  misc_feature (1056)..(1056): n is a, c, g, or t
  misc_feature (1173)..(1180): n is a, c, g, or t
  Predicted polypeptide sequence is orthologous to G791
cgggtcgaccacgcgtccgcggacgcgtgggcggacgcgtgggcggacgcgtggggccgcgcgcgcgagagccagccaagccaaagccaaagcgaagaaagagcgcgtccgcgtcgtcgtcgtcgtccgcctgcctgcctgcctgcctacccacgtcgcgctcgcgtgcgcgctgccgcttagtcgcgccaaaaaggcggggggaggggaggcgcgtgcctgcccccgatcgcatatcgcattctccactcgcttgcgtttgccgttgcgtttgcgttttgcgtagcaagggaagggagagagctcgtgcttttggattggccgcgatgagctgcgggggcgccgggcagagcgggtggctgctcgagtacgggctggtggaggaggagatccagggctccgacttcatctacatggtcgacgaccccgcggccgtctccagcgtgctactgggcttcgacgttcccaggaaggaggacggcagcggcggccaggacaactctgcctccaagaaaagatctcgtccagaatcgagcgcaccgccgggcaccaaggcttgccgcgaaaagctccggcgagacaggctcaatgaaaggttcaacgagctcagcgcgatcttggagcccggcaagccgccgagggccgacaaggtctccatcctgagcgacgccgcccgtctcctgagccagctgcgcgccgaggcccagaagctcaagagctcgaacgagtcgctccaggactccatcaagagccctcaaggccgagaagtcggagctgcgtgacgagaagaacgaggctcaaggccgaaaaggagaggctggagcaaattgctcaagggcgtcggcgccgccacaccggcggctccagcgccgttcgtcccgcaccacgccgcggcggtggcgtgcgcaccggcgtaccatccggcggcgttcgcgcaggccggcgggcagtacgtgcgtgaagccaccatnacgcgccgcgggcgtttctggcatggtaacggcgaggtctcgaaagtccaggaccgtgaatggcgccgtggtgtacttgtggtgnccgacaccggaaatagagaaagcgtgaacccgtgcgtttatgtgggaacagcgctggcgcgaacttgttgcgcgttccttctcgttttaacatgcggtccttgcgcatactgtgacnnnnnnnnaaacaacatagaaatagacacaaacaacacagaaacaggagataacaacagacagaagagaatagaacagagaggagcacacaagagacacacagaac

SEQ ID NO: 5792 - DNA, 1096 bp, Oryza sativa
  Predicted polypeptide sequence is orthologous to G798, G1897
ctcccgagagagacgatcgagatcacgcgcccacagaaactgcagattaagcggcagagattgtagatagcgcgaggttattaaggccagcagtctgaccgcgcgcggcatgcccttctgctgctgcaaccgaccaaatggctcctgcggttgcctcctccccgtcactcgtgctctccgccgccgccgccaccgcctacaacaagcgcccggccgattccgacgcctcgccgccgcaccagggagatcgcacggggcagcaggagaagaagcagcagcagctggagtgcccgcgctgccgatccaccaacaccaagttctgctactacaacaactacagcacgtcgcagccgcgccacttctgccgcgcctgccgccgctactggacgcacgggggcacgctccgcgacgtgccggtgggcggcgcctctcgccgcggcggcggcggcaagcgccgcagggtctccgccgacgccgacccttcctcggcgtcgccgccgccacccacgacttccaccacggacgcgtacgccgacctcccagccggcttcccgttcctcagtgacggcgccttcctgccgcagttcggcctcgccggcgttgcgccggccgcgttctcttgggcatcggctgtccctgacttgtacaactgcgggatcgcgccgtgggacgatggaacggcggtcaccggcgcggcgtgggacaacttcgccgacatcgccggccttgatctcagctggccgccgccgggtaactgacgaacagtacacagctggtcgctcgtgttttggggggctccggttttagcaaagcagcctcaagtagtgcgttcttcgatcggtatgcaggtagtgtgttcttcgatcggtatgaagtatattttgctgagctagggattatgatataattattgggaatgtaattaagcagctcaattatccaacgtggtgtttgcagttttcttctctcaccaatttcatacgcttgcacaatgatgtggtgattatcattgggatcagtgaatcgtgatctgtagctggaagatgtgtttacgtatgtgcagtgttaatgacaataataagagtttgttgccatc

SEQ ID NO: 5793 - DNA, 941 bp, Oryza sativa
  Predicted polypeptide sequence is orthologous to G801
agagaacaagaccctagctacctgttcagtgttcaattcgcacggaaagccatggcctcccgcgacgccgccaccttccaggtctaccggcccatggcaatgccaacgccggcggcgctgccaccgtcgtcccagcagatcacaatgccgttcacggcggcgctcgtggacgccgtgctcccagctccccgaaaggcggcggcgacgcagggcggcaaggaccggcacagcaaggtgaacgggcgcggccggcgcgtgcgcatgccgatcgtctgcgcggcgcgcgtgttccagctcacccgcgagctggggctcaagtccgacggccagaccatcgagtggctgctccggcaggccgagccgtccatcctcgccgccaccggctccggcaccaccccggccgtcttctcctgctcgtccgccccctccaccgcctcctcctccttcctcctcggcaagcgcccgcgccaggaggaccacgaggcgccgacgttctgggaggcgctgcagcaacagccgcggcccgccgtgtcgtcgtggggtgccctcgcctcgccgtcgcaggaggcgcaggcgtacgcgtcgtcggtggcgcaggtccaccacctcaacctactctccgcgctctccggcgccgccacgagacggccagcacaggaggagtcccggtgatcgcgcgccgcagctatgcagctcaatttgcgacgtgattgcatgcgcgcgcggggttgatttgtacttggagctagtcttgctttgtcttgtgtgtatggcttgccgtacttaatttcccatttccgctggtgtttccatgggtgaattttgtgtgaatttgcttgattttaggccggagaatactagtaagtagctggtgaagaatcaagaatgtgatcagatagatcatcagaggcagcaattgtagataccaagtcttttggatt

SEQ ID NO: 5794 - DNA, 1105 bp, Oryza sativa
  Predicted polypeptide sequence is orthologous to G801
atcacctcaaaacctctcaaaccccacaggcaccggaccaccaccaccattggcaccacctcgcatcacactctctcgctcgccatgagctcccgcgacgccgccgccacgttccatgtctaccagcccgtgcagatcccgacggccacggtggcgcccgctgcggcagtgtcggcggcgccggcagaggccgtcgcccagctggtcccggcgccgagcaagaaggcggccggcgcggcgggtgggaaggaccggcacagcaaggtgaacgggcgcgggcggcgcgtgcggatgccgatcgtgtgcgcggcgcgggtgttccagctcacgcgggagctggggctcaagtccgacggccagaccatcgagtggctgctccgccaggccgagccgtccatcctcgccgccacggggaccggcaccaccccggccgccttcgtctcctcctccgcgccgtccacctcctcctcgcaccagcacaccctcctcggcaagcgccagcgccaggagtccgccgccgccgacgccgtctccgtcgccggcgccgcgtccgcgttctgggcggcgctgcccgcaccaggccggcccgacgcctggggcttctccccgctggacgcgcagccgacgtacgtgccgatggcgcaggcgcaccaccaccacctcaacctcctcgccgcgctctccggcgccgccaggcgcgccgaggaggagtcccggtgaatcacgcacagcagcatgcatcttccgagctctgacacgtctttcgctcaattcaccgacgcgtactgcactggcgtccgtacgccttgttcttgggacagttcttgattggagtgtgcttcttctctctaccccgtggatcgatcgttttgccttcttcctgtgcggttcatcaattgctcaagatgaaattaattgttgctgtggtgtttaagctcaaaactgtaaatacgagtccttagatctcatcttactcctacaaattccagcgccgcatgtgtttgtgtgtttgccacttgtttccagctcttgtgctatgattccatggaacttgtttcagtttagcttcatctacatcgttgtcagaccaaatcatttgacagtt

SEQ ID NO: 5795 - DNA, 756 bp, Oryza sativa
  Predicted polypeptide sequence is orthologous to G801
atggagtcgagactggggaagtggggatcgcatcggccgcgggaggaagacccgggagcggcagaaaggggagaggcggccggcgagcctggccaagctctgcaagcctcgagcgccacgcaacgagaggagggaatgggggagaggggaagtggccagcgggagatgggggaagggagaggcgcggtagggcggcatggcgggcgcggctgctgcggcggccatcatctccaacacaaccacgaagctatagagctggccgaagtcggcccgtgcgggaagcgcccagaagccctgggtgggggcgtcggtagcgggagcgagcgtgggggaggtggtttgtggttgtcggtggcatggaggtgcttgccgaggatgaagggggcggagcaggggaagaggaggtcattagagtggagggagaaaggtgaggaggtggataaggaggccggggtggtgatggtgctggtggcggggatgatggatggctcggccagacggaggagccagtcgatggtctggccgtcaaacttgtggctgagatcgcagatgatggggcatgcggatgcgacggccatggtcgatgaccttgctgtggctatccttggagggaggcttgcggacggtgaggacggtaccatcggtgttggaggtggcggggacgagcgcttcgcccacacccgtctcctggacttcgcagagctagccgccaccaacacccacccgcataccccctccttcaatgaccgccagtag

SEQ ID NO: 5796 - DNA, 711 bp, Oryza sativa
  Predicted polypeptide sequence is orthologous to G801
atgacgaccaggccagacggcggcggtggcggtggcggcgctccggacaagcagctcgtcccggcctccaacgccaatggcaccgccctcgccgttcgcaagcctccctccaaggaccgccacagcaaggtcgacggccgcggccgccgcatccgcatgcccatcatctgcgccgcccgcgtcttccagctcacccgcgagctcggccacaagtccgacggccagaccatcgagtggctcctccgccaggccgagccctccatcatcgccgccaccggcaccggcaccaccccggcctccttctccacctcctccccttcctccctccgctccaactccacctccaactccaacgacctcctcctcccccgcgccgcccccttcatcctcggcaagcgcctccgtgccgccgacgaccacaccacttcgcccgcgcccgctcccgacgccaccgcccccacccaggccttctgggcgctcccggccagggctgacttcggccagctctggagcttcgccgccgcgccggagatgatggtcgccgccgccgccgcacccgccatgcctggggaggcgtccgccgccagggtcggcaactacctccccatggcgcagggcaacctcaaccttctcgcctccttctccggcggcccaggaggcgccggggccacggcggcgaccggccgacccgaggaggagagcgcccgctga

SEQ ID NO: 5797 - DNA, 1649 bp, Oryza sativa
  Predicted polypeptide sequence is orthologous to G802
ggcacgagtggtgggttgagggcggcggcggcggcggcggagggtgggatggagcagcaggcggcgccgtcgagcagcacgagcacgagcaccaacagcagccggagcacgtccgaccaccacgccgccgccgccgccgccgccgcggcggcggcggcgcaggtggcgcatcagcaccacccgttctactacgccgccgctcagggtggcgcgaataccatgccggcgccggcgtcgttcatggggtcgctggccatagtgcccgctgctgctgctccgggtggtggtggtgggcaggtgcaggcggcggcggctccggtggcgtcgtcggagaagaaagcggtggtggcggcgggggcgggggcgaagcggccgaccaaggaccggcacaccaaggtggaggggcgcgggcggcggatacggatgccggcgctgtgcgcggcgcgggtgttccagctcacgcgggagctcggccacaagacggacggcgagaccatcgagtggctgctgcagcaggcggagccggccatcgtcgccgccaccggcacgggcaccatcccggccaacttctcctccctcgccgtctccctccgctccgccgcctcccactcctcctccccgcgcgccgcgccgttccaccacctccagcagcagcagcagcacgacgtcgccgccatgctcggcttccaccaccaccaccaccagctgctccctcctccgccaccgcaccagcacccggagccgacgccccaagatcccggcgccggcgagttcatgcgtaagcgctacagggaagccgacgacctgttcaaggacacctcacgccaagaccccgtcgatggcgccaccggcgaggccgagcagaaggcccgtgcggccgcagcagcggcggcgccgccgccaaccgccccgtcagcaatgtgggccgtggggccgaacaccaccggagccaccgccgccttctggatgcagccggcatgggcattcccccacggcgccggcgccggcgccgccggtaacacggtgcaggcgccactccagttcatgtcgcgcagcagctttcccacggcgatgaacgtcaccatggcggacaacaacaacagcagcaacaacaacctcggcatgctcgccgcgctcaacgccggcggcggcggccgctccggcgagcaccagcaccagcatgaggggcagtcgccggcggagatggatcatcagcgccgcgccaacggcggcggcggcgaggctggcggcgcggcgagctcgcagtgagctgagctaagctaagctaagctagctaagctgtgatgatgggttaatgggaggtagctgtgcaaatgcaaatgcaaatggcatatgatgatttgattagagagagtacagattagggtgtttggaactgcttgcagctgctctcgttaattaatcatctcaattcatcaatcaatggattgtttgcttctttagtttaccccccttattttttacctgggattattttagtttgctcttttggattaattaattaatcaatgtaaggtgtttgtgatgatgatgatgattagtagtgggtccaattggatcgatcttgagaagcctagctgagtgattaatttaatatgtttcttgttgtcaaaaaaaaaaaaaaaaaa

SEQ ID NO: 5798 - DNA, 4695 bp, Oryza sativa
  Predicted polypeptide sequence is orthologous to G805
tgatcctctacaacctcgtccccgcccaacccctaaaccctagcgccatccccaaccctaaccccgacctctccatcgccgccgccgagcccccctcctccgacggcgccacccctcgccgcgtcaggcccaggaagtccccctcctcctccgaccgccactccaaggtcgccggccgcggccgccgcgtccgcatcccggccatggtggccgcccgcgtcttccagctcacccgcgagctcggccaccgcaccgacggggagaccatcgagtggctactccgccaggccgagccctccatcatcgccgccaccgggacgggcgtcaccccggaggaggcgccccccgccgccgtcgccatcggctcttcctcggtcgccgccgccgccgccgccggcgggcatgggggcgcgttcgtccatgtgccttactacaccgcgctcctcatgcagccgcctaacgcggacgagccccccatggcatccgctgcctccgcctcgggcaccaccgccgccgacgagaacaataattaatttagaactgccgctgttaggtttaggagcttggagcgtgttagggttagggttccccggcttatttaggagaggtctccccctcctcaataatttaacctcattgtccttgtggcggttgcggcggcggcatggatttaggttatttagatgccttattcaggcaagcaaatgagggggtgattcagatggtttcttagagaggagggcagaaaaatggagagctctctgtaagtggtgggtgaggactggagtgagtggtactgatgttctgatgaaacaatgcctgagttattgtgaatgtttagatctgctgatttattctccgtgtgcgctttttatgtgctatagtagatgattccatttggtgtttaccttgactaggaagtaggaacatggtttggttgtgccgcagaaggaacagtcttgggttgtatcatgagaggagcttggaagttggaaacataaccaaattgacttggctgttactgtcagctggttatttttgaatctaaccagaattcagatgcagattaacaaaaaaggttttatttggaaattgcttggaagggttttagtgctcaggacatgtgttctgcggttgcatcttgtcgtattctgaagacgacggttctggattgccaaatacatgcttttattcctactatgcttgttttggacgtcaaataaaatgcatgtgctcttccacaagtggatacacatctcatttggaggattaggtttccttttgttgtaactgtttgctctatttcttgtttattacttttgtttattcttaaatcatgtagaagaactatagttgtagtggttaatgttttttgtctgtttggtttcccttgtcataaaaaattataccttttgtctttgagttgggaaacgactttatatgatgcttaatttatttcattgctttctggacatatttatatcaatagcaatgtgttggtgcattcaacttgctactgaagacctacagtttgttgacctcaatgcttggcatggctgcaaagattcaggtatggtgcttttgctatgctatagtattttctctaaaaattagcttcttcacatgatcttccgaagcattagtcttctgcagaaattaaaataatacagctagccttgtggatgtggaatttagtgatagatttaaaattttcattattctcatatgccatcattttccattttatttagatgtaaatttgcatggattttccccaagaatgcttgatcgtttcacgatttacaggtaacaggctatgtacctttttggaattttataattgttgggcatttaaatgttattgagtaatgttatatgtatactaacaagcaaacatcagatcaaaactgagtcgtgtaaggaaatttttgggttggatgttccagaacatcttgataatccatcaattcttttaaaagcggtacgcggtttcatgtggtcaccacacctcgtagcgcttatgcggcataattggccgcttatgcggtggattggccgcttatgtggcttaagcggtacaaggttggggcacctgttccttgtatgcggccttgtaaatgtttttttagaacactgtaatccactattttgatcagggggctgatatggtaactggatccttgttctaaattagtaccctgtacaatcaatttttgtttattaacgtggaatttttatatccaaagaaggcctcacgcagggctggtgcaccaattttgatgggtagctgaatacccatttattttgtgtctatgttatatcgtgataaaatggagttttgctctattggttcatatattttctgtatctatgtatatagtgaagaaggtgaattttgctctattggttaggccttggatgcatcattctggctgtgggtttgattcccatgctctccagccccatgtcacctttttttcccagtatctcttgttcgcctcaatatctttgtattgtttctctcttccacccggtaagatttgagaaacctgccatattttctcagaaattcatcagttcttttcaaaaacaacctatcattgcataaaaaaacttgcatcttttctactgacgacattaaatcttttatttaaataccaccacataagcttcatatctcctgtgtttgccgctgtgccaccgcttgtcctagcgccatatgctccacgctcctccccttgtgtctttatctttgccccatctactattgtgcacttgggtcttggtcaaacagctcaacatggaatcaatcgactcaagcctagcctatcatgcaacttgtacctctcccctacaatcaggttgttaccacactgccataggcagattgccacctagctgccacacatttccttgccttgcagcctccaacatggctctaatccctgttgagcggtgcagatatgctaattaggtgcatcacaaactgtcatacttgccagttgcttgacaaaatgattgacttcttaaactttgaaccatttgtgcatgtactctgtccttctgttggataaactgtagtgcttgtgagagtgacgtggtaattccatttaacgtcaaaggtggagtctaggggttgtgggatttcatgtcaaaggggagtccagttatcctgccatttcagtatttagcagttcattatttccttttgaccatgctccatgccgatagattatgcaactggggcattaattgaaccatgttacgatttctctatattcagtcgagtgattgcttatattgcacctggtctgatcatgaatgaggttatgaacctgactactgctttccaattgctctttgggatgatatatgaatctatgttctctgaactgcatgctttagattattgcaaacatgttgaccattaagtataaataatgtagagttctcaatttgcagttcattttgatatattttcatttttctatgttctttgcagctgatacttgaaggaaatgcttctgattgttgtgtgtgcaactgtgcatgtcactcatttttcaatttggttaagtctaatcatggattccaggtgtagttccctcttcgcacattcatacctacgcaacatcctgtttctgcatatgtattgccgttaattgttgaaactgcatcataaacaaattttgcactgagaatatttgacttcttacctttgtggagaatgcgtggccagagcatagctcataacaaaatggtaagagtgactaaagtcaattgtcactggttagagcatggactgtttctaagtaagatttctttcttctgtaacatttactggttaacatatctgagttctgtgggtgctcacaagtgagcgtattgtttatgtatattgacatattgtttcacttctagacgataaagaaatcacgaatttgtagataatgtgggccattcctatgggcttctccttttgcatctgcatattacatctttaagtcttcaatatgaacaagaaatgatctttcttgattgggaaaaagtcagttatgtcaggtcactggttatttcttgattgttgaaatggactttgatcatggatcagaacatggtattttctccattgaattctacaggtacagtttcttttccttgttactgaccaatgcacttttgtcatcatctgattagtgttatcatctgaaaaccaatctgtatttcaatgtgttttaatcttcatctgaaacccattgtaccagctctgttccttgaccacaaatccaacttgcagagaagtacactgacctaggatggctcccaagcaaggaccaggaagtatacatctaaaaaataaagcattttttgtgcccaaacatttatggtcttgaacatcttgggtgtgttttgggagtcgttttttagcagcggtagcagctggagcagttcaaagtggctgcagtttgcagcaattttgaactgccgcagcctcagcagctgtggcaggtatggctgctgaacagagcccttattgttcaattatcaccctgtgacaggactttctgaaggcaagcttctgcatctagaatttctattttggtacttatagttcttgcgtgacatttgttctggcacaatgtaccaacaattttgatagtgaataactgagtacaatttaaaagatgaactttc

SEQ ID NO: 5799 - DNA, 1392 bp, Oryza sativa
  Predicted polypeptide sequence is orthologous to G811
atcccgcatttcctccattgcataccaacaccaaccactgaactagcactactagtatagcaagaagggtgatgacgacgacgacggcggagggcggtggcggggtggcgccgttcgtggcgaagacgtaccggatggtggacgacccggccaccgacggcgtcatcgcctggggcagggacagcaacagcttcgtcgtcgccgaccccttcgccttctcccagaccctcctccccgcccacttcaagcactccaacttctccagcttcgtccgccagctcaacacctacgggtttcgcaaggttgatccggacaggtgggagttcgcgcacgtgtcgttcctgcgcggccagacgcacctgctgcgccggatcgtgcgacggagcagcggcggagggggagcgaagaggaaggaggaggccggcggttgcggcggcggaggggaggcggccgccggggacgtcgacgaggagagcgccgtggtggccttggaggtggcgcggctgaggcgggagcagcgggagatcgagggccgcgtcgccgcgatgtggcgccgcgtgcaggagacggagcgccgccccaagcagatgctcgccttcctcgtcaaggtcgtcggcgacccgcaggtgctgcgccgcctcgtcgacagggacaacaccaacgccgccgcctccaacgccgacgactccgccgtgcatcatcaggtcaagaggccgcgcctcctcctcgactcatcctccaccaccaccacccacggcgaccgccacctcgtcaccgccgccgcagacgggttctacgccggcggctgcggcccggaggccgcagctgccgccgcgttcgtgccggacgacgcggtcgacttcaccggcctctacaccggcggcgacgggttcggcaacgccgtcgtcgacgccggcgtcgactacccgccggcgtacgcgttcccggtggtggacagcggctactaaagctgtaaccgctttgagattcgtgctcttgttgccgatccaacgatttgtgtacgcagtagtattttccgtttcagtttgccctccccaaagtgtttggacgaagtggctgtgaacggcgaaagaaggaagctaggtagctctcctagtagccatgttgggttttttcccccttgttgggggtttttggtctcggtgtgtgcctgacttgtgggccagccgggtgtatatgcgcaagcaaaaaaaaataatagtactggtagtatctaagttcaacaaaatttgctccgtttgaacaaaagatttcaaaaactacagaaacaggaaaagcacagtattaggaatcgaatgttggaatcgaatgttgagtgtgccttgtttggatggttatgaaaggaaaaatattttttaaatgtttggtacc

SEQ ID NO: 5800 - DNA, 1573 bp, Oryza sativa
  Predicted polypeptide sequence is orthologous to G811
gtccgtgcgtggctttgccttttgagggatttgacgtgtaggcaaaagctatagctcggagcagtggagtggcttggcttggcttggcttgctgctcggtcgatcgatcgagagatggacgggctgcacacggagctcgcgctggggctgatcgggtgctgcggcggtgacgggcagcagcagacggcgccgttcgtggcgaagacgtaccagatggtgtgcgacccgcggacggacgcgctcgtccggtgggggagggacaacaacagcttcgtcgtcgtcgaccccgccgccttctcgcagctcctcctcccctgcttcttcaagcacggcaacttctccagcttcgttcgccaactcaacacctacggattccggaaggttcaccctgaccggtgggagttcgcgcacgagtcgttcctgcgcggccagacgcacctgctgccgcgcatcgtgcgccgcaagaagcgtggcgagggcggcggtggcggtggcggcgcgtcctgctctttcggtggcggcgccggcgagcaccaggtggctgctgctgcggccagcgtgggaatgtcgggagaggaggaggatgcggcggaggacgtgctggccaaggaggccgcgctgttcgaggaggtgcagaggctgcggcacgagcagacggccatcggggaggagctggcgcggatgagccagcggctgcaggcgacggagcggcggcccgaccagctcatgtccttcctcgccaagctcgccgacgaccccaacgccgtcacgggcctcctcctcgagcaggccgccgagaggaagcgccggcgccagcacctcccttcccacgagcccaccgtctgtcccctcccgccggcgccgccgccacaacctccgcagccgctcctggctctcgccggcgccgcggccatggacggcacctactggtggacgacggagcatcatcatcatcatcatcatcagatgaagcccatgacggtgttgccatccttggagccgcccaccgctagctgcggcgtgcaccaagtgccggagctcgggggtggcggcgtgatgggcttaacgacggacggtgaggccaaggtggagccgccattcccattctgtctacttggtcaagctttcttttaattaacctgccgaatcatgcccatgcacgtagtaattcttccattccacttactgattcagtcactcgatcctacgtacacactgccaagaaaaaaaaaaacagatgttagttctggtgcaatgcatgcagtaacaccagcatcgatcagtacgtgttgatctgattattcttacagggtacagattagattacagacgatggtgtaaaaccttaattactactgtgtacttatgtacaacgcatcaaacaatagtggtacggtgttgattactagtacttttttgattgctagctgatagttaattagtactactattattagtaagtagtgttttcattaggtggatgcatggacatttcttcttgccctccaagtttgtagggttcatgatttcatcaaagtgcttatattaatctctgctgcataacttttgctgg

SEQ ID NO: 5801 - DNA, 1102 bp, Oryza sativa
  Predicted polypeptide sequence is orthologous to G811
ggcgcgctcactccctcccttgcccccaccgacgaacggaacaaatcttagcgaggaaaaagcgagcgcttttttcttatcctgttccgcgggcgcgctgccacgaccgaaccgggaggatacttgcgaattacacgatcggttgtggcactatgatgggcggcgagtgcaaggtccaccagctccaggccgccggcgacgggggcccaggcgccgtcgcgccgttcgtggcgaagacgttccacatggtgagcgacccgtcgacgaacgccgtcgtgcgctggggaggcgccggcaacacgttcctcgtgctcgaccccgccgccttctccgacttcctcctcccctcctacttcaagcaccgcaacttcgccagcttcgtccggcagctcaacacctacggattccgcaaggtggatccggacaggtgggagttcgcgcacgagtcgttcctgcgggggcaggcgcagctgctgccgcggatcgtgcgcaagaagaagaagggcggggcggcgccggggtgcagggagctgtgcgaggaaggggaggaggtgcggggcaccatcgaggcggtgcagcggctgcgggaggagcagaggggcatggaggaggagctccaggccatggaccagaggctgcgcgccgccgagagccgcccgggccagatgatggcgttcctcgccaagctcgccgacgaaccgggcgtcgtgctgcgcgccatgctcgccaagaaggaggagctggccgcggccggcaacaacgggtccgatccctgcaagaggcggcggatcggggccgacacggggcgcggcggcgtggcgaccggcggcgacgcggccgagatggcgcagagcagaggcaccgtgccgttcccgttctctgttcttggccaagtgttctactagccgcaacagggccagataggtgtacacgtacgcagtcccccgttgtatatataacaacagtgtaacttcgcctcggtttagttgcctactgttaagttagtgtacttaagcataataggagagtttggctaagtagctatcgttggatttgtgtgtatatatcgactatcgaggggctaataacgcctattttgttc

SEQ ID NO: 5802 - DNA, 412 bp, Oryza sativa
  misc_feature (405)..(405): n is a, c, g, or t
  Predicted polypeptide sequence is orthologous to G811
gatcgcttttgctgtactttgccttccgcttttcttcccctctcccttaccacatttaggagcccgcccccccccccccccatcacatatctccatctcgatccgcaacaaagatagtttgtagcggagatggcggcggcggcgggaggaggggcggcgccgttcgtgtggaagacgtacaggatggtggaggaccccgggacggacggggtgatcgggtgggggaaagggaacaacagcttcgtcgtcgccgaccccttcgtcttctcccagaccctgctccccgcccacttcaagcacaacaacttctccagcttcgtccgccagctcaacacctatgtcagtctcgtcactcccagttctatttcatcgtctcatcatactccccccctctctgcacttcanatcatgc

SEQ ID NO: 5803 - DNA, 3215 bp, Oryza sativa
  Predicted polypeptide sequence is orthologous to G812, G2467
attccattcgacaaactcgacatcgcgctgcgacgctccggccgacgcaacgcaccgctacaaacgcattctcgagtccacctgtgctcacctcggtcgttcctacaccgactcggtcgactcgtcaatgtgcgcggctttggccagcattcgctcttttcacctctcgtgagcttcggcattggccgagcatcatatcgctccttctttgcaacgcaaccaaatccttccatcggccacggccggtcaacgtctcagctgcaattcagccttcgcctcgtccggtcctcggcaagtccgaaccaagaatcggctcgattccgcacaggtgcttccgcctacatcgcttcgccttgctccatccttacgcctcgtaagcttctcttcgccctcttccgtgcgtgtcgaagacgagtgtcgattgctcgctcgaactcgtctgcacccatccttttccaacgtgacaatcgcccggtaaggccgaacgacaatctcacgcacaacgccgaaaagatcgctgtcgacagctcctgcacccgcacttgccctctgcgcagcatcttctggcctgttgccggagcaggaacgtagcgctcaagcaggccgtcacgcccatcattgatacccttggtgcgccaccgacgctcgccactcgcagctccaggacgccgttcggttgcctctgtggtccgcctttgctcaacatgaacggcatggaacacggtcaaagctttgaccccgcctttgatgccttctttcaggctccgtcctcatcctctccacatcaccaacttcagcattccgccgccggctcgcctgcgtccatccagcagatcggcaacatgagcgcagccgactcttcgctcagtctgtacgctcaagacacctcggcgatgcgcccgagctcctcgtcgggcggcaatctccatctcaacatctccaacctctcggtcacgggcggtgaagccgacgcctcacacgcacaggcacaccagcagcagggcgtcgccagctcgctcagtttcgcgcctaacaacacggcctcacctcagtccaccctcgcgtcaccggccgatgccactgcttcattcaacatgcccagcaccacatcaacctcgccgctcttgcatcctgatgcaccggtgggcacagccacagaagcccacctcggcgttcctaccgcatcgtctcctctcaagaccgagtacaacctcggaaacgagtcggctggcctgacgtcgacgatgcgctcctacagctctacttcgatcaaaagcgccgcgggatcgcagaatgccgacagcccaagctccggcttcggtgccggcggcgcggcaaatcagagcatgggtgacgtctcgatcgatgatgccaatgtcgctagccagtcggaagccgagctggcggccgagaaacgccaaagcagcaaatttgtctacaagctcttccgcatggtcagcgaccccgactaccagcatctcatcagctggaaccgcaacggcaccagcgtcatggtgtgcaactttgacgagttcgccaaggaggtgctgggcaagcactttaagcacagcaacttttccagctttatccgacagctgaacatgtacggcttctacaaggtgaacaagacgcctcgcggccatcgacagtcggtggacgcgcagatctgggagttctcgcatcccaagttcctgcgcggccgttcggatttgctcgatgacatccgtaggaaggccctggactctgaacacgcgcgggtcgaagctcgcgatctgcagtacagcgtcagtgtggggcagatgcagctgcgtcagcaggtcgacgagatgcaattccggctcgaggagctcacagagcagaacatggcgctgcgaacctttacaacccaactccgagacgtgcttggcctggtgctcgagcacgtcaaaaagacgagcggcggcaacattggtttcgacgtgcgcatccccacgctggacctgccctcgcccatgccgccgcaaggcctgtggacgccgcagggtcacgatggcccgcctatctttgtcaccgagcccgagttcggcgctggtgtcggaccgggtgggctgaggatgggcccgacgcctggcatggtgcctgggccgggccacgctccgccaccgatgcatgcaccccaacaccactttggcggtgcgccggatgggttcgccatgacgggcacgcccatctcgcgtcgcgtgtcggcgagctcggcgcatagcgagagcatgcttgccatgaacggctcgcccatgcacggatcgatgcagggtgagatgggcatgctgcctgctggtctgccgcagcgctcggcttctttcggcgagggacagatgcctgcaccccacttcaatatcggccgcggcggcgtcaaccgaccgggcctggcggggctcgcaattgacacttcggctgcatctggcatgtttggcggcatgcatccgagcgtgagcccgacatcagcagggctatcggcaagcaatgcagggctgggcgtgatgagcatgccgccgtcgccgctgacgccacagcatcaagcgatgatggcagcgatcaacactccgctgcctccgtcgccggcgccggggtcattggcgggtggccagttcaagccgttcgatggctcgccgttcgtgaccaataacggattcccctcgtacggccatggtctttctcttgccgaccagagcttctttgggccggaggccgatggtcccaatgccaaggcgatgcgcacgcccatgaagcacacggcgtccaattctgggcctagcgcgcagggcacgccagtgctcatgcagtcaacgtcgcccgggcttgccaagcgcaagtcgccaatctgaacgcgatgtcttctttgatacccgggtggctggcgcacgtcgtcgccatcccagtgattctccccttcgtttgtctccacaatcctttcccctcaaggacatcccctgaacccaacttctcttcttccctctccacgattgtgcctacgctggcatttcccaccatcttggccgactgtggctttcccctcagcactgctggcacagtgtgcagcggggctagtgtcgggagagtctgaccacgctcgttttttcgatttgatcccccctctgtctctccgccttgcggcctgtacaagttcggactctcgtcgtcgtttaatgcccgaagtcaccttctgtacctttttt

SEQ ID NO: 5804 - DNA, 1701 bp, Oryza sativa
  Predicted polypeptide sequence is orthologous to G831, G1202
atgccgaacgccggcgccgccaggaggtgcggcagggccacgcacgtcgacctgctcaccgtcgtcctcgccgcgatgctctgctgggcgtcctacaccctgtcgatctggcacaacagccgcggcgccgcggacagcagcgtgctcggcctcgtcgtcggcgccacggtctgcggcgacgccgacgaggagctcgacttcgaggcgcgccacgccgccgacgacgccggcctgtccgtgtcctcgggcccggcgaactcgagagtgcggcgggcgttgagctcgtcggggccagcgcccgccgcggcggggacgacggtgagccggtaccgcgccccgttcccgtggccggcgagccgcggcgtggtttgggcggggaactcggcccgcggcgccaaggccgccgccgacgccgccgccgccgccaacaagtgggcgcgcgtcgacggcgacatgctccggttcaccgacgccgccgccgtccgcgcgtacgcctacgtcgtgctccggctagtcgccgcgcccgtgcgcgccgccgtcgacgtcggggccatgcatggagggagctgggcggcggagctgatgtcccgcggcgtggtcaccgtgtccgtggcggcgccatggggcgcgtccgatggcgcggcgctcgtcgagctcgcgctggagagaggcgtcccggccgtgctcgccgccgcggggggcgcgcccagccgccggctcccgttcccggccggcgcgttcgacatggcgcactgcggtcgctgcctcgtgccgtggcatctccatggtaaacattttccatcctcgcgcacacggcgggcggttcttgatggagatcgaccgcgtgctccggccaggcggctactgggtccactcggcgcgccggcgaacggcacgcatgagcgcgccgccatcgaggccgccgcggcgagcatgtgctggaggagcgtcgcggaccagaacggcttcaccgtgtggcagaagccggtgggccacgtcggctgcgacgccggcgaaaactctccccggttctgcgccggccaaaacaagaagttcaaatgggacagcgacgtcgagccgtgcatcacgccgatccaagaaggcgcggcgccgccacgggaagcctcggcggcggaggcgctccgtcgcgacagcgagacgtggacgcggagggtggcgcggtacaaggcggtggccacccagctggggcagaagggcaggctccgcaacctgctcgacatgaacgcccgccgcggcgggttcgccgcggcgctggccgacgaccccgtctgggtcatgagcgtcgtcccggcgaccggcggcggcgacacggacacggacacgctcccggcgatctacgaccgcggcctcatcggcgcctaccatgactggtgtgagccattgccgactcccgccttgagctacgacctcctacacgccgactccctcttcaccatgtacagagacaggtgcgacatggaggatatcctgctggagatggacaggatcctgcggcccgggcgcgccgtgatcatccgcgacgacatcgccattttagcaaggatcaagaacttcttaactgatcggatgaggtgggattgccagattttcgacggcgaggatggctcggacgatcgtgagaagatcctgtttgcagcgaagacgtgctgtaacgatgaggatcgagatcaggagcaatga

SEQ ID NO: 5805 - DNA, 2679 bp, Oryza sativa
  Predicted polypeptide sequence is orthologous to G839, G1196
ccccccttcgtcctcgtcgtcttcctcccatttttttttcctcctcctcctcctctcatccctcgccgcgagccaaagcccctggtttcctcgcaactgcctccccgcgattccgtttgacccccactgttcttctcccctaccaccaccaggtcgcagtcgcttccaatttccaaataattccctccactccggccgctcgcgaggaaagaaaaggatttctttttctctctctctctctctccctctctccgagatccgtttcccaaacaggcggggggtcgaaagtgtttggtactttggtttggggaggcttgtttgccgacgcggatctgcgtggagacgagcagaggggggagcgccggaattgggtggtttggcccgggaggcgccggaaagtgggggagcctttggattccccgaacccgccatggtgatccggcacgagtagtagtggtggtggtggtattagtagcagtgagatgccggcgcgtagcgcggtggtggtaatagccatggagccctcgtcgtccatcaccatcgcgtcgtcgtcctcgtacctctcgaacgggtctagcccgtgctcggtctctcttgcgccgccgggggcaggggcggtggcggcgcaggcggcgccggttgccgccggggagggcggcggcggcggaggaggaggaggaggaggagggagtagtagcgtggaggtggtgagcctgaatcggcttagcgctaacctcgagcggctcctcctcgattccgacctcgactgcagcgacgccgacgtcgacgtggccgacggtggcccgcccgtgccagtccaccgctgcatcctcgccgcccgcagcaccttcttctacaacctcttcgcggcgcgcggccgcggcggcgatggggctgccggcggcggcggcggcggcggtggtgggggaggggagaggactggggggaggccgcggtacaagatggaggagctcgtgccgggaggccgcgtggggcgcgatgccttcctgtcgctgctgggttacctgtacacgggcaagctccggccggcgccggatgacgtggtgtcctgcgccgaccccatgtgcccgcacgactcgtgcccgccggcgatcaggttcaacgtcgagcaaatgtacgcggcgtgggcgttcaagatcaccgagctcatctcgctgttccagcgacggcttcttaacttcgtcgataagactctagtagaagatgttcttccaattctgcaagttgcttttcattcagagctgactccagtgcttgaaaaatgtattcggagaattgcaagatcaaatcttgataatgtatcgttggataaggaacttcctccagaagttgctgttcagataaaagagattcgccaaaaatctcagccaaatgagggtgacaccgtcatttcagaccctgtacatgagaaaagggtcagaagaatccacagggcactggattctgatgatgttgagcttgtgaagttgcttcttaacgaatctgagatcaccttggatgatgccaatgcattgcactatgctgctgcttactgtgattcgaaagttgtttcggagttgttagacttgagacttgccaacttgaatttgaagaattcgcgtggatacacggcactccatctggctgctatgaggagagagccagctattatcatgtgtctcctaaacaaaggagcagctgtatcacaattgactgctgatggccagagtgcaatgagtatctgccggaggttaacaaggatgaaagactacaatacaaagatggagcaaggccaagagtcaaacaaagacagattatgtattgatatattagatagggagatgataaggaaacctatggcagtggaagattctgtcacctcgcctttgttggctgacgatcttcacatgaagcttctctaccttgaaaacagagttgcatttgcaagattattttttcctgcagaagcaaaggttgcaatgcaaattgcacaagcagacaccacaccagaatttggcattgttcctgcagctagcacttctggaaaattgaaggaagtcgatctgaacgagacaccagtaacacaaaacaaaaggctccgttcaagggtggatgcactcatgaaaacagttgagctgggacgtcgctacttccctaactgctcgcaggtgctcgacaaatttctggaggatgatttgcccgatagtcctgatgcactcgacctccaaaatggcacttctgatgagcaaaatgttaaaaggatgcggttctgtgagttaaaggaggatgtgcgcaaggcattcagcaaagacagagctgataatagcatgttttctatcttgtcatcttcatcgtcatcttcgccacctcccaaggttgcaaagaaatgacagaagttttgtaacaaatttccgctcgtgatgttactgggacaagagatatcgatcaatagacctgtatagtcttacagtggtataacaattagatatcgaagcttcttcgaatattagaaagtgctgttctgggctgcactcagctggtttatgggacccatgcggtgaaactggcaaaagaaaaccagctgattagaggctccaaagcagtgtctctcgtgaatatgtttgtagcattctgttttgttcaggatggctataatgataaaatcttttcaatagatat

SEQ ID NO: 5806 - DNA, 3746 bp, Oryza sativa
  Predicted polypeptide sequence is orthologous to G839, G1196
gagcgagagaaaaatacacgcgcgaaatttccggataagagcagcgccggcggcggatgtaggcagcgtttgctgttgctgtttttttccctttttttccgtctcgttttgctcccacttcgctgctcccggatccgcgtagggttcttgtgtcgtgtggtggggttatgacccgcggcgctgctctgctttgctcgatttgctgtgcttgccttggaggtcgcctgcttggctgcttttgagagtgagtgtgtgtgtgtgtgtgttttttttttatacctcttttctttttctgggagaatttcccgttcttgggtttggtcttttttgcgaacctttgaaccctttcttgttggattctggggggaagtttatttatgcttaatttggcggttcttgttttgtttcggggagtttagaaaattttcgaggctttgattcgttttgattttgggtggggggaatctcgtcgtgcgaaaggattcgatcgggagagcctaccggagtttggattctcgcgtgcaccaccgcgtgaattatgaggggagaagtgagcttctagctagcatctagaaccttctagactctcctcgccatggagacgtccaccataagcttctcctcctcgtcgccgccgtcccctccgccgccgcagccggctccgggcgacatcgacgccgtcagcctcggccgcctcagcaggaacctcgagaacctcctcgaccccgcctttctcaactgcgccgacgccgagatcgtcctcgcctccggaggcggcgaccccggcggcggcgccgtcgtgggcgtccaccgctgcatcctcgccgccaggagccgcttcttctacgaccacttctcctccgcccccgcccccgcccccgccaccgccggcgacaagccgcagctggacctcgacgggctggtccccggcgggcgccacatcggccgagacgccctcgtcgccgttctcagctacctgtacaccggccgcctcaggtcggcgccccccgaggccgccgcctgcctggacgacggctgcagccacgacgcgtgccgcccggcgatcgacttcgtcgtcgagtccacgtacgccgcctccggcttccagatctccgagctcgtctccctcttccagcgccgattatctgattttgtgaacaaagctttggctgaggacatactgccaattcttgtggttgcctccacctgccatcttccagagctgctaaatcaatgtatccagagggttgccaactcgaacctggacaatcgttacctcgagaagcggcttccggatgatctgtacgccaagctgaaggagtttcgcgtgcctgatgaaccacacagtggcattcttgaccctgagcatgagaagagggtcagaaacatccacaaggccttggattccgatgatgtcgatcttgttggcatgcttctgaaggagtccccggtcaccttggatgatgcattcgccatacactacgctgcggcctactgtgagccaaaagtgttagcagaattgctgaaactggaatctgcaaatgtgaacctgaagaactcaagtggatacacgccgctccacatggcttgcatgaggcgagaaccggatatcattgtttcgcttatagaaaagggggcctctgttctggaaaggacacaggatggacgtgatgctcttaccatctgcaagagattaacaagggagaaagaccgcaacgagaaatcagaaaaatgcaaggagagaagcaaggcttacttgtgcattggcgtcttacagcaagaaataaagaggagaccacaaattttggaggaccagatgtctgcagaggagtcaattgctacacctctgctggttgataattttcacatgaggctactaaacttggagaatagagttgcctttgcaagaatatttttcccttcggaagccaaacttgtgatgcgcatagcacaagctgactcaactcaagagtttgctggtctcacatctgctaatttcagtaaacttaaggaggttgacctaaatgagacccccacaatgcaaaacaggaggttgcgagaacgccttgatgctttgacaaaaacagttgaactcggacgacgatacttcccacattgttcagaagttctcgacaagttcctgaatgaagaatccaccgatttgatcttgcttgaaagtggcacagcagaggaccagcaaaccaagaggatgcgcttttctgaactcagagaggatgtacggaaggcctttaccaaagataaggcagccggcgctgcaatatcttcctcaacatctgcgtcttcatcaccaagttgatttgatccaagatgagtcgacctcgctcctcgtttcaacagctcgtggatgaatcatcgtctgacgatgacgatgattttttttttgccacggcacaaatcgtccatagctattggcactctgtcaatgcaccaagacatggtgggtcagtcatgggacatgaagtgattgatcgcaacagagaagcacggcacttgagattataccaagactacttttctgataatcctacctatggcccagttttattcaggcgcaggaatagaatgagcaggcctctgtttcttcgcataatgaatgcagtagaggatcacgatgactattttgtgcagaagagaaatgcagctggtttaattgggttcagttgtcatcaaaaggtcactgcagcaatgcgtcagttggcttatggtatagcagcagatgctttggatgaatatctcggtattgcagaaagtaccgctatagagagcctgagaaggtttgtgaaagcagttgtacaagtttttgaacatgaatacttaagatcacccaatgagaacgatacaactcgattacttgaacttggggaggacagaggtttccccggtatgttaggctccatagattgcatgcattggaagtggaagaactgccctacagaattgcacggtatgtaccaagggcacgtgcacgagcctacaataattttagaagccgttgcttcaaaggatctctggatttggcacgctttttttggtatgcctgggtctcataacgatatcaatgtacttcatcgatccccgctatttgcaaagctagctgaaggcaaggctcctgaagtgaactatagtataaatagacacgattatatgatgggatattatcttgctgatggcatatatccttcttgggccacatttgtgaagaccataccagaaccacatggcaacaagaggaaatattttgccaaagcacaggaagcagtaaggaaggacgtcgaacgagcttttggggttctgcaagctcgatttgccattgttcgagggccagctcgacattgggatgaaaagactctgggatacatcatgaaagcttgtgttatcatgcataacatgattattgaagatgagggagaagttgattgggaagaacggttcccagagggaggagaaaatgtcagagtgtcccacgatgaaatacctgatcttgatgattttatccaaatgcacaaaaaaataagggacgacgaaactcactatcagctacgtgaagacctagtggagcacttgtggcaacattatccggataaatattgaggttttatttatatgtttgaattccatgtaataaataatatacatatgtgaggatttgccaaatcatcttaatttgtttttcatgaattgaataaatggtgtactgttcggtttaagaatagtacaggagaatt

SEQ ID NO: 5807 - DNA, 3746 bp, Oryza sativa
  Predicted polypeptide sequence is orthologous to G839, G1196
tagcgagagaaaaatacacgcgcgaaatttccggataagagcagcgccggcggcggatgtaggcagcgtttgctgttgctgtttttttccctttttttccgtctcgttttgctcccacttcgctgctcccggatccgcgtagggttcttgtgtcgtgtggtggggttatgacccgcggcgctgctctgctttgctcgatttgctgtgcttgccttggaggtcgcctgcttggctgcttttgagagtgagtgtgtgtgtgtgtgtgttttttttttatacctcttttctttttctgggagaatttcccgttcttgggtttggtcttttttgcgaacctttgaaccctttcttgttggattctggggggaagtttatttatgcttaatttggcggttcttgttttgtttcggggagtttagaaaattttcgaggctttgattcgttttgattttgggtggggggaatctcgtcgtgcgaaaggattcgatcgggagagcctaccggagtttggattctcgcgtgcaccaccgcgagaattatgaggggagaagtgagcttctagctagcatctagaaccttctagactctcctcgccatggagacgtccaccataagcttctcctcctcgtcgccgccgtcccctccgccgccgcagccggctccgggcgacatcgacgccgtcagcctcggccgcctcagcaggaacctcgagaacctcctcgaccccgcctttctcaactgcgccgacgccgagatcgtcctcgcctccggaggcggcgaccccggcggcggcgccgtcgtgggcgtccaccgctgcatcctcgccgccaggagccgcttcttctacgaccacttctcctccgcccccgcccccgcccccgccaccgccggcgacaagccgcagctggacctcgacgggctggtccccggcgggcgccacatcggccgagacgccctcgtcgccgttctcagctacctgtacaccggccgcctcaggtcggcgccccccgaggccgccgcctgcctggacgacggctgcagccacgacgcgtgccgcccggcgatcgacttcgtcgtcgagtccacgtacgccgcctccggcttccagatctccgagctcgtctccctcttccagcgccgattatctgattttgtgaacaaagctttggctgaggacatactgccaattcttgtggttgcctccacctgccatcttccagagctgctaaatcaatgtatccagagggttgccaactcgaacctggacaatcgttacctcgagaagcggcttccggatgatctgtacgccaagctgaaggagtttcgcgtgcctgatgaaccacacagtggcattcttgaccctgagcatgagaagagggtcagaaacatccacaaggccttggattccgatgatgtcgatcttgttggcatgcttctgaaggagtccccggtcaccttggatgatgcattcgccatacactacgctgcggcctactgtgagccaaaagtgttagcagaattgctgaaactggaatctgcaaatgtgaacctgaagaactcaagtggatacacgccgctccacatggcttgcatgaggcgagaaccggatatcattgtttcgcttatagaaaagggggcctctgttctggaaaggacacaggatggacgtgatgctcttaccatctgcaagagattaacaagggagaaagaccgcaacgagaaatcagaaaaatgcaaggagagaagcaaggcttacttgtgcattggcgtcttacagcaagaaataaagaggagaccacaaattttggaggaccagatgtctgcagaggagtcaattgctacacctctgctggttgataattttcacatgaggctactaaacttggagaatagagttgcctttgcaagaatatttttcccttcggaagccaaacttgtgatgcgcatagcacaagctgactcaactcaagagtttgctggtctcacatctgctaatttcagtaaacttaaggaggttgacctaaatgagacccccacaatgcaaaacaggaggttgcgagaacgccttgatgctttgacaaaaacagttgaactcggacgacgatacttcccacattgttcagaagttctcgacaagttcctgaatgaagaatccaccgatttgatcttgcttgaaagtggcacagcagaggaccagcaaaccaagaggatgcgcttttctgaactcagagaggatgtacggaaggcctttaccaaagataaggcagccggcgctgcaatatcttcctcaacatctgcgtcttcatcaccaagttgatttgatccaagatgagtcgacctcgctcctcgtttcaacagctcgtggatgaatcatcgtctgacgatgacgatgattttttttttgccacggcacaaatcgtccatagctattggcactctgtcaatgcaccaagacatggtgggtcagtcatgggacatgaagtgattgatcgcaacagagaagcacggcacttgagattataccaagactacttttctgataatcctacctatggcccagttttattcaggcgcaggaatagaatgagcaggcctctgtttcttcgcataatgaatgcagtagaggatcacgatgactattttgtgcagaagagaaatgcagctggtttaattgggttcagttgtcatcaaaaggtcactgcagcaatgcgtcagttggcttatggtatagcagcagatgctttggatgaatatctcggtattgcagaaagtaccgctatagagagcctgagaaggtttgtgaaagcagttgtacaagtttttgaacatgaatacttaagatcacccaatgagaacgatacaactcgattacttgaacttggggaggacagaggtttccccggtatgttaggctccatagattgcatgcattggaagtggaagaactgccctacagaattgcacggtatgtaccaagggcacgtgcacgagcctacaataattttagaagccgttgcttcaaaggatctctggatttggcacgctttttttggtatgcctgggtctcataacgatatcaatgtacttcatcgatccccgctatttgcaaagctagctgaaggcaaggctcctgaagtgaactatagtataaatagacacgattatatgatgggatattatcttgctgatggcatatatccttcttgggccacatttgtgaagaccataccagaaccacatggcaacaagaggaaatattttgccaaagcacaggaagcagtaaggaaggacgtcgaacgagcttttggggttctgcaagctcgatttgccattgttcgagggccagctcgacattgggatgaaaagactctgggatacatcatgaaagcttgtgttatcatgcataacatgattattgaagatgagggagaagttgattgggaagaacggttcccagagggaggagaaaatgtcagagtgtcccacgatgaaatacctgatcttgatgattttatccaaatgcacaaaaaaataagggacgacgaaactcactatcagctacgtgaagacctagtggagcacttgtggcaacattatccggataaatattgaggttttatttatatgtttgaattccatgtaataaataatatacatatgtgaggatttgccaaatcatcttaatttgtttttcatgaattgaataaatggtgtactgttcggtttaagaatagtacaggagaatt

SEQ ID NO: 5808 - DNA, 845 bp, Oryza sativa
  Predicted polypeptide sequence is orthologous to G846
cgacttgctctgtgctttgggtggttgttttctcttattaccagcagaagattcttcaccattcttctgatcagtgtcatcatcggcgttctgtttaggcacttcattggccacaattgtgtatgtagtgataacaacatcatattttgccaactcatttggatctttggtccttgagccaccatgatagaccaaaacagacaatttagcactttcaccaaccttgtcagtcaattcgttcgcccattgcttaagaacactagctgggcacaccactagagtacctgcagcaggccttgtcatggattgcatagtaaatgatgtgcttgccttactcttcttcttacgttcaacatttctttcaaccgtcttatctggagcagtattcattaggctagcacatgtttcaacgtcaccagtaccagctgctgttgatgacgaaccagctcctagatccttcctgggttcatcattcttagtctgctcccccttattatccgcaacaggcgctgcctcatcgtcatcatcaaggtttagcgcttcagcttttaaacgatctgaatcaacagacataaacttagactgctggatcctctgtttctgtataagggcaattgtagacactgttttgccaagaccctgatcatctgcaagaattccacctgcacaatgagagctattctccttcgaaaccatccaagccaatgccattttctggtgcctaagcagaggtactgacagaacaccctcaggcagatcatcttcccttttatcctggataatattctgtagtgcttcctggtacaccgctctctcgtcagaatctataatcctattttccaggt

SEQ ID NO: 5809 - DNA, 4155 bp, Oryza sativa
  Predicted polypeptide sequence is orthologous to G846
ggtgggagttttttttttcctcgcgtgtaatttttggcggtgttggatcgggttatgggggatagctgggaggttagcgaggtttggggtgtgtggttgggatgggagattggttgatcccgtcgattaggggtgtcccgcggcgagatttggtcccgttgcgcatttctgtttttctttttttgaaatgacctgattaattcaatccagttcgtagggtgtagctctctgtctggatcagattaggctttagtttatccatgtgtgattgcttcctagatttgaactggtcgggagtgtaccatgtgaatactgctttcgtatgaactgtgcggttactaacttccattcctaattaatatgactaatttttagggaagaaatgacttggtacctatgctagtatttttttcccctcatggataatgcttgataacgactttgagaagggcaaataaattcctaaaaaatgtttagcgttgctgttttttttttctttagtgttttctcacagttcaatatttactcatctacaccattatttgatccaccttgcaggttaagtcagcatagctaataactccgtctactgttgtgacctctgtggtttgctttgtgtgtttggcttcccaatcatctgcataaaccaggaagtgggtttgctttggaaatatttggggtcaaactagtagttggcacattgtgatctgatcatgtttatgcacagtttgtactgctaagcacaattggagttctgactatacagatgctgtgcgcatgcttgctggcaatatgaacaacgataactatattgacttgagttcagacagtgatatagattttgacttcgactcagatgattcagttggtggtttggaccaggagctagcttcatcttcttctaggcctactgaaaatataaatggtcaatataggactctgccaccttcttttacaaatggtagacatgttgataacgctcgtcatgcgttaggttcaggtgacagagcttatccgcattcaagttcttatagggggtcaccaaatgattctgcaagggcaactcctgcttccaacagaactgatattgtagtcaagaagcacaatggttttgcatcggaagaaaatgataatggcaagaggattcttccctcatccttttcaaatggccgcacaacaaatgctatgcatccagtggttgcaagtgagacacgcaaattcccaccatcttttaccaatggaaattcacaaagattggctgaaaataggatgggaaaaaatgttgccaatggaattggggagccttcatcgtcaaggtttccgagccgaagttcttttggtactgacaacaagagggtcatcacagacagtgacaatgaggatgtctatgtatatggaagctccagttcacatagggttcttcctccatcttttggtcgcaatagttctgctaatcacagcgaatttgctaatggcattgatatgcaaggtcgtctgaacctggaaaataggattatagattctgacgagagagcggtgtaccaggaagcactacagaatattatccaggataaaagggaagatgatctgcctgagggtgttctgtcagtacctctgcttaggcaccagaaaatggcattggcttggatggtttcgaaggagaatagctctcattgtgcaggtggaattcttgcagatgatcagggtcttggcaaaacagtgtctacaattgcccttatacagaaacagaggatccagcagtctaagtttatgtctgttgattcagatcgtttaaaagctgaagcgctaaaccttgatgatgacgatgaggcagcgcctgttgcggataataagggggagcagactaagaatgatgaacccaggaaggatctaggagctggttcgtcatcaacagcagctggtactggtgacgttgaaacatgtgctagcctaatgaatactgctccagataagacggttgaaagaaatgttgaacgtaagaagaagagtaaggcaagcacatcatctactatgcaatccatgacaaggcctgctgcaggtactctagtggtgtgcccagctagtgttcttaagcaatgggcgaacgaattgactgacaaggttggtgaaagtgctaaattgtctgttttggtctatcatggtggctcaaggaccaaagatccaaatgagttggcaaaatatgatgttgttatcactacatacacaattgtggccaatgaagtgcctaaacagaatgccgatgatgacactgatcagaagaatggtgaagaatcttctgctggtaataagagaaaacaaccacccaaagcacagagcaagtcgaagaaaaagaaaaagaaacttaaggattcagacatttaccttgccagtggcccagttgcaagagtgcgatggtttagggttgtccttgatgaagctcagacaataaagaactttcgaactcaagtggctaaagcctgttgtggattacgtgcaaaaagaagatggtgcttatcaggaacacctatacaaaatgcaattgatgagctctacagctatttccatttcttgaaatacgatccatattctacttataattcattttgtacaatgataaagcacccgattgctagaaatgcagttcatgggtataagaaacttcagactgtgttgaggatagttctcctgcgccgcacaaaagaaactctgattgatggtgagccaatcataaagctacctccaaagacaattaatctggataaagtagattttacaaaagaggagcgagctttctatttgacactggaagaacgctcgcggcaacagttcaaggcatacgctgctgctggtacactcaaacagaactatgccaacattcttctaatgctgttgcgccttaggcaggcctgcgatcatcctcttcttgtgaaggggcatcagtcagagtataaaggcgatggttctatagaaatggcaaagcaacttcctaaagaaatgataataaatttgcttgcaaagctggaagttggagagttttgttctgtatgcagtgatgtacctgaggatgccgtcgtgacgatgtgtggccatgtcttctgctatcaatgtatatacgagcggataactactgatgagaatatgtgtcccttccctaattgtggaaacacattaagtaccgattcagtattttcgtcaggagcgttaaggatttgcatgtctggtgtatccagttctcatgcatcagggagttcatcattagatgacgagtcatcttctattagtcaaactagttacatatcctcaaagatacaggcggcaatcgatatactgaattcgatcattaacacctatgcccttaccgacagtgataccgtcgaatcaaatcctagccgagtggccccagtgaaagccattgtgttctcccagtggactggcatgctggatttgctggagctttcattgaatagcaatctcatacagtacaggagactagatggaacaatgtccctcaattcaagagataaagcagtgaaagattttaacacagacccagaggtcagggttatgatcatgtcactgaaagcaggtaatcttggtctcaatatggttgctgcttgccatgtaattctccttgatctttggtggaatccttatgctgaggaccaggcaattgatagagcacacagaattggtcagactcgtcctgttactgtctcccgtttaaccattaaagatacggtggaagatcgcattttagctctgcaggaggaaaagagagccatggttagctctgcttttggcgaagacaaatcgggtggccacgcgactcggctcaccgtggatgatctgaagtatctatttaggttttgattggaagcacccgtgatctctgcgatacaatgacattgtatagtagcctgtgatctttgcctagatgcaactccaacagctgtgtaccgctgctgagtattttggtgcgaggtactgcggatttgtgtccttccatggctcgcagcagctccagttttgtcatgctctgatttgctagacgaaatgtagtaggcttagtcgctagcctgtgttgaatatttgaccccagcttgtaggagaattctgccattgctccctgttttatcaagagatccatctggtggt

SEQ ID NO: 5810 - DNA, 4156 bp, Oryza sativa
  Predicted polypeptide sequence is orthologous to G846
gtgtgggagttttttttttcctcgcgtgtaatttttggcggtgttggatcgggttatgggggatagctgggaggttagcgaggtttggggtgtgtggttgggatgggagattggttgatcccgtcgattaggggtgtcccgcggcgagatttggtcccgttgcgcatttctgtttttctttttttgaaatgacctgattaattcaatccagttcgtagggtgtagctctctgtctggatcagattaggctttagtttatccatgtgtgattgcttcctagatttgaactggtcgggagtgtaccatgtgaatactgctttcgtatgaactgtgcggttactaacttccattcctaattaatatgactaatttttagggaagaaatgacttggtacctatgctagtatttttttcccctcatggataatgcttgataacgactttgagaagggcaaataaattcctaaaaaatgtttagcgttgctgttttttttttctttagtgttttctcacagttcaatatttactcatctacaccattatttgatccaccttgcaggttaagtcagcatagctaataactccgtctactgttgtgacctctgtggtttgctttgtgtgtttggcttcccaatcatctgcataaaccaggaagtgggtttgctttggaaatatttggggtcaaactagtagttggcacattgtgatctgatcatgtttatgcacagtttgtactgctaagcacaattggagttctgactatacagatgctgtgcgcatgcttgctggcaatatgaacaacgataactatattgacttgagttcagacagtgatatagattttgacttcgactcagatgattcagttggtggtttggaccaggagctagcttcatcttcttctaggcctactgaaaatataaatggtcaatatagaactctgccaccttcttttacaaatggtagacatgttgataacgctcgtcatgcgttaggttcaggtgacagagcttatccgcattcaagttcttatagggggtcaccaaatgattctgcaagggcaactcctgcttccaacagaactgatattgtagtcaagaagcacaatggttttgcatcggaagaaaatgataatggcaagaggattcttccctcatccttttcaaatggccgcacaacaaatgctatgcatccagtggttgcaagtgagacacgcaaattcccaccatcttttaccaatggaaattcacaaagattggctgaaaataggatgggaaaaaatgttgccaatggaattggggagccttcatcgtcaaggtttccgagccgaagttcttttggtactgacaacaagaaggtcatcacagacagtgacaatgaggatgtctatgtatatggaagctccagttcacatagggttcttcctccatcttttggtcgcaatagttctgctaatcacagcgaatttgctaatggcattgatatgcaaggtcgtctgaacctggaaaataggattatagattctgacgagagagcggtgtaccaggaagcactacagaatattatccaggataaaagggaagatgatctgcctgagggtgttctgtcagtacctctgcttaggcaccagaaaatggcattggcttggatggtttcgaaggagaatagctctcattgtgcaggtggaattcttgcagatgatcagggtcttggcaaaacagtgtctacaattgcccttatacagaaacagaggatccagcagtctaagtttatgtctgttgattcagatcgtttaaaagctgaagcgctaaaccttgatgatgacgatgaggcagcgcctgttgcggataataagggggagcagactaagaatgatgaacccaggaaggatctaggagctggttcgtcatcaacagcagctggtactggtgacgttgaaacatgtgctagcctaatgaatactgctccagataagacggttgaaagaaatgttgaacgtaagaagaagagtaaggcaagcacatcatctactatgcaatccatgacaaggcctgctgcaggtactctagtggtgtgcccagctagtgttcttaagcaatgggcgaacgaattgactgacaaggttggtgaaagtgctaaattgtctgttttggtctatcatggtggctcaaggaccaaagatccaaatgagttggcaaaatatgatgttgttatcactacatacacaattgtggccaatgaagtgcctaaacagaatgccgatgatgacactgatcagaagaatggtgaagaatcttctgctggtaataagagaaaacaaccacccaaagcacagagcaagtcgaagaaaaagaaaaagaaacttaaggattcagacatttaccttgccagtggcccagttgcaagagtgcgatggtttagggttgtccttgatgaagctcagacaataaagaactttcgaactcaagtggctaaagcctgttgtggattacgtgcaaaaagaagatggtgcttatcaggaacacctatacaaaatgcaattgatgagctctacagctatttccatttcttgaaatacgatccatattctacttataattcattttgtacaatgataaagcacccgattgctagaaatgcagttcatgggtataagaaacttcagactgtgttgaggatagttctcctgcgccgcacaaaagaaactctgattgatggtgagccaatcataaagctacctccaaagacaattaatctggataaagtagattttacaaaagaggagcgagctttctatttgacgctggaagaacgctcgcggcaacagttcaaggcatacgctgctgctggtacactcaaacagaactatgccaacattcttctaatgctgttgcgccttaggcaggcctgcgatcatcctcttcttgtgaaggggcatcagtcagagtataaaggcgatggttctatagaaatggcaaagcaacttcctaaagaaatgataataaatttgcttgcaaagctggaagttggagagttttgttctgtatgcagtgatgtacctgaggatgccgtcgtgacgatgtgtggccatgtcttctgctatcaatgtatatacgagcggataactactgatgagaatatgtgtccctcccctaattgtggaaacacattaagtaccgattcagtattttcgtcaggagcgttaaggatttgcatgtctggtgtatccagttctcatgcatcagggagttcatcattagatgacgagtcatcttctattagtcaaactagttacatatcctcaaagatacaggcggcaatcgatatactgaattcgatcattaacacctatgcccttaccgacagtgataccgtcgaatcaaatcctagccgagtggccccagtgaaagccattgtgttctcccagtggactggcatgctggatttgctggagctttcattgaatagcaatctcatacagtacaggagactagatggaacaatgtccctcaattcaagagataaagcagtgaaagattttaacacagacccagaggtcagggttatgatcatgtcactgaaagcaggtaatcttggtctcaatatggttgctgcttgccatgtaattctccttgatctttggtggaatccttatgctgaggaccaggcaattgatagagcacacagaattggtcagactcgtcctgttactgtctcccgtttaaccattaaagatacggtggaagatcgcattttagctctgcaggaggaaaagagagccatggttagctctgcttttggcgaagacaaatcgggtggccacgcgactcggctcaccgtggatgatctgaagtatctatttaggttttgattggaagcacccgtgatctctgcgatacaatgacattgtatagtagcctgtgatctttgcctagatgcaactccaacagctgtgtaccgctgctgagtattttggtgcgaggtactgcggatttgtgtccttccatggctcgcagcagctccagttttgtcatgctctgatttgctagacgaaatgtagtaggcttagtcgctagcctgtgttgaatatttgaccccagcttgtaggagaattctgccattgctccctgttttatcaagagatccatctggtggt

SEQ ID NO: 5811 - DNA, 715 bp, Oryza sativa
  Predicted polypeptide sequence is orthologous to G846
gcatccgctcggacgcgacgaccacggtgatcctcatctcgttcaaggcgggcagtacggggctgaacctgacggcgtgcagccgggtgatcctgatggacttgtggtggaatccgcagatcgaagagcaggcgttcgaccgcgcccaccgtctggggcaggtgcgcgacgtgaccatctacaagctcagcatcaaggatacggtcgaggagcgcatcctcaagctgcaggacaagaagcgcgcgctcgctaaggccgcgctcgagggcagcaagctcgtcaagggcaatcggctcgatttcaaggagatctggttcttgttcaacggcaacgactagcgtcgcccacaacgcaacttgcagaaaactattcaacaaaacgagagtgaggcaaggaaacaaaggcagtgtgtgtggggagtgtttagggacggcggagggcgacggcttcggagaagggtttgaagacgtcaaagtggtcgaggggtacgtcgaggggcttggtgattttgaaggcgggtttggtgtggaagtggggataccaaaagtcgtcgtaggtggcatactccgtacccagcatttgctgtaccgtcttctttcccttcctctgaagtctagctaaggcctctgggggagtatgagccagattggcatgcaacttctccgccagactattttcgaacgcaatggtgctttcctttgttaaaaaaaaaaaa

SEQ ID NO: 5812 - DNA, 2582 bp, Oryza sativa
  Predicted polypeptide sequence is orthologous to G852, G2633
ggtttatgcttaatttgcttccattttgtttattactcctacaagaaattgatgagggggttcgcttgccgttgcagcacaccacatccccctcatccacctgtccgtgatgatactcccatagttgagacttgagattgcccttctcctcaatcttgttgatctcttctcccacctcgcgccttcgagctagtcgtgtttaggtttagccccattaatcttggtaagggtggtagtggttgttgctgttgttgttgttgttgccctgaagctttcttcctcaaggaccagaatttgtcttcagctgctaaaggagggcctaccactaaagatttgtgatcaatcccactttgatctattaccattgtggcgctgaatattcagtgataacaacggcaagatcaactccctattaattgttcggaagtgcatcattcctcagcgactccagcatataaataaaatccagaaggttgcaccagagaatatgtcaatgcaggcctctaaccgaccatacagatatccagacaattctcaaataccatactacagccggagttcaatgcatgtggggcaaaatggtacttaccatgtgcaacaaaatcatgaggatctttacgcgtcatctgatgatggttcacagaacggcaattctaaggctcaggggttgcaagcacagtactgcactctagattcatcctcaggcaattttgtgtatccagcacatagctctacatcctcccacataagtgggagccccatttctcagcaagatagccactcagagcacacatctggttcccctgcaagtgcttcatgtgttactgaagttccaggcttgaggtttacaacaattgaggagatagagaatgcaatgtttggacctgaacctgacacagttagctcggactgctccttacttactgattctgctttttaccaagataactggagggagcatctgggaatcaatacaggggacttgaagcaggtaattgcagcatgcggtaaggctgttgatgagaatagttggtatagggacttgctgatatctgagttaaggaacatggtttccatttctggagagccgatgcaacgccttggagcctatatgttggaaggccttgttgccaggctttcttcgactgggcatgccttatataaatccctgaagtgtaaagaacctactagcttcgagctcatgtcttatatgcatctcctctatgagatatgcccgtttttcaagtttggttacatgtctgccaatggagcaattgcagaggctgttaagggcgagaactttgttcacatcatcgacttccaaattgctcaaggtagccagtgggcaactatgatacaggcccttgctgcaaggcctgggggaccaccatacctgaggattactggtatagatgactcgaattctgcccatgcccgaggtggtggactggatatagtcggacggcggttattcaatattgcccagtcatgtggtctgccctttgagttcaatgctgtcccagcagctagtcatgaggttatgcttgaacatcttgatataagatctggggaggttattgttgttaattttgcctaccagctgcatcacactcctgatgagagtgtgggcatagaaaatcaccgggacaggatattgagaatggtcaaggggctctctccaagggtggtaactcttgtagaacaggaagcaaacacaaacactgcacctttcttcaatagatacttggaaactcttgattattacacagctatgtttgaagctatagatgttgcttgcccaagggatgacaagaagcggattagcactgagcaacactgtgttgcaagagatattgttaatttgattgcatgtgaaggtgcagaaagggtggagaggcacgagccttttggaaaatggagggcaaggctttcaatggctggctttaggccgtacccactaagtgcactggtgaacaacactatcaaaaagttgctggatagttaccacagttactacaagctagaggagagagatggtgccctttatcttggatggaagaacagaaagctggttgtatcttctgcatggcggtgacatctccgtgttaatttggaagaagcttctttaggttctttcgtggcttcttggtggacgcatgaatccaaggtggaacctgatcttcatagagcagagagaactccatagtccagaacaatgtggtcgcttgcttgttggcacccatctctaaaccctcgtatgcttaccatccgtcagatttaatcgccataggcagaatactcttcctgacttcccatagtccagtccagtcgcaatataggtgtacactgtactgttttacctgctcatggtagaatgtccgttttatgtcgatcagtcaagtagagtctggtcaccagaatccccgtcttaatagaacgtctgttttaaaagtcagtcaagaagagagtctggtcaccagagtccgtttcttgatcctgctcgttgtacaatacaatgacgtctcaatgtgaattctggatcctatgctactacaatgatgatatgcctcactgaattctgg

SEQ ID NO: 5813 - DNA, 2162 bp, Oryza sativa
  Predicted polypeptide sequence is orthologous to G852, G2633
gatcgcagcacacgaaaagagaaccagagagagagagagagagagagagagagagagaggagtggaagtggatcggggcatcgctgcggcgtcggggctgtgcagatcggaggaggtcatgaacgactaatctccgttcatttattatggacttgcaccagttattaaagtacagattgactggcgctaacgttgtgtacgaaattcctacagagaacaacttgcaaaactctccctggcaagctaacccactgaagtacgagttcagcgattccccatacacccctctctcttcccaatttgagtgtgacaatttgtctgctcttaccaacactccagataaccagagctctgcagaaaccatttcagcccaaccaatctccccattggaagcagacagctcatatagacaggcgggtattcttctccaggagaacattcaagtgggagctgatccgttgtatgctacatcaagacataatatgcaacacgccttacgggagattgagactgttctgatggcacctgatacagatgatgcaacaactagcaccgagcatgagtttgaggaaatcaagcctgctcagcttgtgaggcagcggtcgagaacatggagtcatgaatcacggcagccgttacctggagttggtcggtcacagtttgcatctggtggataccccacagcaagctatgaatttcgtccagagaaacggcaaagggagttaagggaagaccctcagataattgtgaagcagctattaaccaggtgtgctgaggctctgagtgaggacaggacagaggagttccataagcttgttcaggaggctcgtggagtggtctcaatcaacggggaaccaatccaacgtctaggtgcttacctactggagggtttggttgctagacatggaaactctggcacaaacatctaccgtgctctgaagtgccgtgagccagagagcaaggagctcctgtcctacatgagaattctatacaatatctgcccttacttcaagtttggctatatggcagccaatggggcgattgcagaagcattgagaactgagaacaatatccacataattgattttcagattgctcaagggactcaatggatcacactgatacaagcattagctgcaaggcctggtggtcctcctcgtgtgcggatcaccgggatagatgacccagtgtcagagtatgctcgtggtgaaggtcttgacattgtggggaaaatgttgaaaagcatgtctgaagaattcaaaatacctctggagtttacgcctctgtctgtctatgccacacaagtcacgaaagagatgcttgagatcaggccaggtgaagcactgtctgtaaacttcacactccagctacaccacaccccggacgagagcgtggatgtcaacaacccacgcgatggtctgctccggatggtgaaagggctgtccccgaaggtgactactttggtagagcaggagtcacacaccaacacaacgcctttcttgatgaggtttggggagaccatggagtactactccgccatgttcgagtcgatcgacgccaacctgccgcgggacaacaaggagaggatcagcgtggagcagcactgcctcgccaaggacatcgtcaacatcatcgcctgcgaggggaaggacagggtggagaggcatgagctgcttggcaagtggaagtcgaggctgaccatggccggcttcaggccttacccgttgagctcgtacgtcaactcggtgataaggaagcttctcgcctgctactccgataaatacacattggatgagaaggacggcgcgatgcttctcggctggaggagcagaaagctgatatctgcttctgcgtggcactgacagtagtatgttgagaagaagaaatgatagagagcatatatatacataccgattccctggtccaatttacagaatgataccctttgatgtaccctcagtttgattgacagcgggtgttgccttcatttatagaccaggatcaaacattgacattagatttgtagagaagttgtatgataataattttctttgcgattcaatgtatgatgtatccatggctgccatagttaataatattcttgcatagtcatattgatcggctaatcacccgtggattagcgttgtgtctgtcttgacaat

SEQ ID NO: 5814 - DNA, 2171 bp, Oryza sativa
  Predicted polypeptide sequence is orthologous to G852, G2633
gtcttcttccccttttccttccttccctcctgctccctctccttcccatttccgttctccgcttccccacctcgccttctccgctcctcctcctcctcctctcctgccgctctcctgtgtgtgctaccggaagcaagctaccccctcctcctgtatttgttcaatatccataatcagaggaagctgtgccttgagtttgagtatttagcctagtaggtttagaagcactacagaaaagtaatgtcttttatcaggcgagcagacccgtcaaccacttacgcagataatctttacatacataaatttggcactccaaattcaaatttcgctgcacgaagatatgcgtccgacacacagctgttccgttatgggcctgaaccatacaatcctgagaactccttttacaatcaacaggcctcaccaatgccgtacatggtaacagctgatggccattctccatcttctgcagacaattcctgctcagatgtggcaaaagactcaccattggtgtccaatgtatctcagcagaattctcagtctatatcagacaatcagagttctgaacttgaagtagagtttgatgaagatgatatcaggatgaagcttcaggagctggagcatgctttacttgatgatagtgatgacatcttgtatgagatttcccaggcaggtagcattaacgatgaatgggctgatccaatgaagaatgtcatactccctaactcaccaaaagaatcggaatcaagcatcagttgtgctggtagcaacaatggagaaccacggaccccaaagcagttgctctttgactgtgcaatggcattatctgattataatgtagatgaagcacaggcaatcataacggacctccggcagatggtctcaatccaaggggacccttctcagaggattgcagcctatctagtggaaggtcttgcagcaagaatagtagcttcagggaaaggcatatacaaggccttgtcgtgcaaagagcccccgactctttatcagctttcggcaatgcaaatcctctttgaaatctgcccgtgcttccgatttggtttcatggctgctaattatgctatacttgaagcctgcaaaggtgaagatagagtgcacattatagactttgacattaatcagggcagccagtacattacactgatacagtttctgaaaaataatgcaaataagccacgtcatttgagaataactggtgtggatgatcctgaaacggtacagaggaccgttggcggtttgaaggtcattggtcaacgtctagagaaacttgcagaggactgtgggatatcttttgagttcagggcagttggtgctaacattggggatgttacacctgcaatgctagattgttgtcctggggaagcactagttgtcaattttgcattccagctgcaccaccttcctgacgagagcgtttcaattatgaatgaaagggaccaactccttcgaatggtgaagggtctgcaaccaaagctcgtcacactggttgagcaggatgccaataccaatactgctccatttcagacaaggttccgtgaggtttatgattattatgctgcactttttgattcactggacgcgacacttccaagggaaagtccggatagaatgaatgtggagcggcaatgtcttgctcgtgaaattgtcaacatcttggcttgcgaaggtcctgatcgtgtggagagatatgaagttgctggaaaatggagggcaagaatgacaatggctggcttcacaccatgcccatttagtagcaatgtcatcagcgggataagatcgttactgaagtcgtactgtgacagatacaagttcgaggaggaccatgggggacttcacttcggctggggagagaaaactctaatcgtctcctccgcatggcaatagagcttacagaatgagttggcattagtcttgctgttatttaggagcatctgatgcagagactgtaaaaaatgtgaaccactgaacttgtcaactgatcttacctaatcgtagatgtctgcttgtcagaataatcgagttagttgaactatgttgtattagagaattggcacatgatcgtgttgtattctggggtagaattatcttgtcgactctgcttcatgtataaaattatgtgttgctagaatatgccatatttatcatcttgggag

SEQ ID NO: 5815 - DNA, 1575 bp, Oryza sativa
  Predicted polypeptide sequence is orthologous to G852, G2633
atgccgtactataataactcagtgccttcagggggaaatggtaggttctatataacacaaaatcatcaggatgctcactacgcttcttctgatgatgggtcacagaagattggttcgagccctcaagcatttgaagcgccgtactgcactctagaatcatcctcagcaaatggtgctcatcctgcccatagctctgcatcttctcacagcatctctcctattagcgggagccccctgtctcatcatgatagccactcagaccacacgtacaattcccctccaagtgcatcctgtgtcacagagattacagatctccagattaaactgagggagctggagaatgcaattcttgggcctgagctagacatagcttatgacagccctgagagcgccttgcaaccaaacataatggcaacaccagaaaattggagacagcttctgggaattaatacaggagatttgaagcaagtaatcatagcatgtggcaaggctgttgccgagaatgatgttcggctgacagaactactgatatctgagttaggtcagatggtgtctgtctctggtgatccattgcaacgattgggggcttatatgttggaaggccttgttgccagactttcttcctctggcagtaagatatataaatccttgaagtgtaaggagcctacaagctctgagctcatgtcatacatgcatcttctttacgagatatgcccattcttcaaatttggttatatgtcagctaatggcgccatcgctgaagctattaagggagagaactttgttcacataattgacttccaaattgcacaagggagtcaatggatgacattaatacaggcccttgcagcgaggcctggaggaccaccatttctacgaatcactggtatagatgactcgaattctgcttacgccagaggtggtggactggatatagttggtatgagattgtataaagttgctcagtcttttggtctgccctttgagttcaatgctgttccagctgctagccatgaggtttatcttgagcatcttgatataagagttggtgaagttattgttgtgaattttgcctatcagctgcatcacactccagatgaaagtgtaagcacagaaaaccatcgggataggattttaagaatggtcaagagcctctcccctaggttggtgactcttgttgagcaggagtcaaatacaaacacacggccattcttcccaagatacttggagactcttgactactacacagccatgtttgagtcgatagatgtcgctctcccaagggatgataagagacggatgagcgcagagcaacactgtgtggcgcgggacattgtcaatttaatcgcatgtgagggtgctgagagggtagagaggcatgaggtctttggaaaatggaaggcaagattaacgatggcagggtttcggccatacccgctgagttcagtggtgaacagtaccatcaaaacgctgttgcatacttacaatagcttctacaggcttgaggagcgagatggtgttctttaccttggatggaagaacagagtattggttgtatcttctgcatggtgttga

SEQ ID NO: 5816 - DNA, 2272 bp, Oryza sativa
  Predicted polypeptide sequence is orthologous to G852, G2633
ggcacgggccaccgggtagaaatacccgcgcccacccgaaaaattccccagctcacctcctcctcactaccaccaccaccaccaccacctgcttcctccgcggctgcgtgcgccgcctccccaacccttcgtcctccccgccggccgccgctgagatccgacgcgccggagcggagctcgctgagattttgttcctgctggatttctgaaattttactggaggactagagatatcaagacaccaacaacaaactagtacaaagttttccttccagttaatctgttcctggatctccttgccatacgcgaagcagtggatactatgcagtaattggttaggaggtctttactgaaccataatggctgatactccaacttcccgaatgattcatcccttcagcaatataccgagccaaaacctgaagcagttccagtattctgataatccgcagcacccttgccacccttatagggcaccttcagacacccacgttgtgccacatcattatggcctaaagtcacattcaccggatgctggttatgaaagccaggctactcctaacaagtacacattggactcctctgaaggtgctggttgtatgagacatgattctccttccagtcaaagtttcacaaccagaagtggtagccctctatctcaggaagacagccactctgactcgactgatggatctcctgtaggcgcctcctgtgtcactgaggatcctaatgatctgaagcaaaaactgaaggatctcgaggccgttatgcttgggccagactcggaaatagtcaacagccttgagaattcggtggcaaaccaactttccttggagccggagaagtgggtgcgcatgatgggcattcctagaggcaacttgaaagagctactgattgcctgtgctagagctgtggaagagaagaatagctttgctattgatatgatgattccagagctgagaaaaatagtttcggtatctggtgagccacttgagaggttgggagcctacatggtagaagggcttgttgccaggcttgcctcctctggcatttcaatctacaaagctttgaaatgcaaggaaccaaagagctctgaccttctgtcttacatgcacttcctgtatgaggcctgtccctacttcaagtttgggtatatgtcggcaaatggtgctattgcagaggctgtcaagggagaagacaggattcatatcatcgacttccatatctctcaaggggctcagtggatctctctccttcaggcccttgcagccaggcctggtggaccaccaactgtaaggatcactggtattgatgactcagtgtcagcttacgcacgaggcggcgggttagagctggtcggaaggaggctgtcgcacatcgccagcctgtgcaaggtgccctttgaattccacccacttgctatctccggcagcaaggtggaggcagcacatctcggagtcatccccggggaagccctcgccgtgaacttcaccctggagctgcaccacattccagacgagtcggtgagcacggcgaaccaccgtgaccgcctcctaaggatggtgaagagcctgtcgccgaaggtactcaccctggtggagatggagtccaacacgaacacggcgccattcccgcagaggttcgcggagacgctggactactacaccgccatcttcgagtccatcgacctgacgctgccgagggacgacagggagaggatcaacatggagcagcactgcctcgcgagggagatcgtcaacctcatcgcgtgcgagggggaggagagggcggagcggtacgagcccttcggcaagtggaaggcgcgcctcaccatggccgggttcaggccgtcgccgctcagctcgctggtgaacgccaccatcaggacgctgctgcagagctactcggacaactacaagctcgccgagagggatggggcgctctacctcgggtggaagagcaggcccctggtggtctcgtcggcgtggcactagcgttgtgactttgtgaggtgatctgacgacgaacttcccttgtaaccatcttggctgggggctttagaaagctatagtgatcatggactggtaagggtagctgtaacaatggtgttgtaatggtaaggtagcggctagggtcaaactcgaaaatgggcaaaatgctgatgaggtgtagaagtgtagtacatgtttgagagtatatgtttcagtttttcttttaaatgtcttgtagtaatgttgtggcacactaatgtctatgatcagaattatcatcc

SEQ ID NO: 5817 - DNA, 1245 bp, Oryza sativa
  Predicted polypeptide sequence is orthologous to G861, G1140
ggcgccgcgcctcgcctcgcctcgcctcacctcacctcacctcaccctccgcctcgtctccttcccccctttcctctacccacgcacgccctctctcccatcccagccgtagccgcgccgtgacttgtctcgatcggcggcgaggaggagggcttccgttccctggccggtgggggaggatcaggcgggggggcggcggggagggggaggagatcggtctcggtcgatccgcgcgcggcggcgatggcgcgggagaggcgggagataaagaggatagagagcgcggcggcgcggcaggtcaccttctccaagcgccggcgcggcctgttcaagaaggccgaggagctctccgtgctctgcgacgccgacgtcgcgctcatcgtcttctcctccacggggaagctatcccacttcgcaagctccagtatgaatgaaatcatcgacaagtacaacacacattctaataatctggggaaagcagaacagccttcgctcgacttgaatttagaacatagcgagtatgcacatttgaatgagcaacttggggaagctagtctccggcttagacaaatgagaggtgaggagcttgagggattgagcattgatgaactccagcagctagagaggaacctggaagctggtctgcacagggtgatgctgacaaaggatcaacaatttatggagcagatcagtgaactccagcggaagagttcacagctggcagaggagaacatgcaactcagaaaccaggtatcccagatatcaccagctgagaagcaagttgttgatactgaaaattttgttaccgaaggacagtcctctgaatctgtgatgactgcattgcattctggaagttcacagtcgcaggataatgatgatggctcggatgtatccctgaaattagggctgccttgtggtgcatggaagtaactgaaaggaaaaaaaaagcatccttgcagatctggttggagtcgttgcggcatccaggggagaaacgcttgtgttattcccaaacccagactgcaataatataatcttgcgttggaagcgagatcagttaacctgatttatcatccttgtggctgcatgatgcgatgttccgcttgtactgttcgctaggatcttgactaaactttgagatctatgtgccgtttaattatcccatcgctattggcactccttatgcgatacatcatatatgcactttgttgctatcttaattatgatgcgtcttttgcagcgttc

SEQ ID NO: 5818 - DNA, 1218 bp, Oryza sativa
  Predicted polypeptide sequence is orthologous to G861, G1140
gtttctctctctccttgtctctctgtgctgttgttgttgcgggtgaatctgcttggatttcgtcggagttttctgtcgcggaggaggagggggtggtggttgatcggaggggaggggggagggagatggcgagggagaggagggagatacggaggatagagagcgcggcggcgcggcaggtgacgttctcgaagcggcggcgggggctgttcaagaaggcggaggagctggcggtgctgtgcgacgccgacgtcgcgctcgtcgtcttctcctccaccggcaagctctcccagttcgccagctccaatatgaacgagatcattgacaagtatactacacattcaaagaacctggggaaaacagataagcagccttctattgatctgaatttagagcacagcaagtgtagcagtttgaatgaacaactggcagaagcaagtcttcaacttagacagatgagaggtgaggagcttgagggattgagtgtggaagagctgcagcagatggaaaagaacctcgaggcaggactgcagcgggtgctatgtacaaaggaccagcaattcatgcaagaaatcagtgagctccaacgaaagggcattcagctggcagaagagaatatgcgcctcagagaccaaatgcctcaggtgcctactgctggcttggcggttcctgatactgaaaatgttcttactgaagatggacaatcatctgaatctgtgatgactgcattaaattcgggaagctcgcaggataatgatgatggttctgatatatccctgaaactagggttgccttgaaataaaaggaccagctagagagctgagaaatgggatgacgaccaccatgaattatttgtctgtgtgcatgagtggatgaagttggaagttaaatgcatcttaagaagatcaagaagatgtcatgctatgagattaccaacaaggctgcaataatcctatcctatgttaaaaaggagatcgattgacttgtcatcctatgcctgctgatgcaatggtccggttgcttggatctttttttctcaacttgtactagtgtaccatactaccttcgtcgcacttaatttaaatgcgacatgtacgtatgtatcgttcgcttaattcgtgcaagttatgtacgtacctgtatgggaactgtatggaaacttgtgacctcggctgagacttattattggcacaattattaagctagtcattctcatcg

SEQ ID NO: 5819 - DNA, 1045 bp, Oryza sativa
  Predicted polypeptide sequence is orthologous to G861, G1140
atggctggcggcggcggtggcgggggaaggggggagggggaggggagggcggccacggggaagagggagaggatagcaatacggaggatcgacaacctggcggcgaggcaggtgaccttctcgaagcggaggagggggctgttcaagaaggccgaggagctctccatcctctgcgacgccgaggtcgggctcgtcgtcttctccgccaccggcaagctcttccaattcgccagcaccagcatggaacagattattgaccggtacaactcgcattccaagacacttcagagagcagaaccttctcaactcgacttacaaggggaggacagcagtacttgtgccagactaaaggaggagcttgcagaaactagccttaggctgaggcagatgagaggagaggagctgcacaggctgaatgtggaacagctgcaggagctagagaagagcctcgagtccggtctaggctctgttctcaagaccaagagcaagaaaattctggatgagatcgatggactggaacgaaagaggatgcaattgatagaggagaatttaaggctgaaggagcaagtgtccaggatgtcaagaatggaggagatgcagcctgggcctgattcagaaatcgtgtacgaggaagggcagtcgtctgaatctgtcaccaatgcttcttacccgcgacctccacccgacaacgactacagctctgatacatctctcaggctcgggttgtcactcttcagctccaagtgatggctggaaactaaaactgagaggaaacagctggatggcatgcctgcatcgccaaatgatcagtgcatgcactgcaagactgcaacaaataacacagttttagattgccagatgatgatgtgtgtgtgctgagagtcactggctattatcgtacacataataacaatagaacgaacaagttcttctgttcttggatgttacctgaattctactcccatacatgttgtcaatggctctgtaatcgagtgtctgcaattccagctgaaagcaaccgattacagggaaaaaaaaaaaaaaa

SEQ ID NO: 5820 - DNA, 1042 bp, Oryza sativa
  Predicted polypeptide sequence is orthologous to G866, G883
caattttgctttgcttgcttctcgccgcgatcgcgcgccatggcggatccgttcccggcggcggcgcgcggcggcgagcagggtggtggcaccgcggggcagctggtgtcgacgccgtccaggttgaggacggcggtggcgtccatgctcaaccgcaccggccacgcgcgcttccgccgcgccgcccccgtcgtcgtgcaggaggaggaggatgaggcggcggcggcggcgagggatgcggtcgtgcggtgtgacgggctcagcgcgtcggccagctcgtcgttcccgtcgtcggtgacgggggtcaccggcgatgggagcgtgtccaacgcccgcgcggtgctcccggcggcaggcgacggcgacaagccgccaccaatgcagtctgcttcagattatgcttctgatggccgcctcaaacgcagcagcgacgacgacggcgagcgctgccactgctccaagaaaaaacggaaggcgtcgtggagggcgaggcggcgcatccgcgtgccggcgatcagctcacggaacgccgacatcccggcggacgactattcgtggcgcaagtacggccagaagcccatcaaaggctcgccttatccacgcgggtactacaagtgcagcacggtgcgcgggtgcccggcgcggaagcacgtggagcgcgaccccggcgagccggccatgctcatcgtcacctacgacggcgaccaccgccacggggaacccggccatcgacgtcccgatgaggcggcaacgacgacggagcacaggacgactgaccaaactactggaagattgctctagatagtagtgtctatgcatgtagactctataatctatatatagaaacaaactaatctaatcaattgaccgtttgaatattggttaatttcttagtgctctttcatgcacgtagtatttgccaattgccatgtacatcatatctagtttagactattgactgatgtgatatccatgtaattgatctgctacctccctcactctcttgattaagtatatgatggttgatatttccatggttttt

SEQ ID NO: 5821 - DNA, 1248 bp, Oryza sativa
  Predicted polypeptide sequence is orthologous to G866, G883
gacttcttcttcttcttcttccccccatttctcacttactccggcgatcaccgtggttgagcgtcggcggcggaggaggaggcgatgattaccatggatctgatgggtgggtacgggcgggtggacgagcaggtggccatccaggaggcggcggcggcggggctaagggggatggagcatcttattctgcagctgtcccagactgggacgagcgagaggtcgccggcgccggcgcaggagcagcagcaacaggtggactgcagggagatcacggacatgacggtgtccaagttcaagaaggtgatctccatgctgaaccgcaccggccacgcgcggttccggcggggcccggtggtggcgcagtcgtcgggcccggcggcgtccgagccggcgccggtgaggtcgtccccgtcggcggtgtcgaggcccatgacgctcgacttcaccaaggcggcgtccgggtacggcaaggacgccgggttcagcgtctccggcatctccgccgcgagctcgtccttcctctcgtcggtcaccggcgacggcagcgtgtccaacgggcgcggcggcgggtcatcctccctgatgcttcccccgccgccggcgaccagctgcggcaagccaccgctgtcctccgccgccgccgccatgtcagccggcgcaggccacaagcgcaagtgccacgaccacgcgcactccgagaacgtcgccggcggcaagtacggatccaccggcggccgctgccactgctccaagcgccggaagcatcgggtgaagaggacgatccgcgtgccggcgataagctcgaaggtggcggacatccccgccgacgacttctcgtggcggaagtacgggcagaagcccatcaagggctcccccttcccacgaggatactacaagtgtagcacgctgcgcggttgcccggcgaggaagcacgtggagcgcgacccgaccgacccgtccatgctcatcgtcacctacgagggcgagcaccgccactccccctccgccgccggccaggaccacccgccggcgccgcctccgccgctggcgctgccgctcgcctgagatacccccggtgaagaagagtgagaattagcttgtcggtcatcataattaccgttagaaattatttttttcgtttttctctctttttttttcttttttttactgcatcattgtagaactagcgtgtaaaacaattttaggagactttgagactgagcttttactgaagaaaaaataaagcag

SEQ ID NO: 5822 - DNA, 1142 bp, Oryza sativa
  Predicted polypeptide sequence is orthologous to G866, G883
gatcctcccaacccaaaccgagcgcagcgcacggaccgagatctgcgcccggcagcggcggcgaactccggtgaaccaaccatggccgtggacctgatgggctgctacgccccgcgccgcgcagacgaccagctcgccatccaggaggcggccaccgccggcctccgcagcctggagatgctcgtgtcgtccctctcctcctcctctcaggccgccggggctcacaaggcctcgccgcagcagcagccgttcggcgagatcgccgaccaggccgtctccaagttccgcaaggtcatctccatcctcgaccgcaccggccacgcccgcttccgccgcggcccggtcgagtcgtctgctcccgccgcccccgtcgctgctgctccccctcctcctcctccaccaccggcgccggtcgctgccgccctcgcgccgacctcctcgcagccgcagaccctgacgctggacttcacgaagccgaacctgaccatgtcggccgcgacgtccgtgacatccacgtcgttcttctcgtcggtgacggccggcgagggaagcgtttccaagggccggagcctgctctcctccggcaagccgccgctgtctgggcacaagcggaagccctgcgccggcggccactccgaggccaccgccaacggcggccgctgccactgctccaagagaaggaagaaccgggtgaagaggacgatccgagtgccggcaatcagctcgaagatcgccgacatcccgccggacgaatactcgtggaggaagtacggccagaaacccatcaagggctccccttacccacggggctactacaagtgcagcacagtgagaggatgccccgcgcggaagcacgtggagcgcgccaccgacgacccggcgatgctggtcgtgacctacgagggcgagcaccgccacacgccggggcccctcccggcgccacccgccgccgccgccgtcgccgcgatgccggtgtccgtcgccgtgtccaccggcaacggacatgtctaacctaattagctccataatttttttcttcctttttttttagttgcttctcatcaatctaatgatgcgtgtaaagaagaaaagattgtagaaagaggacgagggaaacttgatgctagagaattaccgtctcc

SEQ ID NO: 5823 - DNA, 977 bp, Oryza sativa
  misc_feature (916)..(916): n is a, c, g, or t
  misc_feature (920)..(921): n is a, c, g, or t
  misc_feature (939)..(939): n is a, c, g, or t
  misc_feature (957)..(959): n is a, c, g, or t
  Predicted polypeptide sequence is orthologous to G866, G883
tacggtcggaatcgcgggtcgaccacgcgttcgcgcagccgcagacctgacgctggacttcacgaagccgaacctgaccatgtcggccgcgacgtccgtgacatccacgtcgttcttctcgtcggtgacggccggcgagggaagcgtttccaagggccggagcctgctctcctccggcaagccgccgctgtctgggcacaagcggaagccctgcgccggcggccactccgaggccaccgccaacggcggccgctgccactgctccaagagaaggaagaaccgggtgaagaggacgatccgagtgccggcaatcagctcgaagatcgccgacatcccgccggacgaatactcgtggaggaagtacggccagaaacccatcaagggctccccttacccacggtaaatctcttcctcctgcttgaacacgaaattctcccaagaaattcatcgcggtttgcaacgaacctgacgtgttctgcgattcgatcatcaggggctactacaagtgcagcacagtgagaggatgccccgcgcggaagcacgtggagcgcgccaccgacgacccggcgatgctggtcgtgacctacgagggcgagcaccgccacacgccggggcccctcccggcggtggctacggccagcgccgtgaaggcggctacggcggtggcggtggctacggtggcggccgtggtggcggcggctacggcggcggctacggcagccgcggcggcggcaactccgacgggaactggaggaactgagcggtggggccctcatggccaagttatctatctatctaatcgagctaccatcatcatcatccgatcgttatcatcgttagttttgtgtggaactatctagtttgtgttaactgtgtggttgcccatctgtgtttttgatcgcaagaagaaagctcngtcnntcgtttgctttggatcanaatgaattgaattgaatnnngaatcttagtgtgaaaaa

SEQ ID NO: 5824 - DNA, 1268 bp, Oryza sativa
  Predicted polypeptide sequence is orthologous to G866, G883
caaccaaacgattaagatttgctcggtaaaatggctttctcatttaatattagtacaaccagtagtaggagcagcagtaaaaagtaaaaactcatttacacaaggggctaacgatttttgctaattaattaattaaacaagcggcggcggcggcgagtggcggtggtcgccctcgtaggtgacgacgagggtggcggggtcgtcggcggcgcgctcgacgtgcttccgggcggggcaacccttgacggtgctgcaccggtagtagccgcgcgggtagggggaccccttgatcggcttctgcccgtacttgcgccacgagtactcgtcggcggggatgtccgccacccgcgcgctcgccgccgccacgcgcaccgtgcgccgaacccgctgcttccgcttcttggagcagtggcacccgccgtgcgcgtgcgcgtggcctgcgccgtggccgtggccgtcgccggcggcggcgcagggcgggtgcgggtgcttgcgcttgacgccgccggccagcgggggctccccggaggagaccaggctccgggccctggacacgctgacgactccgccggcgatgaacgacgagacgacgacgtccagtcacaaaacccgcggaactaggcggcatcgcacacccaacgaagccccccagaggccgctaaggatcacctcagtccgtgcggaagaaagcttcacggtcgcatcaccaggcgcctaaaacgagaggcaacgacaaccaacaggacaaccataacgagaaaaagcgaaacactacaaggaaccccacacgtgcgaacacactccccagacgatagctggcgcaggccgacacaacacagccaccaaagacggacgcacacgaaacacacagaaagcacgcaccagccgccgacacgcaccccggccagccagcgcgcaccagagcacgcccagcggcacccgcacagccaccacgccagcaccgacgaccccacacagcgcgagcgcgcggcccacgaaaggaagaccgacaccacagaaaaagcgccgccggacagccaagccgcccaggacaaaagaacggaggagcaaaaagaacagacaataaagaaagcaaagcagaggccgagagcgagagagcgcccgtgaagcgaacgagagcagggaccgagaaaacaacgatcgcagagaaaagcagcacagcgaagaaaagaaaacgacacagcaacaaaaaaggaacaaccgacggaaaagaagcatcagggacgagacggaataaaccaacagag

SEQ ID NO: 5825 - DNA, 1874 bp, Oryza sativa
  Predicted polypeptide sequence is orthologous to G869
ggctcctctcgccgttttggtcggggttttagcgagcgcgtgggaggccggaggcgacgacgacgaccgcgccgccgtcggagaagaaggccgcggaagcaccagtaccagcacccgtatatgtcttctagccccttctccgatctggtggtagtcgtgctcctcgtctgcgccgtcgtcgccgcagccgtcctcctccccctcgtctgcgcccgccgatctatgcaccagaggctccacggctggaacaagtccacgtcgatgctcagggacgggttcggggtcaagtattccgggttcctccacataaggccgtgtggtttctgtcgaggagattgacggattcgatcgattcgtgttcgtctccgtcaaatttttgcacaagagaaaaaaaaagtttcccccttttagagtttttccccttcagttttgtcagttttggtgaggaattttagagttcttttccggcaagagttagaagaagagagaaatggccccttccaagcagcagcagatgctcctcaagaaggtgatggcgaagaagcccaagacgaagaggctatccgggtttggccttaaaccctctgctgctttctccaggccccatgtgccgtcggcggcggcctccctgcagccaagccgtcgcgtccgcgtcgtgttcgaggaccctgacgcgacggactccgactctgacgacgacgaggacgccggcgccgcctcaaagaagcgctactttgagctcttcattggcaagccagcttcgtcgacgaagcaggcctctccggcgtccaccgtcgctgcctacgccaacatcggcaaggttgggagcacctgctaccgtggtgtgcgcctccggaagtggggcaagtgggcggcggagatccgcaaccccttcaccggccatagggagtggcttggcacctttgacactgctgatgcggcctccgccgcctaccagtctgcctcccgcaacttcgccgaagagaagcgccgccgtggtgtggcctcctctgcctcacctgctagttcggcgacccctactccgactgcgtcctcgtcgtcctcgacttctgccgcgccattcgcccacccttcgccgtcgtctgtgctcgaagccaccaagccagctccaaagccagagtcgccgccgctgccggagcaagctgcaactcccctcctggtggaggctgccaacgagaccgccgagctgccggatgacccagagttctacaaggatatactgcgcggtctacagctgccggacattgacccgatggatttccgagctgggctggatgctctggatatctccgatgtgccggcttacatgaatggcgaacaagacgtactcttcactgaggacatgctgcttggagacttcgctgaagaagatgacctcgacctcgacgacatcggtgatgacttctgcgaggatttcccagagatacccagcggctacgacttcggccgtggtgatatgttccggcaggtggatttctgcgtgtgaattaagagcttgctaaagttattcatgttggtgtgatgggcctgtgagtgtgggtgcttgggaggagatttcttgggttttttccccgagcaaaatcaatctgctcgtgcccttgagatttcagttccgcccataagaactccaacgcacatttagcattcggagagtaattttgttaggttaaaagtatggtaagttataggtggtatgttatgtttttctttttcttttctcaatgttatctggtacctaagtttgtcaagaaaatcatagtggacaagtcaagtatttggggctgtcgtctctgttatggaaagaaaaataagttttgattacattacatatcttttgctctcgagatctggcc

SEQ ID NO: 5826 - DNA, 2123 bp, Oryza sativa
  Predicted polypeptide sequence is orthologous to G869
gacacatcacacgtttcgcctccctcctccgctcgtcttcttcattctctctccttcgcttcgcttccaaatcgcccgcaatttctcccccaaaaacctcccctccccccaccaccaccattaataaacccctcctcctcctcctcttcttcctcctccgcctcgccatctcaccgccaccgcctcctcactcactcacttcctgccacgtcattcgcgccatcgatcgcgtcgtcgcctcagctgcctgtaagtgagaggaagaggaggagtagagctcgtcgtctccgccgccgcagctggtgctcgctgttgatttatgtcgcctgctctacccccgtttctccatggttctgagctccagtcgccgccaacggtttcttcctgctcccttctcatcctcctccttcaaaattggtatacgaggggcgcaagaacacagcaaaatcccttcacgatctccagatttggatttggggtgaaatactttggctttcttcgtttagactggtgacaattgaagatagcccccaaattgccttaagatttggtttggcttgagtggatcaagtacagaatccgaacttttgcaacctgacattcttctagttcacaaagtcggccagatttgagatttctctcggacatctctgtacacacaggagctctcttttgctccagttttaaacagaagttggacaaaggctctgtttctggttttttgagtttctgcgataagcttagagagcagacaacaaacttttgtcctgattcatctaaactcttacctgactgcaatcaaggccaattgtaatccaataatctctgatcttgttctggttgcacgttgagatgatggtgccctcttcacggaaagtccgtgttttctgctctgatcctgatgccactgactcctctgatgaagatgaccagaataagaaggaaaggagattttcaagggaaatactaattccaatggaaaactccaaggcatccaaacctgttaagacccttgttcaatgtggcacaaagactgtaaaggattccgagaaggaaccgacgagcaaatacaggggtgtgcgccggcgggcgtggggcaaatgggctgcagaaatacgtgaccctgtgcgaaaatcaaggaaatggattggcacatttaacagtgaggaggaggccgctgcggcatatcttgcacaatcaaaccagttccatgaagagttgatggccttgaaaatccaatcttctgtatcagagcaggaagatttgtcaagctctgttactatatcctgcgtgtcctcatctcagtcatgtgaccagaagattcaggcaaagccacaagaacacaagagagtgtcagtggtggttaaccgtgagaccgttgagcagaagtttaaggcacagccacaagctcagaagattaaggcacagccagaagtgcagaagagagtgtcagtgaagattagccatgagactgaggatgagcacttgctgaacttgccgtccacgcctaaaggcaaagagatttcgatgggcgctgttcttggcaggatagatgagattcctgtgagcaactgtgtgggccatattgatgaatttccacctgatgatttcactaggcttgcagatgcgttcccagttagtgattttatcggcatggcagatgtgccactgggcgatgattacattggccttgcagacatcagccacctgccgctgcctatcacagatctgaagttcgacctcaatgcagaactcaactgggacgggttcgactttgcttcattggaacaagaactcaactgtctttgatggcttgaatcctgttctatgtgaaaacctcttgttgattgaattgagtgcaggaggtagattcaggtatccatctttcacattgctggcaggccgagtgtatgatctggagattttcatctccaattttgccggaaaattgtacagtccccctacggcaaacaaatgagtaccgcagtatttatgtatatgttcaccaatctcaaaaatgttaatgagattgtggtgacagaccgtccttgatctcagtttggttgtgtatttgttggacgccattattatatttgttaattttgatattgttcttgtgatcc

SEQ ID NO: 5827 - DNA, 706 bp, Oryza sativa
  Predicted polypeptide sequence is orthologous to G869
aagcactttcgaagctaaggatacagtacatgcaggtattgagcaattaacatcgtgttccccttacaaggtaaataattttgaggcacatattgttgaagcagactccattgatgaatttaactcattgtttaagtgtcgtatggaggaagtactagtgcaatccatctcaaagtccagtatcagtcaacccttgacagttaaacttgaagatgaattgagtgaaccattatctccagattctgggactgggacacatttcattgacgggagttcagttgaagattcggatccacgatttgcacagctcaatgatgaagcactggtatcttctacttctaacgcaacatgtcgtaatgagtcaattgaagagaaatcaagtgaagcattactggcaggaaacgaagattattcagaactgccaaatgaactgttaaaatcaggagatccacagactgcagatagttctgagattcaagtgcaggttattgatgctacaggtcactgaatgatgagacaagggcctaaaacaaggccaaacagccaatttctcagagagatctgtaaagcatagatagtccagtattagttctctgaaccaggtttcttgcccccctttgttccaacttgctctatggcgtctggatttaacttttcctcttcttaatacaaaatgtgcagcaatcatgctgtttttcttcaaaaa

SEQ ID NO: 5828 - DNA, 693 bp, Oryza sativa
  Predicted polypeptide sequence is orthologous to G872
cgccgcggtcggccggaattccgggtgaccacgcgtcgcacagcacgtacacgtacgtgcaacgtcactgcatgatgtcatcgtcgtcgccggtggcggcgtcaccgccggagatggagaagaagtacaagggtgtgcggcggcggaagtgggggaagtgggtgtcggagatccggctgcccaatagccgcgaccgcatctggctgggctcctacgactcgccggagaaggcggcgcgggcgttcgacgccgccttcgtcacgctccgcggccacggtgccgccggcgccgacctcaacttcccggactcgccaccgtcgtgcgacgcccgcagcagcgacccgcggcaggtgcaggccgccgcgctctcccacgccaaccgcgcccacgtcacgccgcagcaggcggccgcggcgctcatgtcgccgccctcgctgtcgccgccgccggggttcgctaccggcagcgaggtggtggcgcccgccgtgcgcgccgacggcagcatcgactggcgcccggtcatggcgcacccgccgccgctgtactcggcgcccggctggggcggcggacatgcctacgacttcttgcagccgccgccgccgacgccgacgttgccgtcgtggcgacgaccaaatggacgacgtcgtagatgacagcagcgcattgctttgggagtttgacacgcaagatacc

SEQ ID NO: 5829 - DNA, 1015 bp, Oryza sativa
  misc_feature (812)..(812): n is a, c, g, or t
  Predicted polypeptide sequence is orthologous to G878, G884
acacaatcaccaacgtccaccaaacaagcgggcaaaagatggcagctcttcagcagctgatcaaaatgagcaatccaatgataccgtgtctggtctgtcaggtattaagagagatcaggaagctatatatggaatgtctgagcaactatctggtttaagtgaaggagatgatatggatgatggtgaatcaaggccacatgaagcagatgacaaagagagcgacagcaagaaaaggaatatacaaatttcttcacagaggacttcagcggaagctaagattattgtgcaaacaaccagtgaggttgatcttttggatgatggttatagatggcgcaagtatgggcagaaggtggttaaaggaaaccctcatccaaggagttactacaagtgcacctatgctggatgtaatgttaggaaacacattgagagggcttcgtcagaccctaaggctgtcataacaacttatgaaggaaaacataaccatgaaccaccggttggtaggggaaacaaccagaatgcgggaaatgcggccccttcaagcagtgcacaacagaatatgcagaatttgtctagtaatcaagcttcacttacaatggcagacttcaacaacattaaccagaggccaattggtgtcttacagttcaaaagcgaagaataacaccgtcaactgactttcttgtgaccccggttgctgaagtggcacactggtatttggttgatttcttcaggcaaatattggatgccttgcattctaatagtcacactgttccaaacgttcaagaataatacaacaatatcattgtctgcaattnttctaccggtacacagaattactgtaacgacacctaacccttctagcttgtacatgctggtactttgagcataaactcaatataacaacacctatgtggatgtgcaaatagaccgtcgtaaacatatcatgtttactttggaatatggtaataaacaagctccttgctttgtattagaatggatataaaaatgaaatgcccct

SEQ ID NO: 5830 - DNA, 1654 bp, Oryza sativa
  Predicted polypeptide sequence is orthologous to G878, G884
gccgagtccagccccggcgcgctcactctcgccgcctcgctcttccccgacgcgccctccccggccttccaggggtctttcacccagctcctcgtcggcgccatgggctaccccgccgcctccgcccccgctccgccctcaccgttcccggtgccgcacggactcagccccaccgcgttcctcgggggctcccccggcctcttctccccgacggggaactttgaaatgtcccatcaacaagccttggcacaagtaacagcagaagcagtccattctccgtacagtatgattaatcaatcagatttctcactcccgttctcgtcgacaacgacttcagtgttggcatcacaacatgtcaactcttctgccaatgtgtcatcaccacgagaaataccaactctgccatcccacacagataatagcaacattgaatcaactgaggtttcacatggattccaaactactgccctcactgaggataaacctgctgatgatggctacaactggcggaagtatggccacaaggcagttaagggtggggagtatcccaggagctattataaatgttcccatttaagctgtccagttaagaagaaagtggaacgctcatctgacggacagattactccaatactttatagaggccagcataaccaccaacgaccaaccaaaaagagtccaaagatggtggcgctatacttaaatgaagcagatgtttcccgtgagaaggaagatgcatcaattagatcagaacagggctcccaagattattctggaaaattcaaggcatcaaatgatggtggtccttcatcatccaggaggggagataggggtgagcaaatatcgggctcaagtgatagcaagcatcaaggcgaggaagaagtgaaggttgagggtagagctactagtgatggaaatgcgaacaaaagacatgtgccagctccagctcaaagaatcattgtgcaaacaactagtgaggttgatctttcggatgatggctaccgatggcgcaagtatggtcaaaaagtactaaaagggaatcctcacccaaggagttactacaaatgcacgtaccaaggatgtgatgtgaaaaagcatattgagagatcctcacaagacccaaagggtgtgataactacatatgaaggcaagcacagccatgacgtgccagcagccaggaacagtagccattcttccgctaatgccaacgtatcgtcttccagcaatttacctcccaagggacagggggcaacggtcgtcgtgcatagatggttcgcggaatgcatcttcagtttcttccttccagttaaaggagggggggggatggcaggaaatttgggtggggtttagcggggtaaattgttttttttttcagtccatttggggtgtgttgtttcccaagccccgttgggcggggggtctgggctttgtgggtgggttttggcatgggtttagttggggcttgggggttcgttgggtaggggggaatatgttcattttccttttggaattcgacccgtttcatgggaaaataaaatttatgccttccaaacaggcccttggcaaggggaaaccccgcatagcttccttcccaaaaaaaaaaaaaaaaaaaaaaaaaaaaaaaaaaaaaaaaaaaaaaaaaaaaaaaaaaaaa

SEQ ID NO: 5831 - DNA, 1229 bp, Oryza sativa
  Predicted polypeptide sequence is orthologous to G878, G884
ggcagtcaaaaggctccccgctcccccgtccccttccccctctcgccctctcctacccaacttctcgaactctccaaaccctagctttttcctcctccccctcctccgcgaatcttccatgcccgacggctatccggcggcgccgcccgggatggagcgccctgccccggaggcggcggctgcggcggcggagccccctggggcgaaggcggaggaggaggaggaggggccgaaggatgtgggggtgaagggtacggggaaggagaaggagacagagaaggttgaggccgagaaggagatggaggggaaggggaaggggaaggagtcgatggaggtggaggaggggaaggagaaggagggtaaggggaaggcgaaggagaaggagaaggagacgaaggtgaaggtgaaggaggagggtggggaagagaaggagaaggggaaggttgaggtggtggaggcaaagcggcggccggctggtgttggcgcggagacacccatcctagcggtgccgatggtggccgtgccatgcttcttggcgtctcctgcatttgcgggtcacttttcaatgagccatcaagcagctttggcgagagtgacggctcaggcacaaatacaattgcagtcaccaaccacaccatattcagaagggctgcccagtccatttcctataacacctaaagctgtaatgcccctgcagcgatcaccttcaggaactgaagggagtgttcgcagatcagtgttagagaagtcagcctcatttcagtcaagaccacacaatcatgtgtctgtaaacatggttggtgatggcttcaactggaggaagtatggtcagaagcaagtgaaaagtagtgaaaattccaggagttactatagatgtaccaactctaattgcttggctaaaaagaaggtcgagcattgtcctgatggccgcgtggtggaaatcatttacagaggaacacataatcatgaaccgccacaaaagaccagatttgtgaaagagagagtggctcatattactgcttcctctggagatgatgaaaccttgggacttgtgaacaatgaaattatagaatccccgtcaccgggatgtaaattagagccgggtgctgtctctgaagcttctgaacagcagcttttttgctcaagtgattgtgaaggtgatgctggtaacaaatcagaagatgatcatcctagcacagagcctcagccaaaacgaagcagaataattg

SEQ ID NO: 5832 - DNA, 1498 bp, Oryza sativa
  Predicted polypeptide sequence is orthologous to G878, G884
ctcgatcgcctcgcctcgcgtccccgcgatttctcactcgccatcgccgacgagatcctcgccaccgcgccgcccccacccccctcatggcggccgcgcggcgggtggcgggcggcggcggtggcagcctgtggggcccgcctcagccgccgccgtcgaccggagggggcatcccccagctccccgccgcggccgccgccccagtggagggcctcctcgacgcccccttctcttcctcctccggtggcggtggcggcggctggccgccgccgccgccgccgctctccggcaccgccgtcctcatcgggtacccccagggcaactttgaaactttccctcaacaggacttggtacctttaacagcacaagaggttcattctaagtgcattacattcggtcgagcagagaacctgccttttatccctttggcgacttcagcgctggtctcccaacatactggttcttcttctgtaaatgtgacaccgttgcaagaaattctgacttcgccgtcgcaaataagcaatgtcaacactgaatctattggggtgttacaagggctcccagcttcatccatcgttctggatagacctactgatgatggatacaactggcgaaagtatggtcagaaggcagtgaagggtggggaatatccaaagagctactacaaatgcacccatctgaactgtttggtcaggaaaaatgtggagcactctgcagatggacgaatcgttcagataatttacagaggacaacacactcatgaacggccctcaaaaaggaggtttaaagattgtggtggtatatcagatgatttagacgatttcagtggcaccacgggcacttcagtcagatcacagcctgattacgatgattactgcagaaagcctatcattccaagtggcaccatggttgctcctttagtgaaaaagattgaagatggtgatgaccaattgtctggatcaagtgataaccaggatgagcatgatgatgaggtgaggacttctgatggagcttccggtgatgccagtgcaaatgaaaggaatgtgccagccccaggtcaaaagattatagtgagtacaaccagtgagatcgatcttttggatgatggttataggtggcgaaaatatggacagaaagtggtgaaaggaaatccttacccaaggagttattacaaatgcacctacctaggctgtgatgtaaagaagcaagttgagagatctgttgaggaaccaaatgctgtgataactacatacgaggggaagcatatccatgatgtgcctgctgcaaggaacaaaagccatgtcgtagccaatgcctctctattgcagaacacaaagtcgaatacctactgcacagagcaatcctacacaacgatcacttgctagattctgccatacatccgtctgattgctcatatgtagcatttctgaagctgtgtattttatcggccgtacccactaacgaggcgatttttggcaccattgtgccatgtattttt

SEQ ID NO: 5833 - DNA, 1650 bp, Oryza sativa
  Predicted polypeptide sequence is orthologous to G878, G884
atgcccgacggctatccggcggcgccgcccgggatggagcgccctgccccggaggcggcggctgcggcggcggagccccctggggcgaaggcggaggaggaggaggaggggccgaaggatgtgggggtgaagggtacggggaaggagaaggagacagagaaggttgaggccgagaaggagatggaggggaaggggaaggggaaggagtcgatggaggtggaggaggggaaggagaaggagggtaaggggaaggcgaaggagaaggagaaggagacgaaggtgaaggtgaaggaggagggtggggaagagaaggagaaggggaaggttgaggtggtggaggcaaagcggcggccggctggtgttggcgcggagacacccatcctagcggtgccgatggtggccgtgccatgcttcttggcgtctcctgcatttgcgggtcacttttcaatgagccatcaagcagctttggcgagtgtgacggctcaggcacaaatacaattgcagtcaccaaccacaccatattcagaagggctgcccagtccatttcctataacacctaaagctgtaatgcccctgcagcgatcaccttcaggaactgaagggagtgttcgcagatcagtgttagagaagtcagcctcatttcagtcaagaccacacaatcatgtgtctgtaaacatggttggtgatggcttcaactggaggaagtatggtcagaagcaagtgaaaagtagtgaaaattccaggagttactatagatgtaccaactctaattgcttggctaaaaagaaggtcgagcattgtcctgatggccgcgtggtggaaatcatttacagaggaacacataatcatgaaccgccacaaaagaccagatttgtgaaagagagagtggctcatattactgcttcctctggagatgatgaaaccttgggacttgtgaacaatgaaattatagaatccccgtcaccgggatgtaaattagagccgggtgctgtctctgaagcttctgaacagcagcttttttgctcaagtgattgtgaaggtgatgctggtaacaaatcagaagatgatcatcctagcacagagcctcagccaaaacgaagaataattgaaactagcacacctttgactccagttctcagaactgttagagagcaaaagattattgtacaggctggaaagacgagtgatgggtatagatggcgcaaatatggacagaaaattgttaagggaaatccaaaccctaggagctactaccgttgtactcatgatgggtgccctgtccgtaagcatgttgagaaggcaccagacgatgataacaatattgttgtgacctatgaaggtaagcacaaccatgatcaaccgtttagaaacaacagtgagtcgaaggatgggcctgttcctatgatcattccagcagagacaacatctgagcagcccagcacaatgacctcaacatcagaacagaaacagccgatcagtctgctgaaggatggcggcgatgagcccatgaagggcaagacttcagaaatcggtggtgagaaggcagtggagtctgcgcaaacccttatcagcattaaaactaatcccgatgacatgaagaataccctcttgaaagatacttccgcggtagttcctgtccaaaataattga

SEQ ID NO: 5834 - DNA, 1347 bp, Oryza sativa
  Predicted polypeptide sequence is orthologous to G896
agcagctcatctcaacacgcgcgcacggggcggcatggcggtcgtcagcggcgggaagcgcgcgctcctcgtcggcgtgagctacaagggcgacaccagcagagagctgacgggcgcggccgaagacgtcaagaacatgaacagcctcctcaaaaaattcctcttccccgaggaatccatccacatgctcaccgaggagttgggcgccaaggacccgttgaaggcgccgacgagggagaacattatgaaggagatgcggtggctggtggaggggtgccgcgccggcgactcgctggtgttccacttctccggccacggccggcagaggaaggacgacaacggcgacgaggtggacggccgagacgaggagctctgcccagtggactacaaggtgagcggcaacatcttggacgacgacatcaacgatgccatcgtcaagccgctcacccaaggcgtgaagctgcacgccatcatcgacacctgccacagcggcaccatgctcgacctcccctacctctgccgctttaacagaatgggtctatgttcaagatacaagtgggttggccaaacgcgttggcgactatccccaaagaaagagtgggcgatggtccccgtaggcggccacgccatctccatcagcggctgcaaggactaccagaattctctagagccagacaacaccgccggcggcggcgtcatgacatggagcttcctggaggcagtgggatcgcggaggacgatgacgtatggggagctgctggactcgatgcgggcgaaggtacaccataggttgcagcaaagcagctccggcaagtgcctcgtaacgggctgcctcggctcgctcgccgccaagtgtctcccctgctgcttcctcagcgtgcaggagccgcagctctgttcgtcgaaggagttcaacgtctacgaggagcagtttatcctgtgaccgaccgcattgtcccgggcacaagctccattcagatgaaaacctctgctcctccagctccattctaattgcggatgctggatatcatacacgtaggctcgctttcttaaaataaaatttaaatattattgttcgtagaaaagagtatgatagtgtgatatcaaaatgtggacgaggaaaaaaaccgtgttctaagtatcgtgtattagcgaaggatatatgttgctctgttgctgcggccatggccatgcatgtgtgttcttacaaaaactcaagcgtgtgatcatatttataataaggtagcgcagagcgacggattggaactgaaattgtgtaattgagcgtgtactttgtattgtccaaatctgtttttataatttgtaagtttgttaagcttcggtcac

SEQ ID NO: 5835 - DNA, 1137 bp, Oryza sativa
  Predicted polypeptide sequence is orthologous to G896
atgatgatgctgatcgactgctcgggctgccggacgccgctgcagctgccgcacggggcgccctgcatccgctgcgccatctgcggggccgtcacctacgtcgccgccgccgcgccgccaccggcccacggcgaccccgcccgcggcgccgcggggccgggggcggtggcgccccagcaccaggcgccggggtgggggccgcctcccccgcccgcgcacgggcggaagcgcgccgtgatctgcgggatctcctacaagttctcgcgccacgagctcaagggttgcatcaacgacgccaagtgcatgcgccacctcctcacgacgcgcttccacttccccgacgactccatcatcatgctcaccggtaactacccgatattacctccctattggttgaattctggttcggaagaacaaactgacccttacaagattccaacaaagcacaacataaggatggccatgtattggcttgtacaaggttgccagcctggagactcattggtattccattattctggtcacggagcacaacaaagaaactacagcggagatgaagttgatggaatggatgaaaccctctgcccattggattttgagacacagggaatgattgtggatgatgaaataaatactgctcttgtcagaccacttactcctggagttaaacttcatgcactgatagatgcttgtcacagtgggactgcacttgatttgcctttcctctgcagaatgaacaggagtgggcaatatgtatgggaagatcatcgacctcgatctggtgtctggaagggcactagtggcggcgagtgtatttcatttagtggttgtgacgatgatcagacatctgcagatacttcagctttgtcaaagatcacttcaactggcgctatgacattttgctttatccaagcaattgagcgtgggcagggcaccacctatgggagtatcctgacctccatgcgttcgacaatacgcagtacaggtgattcaatgggcagcggaggtggtgctgtaacatcgctaatcacaatgcttcttacaggaggcagcgttagtagtggcggcttgaagcaggatccacagctaactgcaaacgagccattcgatgtgtatgcgaagcccttttctctatga

SEQ ID NO: 5836 - DNA, 855 bp, Oryza sativa
  misc_feature (231)..(231): n is a, c, g, or t
  Predicted polypeptide sequence is orthologous to G896
tgcgcgttaacgactcaccacgagccgagccgagccaacgaagaaatcgttgccaaccaaatcacccgccgattcgcctccccctcctcgccggcggcggcgaccccgcggcggcggagagatgatgatgctgatcgactgctcgggctgccggacgccgctgcagctgccgcacggggcgccctgcatccgctgcgccatctgcggggccgtcacctacgtcgccgccgnccggcccgcaccgtgcccacggcgaccccgcccgcggcgccgcggggccgggggcggtggcgccccagcaccaggcgccggggtgggggccgctcccccgcccgcgcacgggcggaagcgcgccgtgatctgcgggatctcctacaagttctcgcgccacgagctcaagggttgcatcaacgacgccaagtgcatgcgccacctcctcacgacgcgcttccacttccccgacgactccatcatcatgctcaccgaagaacaaactgacccttacaagattccaacaaagcacaaacataaggatggccctgtattggctttgtaccaggttgccagcctggagactcattggtattccattattctgggtcacgggagccacaaagaaactaccgccgcattagtgcatgcatggtttaacctttgccattggatttgggcccccgaagattgggtaagacaaaaatcggctgggaacaccctaacccggagaacacacccggaagggcgattcatcgttagcgggggtaaacaaagatccggggggaaacggtgcccgaagacctgaccgggcgataggccccccaagcgagtaggaacgcggttgtcctgtgtgataatatt

SEQ ID NO: 5837 - DNA, 784 bp, Oryza sativa
  misc_feature (253)..(253): n is a, c, g, or t
  misc_feature (648)..(648): n is a, c, g, or t
  misc_feature (728)..(728): n is a, c, g, or t
  misc_feature (734)..(734): n is a, c, g, or t
  misc_feature (738)..(738): n is a, c, g, or t
  misc_feature (772)..(772): n is a, c, g, or t
  misc_feature (777)..(777): n is a, c, g, or t
  Predicted polypeptide sequence is orthologous to G898
ttcggccgcttttttttttttttctctttttttttggaaaactagatattttccctttttcagaacccacaggagaaaaatgcacgccattacatacaaatcagatcagatgtagtcaatgagctaagaatcgtgttgtgcacttcttaccacattgttagcctacagggctaacaaacaaagactaaatgtctaactctaactactgctcaagttcttttgcacacaagatgaatgtgcaggagtggactangtgaggttcaggccagcagaaactaattaatcataatcagcaggagtagggaggtaaacacgatggaagctcttgatccctagactcttcctacaagtagggcatttcttctgagccttgaggcatgcctggatgcatttctcgcagaagatatgaccgcaatttgtcgtggatggcttgtccagtttgttcagacacacaggacaggtaaaggttggttcctttggagcaaccttggcatgcgtcgtactggtttgggccacatttttcggcttgctggtcccttcttccctatctggagaaaggcatataacatgtacagcaccctgaaaatttctgccccgggaaaatatagctccagcaacgccataacctcccggaccagtatccttctncagatccactacagccacagagcgcctcataatttttctgctcctccttttatcatctagagcttcaacatcgatggggngagggnccgngtacccctaaaggatcagagcctcatgctggctnccagnggtcacc

SEQ ID NO: 5838 - DNA, 1146 bp, Oryza sativa
  Predicted polypeptide sequence is orthologous to G898
gtttctcttcttctctcttcactcgtgttgaaattgaaataaatcgcggtcaagataaaaaaaaaagaaaaaaaaagaagaaaaaaatcgcggtctcctcctcatcgagccgcgcggctggatcgaggattcgagcaggttgatttcagagttgagtgccactgattcagctccaaagttagcatgagtactgtcagcggcactcggcgtgccccaaggaggcaatcacaagatggtcctggtgataaagtcgttgtgaacctggacgcgatctcctccccagtggttggaagccgtcgcgcggtgccgacctccactggtgcgcgcgcctcccccattgatgtggaagctctggatgatgaagtgcagacattgtccgcttcgcaagtgcctcctccgagaaggaaccggagaactaggaggcagcctgtggcagtagttgatctggaagtagatgctagccgggaagggaacaaacgtcaaagggttgcacctgttatacactgcctctctccagaaaggggagaagggtccagcttgaagactagcaatgagcctcctaaggcaaaggaaccggtttttaactgtccggtgtgttggaacaagttggaggagccctccacaacaatttgcggccatatcttctgcacgacatgcatcaagcaagccatccagattcagaagaaatgccctacttgcagaaagagtctgagggcgaacaatttccaccgtatttaccttccaaactctgatagttaaggctcattggatgtaccaaaggaacttctggcagcagcagcagcatcctccaatctaatatattcagaggaacaggagttctcccataacgtgtaccattttgctgtggaattgtgtcacggcaaaatgaccacctagacccgcatgttcatccaaggctactgttgtttgtatgtagatgcatcaccaggagctcatcagctgcaggtgacaactctggtttaggctaccgaatggcctctctgcctccaaaggatacacaacaaaactaactatagtccccattggttagatttatctagtttgtgtactgttgtatttaccatgcgtttggccatgtaccttaccttctctccatagttgttgacgtagccttgaatcagcttg

SEQ ID NO: 5839 - DNA, 1243 bp, Oryza sativa
  Predicted polypeptide sequence is orthologous to G898
gagtcgtcgacccccgcgtcccccttcctctgctgggttcgcccgcacgcccgcccgcaccgccgcacgccgccggtcgcccctcctccccgccgacgctgagcaccgccggtccccgtcccgctaggcagcggcgccgccgtcctccgaccgagcccctcgccggttcctgctcctattgctcaagccattaggttgcatcgaaacagtatgagctctcatgattttgcaagaagggttccgaagaggcggcggactaacaagttgctttcgcaacttcttccggacctgaactcactcccagctgaaggagctgatgatgggggatcaccttccagtagtgtgctcgtctcacacgcccagacttctgctgtagctgtggctggaacctcgcagtatttggtgccagcagttgttgcggggccgcacattggaatgagtagttgtcccattatcgtggatgatatcaatgatgatgttgtgatttattctgcaagctcgttccctcaagtgaggcagcaggctccaaggacagaacctgttgtgaccatagaagatgattctgaaactacccctggacaagcaggggatgcagttgatgagcatgtggatatactactatctctgactctgggcaggtatcctaggcatggtcatcagagatcctccaacatcagcaccagccctgtgatacatataattgacacacctagcaatgtactcaaacttgaatttcttcaatacacctatcaggtctgtgatgttcagttaaataatgcagcgtttggtggtaatgcaggcactccctgaacccgagaaggccgttccgaaggaaccaactttcaattgccctgtctgcatgaacgagctggtcgaaccgtcatcgaccatctgcggtcacattttttgcaagcagtgtatcaaggcctcaatccaggctcagaagaagtgccctacctgccggaggaagctgaccatgaacaacttccaccgcgtgtatctcccttctgcggagtaagccggtttccaccattctggaaatcagcgtccctcctcccaccctgactctcgccacattggcgttctgatgattgtatctgaaaatgtttgacaggcttgctagcataccgttttgctggagcagttttaacaggtgttgtactgttgttggatccgttaaaagaatacgattgtatgtcctgtggaaatgatccatgctattaaaggtctagattttgtgggg

SEQ ID NO: 5840 - DNA, 1783 bp, Oryza sativa
  Predicted polypeptide sequence is orthologous to G903
actagctacactagctaacccttgctatgcttgcacaaacacctaaagacacacctttcaactttcacctttttaccacttcaaatattttattctcacacatacacacacaaacaatctctctccatcgatctcactctcactagcaaagctctatatttatcctgccttgatggttttgttgttgccactagctagcaaagcttatttatgcttgggggtaatgacccatacctaagaacaaaagttgcccttttgtctccaaagggaactagtcaagcagaagaggagatcgatcagcaactagcatagtttgatcccaagagagatcgatcgattaattagcaacaagccaacgacaagcttagcaatttgataacaatggcgactagtgaagccgcagccatctccaaccctttcgctcctctcaccaaccatcagcaagaacaccctcctcctcctcctcctcccgccaagaagaagcgcaatctccccggcacaccagatccggaggcggaggtgatcgcgctgtcgccgaggacgctgatggcgacgaacaggttcgtgtgcgagatatgcgggaaggggttccagcgagaccagaacctgcagctgcaccggcgagggcacaacctgccgtggaagctgcggcagcggagcgggaaggagccgaggaagcgggtgtacgtgtgcccggagaagagctgcgtccaccacaacccgtcgcgcgcgctcggcgacctcaccgggatcaagaagcacttctgccgcaagcacggcgagaagaagtggaagtgcgacaagtgctccaagcgctatgccgtccagtccgactggaaggcccactccaagacctgcggcacccgcgagtatcgctgcgactgcggcaccctcttctccaggagggacagcttcatcacgcaccgcgcgttctgcgacgcgctggcggaggagacggcgaggctgaacgcggcgtccggggccgccgcggcggcggcggcggccacggccacgtcgctgtgcgggcagagctacctgttcgccgggtcgggtgggccggggatggcgggcatgcggccaaacacgatgatgccgccgcagttcgacgcggcgcagctgagctggctgtacgggaacggcaagctctcgtcgtcgaatgccagcgagctgacgagcgccacggcggcggcgaaggaggcggagagcgtgccgtccgtgttcagcaaccagcagcacgcgaagcccgcggcgcccaccgacatgtccgcgacggctctgctgcagaaggccgcgcagatcggcgccgtgacatccaccgccgcgatgcccctagtgtccccgttcgagccgaccaagcccggcggcgccaccgcctcaccggccgacgagtgcggcaagttcgacggtgcagccctattcgccgccgcgagccatcacaatgccaacctcggcggcgcaatgagcgagctcacgggggccgccggcaacgtgccttacgacgtcttgtcggcggtgcgccaccatgccggcctgaaggacgccggcggcgtcgggagagaggaaactagggatttcttgggcgttggcgtgcaagcactgtgctcgtcgtcgatacatgggtggatttaaaccttaatttgcatgctaattctgtagccatgaagagattagttagtgctaattttgaagctatgtaagcaagtaagctacagtggagtgaagcatgcatgcaagctcacaaaagggctcaagaagagcacccaatttaatttactaaaatttc

SEQ ID NO: 5841 - DNA, 1380 bp, Oryza sativa
  Predicted polypeptide sequence is orthologous to G903
atgtcggtgggtgcagatccggaggcggaggtgatcgcgctgtcgccgaggacgctgatggcgacgaacaggttcgtgtgcgagatatgcgggaaggggttccagcgagaccagaacctgcagctgcaccggcgagggcacaacctgccgtggaagctgcggcagcggagcgggaaggagccgaggaagcgggtgtacgtgtgcccggagaagagctgcgtccaccacaacccgtcgcgcgcgctcggcgacctcaccgggatcaagaagcacttctgccgcaagcacggcgagaagaagtggaagtgcgacaagtgctccaagcgctatgccgtccagtccgactggaaggcccactccaagacctgcggcacccgcgagtatcgctgcgactgcggcaccctcttctccaggagggacagcttcatcacgcaccgcgcgttctgcgacgcgctggcggaggagacggcgaggctgaacgcggcgtccggggccgccgcggcggcggcggcggccacggccacgtcgctgtgcgggcagagctacctgttcgccgggtcgggtgggccggggatggcgggcatgcggccaaacatgatgatgccgccggcggcggcggcggctggagggcagctcagggcgggtcagatgctcggtccggcggcggggggcgtcggtggggacctgtgcgacggcggcgtggcgcggcacggcgggctgtcgctgtggggtggcgaggcgttgccgtccatgggccacattggcgtcctggccagcggtggcgcggcgacagtgccgccgcagctgtacgtggatctcttcgcgccgagctccggcgcgccgccgccgcagttcgacgcggcgcagctgagctggctgtacgggaacggcaagctctcgtcgtcgaatgccagcgagctgacgagcgccacggcggcggcgaaggaggcggagagcgtgccgtccgtgttcagcaaccagcagcacgcgaagcccgcggcgcccaccgacatgtccgcgacggctctgctgcagaaggccgcgcagatcggcgccgtgacatccaccgccgcgatgcccctagtgtccccgttcgagccgaccaagcccggcggcgccaccgcctcaccggccgacgagtgcggcaagttcgacggtgcagccctattcgccgccgcgagccatcacaatgccaacctcggcggcgcaatgagcgagctcacgggggccgccggcaacgtgccttacgacgtcttgtcggcggtgcgccaccatgccggcctgaaggacgccggcggcgtcgggagagaggaaactagggatttcttgggcgttggcgtgcaagcactgtgctcgtcgtcgatacatgggtggatttaa

SEQ ID NO: 5842 - DNA, 1558 bp, Oryza sativa
  Predicted polypeptide sequence is orthologous to G904
aagatgacaatttgacacgaaagccttcctgtgcctttttatggtaattacgtttatacccctgcgatccaccggtacagcaccatgaacgccgtctcctcctcctccgtccccggcggcgacatcctcaccgcctccgcgtcccacagccatggctcctcctggctgtggctatggtggctctggtagctctggctccaccgggagctccaccgcccggagaaggacgatagggatgacgcggaggtggccagccgttccacgtactcccgcagccagccgcgcgtcgcgcccgccgcttcggccaccgcctcgccgggaggcggtggagactgctcggctgctggcttgtcttccttgactgcggcggcgctcctggttgtcatgggcgcggcgcgggagacgacggcctcgacctcctcgtcgatgtggtagtcgaacgtgccgagcgagtaggtggggcgggcgttgccgccggtggccgtcgacgcgctgcggttgctgacgctgcccatctcgacgcggaagctcctggaacggtccctgctcctcggctccggcggcggcggctgctcggcggcgaggatggcggagatcgaggggtgcgggagcgtgacggtggcgcggcagagcgggcaggacggggtggtgcggagccacgcgtcgacgcaggcggcgtggaacgcgtggcggcacgccgggagcagccgcagctcggcgtccagcgtgaacggcgacaggcagacggcgcagtccggtgagctcttggggagcgccgccagcgacgacgccatcgtgaacagcggcagcgactcgatcagccgctgcttctcgtcgcccaccacctccttcttcccctcacaaaccccattacgccgcaccggagaagcgtccgccgcctcgacgttgtgcacctcacggcgcgtccgtgggagcggcggcggcggcggcggcggcggcgacgacctggacagaagtctgagaagtaggtggatcgagaccgacgctagtagaacgaaggcaagaagagcagcgatgatgaggagagacgggaggaaggacgaggcggcgtcggaggatccggtgacgggatcggcagacggcggcgacggagacgagagagtggacgccatggcgaggcttagccttagcttgagaatggtttaacttaacccgcccgggaatgagacctctcgcgccttttatccccgggtttctttggagtgcgcggtggtggtggtgcggatgcagaggccggaagtaaatagtggcgggtttgcactctcctgatggagagatcccagaaatggtggaggtcagccttggaaaccaatccacgtctcggtttctacttttctacctctgcctgccctttgcaacctgaaattctgctactactgctacgtggaaaatttcgcatagcagttgagcagacagcagctcaactgtttgcaattcgatagtttgttgcacaatagtacaatgttgtacactggttagtgaacttaagtacgtgcaaagaatcaaatccgcagtaaaaatactgcattacagcagc

SEQ ID NO: 5843 - DNA, 1562 bp, Oryza sativa
  Predicted polypeptide sequence is orthologous to G904
agctcaccttcctcctcaccgccaagatcgcaagaacgcaacaagagaggaggagattgatgtcgtcttcggctgtgattccgccgccgtcgccggagaggagggtgccgatggtggctgtgccggtggtggccgacgatggaggcggagggcatggggcgaagggggaggagagtgtgagcgggagcgtcgcgggcatttcgccgagcatcctcatcatcgccgtcatcgtcgtggtgatgctcctcgcctccgtctccatccactacttcatccgccacctgtgccgccgctcgtcggcgtcggcggccgcgtcgtcctccgcgccggtgctccccgtcgtggtgcgccccgcgtcgtcggcggccgtgggggagcaggtggtggggaaggcgtcggcggagcgcgcggcggagatggagcggctcatctcgcggctgccgctgttcacgctggcgtcgtcgctggcggcgctccccaagtcgtcgcgcgactgcgccgtgtgccagagcgcgttccgcgacgacgacgagctccgcctcctcccggcgtgccgccacgcgttccactcccgctgcgtcgacccgtggctccgcgccaacccctcctgcccgctctgccgcgcctccatcgcgctcccgcacccgcccctcccggacctcctccgcgtcgagctcggcagcgtcagcagccgccgctccaaccccaactccgccgccgccgtcgccagcgcgccgcccgagggcgccgccgtccgcgcctacccgctccccaccctccccaactccgagtacctcgtcgaggaggagctcgaggtcgtcatcaagcaacccgccgccgccgctgcgccaagaaccggcgagccaagccagcatccgctgccggcggcgcaggcggagcgtgggcagccgtcgtcggtgaccccgacggcgtcgttcagctcggcgaggtcgcaggagcggtggagcaacaggtggagcagcagatggagcagccggtggagcagcgggcggtggagcagccggtacgacgccggcacggtgacggcggccgccacggcggagtggtggtgggacatggacggcggcgcggcgcccgccgcgcggcggcgcgaggtggaggagcagggcaacgcgttccacggcttcatgcgctggctcacaggggcatactagtaatttaccactcgatcaatgcccagttcactcgctcgtcaacctcgccggcgccggcgatcgccggagaattgaattcaactgaatttgaaatgaattatgaatttctgatgcggctcggctctgcttttgggcattcgtgattaggagtaattaatagtgtctccttttctcttttttttggctgtgaattcttgtattatttttttcttgagtgcgtggatttcgagggtggaggatgcatatggtgggaaggtttttgatgccgtacggatttgaaaactgcttcttcctccgaattggagaatgtcggcgggaagattgaggaattcggggactttgaggcaaatgaactgaactgcccaataaaaaaacagaattatttcc

SEQ ID NO: 5844 - DNA, 1296 bp, Oryza sativa
  Predicted polypeptide sequence is orthologous to G904
atatctgtttagagcttttctggtgaggactaatacagtgtggtttgttcactctgttgtttgtttgaaggcaagaaaaagaagccgccatggcagtggggagaaggggatgaaggaatacttagacacgtggcatgatctcaggagccgaggggcctcaagtcggtacagctattgaaccaagagagcaagaaccaccggccgtgaagttcgcagcggggaaatggaattcgaggaggattcggcctccttccatggcggcgagggcgtcaccggcgtactgcgctggcacacgacgacgctatcggattcgcccatcggcgattaagaacccctctcactgggccacgacgtcaccagcctcttctccttgtgccgcgacttccgccggtgcagggttgtgattccgaaccccatctacggcggtgacgccggccttctacatgtgcacaacaacaagaagacgctggccatccgcgagcaggtgtcagtgtcgcctggccgcgaacccggcgtcaagaacaggacatccgtgtgcaagcggcgtcctcggacgtttcatctcccttcgtctgcttctcagaagcagtgggctccatatacatcacattgtatcagattacaaggataggaatgaagaggaatatgagggaatgaacatatcactcttggaggaggcctcagtgcagaaggctgatgcaaaacctgtgtactgcacaaagtttctatctgactgggtttgcagcttaagaaattttaagtggaaagtagtggcagggattcaccaagcattagtaccgaatgaatacagttgggaagaagtaatgggctcaccaattattcaatacgcaggaggctgctcgctctcggcgtgcagtgtatgtatcgaccggcttgcgtttgagagaatccatgggagaggatcctttgcatggagggtagaatcaccccctgcaaaactcagaaaagaatgccttaagaggaatgcctggtcacaggaaagtggtgggaaatctgacagggtgctggatgtaatcattgacaacggagggctaccaacgactgacggaattatcatgttaccttggttgctttgcagcgtcaaatggtagatgtccaaaagcatttcaggggtggctcataatccggctgcaatagatttgatgctgcatgttttcatttaacactgtaaaatgatgaatccttctttgtgatgttgatcagggataagatgcccatactatatatgtttctttgtcatttgagatcaagcattatgttccatttacgtgaact

SEQ ID NO: 5845 - DNA, 1509 bp, Oryza sativa
  Predicted polypeptide sequence is orthologous to G904
atgttattaatcagagaagaacgagacggatacaactcatgtcctacacctccaaaaaccacatctcgacacagagaaatgacactgagaacaatcaaggtcagaaaaagcaaccaaagtcagagacacaaatcacagatgaacaaggaaagtagagagaaaaaactggacatgttcactcaccggaaagtaatctccgacctggtctctagtgatgtgtgtgcttgtgtgtgctctacttctactcgtctcacggctaatcacctggtatttgcgctccgatttcgctcgctctccgtgccaacgccgcgcaccccaaaacccataaataaaggcgcgagaccacacgcagggccgagccttaaacacaccgtctccttcccccccatggcctccctgccgccgcccgcgccgccggccatcggcggcgacccgctcgccgccaccattccgccctcattgccgtcgccggcgccgtcgtcgtcttcgctcaacctctccccgtcgcttctcatcatcaccgcgctcctcgccttcgtcttcttcgcctccgtgtcgatccacttcctcctccgctgcctcgcgcggccgtcgcacccggctccgagcccgctgcccagggcgtcggcggcggcccaacgcgcgacgacggcgtccgccgtcgaggctggggaggctaccgccgcgtcggcggtggggaggagccatgagggggaggcggcggcggggggtggggaggaggtcgacgacgagaaggagcggctgatcgcgtcgctgccgctgttcaccatggcgtcggcgctggcggcgctgcccaagagctcccccgactgcgccgtctgcctctcgccgttcgcgcccgaggccgagctgcggctgctcccggcgtgccgccacgcgttccacgcctcctgcgtcgacgcctggctccgcaccaccccgtcctgcccgctctgccgcgccaccgtctcgctcccgcacccgccactccccaccgccgccgccgccgccgcctccaacgcggcgcaacaggatcccctcgactcgcggagcagcaacaactcgaggagcttccgcgtcgagatcggcagcatcagcaaccgccgctcctccgccgcggccgacgaccggcgcacctactcgctcggctccttcgactaccgcgtggacgaggaggtggaggccgtcgtgtcccgcatcgcgcgccccgcggcggccaagtcaacgaccggttccgtgacgccggcccccggcgaggcgctggcggaggcggcggggtcgcggggatggctgcgcgagtacgtggaccgcctcgcctcctccgcctcgtccctctccggccggtggagcgggcggtggagcgcgcggtggagccagagccaccacagcaaccggcaggaggactcgtggcggtgggacccggaggcggcggtgatgtcggcgccgcgcggggtggacgacgacgagccgggcttcgtcacgctgtaccgttggatcgtaggcgtatag

SEQ ID NO: 5846 - DNA, 777 bp, Oryza sativa
  Predicted polypeptide sequence is orthologous to G905
atgtcctcgccggcggagaagtcgacgagcggcggcggcggcatgagcatgaacacggtgacgacggtgatggccttctccgtcagcgccttcttcgtgctcttcatcttcgtcaggctgctctgcgcccgcatccacctcagggcgggccaatccgccgccgcagccgcggcggcgcacggcgacgccttcccggccttcagcgtggagcgcgggatccgcgggctggagccggcggtggtgacgagcttcccaacggccaagttcggcgacggcggctcgcggcctcgcgcggcggcggcgctggaggaatcgcagtgcccggtgtgcctggaggagtacgaggcgaaggacgtggtgcgcgtgctcccctcctgcggccacgccttccacgtcgcctgcatcgacgcctggctcaggcagcactccacctgccccgtctgccgcgcctccctccgcgccgccgccgccaacgccaagcacccacccccctcccccgccgccatgctgccgccgcccctctactgcccccccgccgccgccaggccctccaccccggcccccgcgcgtgcaaccttccggcagcagcagcagcagctctccgccaccgcgtcctcgtcgtcggacgccgacgcgctccaaccggcggcagccgcagacgaccggctggagatcgtcgtctccgatgagcagcccgcgccgtccgccgccgccggcggacaggcagaagaacatcctcatcctcctcctcctgccgctgccgcgggccatcgatga

SEQ ID NO: 5847 - DNA, 776 bp, Oryza sativa
  misc_feature (17)..(17): n is a, c, g, or t
  misc_feature (776)..(776): n is a, c, g, or t
  Predicted polypeptide sequence is orthologous to G911
tctagagtccactgggnctgaggctggcgacatgtattctttttatttttttttttttttttttgaaagaaacagcactccgctgcgtgcgcggaatatatagttaatggcacataataaatacaaatgtccggtatgtaaacatcgatatggtaatctaacactacgtggagaaataatttacatcgaggatgctaggatccatctctttcggggagtcaaggagcgctcttcctcatttttagagaagtccacaaaaacatggactttcagagaaacattcaacatttccgcatagctatgctcttcatgacaccttgttgctcaaagaagaaacctccccaactgtagatcagctgacttgggccgaagataagcactcgcatcattcagagaaacagtctcaagtttatatccatctgttggacctccaaatagaagccacgcaatctggcccatgacctgacgccattgcttccctgtgtgtgatccacaattagggatcattccaggattcccaaaggtcaagaatacgctgacaggagaccaagggaattggattgacgaattggcccaagacgggacgctgcctaatattgtgaggggaatccgtacgctactttgcagccacaccaatttatataagcaccttacatcaatatattacagcaccatcttctgccaccagtgagttacacacacaactcacttaacacatgatactcgtggcactctacatctatacctaaactctcaatctcttattcctcttctcn

SEQ ID NO: 5848 - DNA, 904 bp, Oryza sativa
  Predicted polypeptide sequence is orthologous to G912, G2107, G2513
actgcttgagacgtcgcacacgtcatggagaagaacaccgccgccagcgggcaattgatgacctcctccgcggaggcgacgccgtcgtcgccgaagcggccggcggggcgaaccaagttccaggagacgaggcacctagtgttccgtggggtgcgatggcgtgggtgcgcggggcggtgggtgtgcaaggtgcgtgtcccgggcagccgcggtgaccgtttctggataggcacgtctgacaccgccgaggagaccgcgcgcacgcacgacgccgccatgctcgccttgtgcggggcctccgccagcctcaacttcgccgactctgcctggctgctccacgtcccgcgcgcccccgtcgtctccggactccggccaccagctgcccgatgtgcaacgcgctgcctgcaaggccatcgccgagttccagcgccgggccgggggagcaccgccactgccactgccacctccggcgatgctgcatcgaccgctcctccgtcggcacccgttctgtcagccaaacaatgcgaattcatctttctttcttcactagattgttggatgttaatgtcaaagcttatcagcagtagcagagcaaaaggatcgttgtgcctgcgaaaaaatcccatttcattttgcatggttacaaattcttacactgctcttttgctcgaatacattatattgcagatgaattcaatgatcgttttaatccacgaattatcaaaatatcaagtctttctgctactaaccatgataacacaccacctttttcaatggaggaggtaggcgcggacgccctcgccatcatcgtcgatgtcgccactgatgacgaggtccgcgccgctcaccagctcgcacgcctcgtcgtcgtccatgctcgccacctcggtccagcagctgaacc

SEQ ID NO: 5849 - DNA, 194 bp, Oryza sativa
  Predicted polypeptide sequence is orthologous to G912, G2107, G2513
gagagagtcatccatggaggtggaggaggcggcgtacaggacggggagggcggaaaacacttatgatgtcggcgggaaggaccaagttcagggagacgaggcacccggtgtaccgcggcgtgcggcggcgcggggggcggccgggcgcggcggggaggtgggtgtgccacgtgcgggtgcccggggcgcgcggc

SEQ ID NO: 5850 - DNA, 1272 bp, Oryza sativa
  Predicted polypeptide sequence is orthologous to G912, G2107, G2513
agaattcaaaccggatcaacctcgctcgcttactcgtgtttaggcatggacgtttctgctgcgctcagcagcgactactcgtcggggacgccgtcgccggtggcggccgacgccgacgacggctcctccgcctacatgacggtgtcgtcggcgccgcccaagcggcgagcggggcggaccaagttcaaggagacgcggcaccccgtgttcaagggcgtgcgccggaggaaccccgggaggtgggtgtgcgaggtgcgcgagccgcacggcaagcagcggatatggctcgggacgttcgagacagcagagatggcggcgcgcgcgcacgacgtcgccgcgctcgcgctccgcggccgcgccgcctgcctcaacttcgccgactcgccgaggcgcctccgcgtcccgcccatcggcgcaagccacgacgacatacggagggcggcggctgaggcggccgaggcattccggccgccaccagatgagagcaatgcggccaccgaggtggcagccgccgcatcgggcgccactaattcgaacgccgaacagttcgcctcccacccgtactacgaggtcatggacgatgggctggacttggggatgcagggctatctcgacatggcgcaagggatgctcattgacccgcctccaatggccggtgatcctgccgtaggtagcggcgaagacgacaacgatggcgaggtccagctatggagctactgatcctgcgcgtttgaactcaacttggtttggcgcgaagagatcgcatgtacagcttaagggagtcgagtacaagtacctcaggtgtactccactcgttgcccctttcccttccctttcgtttttcttgagcttatctgcagggtaatgttatgtattgctgctcttctgatgaaatgtgatcggaagaagcggaaggccagatcgagcttatgggttctgaagacggtgaaggcttgtcgagtgttgtgagcatatattcagaaagtcaggcactgtgaaagtatgaatcagatcagccttgttacgaatgagagtgatcgaccttgttcagtgtttataattgaaccacttgtgtgtaataagcagcaaagccatgttgcttgcttgatctgactcttgggaatggtatatttctcaaagaatgcaggattgactactcagaatttgacattttgcagtgaaatgataggattgttaaattaacattggaggagaggcatgtgtatatatgttaagaaacattagtaatgatgagcctatgatacttcgatc

SEQ ID NO: 5851 - DNA, 840 bp, Oryza sativa
  Predicted polypeptide sequence is orthologous to G912, G2107, G2513
ccctcctctcatcgcaccaccacgccactgagctcaagctaagctaagtgctaacctaggtgttcgaccatggacaccgaggacacgtcgtcggcttcgtcctcgtcggtgtcgccgccgtcgtcgccgggcggcgggcaccaccaccggctgccgccgaagcggcgggcggggcggaagaaattccgggagacgcggcacccggtgtaccgcggcgtgcgcgcgcgggcgggggggagcaggtgggtgtgcgaggtgcgcgagccgcaggcgcaggcgcgcatctggctcggcacctacccgacgccggagatggcggcgcgcgcgcacgacgtcgcggccatcgccctccgcggcgagcgcggcgccgagctcaacttcccggactccccctccacgctcccgcgcgcgcgcacggcgtcgcccgaggacatccgcctcgccgccgcgcaggccgccgagctgtaccgccgcccgccgccgccgctggcattgccggaggatccgcaggaaggcacgagcggcggcggcgccaccgccacctcggggcgtccggctgccgtgttcgtggacgaggacgccatcttcgacatgccggggctgatcgacgacatggcgagggggatgatgctgacgccgccggcgattgggagatctctcgacgactgggccgccatcgacgacgacgatgaccattaccacatggactacaagctatggatggactgacatgtatacacacatatcgttcgagtatatatgcttacagatatagataatactccatcagttcctactaaatacggagtatatatttttagataaaggatttatataaaa

SEQ ID NO: 5852 - DNA, 711 bp, Oryza sativa
  Predicted polypeptide sequence is orthologous to G912, G2107, G2513
atggagaagaacaccaccgccatggggcaattgatgagctcctccgcgacgacggcggcgacggcgacggggccggcgtcgccgaagcggccggcggggcggaccaagttccaggagacgaggcacccggtgttccgcggggtgcggcggcgcgggcgcgcggggcggtgggtgtgcgaggtgcgcgtcccgggcagccgcggcgaccgcctgtgggtcggcacgttcgacaccgccgaggaggccgcgcgcgcgcacgacgccgccatgctcgccctgtgcggggcctccgccagcctcaacttcgccgactccgcctggctgctccacgtcccccgcgcccccgtcgcctccggccatgaccagctgcccgacgtgcagcgcgccgccagcgaggccgtcgccgagttccagcgccggggaagtactgccgccactgccaccgccacctccggcgacgccgcatccaccgctcctccgtcgtcgtcgcccgttctgtcacccaacgacgacaatgcctcgtcggcgtccactcctgcggtggcggcggcgttggaccacggcgacatgttcggtggcatgcgcaccgatctgtacttcgcgagcttggcgcagggtctgctcatcgagccgccgccgccgccgaccaccgctgagggtttctgcgacgacgaaggatgcggcggcgctgaaatggagctgtggagctag

SEQ ID NO: 5853 - DNA, 967 bp, Oryza sativa
  misc_feature (836)..(836): n is a, c, g, or t
  Predicted polypeptide sequence is orthologous to G912, G2107, G2513
gcccacgcgtcgcacactcgagcagagcagagcagagcaaatacagttcaggaatcaggagcaagcagaaacacacacacaaatccgaagatgtgcgggatcaagcaggagatgagcggcgagtcgtcggggtcgccgtgcagctcggcgtcggcggagcggcagcaccagacggtgtggacggcgccgccgaagaggccggcggggcggaccaagttcagggagacgagggacccggtgttccgcggcgtgcggcggaggggcaatgccgggaggtgggtgtgcgaggtgcgggtgcccgggcggcgcggctgcaggctctggctcggcacgttcgacaccgccgagggcgcggcgcgcgcgcacgacgccgccatgctcgccatcaacgccggcggcggcggcggcgggggagcatgctgcctcaacttcgccgactccgcgtggctcctcgccgtgccgcgctcctaccgcaccctcgccgacgtccgccacgccgtcgccgaggccgtcgaggacttcttccggcgccgcctcgccgacgacgcgctgtccgccacgtcgtcgtcctcgacgacgccgtcccacccacgcaccgacgacgacgaggagtccgccgccaccgacggcgacgagtctcctccccggcagcgactggcgtcgaatggacgtcctggtgaatgggtgggcctgtttaggagctggcagggatcctggcccacgcgggctgaaaggtacacttccagtcctgggctacccaaggaccgggtccctgtggccggtagataagaacaaaaaaagagaccgcgtcttctttcttcctcgcctttgtgtgnaaaagaaaaatacagaggtatgcctagtacggcagcagcaacaacagagaacaagagcgcaacaaaaatccgcgagactggaacacaagaacagtacagcagtaagcacgagatagcgcagagcgcagtgt

SEQ ID NO: 5854 - DNA, 961 bp, Oryza sativa
  Predicted polypeptide sequence is orthologous to G912, G2107, G2513
ggtcctgaggtacggccggaattccgggtcaccacgcgtcgctcaagctcgccggcgaagtaaccagagagagtcatccatggaggtggaggaggcggcgtacaggacggtgtggtcggagccgccgaagaggccggcgggaaggaccaagttcagggagacgaggcacccggtgtaccgcggcgtgcggcggcgcggggggcggccgggcgcggcggggaggtgggtgtgcgaggtgcgggtgcccggggcgcgcggctccaggctgtggctcggcacgttcgccaccgccgaggcggcggcgcgcgcgcacgacgccgccgcgctggcgctccgcggcagggccgcctgcctcaacttcgccgactccgcgtggcggatgccgcccgtccccgcgtccgccgcgctcgccggcgcgaggggggtcagggacgccgtcgccgtggccgtcgaggcgttccagcgccagtcggccgcgccgtcgtctccggcggagaccttcgccgacgatggcgacgaagaagaagacaacaaggacgtgttgccggtggcggcggcggaggtgttcgacgcgggggcgttcgagctcgacgacgggttcaggttcggcgggatggacgccgggtcgtactacgcgagcttggggcaggggctgatcgtcgagccggcggggcgccggaggttgttggaggagggagagatgccgggtcgaaaatggggtcggagagtaatattcaaatttggactggaaagtgtggaccatttgggatttcgcaaactggcgggaaagagaaggagtttggggaattaagagagtggcgggaatgggataggtacttgtattggaagggcagatgcccctaggaacgatatagaggagcaggaacggaattctcttcaaggaacgaaaaaaagggggcaaaacgaggaggggacctatgacaaggggtggagagacatc

SEQ ID NO: 5855 - DNA, 1021 bp, Oryza sativa
  Predicted polypeptide sequence is orthologous to G912, G2107, G2513
cgcgtaggtcggcggaatccgggtgaccacgcgtcgccacgcgtcgcacttcttcctcttcttcttcttccagcagcagcaacacacactactgacatggagtactacgagcaggaggagtacgcgacggtgacgtcggcgccgccgaagcggccggcggggaggaccaagttcaggaagacgaggcacccggtgtaccgcggcgtgcggcggcgggggcccgcggggcggtgggtgtgcgaggtcagggagcccaacaagaagtcccgcatctggctcggcaccttcgccaccgccgaggccgccgcgcgcgcccacgacgtcgccgcgctcgccctccgcggccgcggcgcgtgcctcaacttcgccgactcggcccgcctcctccgcgtcgacccggccaccctcgccacccccgacgacatccgccgcgccgccatcgagctcgccgagtcatgcccgcacgacgccgccgccgccgccgcctccagctccgccgccgccgtcgaggcctccgccgccgccgcgcccgccatgatgatgcagtaccaggacgacatggcggcgacgccgtccagctacgactacgcgtactacgggcaacatggacttcgaaccagccggtctactactacgacgggataggcggcggcggcgagtacagagctggagatgacggcgagacgatggttgcgcggggggtacgggggggaagtcccttggactatgatgatggattgggtaaggtttggctacggttgtctcataagtatatgggggaattgggcattccgctattgtaattccgaaagggaggggctaagggcagaccagtaactggaggaggattgcccctccggggaacgcgtattacggagagtttaggccagaagagatagagctacatgtgagaatcgacgagaggagctagagacttgaactacttttgacgagagctacgcatcagttctactatatcgcgcgaattaatcactagcgctcgagatctatgacgagttaa

SEQ ID NO: 5856 - DNA, 737 bp, Oryza sativa
  Predicted polypeptide sequence is orthologous to G912, G2107, G2513
gcgcgcgcacgacgtcgcggcgatggcgctgcgcggccgcgccgcctgcctcaacttcgccgactcgccgcgcaggctccgcgtgccgccgctgggggccgggcacgaggagatacgccgcgccgcggtcgaggccgccgagctgttccgcccggcgcccgggcagcacaatgcggctgccgaggcggcggccgctgtcgctgcgcaggcaaccgcggcgagcgcggagctctttgccgacttcccttgctacccgatggacggactggaattcgaaatgcaggggtacctcgacatggcacagggaatgctcatcgagccgccgccattggcagggcaatcgacgtgggccgaggaggactacgactgcgaggtcaatctatggagctactgatgatcgcccgtgcacctgaaccgaaccagccctgatgagcaggaggactcaatgtacagcttattatggtatataatcaagtacgaaccgtacttatggtgtgccgtttccctgctattctgacgaaaatggaatgcgatcagaaggagcagaggagtgtcctttaggttggtagggggggctccatgctcgtgcgacactggcaatgggggccaaaaattttattggcgccagaaatagcacttgctgcggatgatccctttagtttctgtagtaacaagcctcacctcccaggcttgtctaataagcagctaagtttgctgcatatttgacttgcaaaaaa

SEQ ID NO: 5857 - DNA, 955 bp, Oryza sativa
  Predicted polypeptide sequence is orthologous to G913, G976, G1753, G2514
atgatcacttgcatttcatcttttcatgaacgtttttttgtgcatgttgtttactgcatttttcagtttcagctgtgtagtagcacactctgtttgcttcatcgtttgtgttcgagatggatcgagacgagagcttgggcacgcagccattgaccgggaggcgggtgcgcgcggacacaaggcacccggtgtaccgcggcatccggctccgcagcggcaagtgggtctcggagatccgcgagccgggcaagtccagcaggatctggctcggcacgtacccgacgcccgagatggccgccgcggcgtacgacgccgcggcattggcgctgcgcggcgccgacgccgcgctcaacttccccggcacggccacgtcgcgcccggcgccagcctccggctcccccgacgacatccgcgcagcggccgcggccgccgccgcgatgatcggctccggtcaccgtggcaaccagcgcgccgccgacgcgagcacgtctcgcgcggcgacggcggcgccggaggccgccgtcgccgctggggcgggcgatcagaagcgcgtcgtggacgaggacgacgtcttcgagatgccgcggctgctggtgagcatggccgagggcttgatgatgagcccgccgaggctgagcccctcgacggacggcgtcggcggcgtgtcgccggaggacgacgaggacgaggacggcatgagcctgtggaaccattcctgaaatgggcttacgggtgcatagcatttgcaggaggacaccatgtattttccatgtgttcgtatgaattctgtgcctacgtacagtacgtactcggcacgtatgcgagataggaacagagcagagcaggatactgaattttatcgtagttgtcctgttacgtgtatacggtatatatggtcactccactgatgtataagccatccgtagacgaattatggctgaaaacgatgcccctg

SEQ ID NO: 5858 - DNA, 582 bp, Oryza sativa
  Predicted polypeptide sequence is orthologous to G913, G976, G1753, G2514
atggagcaacgggcggcggcggcggcgcagcagcggcaggggaggaggcagagcgcggcggcgtgcgggatcaggcgggcgagggcggagacgcggcacccggtgtaccgcggcgtgcggttcagggcggggaagtgggtgtcggagatccgggagctccggaagccgagcaggatatggctcggcacgtacgccacccccgagatggccgccgcggcgtacgacgccgccgcactggcgctgcgcgggcgcggcgcggcgctcaacttccccgacgccgcgcggtcgcgccccgccccggcgtccgcgtccgccgacgacgtgcgcgccgcggccaccgccgccgccgccgcgatggcacaccaggaggaggacgacgacagtcggcgtcagctcgaggacgggggcggcggcggcggcgtggtggacgaggacgacgtgctggagatgccgaggctgatggtgagcatggcggaggggctgatgatcagcccaccgccggtgatgctcggcctgcaggcggacggcggtggaataatggacgagggcggcggcgtggtgaggttgtgggatcacagctga

SEQ ID NO: 5859 - DNA, 546 bp, Oryza sativa
  Predicted polypeptide sequence is orthologous to G913, G976, G1753, G2514
accacgcgtcgctggtctcgatctcctcttcccttccctatctatactctctctatctccctcttgttgcataatcatatcgacttcttgcaagctaggttcgattgtgttgagacgcatactagcttaattagcagctggccggcagatattctcttggtacagcagccatagctaggggggagtaggtgcactgtagcttaatttggcggatataggtcatcccaaggtgtatatatgtcgatgggtgtgccctaatggtacatggctgacctgaccgagcatccgtcgccgactgctcctcctcaagtgcaaacagctggcctgccggtggcggcttctccgggtcctgcctcgcctcattcaccgtcggagcaaggggacaagacggcgcccggggcagccacggcgtcgacgatgacgacggcgagctcgggcgagccgtcgccacggtcctcggggaagcacgccttctaccggggcatccggtgcaggagcggcaaatgggtctcggagatccgcgagccgcgcaaagagcgccgcata

SEQ ID NO: 5860 - DNA, 1413 bp, Oryza sativa
  Predicted polypeptide sequence is orthologous to G921
actagctcatgcgcatttcggctctcgccttcttcgccttcttctcctcctcctcctgttcttgattttcagtatattcaattcatggattcgtggattgagcagacttccctgagcttggacctcaacgtcggcctgccgtcgacggcgaggagatcatcggctccggcggcgccgattaaggttctcgtggaggagaacttcttgtccttcaagaaggatcacgaggttgaggcgctggaggcggagctccggcgagcgagcgaggagaacaagaagctgaccgagatgcttcgggcggtggtggccaagtacaccgagctgcagggacaggtcaacgacatgatgtcggcggcggcggcggcggcggtcaacgccgggaaccaccagtcgtcgacgtcggagggcggctcggtgtcgccatcgaggaagcggatccgtagcgtcgacagcctcgacgacgccgcccaccaccgcaagccatcccctccgttcgtcgccgccgccgcagccgcggcctacgcctcccccgaccagatggagtgcacgtcggcggccgccgccgccgccgcgaagcgcgtcgtccgcgaggactgcaagcccaaggtctccaagcgcttcgtccacgccgacccctccgacctcagcctcgtggtgaaggatgggtatcaatggcggaagtacgggcagaaggtgacgaaggacaacccgtgcccgcgagcctacttcaggtgctcgttcgcgccggcgtgcccggtgaagaagaaggtgcagcgcagcgccgacgacaacaccgtcctcgtcgccacgtacgagggcgagcacaaccacgcccagccgccgcaccacgacgccggcagcaagaccgccgccgccgccaagcactcacagcaccagccgccaccgagcgccgccgccgccgtcgaccggcagcagcaagagcaggcggcggcggccgggccgtcgacggaggtggcggcgaggaagaacctggccgagcagatggcggcgacgctgacgagggaccccgggttcaaggcggcgctcgtcacggcgctctccggccggatcctcgagctctcgccgaccaagaactgatccatcgttagaacgccgatgaactttgctcgatttagctgagatcgatcgatcaatttacacggtaaaattttagagttgatcgatttgcatggctttgatcggagttaggctagagagagagaggattaactgtgtatatttagtgattgattttaattagctcgctctacacgtgccaaggtggcagtttaagcaaaacgtacgataattcgttgcaatttgtaattcagctagaagattagtgtattcatggagatctattcagagtctcccagatatatatatagagagagagatagtagcattgatgtt

SEQ ID NO: 5861 - DNA, 1343 bp, Oryza sativa
  Predicted polypeptide sequence is orthologous to G921
gaagtgtttgtacttggctttgctggcctgtttctgttttgattactcgagctccagagcacagcagcagagagacgcgagctgttcgtggtcgtcgtcgtcgtcgatggacgcggcgtggcgcggcggcgttggctgctcgccggtctgcctcgacctctgcgtcgggctgtcgccggtgcgggagccgtcggcggcgaggcacgagctgcttgaccggccggccggctgccgcggcggtggggattccaagtcgatgaccaatgacgaggcgaagatcgtcgaggcgaaggtcactcagatgagcgaggagaatcggcggctgaccgaggtgatcgcccgcctgtacggcggccaaatcccgcggctcggcctcgacggctcggcctcgccgccgcggccggtgtcgccgttatcgggcaagaagaggagcagggagagcatggagacggcgaattcctgcgacgccaacagcaacaggcatcagggcggcgacgccgaccacgccgagagcttcgccgccgacgatggcacctgccggaggatcaaggtcagccgggtgtgcaggcggatcgacccgtcggacacctccctggtggtcaaggacgggtaccaatggcggaagtacgggcagaaggtgacgcgcgacaacccgtcgccgagggcctacttccggtgcgccttcgcgccatcgtgcccggtgaagaagaaggtgcagcggagcgcggaggacagctcgctgctggtggcgacgtacgagggcgagcacaaccacccgcacccgtctccgcgcgccggcgagctcccggcggcggcggggggggccggtggctcgctgccgtgctccatctccatcaactcctccggcccgaccatcacgctcgacctcaccaagaacgggggagccgtgcaggtggtcgaggcggcgcatccgccgccgccgccggacctcaaggaggtgtgccgggaggtcgcgtcgccggagttccggaccgcgctggtggagcagatggccagcgcgctcactagcgaccccaagttcaccggcgcgctcgccgcggcgatcctccagaagctgcccgaattctagcttcctttacaattctccaattcttcttacaggaaaaaacatagaggcgcatttcaatagagattagagcttaatctccccccaaatttgaaaattttatacagggtaagaattccgaatgcttttctgctgcttttaggatgtgaattgtactctctcataataacctgttggtccttgggccgtcggaagaagattgcgggcttctatcgggcctcacgatcctgagcccaattgcgaggctccttgagcc

SEQ ID NO: 5862 - DNA, 1192 bp, Oryza sativa
  Predicted polypeptide sequence is orthologous to G921
gaaagttcacgttttggtccccctcctgttcggcgacgggcgacgtacggcgccactataagaaacgtgccctattgctgtcacgccgtacttcctcccgcccaccgggcagctagcttagctgccgccatggacgacgacggcgacggctcatcgtcaccgaccgacgacagcgccgccgccgggcttttgccgctcttcagccgatcgccggccgaggatcttgaggagaagctgaggcgggcgatggaggagaacgcgcggctgacgcgagcgctcgacgccattctggccggtcaccacgcccaccagcgcgcgctcttggcgccgtcgctgtcgccgccgccgccttccgccacagcaagggcgccgagcgtgtccaccagctgcgcggcgagggaggacgccgcaccggcggtcgccgccgccgccgcgtcgacggcatgtccgtcgagacagcagccgccgaccgcggagccacggcccaaggtcaggacggtccgcgtgcgcgccgacgccgccgacgccaccgacgccaacagcatggcggagaccgtgaaggatgggtaccaatggaggaagtacgggcagaaggtgacgcgtgacaacccctaccctagagcttacttccgctgcgcattcgcgccgtcttgccccgtcaagaagaagctccaaagatgtgcggaggataggtcaatgctagtggcgacctacgagggagaacacaaccatgccctgtccacgcagacaaccgaattcgtcgccagcggctgcactacgagccagcacgccggggggtcgtcgtcgtcgccgctgccgtgctccatctccatcaactcgtcgggccgcacgatcacactcgacctgacgaaccaagcagggtccggatcgatcgcgagctgcggcgtcgaggcggccgccgtctccggcgagctcgtcacggtgctctcgccggagttgaggaggcacctcgtggaggaggtggtgcaagtgctcaagaacgacgccgagttcgtggaggccgtgaccaacgccgtggccgctagagttgtggatcaaatcccacacattcctgttcatttgtagttgtttttttttttctctttgagaacgttgatttgtagtttgtaggcagtatatatatcccaaaatgcttgcaagtatatgtacacatgtattcgcaaatgtgagt

SEQ ID NO: 5863 - DNA, 1078 bp, Oryza sativa
  misc_feature (735)..(735): n is a, c, g, or t
  misc_feature (812)..(812): n is a, c, g, or t
  misc_feature (969)..(973): n is a, c, g, or t
  misc_feature (975)..(975): n is a, c, g, or t
  misc_feature (1014)..(1014): n is a, c, g, or t
  Predicted polypeptide sequence is orthologous to G921
cgggtcggtcggaattccgggtcgaccacgcgtcgcggacgcgtgggttctctccttggctcagcttgacatcgtcggagcagcagaaaagtttgctcgatcgagctagctaactaggtcgtcggatcagtgataaatcgttcgccgatggatccgtggattagcacccagccttcgctgagcctggacctccgcgtcgggctgccggcgacggcggccgtcgccatggttaagcccaaggtgctcgtcgaggaggacttctttcaccagcagcctctcaagaaagacccagaggttgcggcgctggaggcggagctgaagcggatgggcgcggagaaccggcagctgagcgagatgctggcggcggtggcggccaagtacgaggcgctgcagagccagttcagcgacatggtcaccgccagcgccaacaacggcggcggcggcggcaacaaccagtcgtccacctccgagggcggctccgtctcgccgtcgaggaagcgcaagagcgagagcctcgacgactccccgccgccgccgccgccgccgcacccacacgcggcgccgcaccacatgcacgtcatgcccggcgccgccgccgccggctacgccgaccaaaacgagtgcacctccggcgagccctggaagcgcaatcgcgaagagtgcaagcccaagatatccaagctctacgttccacgccgaccaatcgaactcaggctggtggtgaacgatcggttnccttggcggaggtttgtccaaagtgtccaggaaaccctgtcaaaagcctattaaatgccattgtcccgctgctgttnagaatggttaaaccgcgggaacagcctgtgcagtcagggggcaacgacgacccgcgcgtttgcgggaaacatgctgcagcgagccaccctgcgggcgcggtgtctcacaacattaaccgggtgtgttgaacagtcaccgccccttcgtcttttcttnnnnngntgcgctagacactatgtagatacatgtccgtacacatgncgtgagtgctacactagcgacatatacataattacatagtaaggactcatacactgactagtgt

SEQ ID NO: 5864 - DNA, 2052 bp, Oryza sativa
  Predicted polypeptide sequence is orthologous to G922
ctcaccggttttgatttgatctgtgtgatttgagtgagtgagtgagattctttggaggagggattttggtttggtttggtttggtggtttgtgcgggattttgtggggaggagagtaatggcgaccgcagggaaggtgatcaagtgcaaagcggcggtggcatgggaggccgcgaagccgctggtgatcgaggaggtggaggtggcgccgccgcaggccatggaggtgcgcgtcaagatcctcttcacctcgctctgccacaccgacgtctacttctgggaggccaagggacagactcccgtgttccctcggatcttcggccatgaagagtgtggccgcgtcgcgacgccgccgggcgccacgccgtgacggcgtagagcggcctcttgtgccagcagaagaagaagccatggccgccggcgtcgtgcctcacctcgtacggccccgcccacccgcagctctgcagcagcttcctcgcctccatggcgccgctgtagctcagccccacccgctccatgccggccgcctccatccgcgccgcccactgccgcgcccgctcgtgccgctccacccgctccgccccctcgcacgccaccacgccgcggatctcctccccgagcagcacccgctccacgcgcgcgcgctccgccgccgccgccgcgctccgctgcaggcagtcgaacagcgacgcgtagtagttgagcgcctcgtcgaaccgctcctggaacgcgccgccgttgtggttcgcctcctgctccgtcatcaccatgatcttcggggacagcgacctcaccgccgacaggaagctccccagctttggcgtcgacgtcgtcgggtgcgccgccgttgctgctgcgggggagtggggtgacagcgacgacaccacggacgcgtcggggctcagctgcagccgcgtgttcagctcccgctccagcagctcgccgaagcttctcgggctggagcgcgcgatgatctggaccggggtgaggcagccggcggcggcgtgcctcctcccgtcgtcgacggcgaggaggcggtgaagctgcagcacgacgctgacggcgagcgcctcgccggacctgacgccgaggtcgtggcggagcgcgtcgaagtccatctcgtcgagcttcgcctccacggcgttgaactggaacgcgatgtcgaacgcctccgcctccttggacagcaccgcggccatgttcgcgaggaactccttgctgtcgtggacggcggtgatgcggaggtgcggcgggccttcccggcggcctcggaacgcgtggaacagcgcgatccactgcaccgggttcgccgccgggccggagaagtcgacgacgtggacgaacctctccccctccattgcctcaaggatggcatggttggtggtcaggtacgcgagcttcaggaacgggagcacgtcgaacatgtggcggcgcgcgacggggacgaggtgggcgtcggcggagttggccgacgacagcagcgcgcgcgagaggcccaggatgaggttgagcagcttgcgcgcgagcgcgtcggcgaagacggcggcgaggcgctggagcgcgtgcggcgcgtccagggacgcgagctgcgtgatgtgctcgaggcagaggttggcgcggtcgaaggagccggcggacacctcggcggcgcactggtaaagcaggccgatcagccgaacgctctgctggtcatggctcagctcctgcacccacgacccgttcgacggcgacggcgacggcgagtacaccgacgacgccggcgatgacgtcgccgacgacagcatgtcgtcctggaacatgcccctgtccgtgcagcacagcctcaactgctaccagttttcagagccgtgaagcttatcaagcaatggcatcattggcatgtcgccattgttgggtttgagacaaatgttgcaaggtcaggtgttcctgtgcgacgaagttgtcatgggacgacgaagggacaaagaagaagtggatgcttcttcggatagaactaagagatgtcgtctgtatcttggtggaataactaaggagcttggaattattcccttgg

SEQ ID NO: 5865 - DNA, 789 bp, Oryza sativa
  Predicted polypeptide sequence is orthologous to G922
gtacctttcttcctcctccctctctctctttatctctctcttttcttatcctcttcggctatggcaacgacgggtgggacaacgggtactggagcagcgacggcggcgaggggacgagggctagagtagtggcggcggggagcggcgtttgccgattcccctcctcttccttggctccccaaaatcctcctcgcacacaacctccgcatcgcacgccgccggccgccggcgtcgcatcgctcatagattaccggctgcgccagccatggaccatgtcaggaactcggcgttggccgcactcgagggcggggtagcgggtaataaatccgtcgccggagccggcgctgccccagggtcatcctgcaaacgaggggagcacaagcaccaagagaggagcgcgtcctgctcagggaggagacccgcggcgtggtagcgtgtgagggggcgaagctggtggagcggcacgagcgggcgcggcattgggcggcgtggatggaagcggacgacatggagcaggtggggctgagctacagcggcgccatgcatggaggcgaggaagctgctacagagctgcaggtgggcggggccgtacggccatggcttcttattctgctggcacatgaggctgctctacgccgtctccgcgtggcggccggcgccgtcgcgccgccaccacgctcggtcataggtgagccagctagctgctcgatcgattgaggtgcacgcgcatgtgttctctgatcattggagtagagtggagaactgcattaatcaacttgtgttgttttc

SEQ ID NO: 5866 - DNA, 1329 bp, Oryza sativa; identical to SEQ ID NO: 2141
  Predicted polypeptide sequence is orthologous to G922

SEQ ID NO: 5867 - DNA, 700 bp, Oryza sativa
  Predicted polypeptide sequence is orthologous to G922
gatgaacgcttacgtgtggataggatgatcctgagggaagagattaaaacatactggtatgcgagggagtccatcggcacgaacggcacgagaggctggaccagtgggcaatgcacatggaggaatctgggttttcacaatgtgcaacttagcttcagtgccatcagggagggtaaagagaatctgctgagctttggattgaaaaactgccagaacaaagaagacaggggttgcctcctactgtgctggggttatacgaatctctactctatctcggcatggaggcaaaatagaggttcatcctctgggagcagagagcatatgttagttcaacgccaaataatatggccattccagtaggcctctctgtccgtggcaattagagagcagcagactacatccaaatttcccactctgggtgctctgttcagcatatgtctggcagctcaaggtacaagctgataatgtgtgtttgcagcaagatttgactcctgcactaaagatatgctaataagttcacttggtgtaaaaaaaaaaggatggtataggtaggacatagaaatatcttttggtgtgaagtatgtaaagaactgaaaggtctgtgttttttttttctctttgaaaattggaaccaacgaaatgggattggcagagatgcttaattcatcatcgatcttgaatgattacccatcatttcgtg

SEQ ID NO: 5868 - DNA, 1959 bp, Oryza sativa; identical to SEQ ID NO: 2225
  Predicted polypeptide sequence is orthologous to G926, G2632

SEQ ID NO: 5869 - DNA, 2034 bp, Oryza sativa
  Predicted polypeptide sequence is orthologous to G927, G1334
caaaagcagcagtggcagcagccaccactttgcacaaaagaagcaaagtaaatggatggccatcgccgttgaggaagggttggtggccatctagagagagagagagaaactagagagagagaggggtgagcagctgagctctgcatctatatacagcactgcatctctctctatttctctctctatatatatctctatctacagtggattttctctctcctctctctctcttgccgttgctgttcgatactgttgttgtcctctcgtggccattattagatggcctcctgctgctgaaatgtgagtgagagctttgctttgcttgcttgctggctggctggctggctagctgggggttggcttcccctcatcctcgtgcatcatccactgtgctcggctcagctgtctgccctgttcttgctttggtggttggacggttagcatcttcctcctcaagctgagatccttcttgacgccattggaggggtcgctgtcgcctgcgtccttgagcctccctgcttttctttttctctctctctctcctcggcgagggagacgacgacgacggtggcggcggcgatgctgagcttcaagcagagccacgaggggttcggccatgtcgccgccgctggagctggaccgcagcagcagcagcagccgtggtgggcggggtcgcagctgctgtacggggaggcgtcgccggaggaggcggcgctgcgcgacggcggccagttccaggtcgtgcccggaggccgcgccgcgctggatccggcggcgccggagccggagaagacggcggtgccggcgatgcccaagagaggaggaggaggaggggctcctgaggtgctgaaattctcggtgttttcaggtaatttggagccgggagatacaggagagaagaacagagagcactctgccactattgcaatgcaatcgccgttgccagaatacaacggccatttcgagcttggtcttggtcaatccatggtctctcccaattatccttgtattgaccaatgctatggtcttatgaccacctacgcgatgaaatcaatgagtggcgggcgaatgctactgccgctgaacgcgccagccgatgcgccgatctatgtcaacgcgaagcagtacgaaggcatcctccgccgtcgccgtgcccgcgccaaggcccagagggagaacaggctggtcaaaggcaggaagccctacctccacgagtcgcgccaccgccacgccatgcgccgggccagaggctccggcggccgcttcctcaacaccaagaaagaagccaccgccgccggatgcggcggcagcagcaagacgcccctcgcgtccctcgtcagccccgccgacgtagcccatcgtccaggctccggcggccgcgcgtccagcctctccggctccgacgtgtcgtcgccgggaggcgtcatgtacgaccaccaccgccacgacgacgccgacgcggcggaccactacaacagcatcgaccaccacctccgcacgccgttcttcaccccgctcccgatcatcatggacagcggcggcggcggcggcgaccacgcctcacactccgccgccgccgtcgccgcccccttcaggtgggcgacggcggccggcgacggctgctgcgagctcctcaaggcgtgacagccttgaggcggggatctccaggcgtgcccagagctgctgctgatcgatcaccatcagctttggctgcctgtaggcaaatcattcttggctctttacttgcattggggttcttgcaagcaactctcctcgtcacctaccaaaactgtccctgaaacttctctagtgctggggtctcgatcagggatgatgatgtgatggaggagaggcttacccatatgcctgtaaattatggttagtgttctgattaagcaactagtagtacttggtaattactggctatgaattagtagtatggactctggtgtcaggttgctctttgtctgaataaactggagtcgtttgaagctttgcaacagctgtgagtgaaactatgtgcttgcttgcttg

SEQ ID NO: 5870 - DNA, 1640 bp, Oryza sativa
  Predicted polypeptide sequence is orthologous to G927, G1334
ggctgctgctgaaagcctgatgaaattgggtgattaggtgcttaacataatcccaatcctagaaaaatacattcggagtggttgctgctgagctcaaccaatcaagcttgttggggaggcaagcagtcacaatgatgagcttcaacaagagccaagaaggatttgggcaggttgctgctgtggccaccctggcctccaatggaggaggctctctaccatggctgctgtacggcgagccactggggcaggggaagccggccatgtcgccggagggcgtggtgccgagagcacagactcctctggatcctcctcaggttccagccatggacaggggtgtccctgaaattctgaacttctccatggttccaggtaaaggagaaaaatgttctgagcactcaactactattgctctgcagtcaccatttgcagaatataatggctgttttgagctgggccttggtcaatctgtggttccctctaattatccttatgctgaccagcactatggcctactttctccttatggagtgagaccaacgcctagcgggcgaattcttattccaccaaatatgccagctgatgcaccaatttatgtgaatgcaaaacagtgttcagccatcattcgacgtcgccatgctcgtgccaaggcagagagggagaataggctggtcaaagctagaaaaccatatcttcacgaatcacgccatcttcatgcaatgcgtcgtgcaagaggctctggtgggcgcttcctcaacacgaagaaagagaccaatgggaaaaccactggtggaggcaggaaggtgatggacatcatcatcccgcctctgtgccccgccgcatctcccagctcggagcagtgcaacccaagcagcgtttccagcctgtccgggtcagaggtgtcgagcatatatgaacacgaagacatggaccacttccatagctttgatcatctccggacacacttcttcaccccgctcccgagcctcatggatgtcgagcacggggctggtaaccccttcaagtggacagcagcctctgatggctgctgtgacctcctcaaagcatgactagaggggggatacaccgggcagccgaagctggcaaacatcagcagtttctgctggatacattgcccagctccaggtcagggattgtccctgctggtattggctgtctgtaggcaactcattcttggctgatcggttccgctcatcgcctacttgtcccggaaactccagcaccggtttctgggatcctgcggtgatcagaacaacccatcgcgtgtaaaaaaaaaaaaaaatcatctatgctatgctgttactgcttgctaccattatctgaactgctactactaggtagcaagcttaatctggcaaggtaaataaagtctggaactttgaactggttccagtggtgatgattgtggtgtgcttgtatcctgataactattgtgagtttgagacctggctttgttgatctactgaactactactgtagcactatgcttgaagtttgtgtgggcttggtttgcagtttgtattgttaaaaaaaactcaaatctagtgatgtattaagaccttgtttgtgtgtatcttgttaatgtggtatatctgcaagaaggtataatctgtttgggagtg

SEQ ID NO: 5871 - DNA, 1125 bp, Oryza sativa
  Predicted polypeptide sequence is orthologous to G927, G1334
atgggcttcaggcgatcaccggccgtggcggcaatggcggcgccgccgctcacgcattgccatggaggaggagaagaatcattctgccaattaagcaacacaatcatggaggacacccgaatcctgcaaaaccaccaccaccagatcctcgccgccggccggcagctgcagcagcgccaccacttcccggcaatgccgccggagcgacaccaccaccctcctcctccagctcctggaagccctgccatgaagttcccaatcatctcaggtgactctgatcttggcaaagatctgaagttccatgagtcctccgcgccgaccatcgccgcgtactcgccattgcaggagtaccaaggacactttgagctagcccttggccactccatggtttgcaccaacttctgcaactctgaacaaagctatggtgtttactccccctatggagctcaaaccatggctgggaggatgctgctgccgccggcgatcgccaccgacgtgggtccgatctacgtcaacgcgaagcagttcaacggcatcatccggcggcggctggcgcgcgccaaggcggagcgggagcaccgggtttcccggagccggaaggtaagacggcggcgacggcgacggcggcggcgagtgctcgtcgtcgtctccttcccttgtcaattcgccggcgaactggcagtgacagtgactgactcgtcttcttcttcttcttcttcttcttcggcgacggcgcagccgtacctccacgagtcgcgccaccgccacgccatgcgccgcgcgcggggcagcggcggccgcttcctcaacaccaagaacgcctcctccgccgccgccgcggccgccgacgcggcgccggtgagctccggtggcggcgaccacggggcgagcaacaagagctcgtcggcgtcggaggcgacgcgcgtgtacgacgacgacgacgacatgggcgcgggcggcggcggcgacggcggcgacttccaccacgcgatgggtcacctccgctcgccggcgttcttcccgtcgctggccgcgatgatggacggcggcggcggcggcggcgaggggaagtgggcgaccgcgacgcctcaccatggctgccgcgtcgacctcctcaaggtgtga

SEQ ID NO: 5872 - DNA, 456 bp, Oryza sativa
  misc_feature (43)..(43): n is a, c, g, or t
  Predicted polypeptide sequence is orthologous to G927, G1334
cccccatctgcatgctttgaaaagggcaagggggtccgtggtncgatttctcaactctaaggctgtggaggggaagcaagacactaaatctgtagataaaaaggatggagctgtgccatctgaggagaagagagacaagaagttggcaaatagcattatcaaattggagaactcgagcccaacaacacaaccaggttgaacaatagttccttggaaataccatgagaataacttgtttacagaacggtttgttcattcccgaattcggtgaggacttgcttggataaaaatgtgtcactgttgttcggtgtgattgctaaccgtatatgataaaaatttcatgcgcttaaaagaagcaagaaagcgtctggagcaattcagcaatatctgtgtgcttagctgacctacgtgagcatacttggtgcacgttatgaactttttactcttcgccttgac

SEQ ID NO: 5873 - DNA, 1412 bp, Oryza sativa
  Predicted polypeptide sequence is orthologous to G928, G931
gatagagcacagtcctctcctcttccccgtgctccccatttctgcttcttttcccacaaatttctctctctatctcagaaaggattcgggagacttgaagagaggagctcgaagcgggacaggagagagaggctaattatagaagtacacgaagaaaaatggtgcctggaccaaagtgagaccatctcataatgctaatgcttttgcgacaaatggaagatcatcgagcccatactacgcccaactatgattttttctctggagattatcagatgaagcagttaggtcataagatgtatgatcaagattccccgtcaagcgattctggacagtcacaccaagaagaatctgccatgaatgatagcagtccaaatgagcgacatacctcaacacaatctgacaatgatgatggtcatcagatgccagatcaggacaaaacaaagtcagtatcatcgttggggaatccaggagctttgcctccaaagctcaactatagccaatcctttgcttgtattccttatacagctgatgcatactatggtggggtcttgactggatattcttcacatgcaattgttcatccccagcaaaatggtacagctaactcccgggtgccgttgcctgttgagcctgcagcagaagagccaatatttgtaaacgcaaagcagtaccatgcaattcttaggaggagacagatacgagctaaattggaggcccaaaataagttggtgaaaggtcggaagccatacctccatgaatctcggcatcgccatgccatgaagcgagctcgtggatctggagggcgcttcctcaacacaaagcagctcgaggagcagaagcagcaacaggaggaggaggccgcatccggtggcgcgagctctggcaataggacatgccttcagaatggcaccggtagcgcgccttcagcttcctctccctctgaaatcgcgagcgtctcaaccagcagagaattccttggtaaccatgagcagagccacttcccctcagctggcttccttcccacaatgagcttcagagcgcagaatggcggagatgggaagctggtcgcgaacgccattcaccagcgcgtttccatgatgaggtgaggtgaagaggggtgaagtgggttcagctcagcaccatcactttggctctctccctgctggtggcaattcatccttggcttatgaaaataccttatgggaaaaaaaaaagtagtttcatcctcaaatggaccaaacatgtgtggctccattttaagttttcctgtaactaaaagcactgcaatgatcaactgactgttggttctgtttgtggatgcttatatctgtacttgctgtatctaatactgaactctaagttgaaaccctgaaactgatggtccccgtgaatattgtagcttgcattttatc

SEQ ID NO: 5874 - DNA, 1631 bp, Oryza sativa
  Predicted polypeptide sequence is orthologous to G928, G931
gagtacaaaggagagagagagagagactctagtgcatatttggcaggaagagccgaagaggggaggtgaggatcagaggaggcagcctcatcgtcatgcttcagcactagtagtagtagtgccaccatttctttgccctcgatctttccccagagagagagagagagagagagagagtcttgattgggggaggagagagggagagagagaaagagagaggacagaaaatgtttgtggatcttgagtaatgccttctaataatgataatgctgttgcaagaaatggagaatcatcctgtccaatgcatggccaagaccaactatgattttcttgccaggaataactatccaatgaaacagttagttcagaggaactctgatggtgactcgtcaccaacaaagtctggggagtctcaccaagaagcatctgcagtaagtgacagcagtctcaacggacaacacacctcaccacaatcagtgtttgtcccctcagatattaacaacaatgatagttgtggggagcgggaccatggcactaagtcggtattgtctttggggaacacagaagctgcctttcctccttcaaagttcgattacaaccagccttttgcatgtgtttcttatccatatggtactgatccatattatggtggagtatcaacaggatacacttcacatgcatttgttcatcctcaaattactggtgctgcaaactctaggatgccattggctgttgatccttctgtagaagagcccatatttgtcaatgcaaagcaatacaatgcgatccttagaagaaggcaaacgcgtgcaaaattggaggcccaaaataaggcggtgaaaggtcggaagccttacctccatgaatctcgacatcatcatgctatgaagcgagcccgtggatcaggtggtcggttccttaccaaaaaggagctgctggaacagcagcagcagcagcagcagcagaagccaccaccggcatcagctcagtctccaacaggtagagccagaacgagcggcggtgccgttgtccttggcaagaacctgtgcccagagaacagcacatcctgctcgccatcgacaccgacaggctccgagatctccagcatctcatttgggggcggcatgctggctcaccaagagcacatcagcttcgcatccgctgatcgccaccccacaatgaaccagaaccaccgtgtccccgtcatgaggtgaaaacctcgggatcgcgggacacgggcggttctggtttaccctcactggcgcactccggtgtgcccgtggcaattcatccttggcttatgaagtatctacctgataatagtctgctgtcagtttatatgcaatgcaacctctgtcagataaactcttatagtttgttttattgtaagctatgactgaacgaactgtcgagcagatggctaatttgtatgttgtgggtacagaaatcctgaagcttttgatgtacctaattgccttttgcttatactcttggtgtatacccattaccaagttgccttaaaaaccctccaattatgtaatcagtcatggttttatagaaccttgccacatgtaatcaatcacctgtttttgtaaattgatctataaacgctataggctgctgtgttatct

SEQ ID NO: 5875 - DNA, 1253 bp, Oryza sativa
  Predicted polypeptide sequence is orthologous to G928, G931
gagagagagaaggagaggggctttgcacttgcagaggagagaagcaaggtgagaagtgaggaggcaagggaggaggtttgccggagaggggacatgctccctcctcatctcacagaaaatggcacagtaatgattcagtttggtcataaaatgcctgactacgagtcatcagctacccaatcaactagtggatctcctcgtgaagtgtctggaatgagcgaaggaagcctcaatgagcagaatgatcaatctggtttggactagacacaccatatgcattttttgtatcagtaaataatattgcaatacagcacctccagggtaaaaggaatattgatggatgcaaagtttgtttgcatctacactactgaagttatgtgacatttcttttcttcttgtactaatgctaggtaatcttgatggttacacgaagagtgatgaaggtaagatgatgtcagctttatctctgggcaaatcagaaactgtgtatgcacattcggaacctgaccgtagccaaccctttggcatatcatatccatatgctgattcgttctatggtggtgctgtagcgacttatggcacacatgctattatgcatccccagattgtgggcgtgatgtcatcctcccgagtcccgctaccaatagaaccagccaccgaagagcctatttatgtaaatgcaaagcaataccatgcgattctccgaaggagacagctccgtgcaaagttagaggctgaaaacaagctggtgaaaaaccgcaagccgtacctccatgaatcccggcatcaacacgcgatgaagagagctcggggaacaggggggagattcctcaacacaaagcagcagcctgaagcttcagatggtggcaccccaaggctcgtctctgcaaacggcgttgtgttctcaaagcacgagcacagcttgtcgtccagtgatctccatcatcgtcgtgcgaaagagggcgcttgagatcctcgccgtttctgtcatggcaaatcatccttggcttatgtgtggtgcccagcaaaaaaaaatctgactgaacctgtgtgtaaactgatgggtatgggtgggttttgtgcaactgtaactagggtgcttgacatctgtgtctgttgttcctctgcctccttagtttggagacggtgcagctgcagctggtaccagtaatctgatcatgctagacttgtgacaaggacaaaactagcaccccgttatgtttcctggcttctgaatttggtggtcattcagc

SEQ ID NO: 5876 - DNA, 1312 bp, Oryza sativa
  Predicted polypeptide sequence is orthologous to G929, G2344
gcttctcatctcatctccctctcctctcctctcgccgtcgccgtcgccgtcgccgccgctcgccgccggcggggatagagttcgccgggatcgcctcgccgggagagttccctcaccatcccgcacctccgctcgcctggcctcttcctcccggaagtgtggtgtgctgcaagctcctgtctctcctacaaggtttcaaaaccaaaatatgcctgaagcacacggaaagctggggtgattaacgtctgtttcttttgactacaatcatcctgattctgcttctgtctgcaaaaacaaccaagccatgacgtctgtagttcatgatgtttcaggcaaccatggagctgatgagcggcaaaaacagcaaaggcaaggtgaacctgaggaccagcaagaagcctcagttactagtacagatagccatacaatggtagcaacaccttcaacagattatgcgacaccctatgcccatcacgatatggcccatgcaatgggccaaattgcttacgcaaatattgatccatattacggaagcctttatgcagcttatggtggacagcctatgatgcatccaccattggtcgggatgcatccagctggactaccactgcctaccgatgcaattgaagagcctgtctatgttaatgcaaaacagtacaatgccatattaaggcgtcgacaatctcgagccaaagctgagtctgaaaagaagcttgtcaagggccgtaagccatatctccatgagtcacggcatcaacatgccctgaaaagggctaggggagctggaggccgatttcttaattcaaaatcggatgacaaggaagagcattctgattccagttccagagataaacaggatggagttgcaccccgtgatagtggccaaccgtctacctctccgtcttcaaagggtgcatcatcagctaaacaaaataagaagtcaaaaaccagtaactaaacgggatttaaacacctggtgtgaaacatggaaacagttttgtacagtacatgctagcgatcgacaaagaatggtgtcattgggtgttgtaggataatgctccatagagaatatatagacagggcaacagattttgcagcctttggttcggtctgctcagtttctttaccttcttgtacaatgagtagttttcgtcagttgtgctttgtcatggggatagctgaatttcttcaggaagtcttgtagttttaaagagttcattagcttgccaattgtttgctttggattggattggtctcttactgcctttgcatcatcatctgcagtgcacagaataaaacattggctatgtgt

SEQ ID NO: 5877 - DNA, 927 bp, Oryza sativa
  Predicted polypeptide sequence is orthologous to G929, G2344
atcttcgagagattcctcccaatcccgagcagaatcccccgccccggcgaatccgcgcggcgctcgagtgaatttgactagctagtagccacgcatgaagccagatggtgaaactcagcttcgtcctacagctgctggacatccagatcctggtttgggcacatcatctgcagaatacgtggcctctctaggaccagctacagctccagtatcttatccatatatcagtacctattatggaggcacttatggtgcttatagtggacaacctctggttaacgctgctttaatggcaatgcctccgcattctgtgcccttggtgaccgatgctgttgtagagcccatatatgtcaatgcaaggcagtatcatggtatattaaggcggcgccaatctcgtgcaaaagctgaatcagaaaataaggccaacaaaatccgcaagccttacctacatgagtcccgccatctgcatgctttgaaaagggcaagggggtccggtggtcgatttctcaactctaaggctgtggaggggaagcaagacactaaatctgtagataaaaaggatggagctgtgccatctgaggagaagagagacaagaagttggcaaatagcattatcaaattggagaactcgagcccaacaacacaaccaggtgcagatgcgtccgatgttgtatgatgcaaatttagccaatccctccctaatccaaccaaattgccagaatcgatcgaattgtgtgcttgctttctgttcgtgacagtttaagtctgtacatagctgttagttttgatgattggataaatccatgatagtatagtgaacatgttgtgggagcagttcagtgctagggtttgttgctgagtgtagattatgaaccttgtgtcactgttgtgttttgcttctgttaatgaatggtagcttacaatggg

SEQ ID NO: 5878 - DNA, 450 bp, Oryza sativa
  Predicted polypeptide sequence is orthologous to G932
ccgttgttgtcctcgtcgtggtcgtctgcgagccgcaccgcctctgcccagatctggcgaggagggtcaccggtgttgtctatggcgatggaggagggtcgaaggacagctccgggctaccgatggaggatgcgtcgggcctcgagctccgccgccatcggccccgagcttcatcgctggtgctgccgacgcccgacacccatctcgtctctccatcaggagaggggaagaagagagatggaaagggaggggcaaaagtgacatttaacagtagggattagacggaggttgacagaaaattagacggcagtggcatggttccaattttcctaaattttagtagcacgtagccgatatcgtaaatagtagtggcatgtattatattattaaaacagccttgaaaggagacaccacgttcgctgtggaggctagaaattcccaaattaatcg

SEQ ID NO: 5879 - DNA, 560 bp, Oryza sativa
  Predicted polypeptide sequence is orthologous to G938
ctcacccttcctcttctctctctcttctctagctctgggcaggccggcgcccgggcgaggccgggggaggagatccagcggccggcgacgtggcggcggtggcggcggcggcggacaccacgctgggtttgctgctctcggcgctgatgcagcactacgacccgtcgtagcgccacttcctactggagaaggacgtgccgtcgccgtggtggccggagcggacagaggcgtggaggagtcatcggcggcctggatgcgttgacggtggagcacccgtgcgtagcgacgtagtaggtccggagcacgtcctggcggacgcggagcttgccaaggtagtcgaggacggagaccatgttcgctgtagtttgagcactggatttgtgatttcttttctttttttttttttgccttttcatgatttgctcgatgtagatgggcatggagctctgatttgctcgctgcagtttgagcaggatctctgattttctaatttgatttttcatttgctcgcatgttgatattgaaggatttagcctaaaaaattaaaaaaaaaaaaaaaa

SEQ ID NO: 5880 - DNA, 2435 bp, Oryza sativa
  Predicted polypeptide sequence is orthologous to G938
gatattctcatctgattactccgcggcggcggcggcggcgggagcggcatctcctacgagattcctctcttgatggtatcgttgaacaagccaactaagcacaaggagttgtctcgggtgatgagataatttggttaaggaaggtaggaaacagtaaattcaatgggcaatccttctattctcacggaggatttaggcgatacgtctgactttgaggttgatggcgtcgagaacctcacggagaatgatgtcagtgatgaggagattgatgccgaggagctggcccgacggatgtggaaagacaagatcaagctgaagaggatcaaggagaggcagcagaagcttgctctgcagcaggcagcactagaggagtccaaaacaaagaagatgtctgagcaggctctccgcaagaagacggcgagagtccaggatgggatcttgaggtacatgctcaagctgatggaggtgtgcaatgctcgtgggtttgtttatgggatcattcctcataaagggaagcctgtcagtggtgcatcggataacattagagcttggtggaaggagaaggttcggttcgatgtgaatgggccggttgccattgcaaagtatgaggttaagaactcaatgctggttgatgctaagcgcagaggggtcttgaaccagcatagcttgatggatctccaggatgctaccctgggatcattgctctcatcgttgatgcagcattgcagcccgcagcagcgcaagtacccactggataagggtgtccctcccccatggtggccatcaggaaatgaggattggtggatttctttaggccttccaatgggaatatcaccaccatacagaaaaccgcatgatcttaagaaggtttggaaggttggcgtgctgacgggtgtgatcaaacacatggccccaaactttgataagatcaggaattgtgtaaggaaatcgaagtgcttgcaagacaaaatgactgctaaagagagcttgatttggctgggagttcttcgaagagaggaaatatattttcgcagttctgacaatgttggatcacagattacacaccgtagttctcgtgagggaaaaagtgatgatatatatagcagcagtgatgagtatgatgtcgaccatttggaggaacctcctcgctcttcatcatccaaagataatgtggggcgtcgtcagccaactgcgcagatcagagaggagcatacctctagtcgacacaacagaggacgccatgatcagcaacccaatcaagtacttcctagcaatgaagggaccaatgaatcaaggaagagaaagagacctagtggtcatttacttactgctgaatctgaggttgaggtaacacaaaaagatgacaatcaactagccattgtgagcaatgcattgcccaatatgagcagaataaaccaaacggagatgatgggcatggctaaccagatgacaagcctcagccatgtcaatacaactgaaactctacagcatcaatatgttcaagggaacttcgtatcttctcctgctgctgtggttaataactataacagcaaccagattacaaatgttaatccttcaaggatttatatgggatatcagcctttagcatgccaaaataatggtcacacaaatccatggtctgaagacacttttcaggttgatgttggtccaccacctattggttttactactaattcttcgtcaggtggtaatcattcttttcccatgaaacaatcactaccaaaatctatagatgatcatgtgcctattacggagacaggggtgttggctgatagcagttcatatggttatcatatcacagccacaggtagtaggaattcaacctctgttgctggccatggaaatcagctcatgggagatcctttcgacagtggtactgctgataagttcaatgggaattcgtttgatggattgccttttgacttcattggtagtagtccaatccctgacatcggtgtattgctagatgatgatgatataatgccatatctgggaacataacctaggcaactcttttgcaattgtaagaactgcgacatccagaaatgtaaatggtggcagaagttcctgtatcgttcattagctaatcgctgagaacttgagaagggcgcgctcatcatggcatgctggtgttccgcttaacctgctgcaaccagtgaaggatgcgtcgtgccaatgatctgtaatttgtacctatcgcttttaattagcctgttctggattatttagcctggctgtaaaaaagctcatagaaactcgcttagctggagaatttcctgcaatgctggatggttgtatacatttttacctgtgctaccatgttaattttgctcagttactcatagataaatcttgatgtatatgagacatgttcattgcagctagctcagacataataatacctgaattcttgc

SEQ ID NO: 5881 - DNA, 2991 bp, Oryza sativa
  Predicted polypeptide sequence is orthologous to G938
ggcctttgcttgcttgctgctatccccttctctttctgttgtgggcttgctgttctccatgtcctcctgttgatggttgcttgtgttcgagtttttttctttttttttctttttttttcttggagaggatgtggttgtgttcatgataggttggtggtctgtgatctgtttgggtagatcttttgtcctctttttcagatatttcgtggatgctagagctgcctgcggtagccaattcctgtttggctacttcttcgttgccctttattcccttccaattttattccgtgattttctgttcttgtgcgtagaattgtttctgccaagcttgagtaaatccatggcagaggtcaaagcttagcttttttcagattatacgatttgctgccagccaaaggagaaagggaaaaaaacttagaaattttctactagttttctcttgttgtgttcattagatctcagagattaacctaatttaaggaatacatgttgtaaatcctgctctgggaatgttaagtggttgggtgtaaggaagcatcttgttttgcatcgagtttatggccaaaaacaatcattgatgcttcctctaaggcggtgtatgttttcctctgttctccatttgatgtgttcttgatccattttcgtctcttgttttcttctgttcttttagatggcctccgattccttttgataagcacatgggtacatgttcttgtttccaacagtccatgccggtcgtggtagaccgaaaaaataatccataaaaatatatcctttttctgaaatgtttttcccgtgcttttctattcctttttcatctcccactttgatctgatcaaggcttgttgtttcatgtgtttcaaaatacttcacggaaaggataagaaaaggagaaatttcacatgtttaagtttcttttgatccctacttgtttcaaagcagcatgaaaataccgtttcagctaatcccgtgcatcgcaaaatgttttcatgcttcggctttgactaattcttccgttagtactttatttatgatcatgtctgaatcatgatacctttatgctgtgtagtatgattatgtcacaacaaaagataaccatgtcctatatgactgttaattgcgtgctcttaactctgtgagaggattgcaggagatatgtctgatcagataaagatctctctgtttcaccaaacacatgcaaaattaggctctggcccttgcttcaataggcaaacctaattttactcgcgcgataatctcctggtctcctggctttctagatcttagaatgttttctgaagggaaacaaaccagtactgcctctttatttttggtaatggcgtaattgccgcattaggatgctgcggtaaccgtagtcgtgttgcgcatgtattctcagttaaggaggtagtagtaacacttattgcgtttagacgaagtaatcagttgcttaaacttggttttgatttctgtaattaacatcagcttcttctcttgcttgtgtgcaggtgaattactacttgagtagaagtggtacaagaagagtcgtcgtctacctgtgggcgaattatttcgaggttgtgcgttgcgatgatgggaggtggtctggtgatggaccagggcatgatgttccccggcgtgcacaacttcgtggatctcctgcagcagaacggcggcgacaagaacctcggcttcggcgcgctcgtgccgcagacgtcgtcgggggagcagtgcgtgatgggggagggcgacctcgtggacccgccgccggagagcttcccggacgccggtgaggacgacagcgacgacgacgtggaggacatcgaggagctggagcgccgcatgtggcgcgaccgcatgaagctgaagcggctcaaggagctgcagctgagccggggcaaggaccccgcgggcggcgtcgtgggcgacccgtccaagccgcggcagtcgcaggagcaggcgcggcggaagaagatgtcgcgcgcgcaggacggcatcctcaagtacatgctcaagatgatggaggtgtgccgcgcgcaggggttcgtgtacgggatcatcccggagaagggcaagccggtgagcggcgcctccgacaacctccgcggctggtggaaggagaaggtccgcttcgaccgcaacggccccgccgccatcgccaagtaccaggccgacaacgccgtcccgggcttcgagagcgagctcgcctccggcaccgggagcccgcactcgctgcaggagctgcaggacaccaccctcgggtcgctgctctcggcgctcatgcagcactgcgaccctccgcagcggcggtacccgctcgagaagggcgtccctccgccgtggtggcccaccggcgacgaggagtggtggccggagctcggcatccccaaggaccagggcccgcctccgtacaagaagccccatgacctcaagaaggcctggaaggtcagcgtgctcaccgctgtcatcaagcacatgtcgccggacatcgagaagatccgccggctggtccggcagtccaagtgcctccaggacaagatgaccgccaaggagatctccacctggctggccgtcgtcaagcaggaagaggagctgtacctgaagctgaaccccggtgcccgccctccggcacctaccggcggcatcaccagcgccatatcgttcaacgccagctcaagtgagtacgacgtcgacgtcgtcgacgactgcaagggcgacgaggccggcaaccagaaggctgttgttgtcgccgacccgaccgcgttcaacctcggcgcggctatgctgaacgacaagttcctcatgccggcgtccatgaaggaggaggccaccgatgtcgagttcatccagaagaggagcgcgtctggcgcggagcctgagctgatgctgaacaaccgtgtctacacctgccacaatgtccagtgcccgcatagcgactatggatacgggttccttgaccggaacgcgcgcaacagccaccaatacacttgc

SEQ ID NO: 5882 - DNA, 3156 bp, Oryza sativa
  Predicted polypeptide sequence is orthologous to G938
gtgggaagagaagcgaatcttttccacctccactgggcaaaaaaaattaaaaaaataaataaaattccccattcccccgaacagattgattcgcttcgattcgagggaggaggggagcacagcgatttcttctctctctttcgccgtcgcattcgcctcgcgccgcgccgcgcacaatcccatccgctgctgcccaaggcttgtttcgcggattcggattggtgctgactcgctcccgattggcaccgggaggtatgaattctcgctaggatttcggtgggcggattgctgacgaggagagggttgggggggagtggagttggatgtgatcgggttgtgggaaatccctagtttgtggtgtagtgatggatcatctggctatcattgcgacggagttgggggattcgtcggacttcgaggtggagggcatccagaatctgacggagaatgatgtcagcgacgaggagattgaggccgaggatctggcccggcggatgtggaaagacaggatcaagctgaggaggatcaaggagaggcaggacaggctcgcccttgcgctgcagcaggctgagctggacaagtccaaggggaagccgatatccgatcaggccatgcgcaagaagatgtcgagggcgcaggacgggatcctcaagtacatgctcaagctgatggaggtgtgcaacgcgcgcgggttcgtttacgggatcatccctgataaagggaagcccgtgagcggcgcttccgacaatattagagcttggtggaaggagaaggtgaagtttgataagaacgggccggcggcaatcgcaaagtatgagtcggagaacttggcgtcggctgatgctccgagcagcgggatcaagagccagcacagcttgatggatctccaagacgccactctcggttcactgctttcgtcattgatgcagcactgtgatccaccgcagcgcaagtacccattggagaggggcactccacccccgtggtggccttcagggaacgaggattggtggattgcgttgggccttccgagggggcaaattcctccgtataaaaagccacatgatcttaagaaggtctggaaggttggggtgcttacaggtgtgatcaagcacatgtccccaaacttcgataagatcagaaaccatgttaggaaatcaaaatgcttgcaggataagatgactgcaaaagagagcctgatttggttgggtgttctacagagagaggaaaggcttgttctcagcattgacaatggcatgtcagaggttactcaccacggtgctctggagtacagaaatggggacacacacagcagcagtaatgagtatgatgttgatggttttgaggaggctcccctttcaacatcatctggagatgatgaacaagatctttctccggctgcacagttgagcgaggagcatgccccaacaaggagagaaagagctaaagtcaaacgccctaatcaggttgttcctaagaaggcaggaacaaaagaaccaccaaagagaaaaagaccacgccacagtgtcaccgtaattgagcaggaggtacaaagagctgatgacgcatcagaacattcaaggaatatgattccagatatgaaccgactggaccaggtagaaatccaaggcatggctaaccagattacaagcttcaatgaggaagctaatacgagtgaagctttgcaacacagaggaaatactcaagaactggcccatcttcctgccgattttaatcactatggcaatgcgcaggcaacaattgctactcctgtaagcatatgcatgagaggccaggctgtaccttatgaaagcagtgacaattccaggccaaaaactggaaatatcttcccacaggattctgattcaggctttaacaatatgcctagtagttaccagaccatacctcctaagcaaccacttccactatctatcatggagcatcatgtggttcccttgggtatcagaacaccagctgacaacagtccttatagtgatcaaataattggtagtgggaattctacttctgttcctggagatatgcagctcattgattaccctttctatggcgaacaagataagtttgctggcagttcctttgcgggattacctttagactatatcagtatcagtagcccaatcccagatattgatgatttgctgctgcatgatgatgatctaatggaatacttgggaacataacataggttaggctccaatgcctccttgcatttgtttctgtcgcccattttgtcagtaggattaccatcgtaacttgagtatggaaggctatacttcttattttgccatcaaatatcaatcttgttagttgataccgtttctagcatggcaaattatacctgacttgcattctttggaaatgatatatcaaatgatgaccgaattgtaaatgggaaaggtgtatatgatttaagtttgaaatatggccttttctgaagaaagatatctagtgaagaatgaacatagtttttgtaatttttttagcctgcgagaaatgaaagttttggtctcctgctttctctcactctctccccttatgcattctacagaaacattgagaattcacctcaacattttatatgcgactaataaatgaaaaatcatcagttgataggaacctcctgtatccgatctgtccatatgttcaattacaatgaagtagagaactgttgtagcagatcaaaagctctttgccagtgccattttctaatagttacaaaagtgaagcaattctataagtgcatataaaattttaggatactctaatgtaatggcactatctaccaggtggcaatgggggctgctactaaatcacaccaacactatcctcctctgtccccttgtgctacttggcaattggcatagttatttttggagatagctgagagaaaagaacccttgatgcaacgatacatcatacatggcaatatggcatagttacttttggtggtctcatgcagctgtgaagttagatcgatgtaattgaacatcagtacccaggcttgatgtgatgatagacaagtctttgtgcattccctaaaagaaaataacccttaaatctgtatgatactatgatagcttgtcctgctggacattttgtatgactggtacattttccaatttgtagaatctgttt

SEQ ID NO: 5883 - DNA, 2103 bp, Oryza sativa
  Predicted polypeptide sequence is orthologous to G938
ctagctgagtgccaagcttatggaaagagtggtagagtaatcagaaggagatagataagggcatagagagagtcagagagaggtggatctatagatagctactgctctgctgctgctattaagtcagtctgtgctacgatcgaggagatgatgggagcagcggtgaccatggtggatcggcgcatggcgttcgcggcggaggccgacgttgatagcaaggccgcctttggattcttcggaggcgagtgcttcgtcggcgagggcgacctggtcaacccggcgccgccgccgccgcagcagcagcaggtgcacgagggcggattcgccgccgaggacgagagcgacggcgacgacgacgacgacgacgacgacgacgtggacgacatcgaggagctggagcgccgcatgtggcgcgaccgcgtccggcacaagcggctcaaggagcttcagcagagccgcgccgggagggagagccgggcgggcgacgccggcggcggaggcaggcagcagcggcagtcgcaggagcaggcgcggcggaagaagatgtcgcgggcgcaggacgggatcctcaagtacatgctcaagatgatggaggtgtgcaacgcgcaggggttcgtgtacggcatcatcccggagaaggggaagccggtgagcggcgcctccgacaacctccgctcatggtggaaggagaaggtccgcttcgaccgcaatggcccggccgccatcgccaagtaccaggccgacaacgccgtgccggggtgcgacggcgacgccggcggcgccgcgccggcggggccgcactccctgcacgagctgcaggacaccacgctgggatcgctgctctcggcgctcatgcagcactgcgacccgccgcagcgccgcttcccgctggagaagggcgtgccgccgccgtggtggccggaggggagcgaggcgtggtggcccgaggccggcgtgcccaaggagctcggcccgccgccgtacaagaagccgcacgacctcaagaaggcgtggaaggtcgccgtgctcaccgccgtcatcaagcacatgtcccccgacgtcgacaaggtccgccgcctcgtgcgtcagtccaagtgcctccaggacaagatgaccgccaaggagatcgtcacctggctcgccgtcctcaagcaggaggaggacctctatctcaagctccatcccggcgccctccccccgccgctctccgccgcgtccttcaacgccagcgtctccggcgagtacgacgtcgaaggagtcgacggcgacgaggccgggaacaacaacctgcagaaggcgcagaacgacgcgaccgcgttcatggacctcaccaccaccatggatgctgctctgagcaacaacaagttcctgatcatgccgctgatgaaggaagaggccatcgacgtcgacttcatccagaagaggagcgagccggagctgatgctgagcagcgacagccatgcccgcgtctacacctgcggcaacgtgcagtgcccgcacagcaactacgcgctcggcttcctcgaccgcaacgaacgcaacgcccatcagtacgcctgcaagcacaacgccgccgccgccgccgccgagagcaagccgccgccgccgcacatcttcgagccactcggcagcttcgacttcgacctccccgtcgacggccagagatgcctcgccgggctgatgaccatgtacgacaacgacgtcgccgccgccacgcagatgcaccaccaccaccatcagcagcagcaggctaatttcttcatccgcgacgacgcgccgttcggaggcgacgtcgccgccacggcggcggcggcgccggagttcaggttcagttcaaatttcaacgtgacaggagggggcgccgtggactacggcggcgccatgcagcagccgccggcgaagtacgccggatccaactggttctactgaaacgaattcgaatcgaatgggaaccaaaagaatcaccacccctagttcgattcgatcagtagcttgtagctgtaggggattagaggagctcataagcctgattaattttcagtgtgcttgtaagaattattggttaataatttttcagtgtagatccatgctatgcaagcttgc

SEQ ID NO: 5884 - DNA, 1299 bp, Oryza sativa
  Predicted polypeptide sequence is orthologous to G938
atggcgttgtcgagcttgcaagattctgccttgggcggtggcggtggcactagcgccgctcgcgactgctccgccgacctctcgcgcaacggccaggcgtgtggccccgtcgccggcaacttcaagggctcctacctcgccatgctcagctcggggggactcgtcttcggcatcatcaacatcgtcggcaacttcggaacggtcttcgtcgacaacgagcaagacgggatcctcaagtacatgctcaagatgatggaggtgtgcaacgcgcaggggttcgtgtacggcatcatcccggagaagggcaagccggtgagcagcgcctccgacaacctccgctcctggtggaaggagaaggtccgcttcgaccgcaacggcccggccgccatcgtcaagtaccaggctgacaatttgttggcgacaatgccgtgccgggggccgcacttcctgcacgagctgcaggacaccacgctgggttcgttgctctcggcgctcatgcagcactgcgacccgccgcagcgccgctttctgcttgagaagggcgtgccgccgccgtggtggccggaggggacaggcgtggtggcccgaatccgtcgtgccctcaccatcgcggcccccgcccccgtttccaccgtcctccacgccgccctccgacctcgacggcatcctcgccatgggcggcgacggcatcctctcccgtcggcgccggcgcgcgccgctccctctccgtcacgcctgagagagagagaggagagacaggaagagaggggagatagggaaagaggaggaagaagaggatgggacgcgccggatctgggcaaggagccagatccggctgtcttcctctccaccaacgccggccgacgcctagaggggcgccggaggacgccagtggcagccgcggggtgcctgcgtgctctggccaccaccggccgccgccggatccgggtgcgccaccgccggatccgcggcctccaccattgccaccccaacgccgtcaccatccccgccgccatcacccacaacaccaccccgcgcaactcacctcgaccgccaccgtcgcccgtccccgccgccagcccatcccgtcagatccggccggaacggcgcggatctggcggacaccgccgtcgccactccgggcggctccccaggccgcccgagcgcgaggagacgaggagcgccccgccgccgccgtccttgtggctgcgcggcttcgccggcggccgctcgggcgacggcgaggcggagaagggggtgggggtgggggagaggggcggccgggtcgttgcctcctga

SEQ ID NO: 5885 - DNA, 2140 bp, Oryza sativa
  Predicted polypeptide sequence is orthologous to G956
gactctctcctcgctcccactcccacccacactgctcacgctgccattgtcgcagtgtttgcacttcattccattccattccacctccactgcttcgtcttctcttctcttctccgagtacggtgacagggagtgcaggttcgcgcgccaccatgccgccgctgtcgctgtcggccaaggcgaggaggggcttctcctcgtcgtcgtcctccgcctccgccgccgcgtcctcctgcaggtcgcagctggagcaggacgtgaagaagctgcagaaggcgctgcaggaggagacgacgctgcacgccatcctcgagaacgcgctccaccgcgccgcgctcactctcgccgacatgtcctacctccccaccaacgcacaggagctgctctccaacatctccatcctggaaggcaccatctccaagctggaggacgacatggtgtccctgcattttcagctcatccaggagcggaacgagaggaggctcgtcgagtaccgcctcaagcaggcgccgccgccaccgcagctgcagctgcagcagccacgctccgtctgctcctgccactccaccaaatccgaatcagatgacaccgcaaacgagaagtcatgtagagtggacaaggtttatccttttgctgtcctgcacgactcagctatgaaactacagaggcagctttcatccaaatgctttggcaatcctaatcagctttcggaggacatcgttcgctgcatgaagaacatcttcatttccttgtcagattcctgcagggagtcctcgaggactccctcgacggagaagcagcagtctggaccatctcctagcggaaactattcaatttctgcattctggtcgctgtccgaaccaacttccatatcctcctgggtgcagagtcctcaggtcgatttgaactacaacaataatctattagcttcagagaccgtctttgatccgtacaaagctcgcgagaagcttagttgggctgacattgggagctacggtgcagcggctgaagtttcgtggatgtcagttgggaagaaacaacttgagtatgctgcagaatcactaaggaaattcagattgctgattgaacaattggcagaagtaaacccaattcacctcggtgatgacgcaaagttggcattttggatcaatttatacaatgcactgatgatgcatgcttatcttgcttatggcgttccacggagtgacataaaattattttccctaatgcaaaaggccgcatatacaattggaggtcactcattcagcgctgcattcatcgagtatgtgattctgaagatgaaacctccaaatcataggccacaaatggctctgcttcttgcccttcagaagataaaagtgcctgaggagcagaaaaagttttgcattgggtcacctgagccactcttgacatttgctctcagctgtggattgtactcttctcctgcggtgaagatatatacagcaggcaatgtaagggaagaactccaagatgcacaacgtgattttattagagcatcggtaggagtcagtcgaaaggggaaacttctggtccctaaaatgctgcactgttttgcccgcggttttgttgacgacaacagcttccctatctggatatcacattttctacctcagcagcaagctacttttgttgagcactgtgtgtctcaaaggcggcaaagtctcctgggcacccgcacatttggcatcattccgtttgattctagatttcggtacctcttcttgccagatatgggattttcaaattaactgccctgacatgtttccccatccagataacatagaagcctaacatgagaaacacagtgaccaagtctcgtgagcaaacctattggttacagttgaaacaagcttttgcagcaagcaagtatctggattacagtatttcttaaacaagcaaatgcacatccagtgatcttggaaatgcaggtttggtaaaattttgaatcggtataagcactggattaagattgacatctttggatgtcagatgtaaaaaaaatcttcagcatgtcttaataggttcccttgcctcgacttcttgtcgaactcagcaaaacatgttgtacattgtatgtgtagtagcaaataaacaatgaagttagtaaaggaattcactg

SEQ ID NO: 5886 - DNA, 2268 bp, Oryza sativa
  Predicted polypeptide sequence is orthologous to G956
ggcgcggaggacgcattggccgccgctgcagccgtggccgtggcgtccgacaagatgcgctccgtgaccctgggcggttcgatccagagggtgatgcggaggattggcggcggcggtggtggccggagatcggccgggtcgaggggcgcgccgcagcgggcggaatgcctgggggcggggagcggcgacgcgtcggcgagctgctccggggatgatagtagcaatggcactggcaagagggatggaagcagaagggtaaggatgcggcggtacagatcggagctcgagcaagaagtaaagaaactgcagaggcaactggaagaagagattgacttgcagttggcattaacagatgccatcacaaataatgctacactgatacttgagccctctgcaaagcttccaaacaaggcacaggagctaataattagcatagcctccttggagaatactgtctcaaaacttgaaaaagacctaaatgacttatgttaccaactgtgtcatttaaggaacaatacgcgacttgcagaaaataattccagatacttagaaactctagctgaagaaaataattccagaggtctactgtctacatcattacagtaccaaccaccgtcaacttgtaaatgtacaggggaggaagacatttcaacactaagagatataaagctcggagaatctgaatcaatgcaagaaaatttattccctgggcttgaggaccaacagaacattcaaaaagagagtgaagggagagagatagtatctcaagatgggcttctcgaagagcatcaagatgttccttcaaatagattgttggaaaaacactggaacgaagagatgcaagagtcctatcctatggaaaatggaggcagagaatatcagataatagatgcgttatcatttgaccaatctcatcagaggaaaagcagcatcaatggtaatgtgtggaatggcaatccaaataagctctctgaagaaatggtgcgctgtatgagagatatcttccttcgtttatctgactcatcatccgagatatcaccaaaagggtcttctgttaattcaatttcatcaacagaacgtctatctggctgtacattgacatctgtatcagattcatccttgatggcatcagtgatgcaaagcccttcagttgattcaaaccatgacagtattgatgaagttagatacttcgatccctacaacgttaatggcaaggaagttcgaagagacattgggaactattgttcagtagctgaggtgtcttggatgtatgttggcaaggaacagcttgcatatgcatctgaagctctaaaaaatttcaggaatctcgtggagcaactatcaaaggttgaccctacatgtatgacctgtgctgagcggttagcattttggattaacctgtacaatacgttgataatgcatgcatatttggcctatggggttccagaaaacgatatcaagctcttctcactaatgcaaaaggcctgttacattgttggtgggcagtccttcagcgcagcagaaatagagtttgtgattctgaagatgaagactccagtacaccggccacaactttcgttgatgttggcccttcacaagttcagagttaccgaggagcacaagaaatattcgatcgatgatgcagagccccttgtgttgtttggccttagctgtggaatgttctcatcacctgctgtcaggattttctcagccgggaatgttcggcaggagcttcaggaatcaatgagagactacatccgagcatcggttggtatcaacgacagcgggaagctcatcgtcccaaagctgcttcagagctatgccaagggcaccgtggaggactctctgctcgccgactggatctgccgtcacctcacaccaaaccaggtcgcagctgtccaagacacttcgtcgtcgcggaaacagcggcttcttggtgtgcgcagcttcagcgtcgttccatttgactcaaaattccggtatctgttcttgcctgacaacagtagctcccagcactgaaccaagcttgccctgccaattgttcagaaagaaaccaagagtagcattttgacaaactgaaaaagaaaatgaagagatcagctgtacatgttgtaaatcttttagggtgattcttttttttttttgggcttgtaaagatcgtttgtaagccatgcatgcttatataaaaactgtagtataaaggtttgtgtataatttgcttgtttttagcaacaatcaagatggtaaaattcagacagtttttcttcc

SEQ ID NO: 5887 - DNA, 1849 bp, Oryza sativa
  Predicted polypeptide sequence is orthologous to G956
caacttgcacgtgcacatgggaagaacacatatcatcattgagagatttaaagtttggaggatctgagtcaatgaggtcaacacaacaagatttatactctgaacttgaatatgaacaagatgttggagaagatcctgaggagagacaaatggtttctctaaatagactatttgaaaaacaccgggatgtttctttaaatagacttctggaaaaacaccgggatgaagagatgcaagaatcttgctctactgataaagaaggcgaagaagatgagaagattgatactctatcatttgaacaatccatactaaagataactagcatgaaattagggaatctttggaacaatcctaaccagctctcagaggagatggttcgttgcatgagaaacattttcctccgtctatctgaatcctcgaagatgttaccaaaggaatcttctgattgttcatcttcctcagcagaacgtctttctggttctacactggcatccttctcagattcatccatcattccctcaatgctacgaagtccttcagttgactcgaatcgcaatgatgagatgacaactgaagccagcaactttgatccatataaagttaatgggaaggaaagccgaagagatattggaaattatcattcagcagctgaagtatcttggatgtctgttggaaaggagcaacttgaatatgcatctgaagctctaaaaaaattcagatttcttgtggaacagctatcaaaggttaaccctaatagtatgaactgtgatgagcggctagccttttggattaatttgtacaatgcactgattatgcatgcatatctagcatatggagttccacgaaatgatatcaagcttttttccctaatgcaaaaggcctgttacacagttggtggtcagtctttcagtgctgctgaaatagaatttgtgattctaaagatgaagactccagtgcatcggccccaactttccttgatgctagctcttaacaagttcaaaatactgaggagcacaagaaatactcgattgatgggacagaaccccttgtgttgtttggactcagctgcggaatgttctcttcacccgccgtgaggatcttctctgcagcaaatgtccgtcaggagcttcaggaatctttgagagactatgtccaagcgtctgttggtataagcgaccgagggaaactgctaatcccaaagttactgcagagctatgccaaggggaatgtcgaagattctttgctcgctgactggatctgccatcaccttacacctgatcaagttgcagtcatccgagattcttcttcacagcggaagcagcggcttcttggagcacgcagttttactgttgttgcattcgactcaaaattccgctatctgttcttgcctgacagcagtggctcccagaagccagaacccaaccggacttcgtgagctgtgttcagaaaacacatgctatgagcgagtatgtttggtcctagaaccatttcttgcatactggacaatggagtagctagttgtatatgatgtaaatttttggaggaagagtatatgatgcaacaaagatgagaagctggagggtgatacaaagagctccagtaaggatacaggatagttcatatgtatgatcagattatctcagctgaattggcgatgaaggttcatctggatctcattttgttctgttactgtctttccataatgaagataaccttttgtaatttttgttttcgacatacctttttttgggggtatagttcttgatcttggtcaattgatttgtaagttgtgctctaaataatgtatagtgcttttacctctttataataatgtgagttactttgtcac

SEQ ID NO: 5888 - DNA, 1425 bp, Oryza sativa
  Predicted polypeptide sequence is orthologous to G957, G961, G2535
tcgtccatccttctcccaatcaagcatccatccatcctccccaactatatataaaccccacacctttccctcgccaccgccctcgatcgtcttcttcctcctcctctcaatctcttcttccttctcctgcagccgccatttctagctagctatacgatcgatctatacatatatatcagaaggaaggaagaggctaattaagctagctgttgctagagctagcaagagcgaggagattgagcagctaggtaggtagcaagaaggagaagaagaagaagatcatcaatgagcatctcggtgaacgggcagtcgtgcgtgccgccggggttccggttccacccgacggaggaggagctgctcaactactacctccgcaagaaggtcgcctccgagcagatcgacctcgacgtcatccgcgacgtcgacctcaacaagctcgagccatgggacatccaagagaggtgtaagattgggtcagggccgcagaacgactggtacttcttcagccacaaggacaagaagtacccgacggggacgaggacgaacagggcgacggcggccgggttctggaaggccaccggccgcgacaaggccatctacaacgccgtccaccgcattggcatgcgcaagacgctcgtcttctacaagggccgcgccccccacggccagaagtccgactggatcatgcacgagtaccgcctcgacgaccccgccaccgacaccgccgccgccacacccacggttacttctgctgctgctgcggcggcggcgatggcggcggcggcggacggcgggcaggaggatggctgggtggtgtgcagggtgttcaagaagaagcaccaccacaaggaggccggcggcggcggcggcaagcacggcggcgacggcagcgccggcgccaaggcggcgcacgcttactcctccagcgacgacgcgctcgaccagatcctgcagtacatgggcaggtcgtgcaagcaggagcacgagctccccccgccgccgaccacctgctgctccaccaccaccaccgcacggactgggccatgatggaccgcctcgtcgcgtcgcacctcaacggcgccaactccgacgcgcccgacgaccagctctgcttcgacgccgccgacgacgacggcctcgcctactactccgccgccgccacgaggctgctcggcggtgccaacgccggcaccgacgacgacctgtggagcttcgcgcggtcggctgcgccgccaccgccgccgccgccgccgtcgtcggccacgccagagcgtctcagccacgtggcactgtaacacatgattcgtagctgtacgtacacgtacacgtatacgtacacgtcaggctacgtacgctcgagctgccaccctagctgctagtacagtaattacagagacaagacaagtaagaagaaaattgtaagtg

SEQ ID NO: 5889 - DNA, 1774 bp, Oryza sativa
  Predicted polypeptide sequence is orthologous to G957, G961, G2535
cctgtttggtttgcactgagtgaacaagcaattaagcttggtagtagtagtagttgttgtattgatcgatcgatcgatctagagacgacgatgagcatatcggtgaacgggcagtcggtggtgccaccggggttccggttccacccaacggaggaggagctcctgacatactacctgaagaagaaggtggcctcggagcgcatcgacctcgacgtcatctgcgacgtcgacctcaacaagctcgagccatgggacatccaagagaggtgcaggattgggtcagggccgcaaaacgactggtacttcttcagccacaaggacaagaagtacccgacggggacgaggacgaaccgggcaacggcggccggcttctggaaggccaccggccgcgacaaggccatctactccagctccaaccgcatcggcatgcgcaaaaccctcgtcttctacaagggccgtgccccccacggccagaaatcagactggatcatgcacgagtaccgcctcgacgacccctcctccgcctccgcctccgtctccgtcaacctcccctcctactactcttcctcctcatcgtcatcttccccaatgcacggtgtcgccggagaccaaggagctcaggaggaaggctgggtgatctgcagggtgttcaagaagaagaacctcgtgcaccacggcggcggcgccgccgcggcgagccaccacgcggcggccaagctcgcggcggcggccatggagggcagcccgagcaactgctcgacggtgaccgttagcgaccacgtcaaggcgcagatgctgcactcgtccgccagcgacgacgccctcgaccacatcctccagtacatgggccgctccggctgcaagcaggagaccaagccggcggcgatgtcggcgtcgtcggcggcagcggcggcggcgctggagcagcacctcagtacgcctcagtacggcaagttcatgaagcttccgccgctcgagcacgtcgccggcggcgtgggcctcctggcggcggccggcggcggcggcgagtactgctccgccgccgacgcgtcggggatcgccgactgggacacgctggtccggctcgcggcgtcgtacgagctcaacggcgccctctccgacgtcgcctccggcaagaacatggccggcttcttcgacgtcgtcgatcagcccgccggcgccgccgccttctcctccggcgacggcgacctgtggagccttgcgcggtcggtgtcatcgtcgctacacgcagacttgacgaccatgaataacgtataataattggagacaagaggtgacgatggagatgatgcatctagacgtggatggcgtatgcgtgcactaactctactcttaatctggtcggtctacgcatattgcatgcatgcatggacgacggtattgtacgtacgtgatcaataattaattactagttagggttccagcgagagtacaagacgacgacgacgacacaatagctagctgagctggccatgtgagcaagctctagacactaggtcaagatctaaccgtcgatcgatctgagccgttgatcgatcgatcgacgatgatggtgttgatcgatcgaattatagtgcagtggtcgagcgagttgttgtgtcgatctgaaacaagagagaggaaaaaaagaattaaaaggacgtacggcgtggtaggagagagagagagagagcatatataaatattatgtatctatatattgttatatattgtacctatagcttattatatatcaaagacatttttctagtgc

SEQ ID NO: 5890 - DNA, 622 bp, Oryza sativa
  Predicted polypeptide sequence is orthologous to G958
caaattggtatgaagaagacacctaggtactacaaagtcgagctcctcaggggattagaaccacttggtgatgcatgagtaccgcatcgaggaaagcgaatgcgagaacgccatggggattcaggactcctatgcgctatgtcggattttcaagaagaatgtgtgttgggtgaatttgacaagaaaggggagtgcagttcatcacaggctaaaggaaatgaagaacacagttacagatttcggggatgctggacatcctcgggagcacaatgagaatgataaagacattcatggatgcaattcatagcagaggatctatggtgcaccaccaactaaagtgaactagaaaactgagagaaaacagcttgttaacttcatctaaccagatatttcggtattagttatactgcgcgtatcttctgtatatgtttgataaggacacttctcactttgcataggaggaccactttaagtttggatgctggttcttaaattaggtttatacttttgttcctttagtactgtataatatatctaaaattgtgctactttgtacttcaatcttcaattaacatgtacctatcatctaatgaaatgataccaaaaaaaaaaaaaaaaaaaa

SEQ ID NO: 5891 - DNA, 1998 bp, Oryza sativa
  Predicted polypeptide sequence is orthologous to G958
gacccatccatccctagcttcctcgctgcttcgcccgccacgtcaccctcctcctcctccccttttttttctctcgctcgcctcgccatccatggcgtcgatggcgaaccagcagtagtagtagtccaccccaacgacgcgcgcgagccagctccggggtacccgccgctcgtgcccgggggggaagggggtgcaccggggagccgtcgcgccgcgcggctctgattcttcccgttcccggagatttgaaccatggagtctttacgtgacatggtcctcccaccaggatttggattccacccaaaagatactgagctcatttctcactatctgaaaaagaaaatacatggccaaaagattgaatatgagatcattccagaggtggatatatacaagcatgaaccatgggatttacctgcaaagtgcgatgttccaactcaggataataagtggcatttcttcgctgctcgtgacagaaagtatcctaacggttctcggtcaaatagggcaacagttgctgggtattggaaatccactggaaaggatcgagccataaaaatgggcaagcaaactataggaacgaagaaaactttagtttttcatgaaggccgcccacccactgggagacgtactgagtggatcatgcatgagtactatatagatgagcgtgaatgtcaagcctgccctgatatgaaggatgcatatgtactttgtcgtattaccaaaagaaatgactggatcccagggaatggcaatgagttggacaacagtgatcctcatccagaaccatatgatgctcctccatcagttatcagtactgaacagctaaatcctgctgctgaaccagttgtcggtgttgaagctgcaccagttaccgttgctgaacctgacggtgttactacgtcagctatcactgctaatataccatctcctagtgatgacattaatctggatgattggttgaatgaactatttgatcctttctttgaccctgaacagagtctggcttctgctgatctgtctccagatgaacaaaatgttgaatcatcgaacgtaggtgctttggctccaaaggtggaacaagactattctagtcctaacgagaacgtagtagatgatacggagtacttgttgcctgaagatgtttacaacatactgcaccctggtacagatgacttcaatatgctccagaatcctttggatcagtaccccattcaatatgcaaccgatgtttggagtggaattcagaaggaagaactgtggtcgccccaggccaatgctgagcctagtcagtcgaatgaagctgctgataatggaattataagacgttatcgtagtatgaaaacacctgaaactagtgtgccgcagttcaagggtaaaactcaggctaaaatgcgggttgggatcaacaagatggctacgagtagttctgaatctatcaaccagactatcaagtttgagaacagtggtcgtcttgttgagcaccagaagaaccaagcgcatgatgtagcttctaccaagcggtcagacgcagggaagccaagtacagagctcagcagcaatcgaggatttctcaggggtatccgaaatgcatttgcaggctgttcggatgctcgatggaacatgatacttgttgcgggtttcgctattggagtcgctgtggtagcgcttcatataggccaacgccttggattaagccagagagatcagcagcatacctagcctttaggtttgcaggttactgggtttctatgctttttgcaatctggagaaacgtaaacaaactccgatctttggttggtgcagaacatttgatgtatgcgccgttttttttgtgttggttttgtacatattattatcttcggttttggtcgacttttgttctcgccagctagtagtactatgttgacgaatgtagaagaaaacctcaaaaaaaaaagaacaaatgaaaaaaaattgacgatgaaaatttatataattaaccgcttgcattgtacc

SEQ ID NO: 5892 - DNA, 1953 bp, Oryza sativa
  Predicted polypeptide sequence is orthologous to G958
atggcgcccgtgagtttgcctccaggtttcaggttccaccccaccgatgaagaactaatcatctactaccttaagcggaagatcaacggaagacagatagaactcgaaatcattccagaggttgatctttacaagtgtgagccttgggatctgcctgaaaaatcctttcttccgagtaaagatctcgaatggtacttcttcagccctagagaccgcaagtacccaaatggatcaaggacgaaccgtgcaacaaaagccggatactggaaggcaactgggaaagatcgaaaagtgaactcacagaggcgtgcagttggtatgaagaagactcttgtgtactaccgtggtcgagctccacatggttctcgcaccgattgggtcatgcacgagtaccgcctcgatgagagggaatgcgagactgacactggcttacaggatgcatatgctttatgccgggtgttcaagaagacagcgcccgggccaaagatcatagagcattatggtgtggtgcaccaccatgtcgagcaacctcaatggatgacgagcagtatcgatcgctccccaacgttggacgtgtcgtgtgatggaagaggtgatgactttgagagcagcagcttctctttcccaacagagacgccaatggactccatgcacggtgggtttggaatgcagatgagtgcacctcacgaggatggcaaatggatgcagtttctgagtgaagatgccttcaacgccaccaatccattcttgacgaacccagtttctgccaacttctcatgccttccatccaaggtggatgttgcactggaatgtgcgaggctgcagcacaggctcaccttgcctcccttggaggtggaggatttcccacaggacgtcagccttgacacgaagattggcatacttcgcagtaaccccaacgaagttgacattctccaagaattcctgtcagttgcgactgcctctcaggagctaattaatggctccaccagtagctaccctgaaatgtggttaggagctagcacaagcagtgctagctacgtcaatgaactgtcctctctagttgagatgggcggcgttggcacttctaaccaccacgaatccgcaaggctacaggtcgagatcgctgacatggaggtgttcaaggacgagaagaagcgggtggagaaccttagaggagtcaagttggtgaacaatgaccttggggagattgttgtagaaggagatgaaagcaatccaacagaagacatcatcgcgcagtaccctataaaagtcactgcagataattcaggagaagccggtcatcgcatgaccgatcccactgacgtaggcggcatcgacactgccccgatcttctcgcaatctcaacctgacgactttgctgctggtttcgacgacgtcaaccctaatgcatctttcgatctgtacgagaaggttgacgtcaaccacaggctattcgtttcaagggtcgctgcggcgaagacattcttccaccgcattgagccatcgaagaaggtcagcttccactcgaacccggcagcaaccgccgtcagtaaggcgaccgagaagttccatttccccgttacgaccaaagttagtggtagggtttccatttttagcaagttcaaggcactcataagggacaagttcttgatgatgaggccatcacattcataccaaaggttgggcagcaaagaaaccacagtgaatgagctgctgcagattgtgtcactccttttagcaccgaagcaaatcaatggctgccctactgagcaagagctggtcaagaagaaggcgaaagaagtgatgaagccgggatggggtcgtgaagggagcaacaaattgtggcttccgctctccaaagggaagggcatttccagcatgtttttgagtgggaaatggacgtttctaacctccgcgttggccatcagcactccagctgagtgcgatcactaa

SEQ ID NO: 5893 - DNA, 739 bp, Oryza sativa
  Predicted polypeptide sequence is orthologous to G961
gacaaagctgggtaccgggccccccctcgagttttttttctttttttttaaactgtcttaatgtcttaccaccgtgccaccgttgacaagtacgtacatgtctaagggcatcaagcatgacgagtagaatttacattttccagacttcactacagtttatgaacaaagttcaagcccaaaatctgtataatacagcatggatgcctctacctacatctctggtttattatgaatagctgaattctttggtcttcgcaccgttccttccaacatctctggtttttgcaatttgcattgcccagattgcctactccagtttgtgaaagatgtcagaagaggatatccggaaattatgcacacatcgcctttccaaaattttgtacatgacacagttttcatttgtccaacgatgaaatgccatatatcagatagagataggcctgcaactctcatgcaaatgaatgctagcaaatcgtggcatgcaggtctgctagtctgctactgcatcgaagttggaacttggaacacaaactcaaggtcatccatgcaagggcacttcaaattcagacggacctcccactattgtgcactgaagcctgaagccggcaacactggaaaaatcgggagcactggcatgtcactaacaaacctgcagtcggatgatactatggggacaatttcttagcgatatgcttaaggaccgcaacacaatgtcctgacattagaagcccaatattct

SEQ ID NO: 5894 - DNA, 763 bp, Oryza sativa
  Predicted polypeptide sequence is orthologous to G962
cttgcatttgctcccccccaaattctcttctcctcctgcttttccagctatagctagctcgccgtcgctgccgccgccgcgccacagcgcacgctatgccggtgacgaccgcgagggagaggaggagggagccatgagcagggacgacgtcgacgacgtcacggcgggcgccgccgggtcaggggaggaagcggcggccgatcaggaggaggcggccgccgctgtcgccggcgactcgcacgagaacgacctggtgatgccggggttccggttccacccgacggaggaggagctgatcgagttctacctccggcggaaggtggagggccggcggttcaacgtcgagctcatcaccttcctcgacctctaccgcttcgacccatgggagctccccgcaatggcggtgataggggagaaggagtggttcttctacgtgccgcgggaccgcaagtaccggaacggcgaccggccgaaccgggtgacggcgtcggggtactggaaggcgacgggggccgaccggatgatccgcggcgagaacagccgccccatcggcctcaagaagacgctcgtcttctactccggcaaggcccccaagggcgtccgcagcagctggatcatgaacgagtaccgcctccccccgcccgccgcagacgccgatctcttctacaagtctgagatctcgctctgccgcgtctacaagcgctccggcatcgacgacggccacggccaccaccagcgccccgccggcaacgtgcaagcgtcg

SEQ ID NO: 5895 - DNA, 1631 bp, Oryza sativa
  Predicted polypeptide sequence is orthologous to G962
gtgcctgtcatccctttctctcttcttccgccgccgcgttctgcttcccaacttgaacactactactactcccccacggcgagctcgcgttctccgggaccaactagccctagcgacggatgcatatgcggagggggagagcggctggaggcgaaggagaggcagctgcggtggtggtgatgaacaggtacgacaacaacgggcatgcggcagcggcggcggcggctgcggtggcgggaggaggaggaggaggaggagggaataaggcggcgggggaggtagatgggcatgaggatgacctggtgatgcccgggttcaggttccacccgacggaggaggagctgatcgagttctaccctccggcggaaggtggagggcaagcgcttcaacgtcgagctcatcaccttcctcgacctctaccgctacgacccctgggagctccccgcaatggcggcgataggggagaaggagtggttcttctacgtgcctcgggacaggaagtacaggaacggggaccggccgaaccgggtgacggcgtcggggtactggaaggcgacgggggccgaccggatgatccgagccgagaacaaccgccccatcgggctcaagaagacgcttgtcttctactccggcaaggcccccaagggcgtccgcagcagctggatcatgaacgagtatcgccttccccccgccgacaccgaccgctaccacaagactgaaatctcactatgccgcgtgtacaagcgcaccggcatcgacgacggccatggccaggtatccacggcgcggtcgtcggcgcactcccgcggcggcggcgcggcaccggtacaggacaacaagcaaggctcctcgtcgacgtccacgccgacgccgcctccaactccgtccaagctccacctcctcagcagcgagtgcacgtcgccgcccgccatcgtcacggaccacgccgccatggtggcgcacaaggcaccgtcgccgcggcaccatcagcagcagcagcagctccacgctgccaagccttgcggcggctacctgcagaattcctcgatggcttccgctgccggcggcgatcagcagcagcaatttcagcaagacttcgcggcggcattgtaccagcagtactccaagaacacgagcggtgccttcgcctccacgtactcgctgctcaacctcgtcaacgcggcatccatgggcagctccgccgctgccattgatgagctgagctcgctggtgggccacggcacgccgtcctacattaaccccgcggccggcagccacaactatagtcaattccttcacctgcctacgacgccgtcgtcgcatcaaccaacgccggcgccgctcgggacgacgacggcggcagcggcggcgacgctgccgatgtcgctcgccgccttctccgacaggatctgggactggaataatccgatccccgaggccggaggtagggattacagcaccagtactggattcaagtgaatcagctatagctacagttcatgcacgcgtgcatggcattctgatcagatggtaccaccatgtactacctctctctctctctctctctctctctctctctctctgtgtgtcccactctctggttcacagttattaattctgatgaaacgatc

SEQ ID NO: 5896 - DNA, 2424 bp, Oryza sativa
  Predicted polypeptide sequence is orthologous to G962
gactggaaggtgatgagagtactcaagttgatcgccggagcagcatcagcatcagcatcagcttcaccatgcggggatcagatcatcatcaggatgtcgtcgcggcaccgcggggcggtggcggtggaggagacgacgggcaggcgcacgacatggtgatgccggggttccggttccacccgacggaggaggagctcatcgagttctacctccggcgaaaggtggaggggaagcggttcaacatcgagctcatcgccttcgtcgacctctaccgctatgacccgtgggatcttcccgctctggcctcaattggggacaaggagtggttcttctatgtgccaagggaccgcaagtaccgaaacggcgatcggcccaaccgagtgacgccatcggggtactggaaggccacaggggcggataggatggtgaaggtggagggtgaccgtcctatcggcctcaagaagacgctcgtcttctacgtcggcaaggcgcccaaggggcttcgcagcagctggatcatgaacgagtatcgtctccctcatggcgacgctgaccgctaccaaaaggaaatttcgctgtgtcgagtctacaaacgcccaggaatcgaagacaacttccacctcaccggcacaaccactaaatcctccggctcaaaggcggcggcggcgatgggcaagaagcacgccgccgcgaaccggacgtcatcgacggcggcggctgcggcgccccgcctcgccccgatgttcgacggcggcggcggcggccaccactaatccgccctcatgggaaaggcaacatacaacgcatcacacaccgccgccgaagggacgaacgccatcgccatgtcactgtcggcggcggccgcgctgcatcctccggcgccggcgatgttccggtcgacggcgtcggtggcctcgctgagctccaccacgtcgacggaggaggacggcacgtcgctcttccacctcaaggccggcgcgacgacgacgaacacgacgacgatgcatcatcaccatcatcatcagcagctgcctgcttcaactcatgctctgctcaacaccaactcgtcagcaatggcgaccatccccatcgacgagctgagtagggcgattggatcttacagcaacatccaccatcaaccaaactctactacaactcatcaatcaactgctttgccgccatcgcaacaaagccctcttcttccattcgctagcatggagaagatttgggattggaaccctctcctagaatctcccaaggtttgcacaaacttcaagtaactttgattatgatctactcttggatgatggattaatgtttgtatgcatgaatgcatctatgcaactatgcatatatatgcattgcatggatgcaaaaaccatatggtattatatgtgtacttaattaattatgtatatgtataacacatatttgggctaggacagggttatctatctatataatggaacatggtaaggtagttctagtcccatgcaattaccggcttaccgcgccattattttagttcacattagtggatggaagtaactgtatgtcaatttctattggatatgatctcgaggacaatgtgtagtgttactcgtcgatctagagttgtaataaagatgaaatagcattatatatgtgatcttttttcgcttccatagtatttattctacatatatataaattatccatgcagccggcagcatatatgcatatgcatgaactgcaggtgtgtgttcataatttatgtagtatatttgataggtgatcttggaagatatctagtgttttggttgcatgaaatgatattgcgcgcgctcattactctggaaaaccacgcatgcatatggtatgaaattaatactgtgttacaaattaaaatggtattggtggtttttgctactcttttcccattatttcgaattttaaacatcacaataatataatcaattttttgctagttaaattggtttgtgcctcgaacagatatatagccactgtatctaattaacatttcttatgtgttcttatggatttatagtcagataataatcggccggttggatggataagtactgatcatatgcagtcttttcacaatggttgacaattttctgcatattgctttgtctatgaataaatgaggagtgcaaaacatcgatccacctgaattaatttaactcagtaaatacagataaatactgctatttgtagtatttcttagcaggagcgttgccattttgcgtcacttatttcttctcagatttaataatgtattttactttaattagttgtgagaacctggtggataaattaatatgtaaacatataataatgtggaatgggtggaatatgatttgacttgattattccctacaattaatatataacacaagctggcagcagtgtatatattct

SEQ ID NO: 5897 - DNA, 651 bp, Oryza sativa
  Predicted polypeptide sequence is orthologous to G962
atgcatatgcggagggggagagcggcgggaggcgaaggagaggcagctgcggtggtggtgatgaacaggtacgacaacaacgggcatgcggcagcggcggcggcggctgcggtggcgggaggaggaggaggaggaggagggaataaggcggcgggggaggtagatgggcatgaggatgacctggtgatgcccgggttcaggttccacccgacggaggaggagctgatcgagttctacctccggcggaaggtggagggcaagcgcttcaacgtcgagctcatcaccttcctcgacctctaccgctacgacccctgggagctccccggaattgagcatctaattaacaagctcgatgggggtgcagcaatggcggcgataggggagaaggagtggttcttctacgtgcctcgggacaggaagtacaggaacggggaccggccgaaccgggtgacggcgtcggggtactggaaggcgacgggggccgaccggatgatccgagccgagaacaaccgccccatcgggctcaagaagacgcttgtcttctactccggcaaggcccccaagggcgtccgcagcagctggatcatgaacgagtatcgccttccccccgccgacaccgaccgctaccacaaggtacccatccatccatga

SEQ ID NO: 5898 - DNA, 1305 bp, Oryza sativa
  misc_feature (178)..(178): n is a, c, g, or t
  misc_feature (188)..(188): n is a, c, g, or t
  misc_feature (217)..(217): n is a, c, g, or t
  misc_feature (268)..(268): n is a, c, g, or t
  misc_feature (306)..(306): n is a, c, g, or t
  misc_feature (363)..(363): n is a, c, g, or t
  misc_feature (415)..(415): n is a, c, g, or t
  misc_feature (417)..(417): n is a, c, g, or t
  misc_feature (463)..(463): n is a, c, g, or t
  misc_feature (507)..(507): n is a, c, g, or t
  misc_feature (549)..(549): n is a, c, g, or t
  misc_feature (650)..(650): n is a, c, g, or t
  misc_feature (777)..(777): n is a, c, g, or t
  misc_feature (818)..(818): n is a, c, g, or t
  Predicted polypeptide sequence is orthologous to G962
ttttttttttttttttcggcaagttgccatagttattgcaaacatactcgcagtacacatataccattactcccttaaaagcagccatcggcccaccagcataagcaattctcactcaccaatcgtgcacattggctccacatcaatgagccagcaccgcccagccaacaccccatcntacagcagcncactatcaataattgagcgcccagacacncagcataaataacacacaggcacacgacattagcacaccataggttaacanccattcatcagcgtcatattgagcatgtgctcccagcncacacaagaagagaaggcagttgcgttctacacaagcggagcacacaatttgagctnacaagtcaagcacaaggcacagacgtcaaatattcagcaggtgcctggtacntncagcagacaacatcacgtcatcgcaaggcagtaagcgacatttcanaaacgaacgttatggggcccacaactgtattggacaaggtggtntctagcaaacagagcaaagacattagaatccctgagcaatantatatcagttacacaaaagagagcgcaatttctataaggccagacttaccttgatatagcattcatccattacaaccaggccgcaaggactcattattacntatctatactccatatttaccgcgcacaggaacaaaagaaccgccacatatccacagttcctatcaatataataggacgaaccagttatccaaggaaacaacacgcacaagtactatcacattgcgnagaccacaaaatacaggaagtatgtgattactcccatgagncgccaatactccacacagcgggagttcctgaacccacatcacagaggttggaaccaaacaacagaggcaccgcaccagcggcacagtatacagcacaagcacaccggacaacaacaacgtctcttgtcatgtaacacatttcaatgacgaatacacgacagcaacacaactccaagagcacaaggacttactcatggggtcttacaacaccgaagagaaatacacatatcgcggatgacattagcatatgtggagaacaatcacaagactccctcatctagtcgacccgacatatgtgatggccaccacccaaaatatatttgagtggtgaccaatacaccaaatgagatacgccactccagcgacacatacagtggactatcatgacgtcacacaaccgcaaacaccaagattcatgtaacaggtgtggctcagaaacaccaacgtgaacatgacagtaccgtcatcactgagtaatgcaccacct

SEQ ID NO: 5899 - DNA, 1599 bp, Oryza sativa
  Predicted polypeptide sequence is orthologous to G963
atggcagaactaccaccggaaggccgcggcggcggtggcaacaacaatgggaagtggaaggggaaggaaaaggtggtgcccgagtacggcaagaaccggcacggcatgtccgtcggctggtacttcgtccccaaggatctggagctctttgccatcctcaagtgcaagctcgtccgcggccagctccccggcgccctcaacaacgtcttcgagcatatcaggatcctcgaattccaccccgccctcctgcatgagatgtacatcaagaacgaggaggatgggtacatctacttcttcagcaagaggcagttcacgacgaaggcagggaacaagaggcggccgacgcgggtgacaaagggcgggacgtggaaggcgtctggcgggagcaagacagtgaggagcaagaaggtcggcggcatcgacgttggccagaagctcaccatggtgttctacgagcgcaggtttgagggtgaccggaaccccatcaagaccaattggggcatgcatgagttcaccaagatcattgatggcaccaaaaaccagcttgaggaccttgccgtgtaccgcctgtacaagatcaaaaggaaggaggacgaagaaccgtcgaacactgccgccgcggcgtcgagcaccgacgagccctccacgtcgtcggcattgccacctcctacgccaccgcggccattgccggacatggccggaccgtcgtcagcaacgccgctactgccactgcaattgccgggcctggccgggtcgtcgtctgcgatgtcgctgcctgcactgcagctgccgggcatggccgggtcgtcgtcggcgatgccgctaccgccactatcgttgccgggcctggctggagggatgatgtccatggcggaccaggcgaacatggcctcgacgtcgcaggcgtccacaccgtcgtcggagctcctgcaagactggtacgacgagttcgagatcacgtacggcgccgtggctccgccgtctcctagcacgatcagctgggtggcgccgcagagctcgccgacggggtggtggccgtcgccgaacggcgggccggtgcagcacgacggctacctcgggatggcagcggatccaacgtcgtacatgctggaaaacctgttgcccaccgcggcgatcccgccggagccgatgatgccgccgacgagctcgccggcgccaccaccagccgtcgaccaccaccaccggctctcgcctccgcatgacgccgccggcagcaactacaaccacccggagctcgccgactacaacggcggcgtccaggcgcagcacgagcatcagtatcacccacaggagccgcaggcatcgctggtggatgccgaggacggctacagcgccatggccggtggcgacgacgcgcagctgggcggcgcggagcttgacaccgaacgaatcgccgaaatggtaaaccatataatggatggcgaattcgagttcaaattcgaggacaacaccgtccttaagtacaacgaagtctttcctgacaatgatgaggtggtggcggcgccgatgatgatcgacggtggtagggatggcgatggcgcagatggaggtgatggagacgacccattcgacaattag

SEQ ID NO: 5900 - DNA, 904 bp, Oryza sativa
  Predicted polypeptide sequence is orthologous to G971
ttctttttttttttttttttttttgttgtgatggttctgtgtgaaaactgagctgcagctttatctctgtaatctcattggagaaccactaatcaggccaatgtaatatgccaagatgcattactgcatttcttgtcttgtattattgatagatcttaacatcttaagagctgtcaccgtgtcattgtggtccctagtttggaaggtatacttgccttgtgggttgggtcctgtgggttatttagggaattttgggggatttaactgaatgggcattttaaaatttataaatgggtaaaaaagatttttttattaaacaatggttggtagatttgtaaatctggtttttattggatgaatgggtgggtacttgggtggaaaacagagtgttacctactgatttaagactccgtctaagggcatgtacagtgctacattaatggtgttgaccgttcacagttgcatgatactactaggcagataggattagattagaaacaacttattctaagagaattatcttaatgatcttttcctatcagaaattgacactgccagagatgtgagggactacctgaaaggactgcgggtacaaacactgaacatatgggaaggcagggaacagcaacataatgccgcaacatagctcactagatcaagtgccaactacggcaaaacgagagagtccacagagtagcgccagcactgcagaatctgccaagaaacagtatctcgtatatcgtgtcttctactcttgtttgtcgcctccaccacccccaccaaccaccgacgaagtgcgtagcaagcagagagaaatagactatcgacatacagaccgagccacgaagacgcacaacggaccacaagcagcacacgcaggagcaagaagcaacacacagcaaac

SEQ ID NO: 5901 - DNA, 1205 bp, Oryza sativa
  Predicted polypeptide sequence is orthologous to G975, G1387, G2583
gattgaacgcacgctacactgcaagaaaggcaagtataggggtggcaggtagtttatattcactggaaaccgagaacttcactcctcccagcactccacactaggaggatgctcactgtctgaatgactgactggctgctgctgctgctcattccttctcctactctgcctgcctcctctgctgtgtccttgggagaattcttcagggacagtatccctgcagaggtgagatcatgggacagtcgaagaagaagttccgcggagtcaggcagcgccactggggctcctgggtctccgagatcaggcaccctctccttaagaggagggtgtggctgggtacctttgagacggcggaggaggcggcgcgggcgtacgacgaggccgccatcctgatgagcggccgcaacgccaagaccaacttcccagtcgcgaggaacgccacgggggagctcacaccggcggctgcggtggcagggcgggatggccgtgtcggcggcggcagcggcagctcgtcctcaatgacggccaacggcggcgggaacagcctgactccagctgggtcatgaccgtcgagctcaacaaggacacggccgtgtcgtcggctgcgacggtggcagcagcaacagcagtgtcgtccagcgaccagccgactccgagtgacagcacagtcacaacgacgtccacgtccaccacgggctcgccgtcgccaccacctccggcaatggacgacgaggagaggatcgcgctgcagatgatcgaggagctgctgggcaggagcggcccgggctcgccgtcacatgggctgctgcacggtggtgaaggtagcctcgtcatctgaattccggaagaacaggaaagaaattgaaaatgcaaggttaaaacagcatgatcaggtcaccatctaagatcaaggatctggtagggtggttggtgcacaggcagttaagattgctacatatgataggtatatctctattactactacatatccagcttaattaggaaacaattataagatcgattactactgtgtgaagtgaagctgtgtatttattaaagacttacttgtatgtacaagacgtccccgtcattatagtcatactggtgaaagctctgctatgtatcaacgtcatcagagatcagactacatatatataagtggtgtcaacttctaataaaagtaaataaaaacattgtaattgtgt

SEQ ID NO: 5902 - DNA, 1328 bp, Oryza sativa
  Predicted polypeptide sequence is orthologous to G975, G1387, G2583
gaacgcacgctacactgcaagaaaggcaagtataggggtggcaggtagtttatattcactggaaaccgagaacttcactcctcccagcactccacactaggaggatgctcactgtctgactgactgactggctgctgctgctgctcattccttctcctactctgcctgcctcctctgctgtgtccttgggagaattcttcagggacagtatccctgcagaggtgagatcatgggacagtcgaagaagaagttccgcggagtcaggcagcgccactggggctcctgggtctccgagatcaggcaccctctccttaagaggagggtgtggctgggtacctttgagacggcggaggaggcggcgcgggcgtacgacgaggccgccatcctgatgagcggccgcaacgccaagaccaacttcccagtcgcgaggaacgccacgggggagctcacaccggcggctgcggtggcagggcgggatggccgtgtcggcggcggcagcggcagctcgtcctcaatgacggccaacggcggcgggaacagcctgtctcagatcctcagcgccaagctccgcaagtgctgcaagacgccgtcgccgtcgctcacctgcctccgccttgacccggagaagtcccacattggcgtctggcagaagcgcgccggcgcacgcgctgactccagctgggtcatgaccgtcgagctcaacaaggacacggccgtgtcgtcggctgcgacggtggcagcagcaacagcagtgtcgtccagcgaccagccgactccgagtgacagcacagtcacaacgacgtccacgtccaccacgggctcgccgtcgccaccacctccggcaatggacgacgaggagaggatcgcgctgcagatgatcgaggagctgctgggcaggagcggcccgggctcgccgtcacatgggctgctgcacggtggtgaaggtagcctcgtcatctgaattccggaagaacaggaaagaaattgaaaatgcaaggttaaaacagcatgatcaggtcaccatctaagatcaaggatctggtagggtggttggtgcacaggcagttaagattgctacatatgataggtatatctctattactactacatatccagcttaattaggaaacaattataagatcgattactactgtgtgaagtgaagctgtgtatttattaaagacttacttgtatgtacaagacgtccccgtcattatagtcatactggtgaaagctctgctatgtatcaacgtcatcagagatcagactacatatatataagtggtgtcaacttctaataaaagtaaataaaaacattgtaattgtgt

SEQ ID NO: 5903 - DNA, 873 bp, Oryza sativa
  Predicted polypeptide sequence is orthologous to G977
actgatcacctcgacctcacttcctcctcaacctcgagctcactcctcgctctcccgccgcgagcgcgcgctctctctcgccgcgaccacgcgcaatccgtcgccgagctcgaggacgtcggcaatggcgcggccgcagcagcggtatcgcggcgtgcggcagcgccactggggctcatgggtctccgagatccgccaccctctcctgaagacgaggatctggctgggcacgttcgagacggcggaggacgcggcacgcgcgtacgacgaggcggcgcggatcatgtgcggcccgcgcgtgcgcaccaacttcccccacgacgtcgccgacgaggccgcgccgccgccgccgccgcacagcgccgccgcagcctcctcgtcgttcctctccgcggcgctcgtcgccaagctccaccgcttcaacctcgcctccgtccaggctgcgcagcgcggcaacagcaacgacgacgactccaccacctcctcctccgccgccgcgtcgtcgcgcgccgtgattccgtcccttcccgccgccgccggcgcattgggcaatgcggcggcgacggcggagtggagcggcgggttcctcgaggagcagtacgtggaccagatgatcgaggagctcctcgactccaacttctccatggagatctcctgctgatgtgccctgttcatctacctgttcttctctgctccatctcctgtttctttctctctctcttttttttctttctttttttttgtttttttagtttagtaagctatgtgaggaagaactctgatcgaggttagtttggtcacagtgagttctggagcagcttgtgtatacggtagcatcatttagagcataatagggttgcagttgagaccttc

SEQ ID NO: 5904 - DNA, 519 bp, Oryza sativa
  Predicted polypeptide sequence is orthologous to G977
atggcgaggccgcagcaacgataccgcggcgtgcggcagcgccactggggctcctgggtctccgagatccgccaccctctcctgaagacgcggatatggctgggcacgttcgagacggcggaggatgcggcgcgggcgtacgacgaggcggcgaggatcatgtgcgggccccgcgcgcgcaccaacttcccgctcgccgacgccaccgcggcggcggcggcggccgccgcgtcctcgtcgttcctctccgccgcgctcgtcgccaagctccaccggttcaacctggcgtccgtgcaggccacgcagcggcagagggaggccgccgccaccgccgccgcggcctcttcggcctccgccacgacgccgccgctcggcaatgccgccgccgccgacgacgacgcgcggaccaccacgacgtacggcgcggaatggagcggcaggttcctcgaggagcagcacgtcgagcagatgatcgacgagctgctcgactccaacttctccatggagatctgctactag

SEQ ID NO: 5905 - DNA, 868 bp, Oryza sativa
  Predicted polypeptide sequence is orthologous to G979
ctacattccacttccccaatatgcgccgctgcgtgcaggacttcgtgcgggaatgttccacctgccagcggtacaagagcgagcaccttcacccggccgggctgctgctgcccctgccgattcccacagcagtctgggccgacattggcctcgactttgtggaagcgctgcccaaggtgaacgggaagtcggtgatcctttccgtcgtcgaccgcttcagcaagtactgccacttcatcccgctggcgcacccgtacaccgccgagtccgtggctcaggcgttcttcaccgacatcgtccgcctccacggcatgccgcagtccatcgtctccgaccgcgacccggtgttcacttcactgttttggcgtgagctgatgcgcctcatgggcaccaagctgcacatgacgtccgccttccaccctcagtctgatggccagacggaggcggctaaccgcgtcattgtcatgtacctgcgttgttttacaggtgaccgaccccagcagtggctccgctggctgccttgggctgaattcgtgtataacacggcctaccagtcctcgctcaaggagacgcccttccgtgtggtgtacggccgtgacccgcccaccatccgctcgtatgagcctggtgagacgcgtgttgcagctgtcgcaagggacatggaggagcgagagaccttcctggctgaagtccgccaccgcctggagcaagctcaagccctccagaagctctactacgaccggcagcaccgcccggtgtcctatcaggttggcgactgggcgctgctgcgccttcgtcagcgcaccatggcgtccctgcctcaagcgcagccccggcagctgaagccgcgcttcgtcggtccctaccg

SEQ ID NO: 5906 - DNA, 1866 bp, Oryza sativa
  Predicted polypeptide sequence is orthologous to G979, G2106, G2131
aaggctagccgcctcactccctctctctgtttcctcttcttcttcttcctcccgccggtcagctcagctcgcctcgtctcctccattttggcgacgcgagcgagcatattaaagctgtgccggcggctgcaactttgccgccatttatttagctccggctcttttaaaagctctcttctcctgctgccatcttcttctggttggcaccaccattccatatataccatctccctcctcctcccgcgctcgctcttcgccaatggccaagcgacgcagcaacggcgagaccgccgccgcgagcagcgacgactctagctccggcgtctgcggcggcggcggcggcggtgaggttgagccgaggcggcggcagaagcggccgcggaggagcgccccgcgggattgcccctcccagcgcagctccgcgttccgcggcgtcacacggcaccggtggacggggcggttcgaggcgcatctctgggacaagaacacctggaacgagtcgcagagcaagaagggcagacaagtttacctcggggcttacgacggcgaggaagcggcggcgcgcgcctacgacctcgccgcattgaagtactggggccacgacaccgtcctcaacttccctctgtcaacatatgacgaggaattgaaggaaatggaggggcagtccagggaagagtacatcggatcgctccggaggaagagcagtggcttctcaagaggggtgtccaagtacagaggagttgcaaggcatcatcacaacggcaaatgggaggctcggattgggcgtgtgttcggcaacaaatacctctacctaggtacttatgcaacacaagaggaggcggccgtggcgtacgacatcgcggcgatcgagcaccgcggcctcaacgccgtcaccaacttcgacatcaatctctacatcaggtggtaccacggctcttgccgctccagcagcgccgccgccgccaccaccatcgaagacgatgatttcgccgaagccatcgccgccgcgttgcaaggcgtcgacgagcagccgtcgtcgtcgccggcgacgacgcgccagctgcaaaccgcggacgacgacgacgacgacctcgtggcgcagctcccgccccagctgaggccgctggctcgcgcggcgtccacctccccgatcggactgctgctgcggtcgcccaagttcaaggagatcatcgagcaggcggcggccgcggcggcgtcgtcctctggtagcagcagtagcagcagcacagactcaccttcttcttcgtcgtcgtcatcgctgtcgccgtcgccattgccatcgccgccgccgcagcagcagccaaccgtaccgaaggacgaccagtacaacgtcgacatgtcgtcggtggcggcggcgaggtgcagcttcccggacgacgtgcagacgtacttcgggctggacgacgacggcttcgggtacccggaggtggacacgttcttgttcggggatttgggcgcgtacgcggcgcccatgtttcagttcgagctcgacgtctgaactctcaactccgaccagggtgtttcgggaggcccacaatcccagcctgttcccgtagatgggctggaaagatcgaatcaaatttgggcctattcaggggatgggctgggagaattgatatgggccggcagggatggccgaaagggaaggcctcccaagttttggctgtcaagaagctagaactgagttctctctcaaaagagagagagagagagaagctagaactgaggattagttgcttactcgcaaatactagtagtttggaggaagagtaaaatattggtttatttgttgcccatctctgcgaaggggaatttaccgtaataaagagtacatattgccgtttt

SEQ ID NO: 5907 - DNA, 1272 bp, Oryza sativa
  Predicted polypeptide sequence is orthologous to G979, G2106, G2131
atgaggaagaagaagaaggcctttgctgttgcagctgcaaccaccttgctttcccctcctcggtcctcctcctcctcctcctccacggcgtcctcctgcattgtgccgccgcgcactgagagcggcaagaagaagagtaagcacaggaagagggccaaggatggcaccggcggtgacgacgacgacgccgccgttgctgctgcgccgaggaagggatcctccatctacaagggcgtggcaaggcacaggggttcagggaagtacgaggcgcacctgtgggacaagcaaggctggaacccaaaccagacaaggaagagaggcaggcaaggagcttatgacacagaggaggctgcagctcgcacttatgatcttgcggcactcaagatctggggctcagaccatgtcctaaacttcccgattgacacgtacaggaaggagcttgagaggatgcagcgaatgacaagggaggagtacctggctactctgaggcgcaagagcagtggcttctccaggggtgtctccaagtacaggggagtggcaaagcatcaccacaacggccggtgggaggccaggataggccgagctgtaggcaagaaatacctctacctgggaacattcgatacccaggaggaggcagccacggcctacgacctggcggcgatacagctccgcggccgcagcgcggtcaccaacttcgacgccagctgctacacctacacggaccacctgccgccgccgccgccgccgcagccaccgtccgtctgcaagaccgagccggagctggagccgccgcagccggcggcgcctccaggctcggagtcacttctccggcccaagatggagccctgcgacgactgggagccgccggcgatttgcccgtcgctccgtgacgcggacgacgcggaccacgccatcgccgagatcctgccggcgctctgcatggaccgcgccgacttcgaggccaggtaccctgcccgccgcgcccgcgacgccgccgccgacggctggtcgacgtcgtcggacgacgtcgccgccgcctccgtcgacgatgacgtgctgcgtagcctgccagacgacgtgggcttcgtcgacgacgtcgagagcctcttcctggacgcgcccggcccggccgccgccgccgccgccgccgcgatgccagacgacgtggaacgcgcggtgcagcgcgcgccttctgccgcgtctcgtcgggccaacgccgcggcggtctcctacgcgatcagctcgttggcgtccgggcgctggtggtattga

SEQ ID NO: 5908 - DNA, 1910 bp, Oryza sativa
  Predicted polypeptide sequence is orthologous to G979, G2106, G2131
gttgcctctcctcctcctcgtcacctcacctgcacctgcaccaacgcgagagatcatggcgaagagatcgtctcctgatcccgcatcatcttctccatctgcatcatcctcgccgtcgtctccttcctcctcttcctccgaggattcctcttcgcccatgtcgatgccctgcaagaggagggcgaggccgaggacggacaagagcaccggcaaggccaagaggcccaagaaggagagcaaggaggtggttgatccttcttccaatggcggtggcggcggcggcggcggcaagaggagttctatctacaggggagtcaccaggtatgcgtctctgcatggcatcggtggactggcagatttgaggcccatctgtgggacaagaattgctccacttcacttcagaacaagaagaaagggaggcaagtctatttgggggcttatgatagtgaagaggcagctgctcgtgcatatgaccttgcagctcttaagtactggggtcctgagacagtgctcaatttcccactggaggaatatgagaaggagaggtcggagatggagggtgtgtcgagggaggagtacctggcctccctccgccgccggagcagcggtttctccaggggtgtctccaagtacagaggcgttgccaggcatcaccacaatgggcggtgggaggcacggatagggcgggtcctggggaacaagtacctctacctgggtactttcgatactcaagaggaggcagccaaggcctatgatcttgctgcaattgaataccgaggtgccaatgcggtaaccaacttcgacatcagctgctacctggaccagccacagttactggcacagctgcaacaggaaccacagttactggcacaactgcaacaagagctacaggtggtgccagcattacatgaagagcctcaagatgatgaccgaagtgagaatgcagtccaagagctcagttccagtgaagcaaatacatcaagtgacaacaatgagccacttgcagccgatgacagcgctgaatgcatgaatgaaccccttccaattgttgatggcattgaagaaagcctctggagcccttgcttggattatgaattggatacaatgcctggggcttacttcagcaactcgatgaatttcagtgaatggttcaatgatgaggctttcgaaggcggcatggagtacctatttgaagggtgctccagtataactgaaggcggcaacagcatggataactcaggtgtgacagaatacaatttgtttgaggaatgcaatatgttggagaaggacatttcagattttttagacaaggacatttcagattttttagataaggacatttcaatttcagatagggagcgaatatctcctcaagcaaacaatatctcctgccctcaaaaaatgatcagtgtgtgcaactgattctctctgtgtgtgtttctgggtgttgaaaatcttgagatatacagggaagttttcaggtttttatcttggggtatatttctctgtccaatggcactgccacaaagaagcaaagcttctgtaggcgttctgttcaggtggggaagattcatatgcttctccctatggtcctagtctcctagaaacccaaaggcattcaacttggcatgagacaagtgtctgtgttccttttcttgtaatacccccaaggctgattgattaactagggagacaattttctcccttaccctagattgagctagttaattctgattactcagaatcttgaatgcttgagtagtactataggtattcccacaagaaaactctgggtagttcacagttttataaggtaatggagcatatgttatacagaaatcacaatatgtaaatctatctaactttcagaataaactatactatacatcttggttgaggcatgaatgcat

SEQ ID NO: 5909 - DNA, 1572 bp, Oryza sativa
  Predicted polypeptide sequence is orthologous to G979, G2106, G2131
gagcagcggtgtcgccgccgccgccgccgcggcggcggtgaagccgaagcgcacgcggaagagcgtcccccgcgagtccccctcccagcgcagctccgtctaccgcggcgtcacccggcaccggtggacggggcggttcgaggcgcacctgtgggacaagaacagctggaacgagtcccagaacaagaagggcaagcaagtttacctcggggcgtatgacgacgaggaggcagcggcgagggcgtacgatctggcggcattgaagtactggggacccgacaccatcctcaacttcccgttgtctgcatatgaaggtgagttgaaagaaatggaggggcaatcaagggaagagtatattggatccctaaggaggaaaagcagtgggttctcaagaggagtatcgaagtaccgaggcgttgcaagacaccatcacaatgggagatgggaggcccggattggccgtgtttttggcaacaagtacctctatctcggtacttacgcgacgcaggaggaggcggcaatggcgtacgacatggcggccatcgagtatcggggcctgaacgccgtcaccaacttcgacctcagccggtacatcaagtggctccggcccggcgccgacggcgcgggcgctccccagaatcctcaccccatgctgggtgctctgtcggcgcaggatctcccggcgatcgacctcgacgccatggcgtcgtcgttccagcacgacggccatggcgccgcggcggcggcggcacagctgatcccggcaagacattcgctcggccacacgccgacaacgtcggcgctcagcctgctgctgcagtcgcccaagttcaaggagatgatcgagcggacgtcggcggcggagaccaccaccaccagcagcacaaccacctcctcctcgtccccgtcgccgccgcaggcgaccaaggacgacggcgcctcgccgcagtgcagcttcccggaggacatccagacctacttcggctgcgccgccgaggacggcgccgccggcgcgggatacgccgacgtggacggcctgttcttcggcgacctcgccgcgtacgcgtcgccggcgttccacttcgagctggacttgtgacggcggcgccgccgctgccgcagccgagcagtgtcagcttgtgcctcgccagtagcccaacggccacggcgcaatacagttacaggccgttaattaaattctttaattgggtggatttggtccataggagaatgaccaaaaaaagagaaggaacagacgaacagacaaatggaaggcaggcaagaatgcaagatactcttatagcacaagctagtgcttacagagttaatgacagtattatagtgacaagctgaagaccgagaattacttcaagattgattttcttaccttgacaatccgaatgagagagagagagatagtgggtgtgtgacagtgtgaggagaggagattgtttcatttttgcttcatccctgacaaaatgaacaactatatagtatcttttttttttgagaacgactatatagtatctataatctacataaatacttgatagaaggatttgtgagtttctg

SEQ ID NO: 5910 - DNA, 1296 bp, Oryza sativa
  Predicted polypeptide sequence is orthologous to G979, G2106, G2131
atggatcatagcatcatgatggtgaagaatgagattgaaaactactcaggatcatctccagcaatgatcatcaatgcgctggaaggcggcgccgaggcgggcccggttgtcaggaggagaaggagggagccgtctttgctcgcaccgatcaatggtgatggtgacaccaatggtggtggcattggcaagtcgtccttgtcaggcatcactgtcaagaggagctctaggtttcgtggagttagcagattcagagcttgtagagatgacaagaagatgttgtcatgtaggcatcggtggacaggtcgtttcgaagcacatttgtgggacaagaactcgtggaatcctacacagaggaagaagggcaagcaggtctatcttggagcatatgatgaggaggaggcagcagcaagggcttatgaccttgctgctctcaagtactggggaccaactacctatacaaattttccggtaatggactatgaaaaggagttgaagataatggagaatcttactaaggaagagtatcttgcatctctaaggaggaagagcagtggcttctcaagaggtgtgtccaagtacagaggggttgcgaggcatcatcaaaatggaagatgggaagcaagaattgggcgtgttttcggaaacaagtacctctacctaggaacctacagcactcaagaagaggctgcccgtgcctacgacatcgccgcgatcgagtacaaaggcgtaaacgccgtcacgaacttcgacctcagatcatacatcacatggctgaagccaacccctgctcatgttgccatgaaccctgcagaagctcttgcaatgcagatccctgtagatcacttcctcccaatggaaacccagatgatgatgctccctcagagcaatcctttcacctcatatcacaatgcacaatcactgggtggtggtgacggtggcagtagcagtactaataatcaagaagcctccatgataatctctcccagtggctcatctagaaagagatcatcatccactgctcttagccttcttctgaaatcgtcgatgttcaggcagctggttgagaagaattcagatgcaggtgaagaaaatggaggtgagatgagagagccgggtgcccatccaggagaaggatatgaataccacaacttcttccagggagatgctgctccggacatggacatgtgtgatctgctttcatcaggaaatgtgcatgctgcaagtggtagtgctggatttgaagaggacatcgcatgttatagtggttttggaagcatgcagtcgctgcagcaatag

SEQ ID NO: 5911 - DNA, 2565 bp, Oryza sativa
  Predicted polypeptide sequence is orthologous to G987
ggggagttgggagttgggactccctgtgcctctcctctccaccgcaacgaccacaaatcaccatctgctttctagtttcttcctgaagttctgcgtcataaaggcaaaaatccaagattgattttggatgaaaaagactgcagtgcttagcaagtgttctgttcttggagtcgcaagctgcggctagctagcaagcaagcagcttttttttttttcgcagatcttggtgaagagcctgttcttccatggctttcgctttgtgagagaaaagggtattgttagtcagtaagtaaaagggtggatcttgttcgaagattcaagagtcatgttggattctggttcttatgatgatgttgactatggggatttgttctccatccccaatccacctgcgcctcacttgctcaatttccccctccagttcttcccttccaacggattcatcagttctgctgatgattcccatagatcaccagctggtatgtttggctcgaccccaagccccacatcaaccacaaccgagttggaaaattcagaggatctgtctgaatccgccgacgatgcggtcctagcatacatcaatcagtttcttcttgaagatgaggaagatgaatcttgtcctggcaccatcacatcggtggaggactctgccctcctcgccgtcgagaagccattcgttgacatcctcactgctagccaagaggcctgtcaagagaattcttggatagattcttgttgtgatttcacggggaatggaggattgcttgatacgttcacaaccacacatgccgcttgccagccagcgccttgtgaatttgagaaggagaagggggagtgtgctgttcataaaggccggaagaacccgcatgatgattgcctattgttagaggaagagagcaggaggagcaagcagttggcagtgtctgaggaggagactgtcagagagatgtttgacaaggtgcttctgtgtaatggcgaatgcgagctccgggcaccactgccagctgaagcacggaactgcggggtgtacgtgaaaggatctggaaataagagaggccgaaagaaaggaaaatctggagcatctgcagaggatgatgcggttgatctcactaccctactcattcattgtgcccaggccgctgcaatcgatgatcaccggaactccaatgagttgctgaaacaaattaggcagcgttcttctgcatatggagatgccggtcagaggttagcacattgttttgctaatgcgttggaggctcggctagctggcactggcagcaacatttaccgttcacttgctgccaagcgaacttctgtttatgacatattgaatgcattcaagctgtatgttacagcatgcccgttcaagaaaatatcgaacttcttctcgatcgaagccatcttgaacgcatccaagggtatgacaaggttgcacattgttgactatggtatacagtatggattccagtggccaatcttcttccagcggatctcgaagagacctggtggccctccaagtgttcgaatcaccggtgttgacttaccacagccgggattccgccctgcacaactcattgaggcgacgggccgtcggttgcatgactatgcccgtatgttcaatgttccatttgaataccatgctattgctgccaagtgggacactatccgtgtcgaagatcttaagatagacaaagacaaggatgaacttcttgttgttaactgccttttccggatgagaaacatgatggacgaaatggtgacagatgacagcccaagaatgcaggttctgaagacaataagagagatgaatccaaatttgttcatccatggcgttgtcaatggcacctacaatgcgcccttcttcgtgacacgattcaaggaggctttgttctactactcttcactttttgatatgcttgaaacaactgcttcacgggtcgacgaaaacaggctgctgatagaaagagatctcttcggccgggaagctcttaatgtggttgcttgtgagggcactgagagagtagaaagaccagagacgtacaagcaatggcaggtgaggaacatcagggcaggcttcaagcagctaccactgaaccaagagacggtgaagaaggcaagatacaaggtgaagaaatcctaccacagggatttcctagttgacgaagataacaaatggatgctgcaaggttggaaggggcgtatcatctttgctctttcagcatgggaaccaaactagcaaactgtaaatatgactaactcagctgatttcttctgtggaggtaccactccattagttatgtctgattcctatttcaatgaattttgacctatttctgggcaatagaagatattggattttgactgggctagagtatactttggatgagtatctgacagaaaaggatatacttctctctaagcgtgtgtgacctgtggggctcaaaactgtactttgaaaacacaattacacatcatgcatgtactgttcacatggtccagcctgggcaaagggttaaagcctacatggtgaattggtgatataaataacgaaatggtttatctgct

SEQ ID NO: 5912 - DNA, 2147 bp, Oryza sativa
  Predicted polypeptide sequence is orthologous to G987
aatccttcaatttaattgcacttgattaatagctagtgatagtggaaggaactggtaggcaatggctaccacgccggaggcggcggagtccctccgattccgatggccggcagcggaggaggagttcgacaacgacatggtcctcccctacatctcccgcctcctcatggaggacgacgtccacgaccacttcttctaccagtaccccgaccaccccgccctcctccgcgcccagcagccattcgcccagatcctcgcctcctccccctcctccgccgccggcgcctcgtcgtcgtcctcctcctccgatgccccgcccagccgccccttcttcgatgacgaggcggccaccgccaagactttccccactgctgcggtccacagcgttgaccaccagtactccggcggcctcgacatggtcaacatggcgttcctcaagggcatggaggaagccaacaagttcctgcccaccaacaccctcctcctctcgaccgactcttctactaccttgcagttgcaggttcagggtgaggtagtcgtcgacggacatggaatgctcgggggggtcgggggagcagctgcagctcatgctcatggtgcaatcaacagcaagaaagtcaactgcagggacgacgacttggaagctggcactggcagggccaccaaactgatggcgcccgagccggagctggaggaggaaggtgcacgccagatgttcgacgaaatgatgctccaggagcacgagatttgcatgaagggggtgaagcagctgagcctcaagtccaagagcagcagcagcaagaaggcgcgggggagacgcactgtgatccacaccgagccggtggacctgcacaacctgctgctccactgcgcgcaggcggtggccacggacgaccgccggagcgcgcacgagctgctgaggcagatcaagcagcactcgtcggcgtggggagacgccggacagaggctggcgcactgcttcgcgcaagggctggaggcccggctcgccggcacggggagccaggtgtaccagtcgctcatgtcgcagcgcacctccgtggtcgacttcctcaaggcgtaccggctgtacatggaagcctgctgctgcaagaaggtggccttcgtcttctccaacaagaccatctacgacgccgtcgccgggaggcgcaagctgcatatcgtcgactacggcctcagctacgggttccagtggcctgggttgctgcgcgagctcgcggcacggagaggcggcccaccggaggtgaggatcaccggcattgacctacctcagccgggattccgccctgaccaacacatcgaggagaccgggcggcggctgagcaggtacgccgacgagctcggcgtgccgttcaagttccacggcatcgcggcgacgaagaaggagagcgtgaggcgggaggagctgggcgaggcggaggaagacgaggtggtggtggtgatcagcctgtgccatttcaggaacgtgatggacgagagcctgcaggaggacagcagcaggagccccagggacgaggtgctggggaacatccgcaggatgcgccccgacgtgttcatccatggcatcatgaacggagcctacggcgcgacctacttcctgacacgcttccgggaggctctctactactacgcggcgcagttcgacctgctggacgcgacggtggggcgggagagccacgagcggatgctggtggagcgggacatcttcgggcgggcggctctgaacgtgatcgcctgcgagggcgcggagcgggtggagcggccggagatgtacaagcagtggcaggcgaggaaccagcgcgcggggctgaggcagctgccgctgaatccgcaggttgtgaggctggtgctggacaaggtgagggacaagtaccacaaggacttcgtggtggacgaggatcaacgctggttgctgcacaggtggaagggccgcgtgctctacgccttgtccacttgggttgcccaacactagctcttagcctcttaccaattatttataccaattttcagatatgcacatcataagtacaaccatgtctatgatcgatgtggaccatggttgagtaaaccctattgtatgtttcttgtatcacatttttgctcctccttggtcatggtgaccactgacc

SEQ ID NO: 5913 - DNA, 1992 bp, Oryza sativa
  Predicted polypeptide sequence is orthologous to G987
atgcaggaggacattgatgacagaggcaatgaagatactgctcttcaagctatggaggagcccttctatgaacttcttggagaaaagtatccggcattccctcagcaacaaccactttgtgtatgtgatcacctgcagaacctcagtgccaacactgacaagtctaatggtcacgcatgcaatacctggtctgtcactagaatgacaaacattagctcaagtatgaattccaatggcaactttcaagggtttcagtttccatggagtttgtcttccattactagagagacagaacagttcactcatcactcaaatagaatggttgttggtctaaaagtggatggcctttccatttccgaaaagcctagccaggacaattgttcacttcaaattgatgcgcattacatgaggaagcatccattgtttgaggttcatgatagaaaaagttatccgtgtattgaagatcttgatttgttagaaggaaggagcaacaagcagtatgctatttactatgatgaaccgattcgggatgagatgtttgacaacgttctactatgttctgatcataagcctctagatgaaggtgttagtttgagcagagccatgacaaacaattcaagcaagtcttcacaaattggacaaggaaaaacatcagctcggcgaaagacaacaggcaaaaggatacaaaagagagatgttgtggatctaagaaccctccttatcaattgtgcacaagcagtatctgtgagcaaccatagcctagctagtgacatactgaagataataagacaccatgcttcacctaccggggatgattcccaaaggctagcactttgcctagcgtattgccttgatgtacgattaacgggaactggaagtcagatataccacaagttcatcaccaaaaggaggaatgtaaaggatattctaaagggaaaaccacaggtccacattatagattttggcatttgctttggtttccaatggccatcactatttgaagaacttgcaaaaatagaagatggaccacctaagcttcggattactggtatagaattacctgagtcaggcttccgaccatatgctagaagaccagagaggattgagaggccagagagttacaagaagtggaaggtaagaaaccttaaggcaggactggtgcagcttccattgaatccagccatcgtcagagaaacacaagatatggtaagaaagggttatcacaaagattttcttgtcgacgaggaagatcaatggttagtgttgggatggaaaggaaggatactctatgcatcatccacatggcaaccaaatgattcaggacgccgtccccctccctcccaatccagtgcgatcgaacggccctcgatcacgagaacacctctgtcatggccgcacccacctgaagctgaaggtacatactggagtggagtggagtctgatagagtctatagagactgttctcttaacaatagagggccactatgcaacggaatcccgtttttaaacgggatgataccggtatcagatgacttctaccacgtatcaggtgatactcgtgagatatcatgtgatacctatcaggtattagacgatttctaccacgtatcgggtgatacttacgagatatcagatgatacctaccggatatcagcgtcctccgccgccatgcgccacgccgggctcgtcgctagcggccacgtcctccgttgtccatgcatcgcgtcgcgtcgaagctcgttgccagaggctgcgtcctctgccatccatagccacgccacgccgggagctcgtcgccggcggccacgccggagctcgtcactggaggctgcatcctccgccgtccatagccatgcgccggagctcatcgtcggaggttgcatcctccgtcgtccacaaccatgccacgccgggagctcatcgcttgagactgcgtcccctaccatccacaccccatgctacgccggagctcgtgcagcagtcatgctttga

SEQ ID NO: 5914 - DNA, 3032 bp, Oryza sativa
  Predicted polypeptide sequence is orthologous to G987
aacctgcgcctctcgaaaacactggtccgcctccgttcccctctcctctcggctctcttatctcacccttcgtttcgctcgtctccctcccgccgcagcaggtggggggattcgagtgttgggaggtttgcatgctctgtggtggcggtagagttggtggtggtggtggatacagatggtcatggatgctggggtgcacgacgtgtgcacgatgctgcccggatccaagcgcgacgcgcacctgccgctgccaatctacccccaaatcgccgccgccaatgggttcgcgacggcggaggagttcgacccgctgctgttcctttcgcccgatgcggtttgcggcggcggcggcgactacctgaatattgtctccgcgcagcccatctcggcggcctccaccaacggcgcgtcgccgccgagagatgtctcggtctctgcttcggcggcgtcgtcggcggcggcgcagcatgacgactccgaggctctctcggatatcgtcctggggtacatcaaccgcatgctcatggccgaggacatcgacgagaagttcgagcactacccggtgaacgccgatgatctgctcgccgccgagaagccgttcctcgagatcctcgccgaccggtcgccgtacttgggcggcagctcggtcgagagtcccgacggcagcagcgccgccaactcctgtaacagcctcagtccctgcaactgtagctcgtcctccgacgggcttggcgccgtgccgcagacgccggtcctcgagttccccacggccgccttctcgcagacgccccagctgtacggggatctgatccccacggggggcatggtggaatcgggcggcgcctggccgtacgacccgacggaattctatcagctctagaccaagccggttcgtgagaacctcccgtcgcaatcttcgtcgttcgcgtcttcgaacggcagcagtgttactttctcagaaggattcgagtcgttgctgagcccggctggtgtcttgcctgatgttagcctgaatgattttgttgtgcagaaccaacaggctttgcagttccgccgcgggtttcaagaggcaagcaagtttcttcctgatgagagcaagcttgtgattgatgtggataagctctacagtggagatgaggggagtaggttccttggtgaggttagacaagagaagaagcttgtgaaggtgaagacagaaacctctgatgttgaatcagcaggtcaccgaggaaagaagcatttctatggtgatgacctggatgcggaggaagggaggtgcagcaagcattccgcgcaagggattgacactgaccacctagtgagggatttgatggacaaggtcttgctatgcaatggtgagacatgctcaaaaggtgttaaggagttgcgtgaggctctgcagcatgatgtggcgaaacattcaggcggaggccatggcaaagggtccagccatggcaagggtcgtggaaagaaacaacccaagaaggaggtggttgacctggagacccttctcatccattgtgctcagtctgtggccactgatgacaagcgcagtgcaactgagctcctgaagcagatcaggcagcatgctcatgccaatggtgatggtgatcagcgtttggcacactgcttcgccaacggcctcgaggcgaggctggcaggtactggtagtcaaatttacaagaactacacgataactcggcttccatgcactgatgtgctgaaagcgtaccagctttatttggcagcttgcccatttaagaagatctctcattattttgccaatcaaacaattttgaatgctgtggagaaggccaagaaagttcacattgtcgattatggcatatactatggatttcagtggccgtgtcttattcagcggctatctaacaggcctggaggcccaccaaagcttaggatcactggaattgacacacctcagcctggtttccgcccagcagaacgcacagaggagacggggagatatctaagtgattatgctcagaccttcaatgttccttttgaattccaagctattgcgtctcgatttgaggctgtccggatggaggatctccacattgaggaggatgaggttctgattgtcaactgcatgttcaaattcaagaatttgatggatgagagtgtggtggctgagagtccaaggaacatggcattgaagacaattaggaagatgaacccacatgtgttcattcatggggtggtgaatggatcttacaatgcaccattttttgtgacacgcttccgggaggccttgttccactattctgctatcttcgacatgttggagactaacattcccaaggataatgagcagaggttgctcattgagtctgctctatttagccgggaggcaatcaatgtgatctcttgtgagggactggagaggatggagaggccagagacatacaagcaatggcaggtacggaaccagagggttgggttcaagcagttgccattgaaccaggatatgatgaagcgtgcgcgggaggaggtcaggtgctaccacaaggacttcatcatcgatgaggacaacaggtggttactacaaggatggaaagggcgcattttgttcgcactgtcgacatggaagccagataatcgatcatcttcatagcttgttcagctctaattattgcatgatattgtaaatgtagacctgttcatatttttttggggggcatttggaccgattgttcctggtaggcaatatattgctaggtatgttatttgaacaaccaagtaatgggaaacttctgcttaggaattgtcctatatgatgatctggttcatctctgtccgtacataagatgaacccgcctgttcctagaatctctgcacatttgttgtgatcattattgttgcttccgacgggaacagttggttcaattttggtggagctgctagatatgttgaagttgtagaccttgggttgtcttatgtatggatgagccttgtacagtatttcttccaaacattcagtacttgtcactaagttctggttctggataatc

SEQ ID NO: 5915 - DNA, 1583 bp, Oryza sativa
  Predicted polypeptide sequence is orthologous to G989
tttgcagtggttttgccacggagaagggtcacctgggaaattattgtttaggctgacgtgatgctccagggagtcctgtcgcgagctcccggcgccgacgcggcagcgatgaaggcgaagcgcgcggccgacgacgaggaggaaggcggcgagcgggagcgcgcgcgtgggaagcggctggctgctgaggggaagcaagggttagtggtggtgagtacgggggaggaggaggaggcggcggcggagacgcgtgggctgcggctgcttagtttgttgctgaggtgtgcggaggcggtggcgatggaccagctgccggaggcgcgggacctgctgccggagatcgccgagctggcgtcgccgttcgggtcgtcgcccgagcgcgtcgcggcctacttcggggacgcgctgtgcgcgcgcgtgctgagctcctacctgggggcctactcgccgctggcgctccgcccgctcgccgccgcgcagagccgccgcatctccggcgcgttccaggcgtacaacgcgctgtcgccgctcgtcaagttctcgcacttcacggccaaccaggccatcttccaggcgctcgacggcgaggaccgcgtccacgtgatcgacctcgacatcatgcaggggctgcagtggccgggcctcttccacatcctcgcctcccgccccaccaagccgcgctcgctccggatcaccggcctcggcgcgtcgctcgacgtcctcgaggccaccggccgccgcctcgccgacttcgccgcgtcgctcggcttgcccttcgagttccggcccatcgaggggaagatcgggcacgtcgccgacgccgccgcgctcctcggcccgcgccaccacggggaggccaccgttgtgcactggatgcaccactgcctctacgacgtgacgggctccgacgccggcacggtgcgcctgctcaagagcctccggccgaagctgatcaccatcgtggagcaggacctcggccacagcggcgacttcctgggccgcttcgtggaggcgctgcactactactcggcgctgttcgacgcgctgggcgacggcgcgggggccgccgaggaggaggcggcggagcggcacgcggtggagcgtcagctcctcggcgcggagatacggaacatcgtcgccgtcgggggccccaagcgcaccggcgaggtgcgcgtcgagcggtggggcgacgagctgcggcgagcggggttccggccggtgaccctggccggcagccccgccgcgcaggcgaggctgcttcttggcatgtacccatggaagggctacactctcgtcgaagaggacggctgcctcaagttcgggtggaaggacctgtccctgctcaccgcctcgtcgtgggagccgacagacggcgacgccgacgccgacgtcgccgtcgccggcgatacccaccatgagagccacgattcttgatcacatgatcgcagtagcagccaggtcgattcacctgtcgcagctttttttggtcatattcattatcctctttctgctagctacttcattcgatcgttcttcctcctgtgagtagtattttggccgatgattaagcttgtaatataatc

SEQ ID NO: 5916 - DNA, 678 bp, Oryza sativa
  misc_feature (678)..(678): n is a, c, g, or t
  Predicted polypeptide sequence is orthologous to G991
ttttttttttttttttttttttttttttttttttttacgaaaaaaatcatatgttattcatggagatcgatataaaaacactgaaatggcacaaggacaatattattctacccctggtcaggagtaacaactgcaacgcttaatttttttaaccgatgccatttcagcacttaaaagctaattaaaacattattagtctcttacaagggtagcaacaacggatgatggtagcagcatatatttggagctaattaaaagcggcagagaattaattattggagatagatagattggacgaaatgacgcggttgcagctatgcttgcgatagccatgtagctatatcaggcgaagcttgggtcatcgttgctcgcggatcccgcaacatcgtcaacggcgtcagctgcagaagcaacgccatcgtcagcagcaactccatctccatgttcggcagcagtagcagaagaagcccggttggcctcttcctcctcctgaaatgattttcattctggtgttcggcaggggacaatggagatgtttttgactgggggggggagaacctcccatgggacatcaccaaggaagcaccgacccccttccatttttgcgcacaagagggtcaaggactgtgatattgggaccatgtttttacttgttaccaagatgcaataagtgttggn

SEQ ID NO: 5917 - DNA, 1414 bp, Oryza sativa
  Predicted polypeptide sequence is orthologous to G1013
ctgatcctatcttggaagaattaagcaagtagcagcagcagcttaggttgatcatatggatggtgcgatgcaagagagcagagagtattggcgcgacggcggcgatgtcgtcggagaggagctcttgagggagatcctcgatgagaccgccgcggtgcattccaattccaattccaattcaaattcaaattccaattcaaaggaggcggaggaggaggatgagagagaatattttgccgcagctgcagcggatgagcagctgcaggtggaggctccttgcgggcggcggcggcgggagtcgatggtgaacaagctcatctccacggtgtattctgggccaaccatcagcgacatcgagagcgctctctccttcaccgccgccggcgaccatcagctactcgccgacggtcacaatttcgctgcaagtagctgtagcccagtggttttctcgccggagaagacgttgagcaagacgatggagaacaagtacacactgaagatgaaaagctgtgggaataatggtgggctcgcagatgatgggtacaaatggagaaagtatggccagaaatccattaagaacagcccaaaccccaggagctactaccggtgcacgaatccgcggtgcaacgcgaagaagcaggtggagcgagctgtggacgaacccgacactctgatcgtcacctacgagggtctccacctgcactacacctactctcacttcctccactccacttcttcctcctcgtcgtctactaccacccaacaacaactgcagcctcagcctcagatgatgaccaactgcaagaagaagcccaagctgcacctgcacccgctgctgcacgacgacccacccccacccccaccgccgccggaaatgacgaccatgatgataatgcagagcttcagcatccagcaacaacaacatgatgatgatcagctgctgcagcctgctgcagatgatcacttgatggtgcaggctccccccgatgattgttacaatattaacggcagcagcagcagcggcttgatgatgagcttggacgacgacgagcaggccgccggcgccggcgggctactggaggacgtggtgcctctgctggtccgccgcccgccgccgcccatctgcaacaacaacaactactactactcgccggccaccacctgcacctctgacaacgagtacggctcgtcggcgtcggcgtcgccgtcctcctccgtctccgtctccagctggactactcccatgtctccctgcatcgacatggccatactctccaacatcttctagctatattcaaattaatgaaatttcatctagtattctctagctagctagctagtcgatctagtacttacaagatatatataggtatgtatgcgtactgtacgtacgtagctagtgcagcacgtatta

SEQ ID NO: 5918 - DNA, 636 bp, Oryza sativa
  Predicted polypeptide sequence is orthologous to G1013
atgtatggccaatcccctcacaagcaacgacggcgttttccaggaccatatctgatgggagatgtgctgcgagctcaggccaccgcgtcggcggaggaggtggccggcggcgtctggccctgcgagctcgacgaccacctcataggcgagctcctcggtgacgacggcctgttcgtcccggccgccgaacaccccaccctctactactcgttcggcgcggggtcatcagcagccgccgccgccgcgccgtgcaacgggggcggcagcgctgatcacgagcggcggccgcggccggcaccggcggtgagcagggatctgtgctcggtgtactcaggcccgacgatccgcgacatcgagaaggcgctgtcgtcgtcggcgtcgccccggccgccgtacccctccggccgccgctacagctctctgtatttggtggaagcggagagcaagtacacgagcaaggtgaggagctgcggcggcaagatgccggccgacgggtacaagtggaggaagtacgggcagaagtcgatcaagaacaacccacatcccagagaagtttctcttaaattactcatccgatttataatccgattacaccgttgtgttcgtaacaataaaatccgatttaatccgatttag

SEQ ID NO: 5919 - DNA, 2826 bp, Oryza sativa
  Predicted polypeptide sequence is orthologous to G1017, G2567
gtggaaaccacctcattagtcatcccatcgagttgggttgagagatgctcaccttcatggagctcgcggggccgacggaaggcgacggcggcgggtccgtggactcccagctgtgggcggcgtgcgcggggagcatgtcgtcggtgccgcccgtgggcgcggcggtgtactacttcccgcagggccacgcggagcaggcgagcgcggccgtggacctgtcgtccgcgcgcgtcccgccgctcgtgccgtgccgggttgtcgccgtgcggttcatggccgacgcggagagcgacgaggtcttcgccaagatacgcctcgtcccgctacgccccggcgacgcggtggtggacgtgggcgaggcggccgcggccgaggcgcggcgggaggaggagaatagtaggccgaggccgacgtcgttcgccaagacgctgacgcagtccgacgcgaacaacggcggggggttctccgtgccgcggttctgcgccgagaccatcttcccggagctggactacagcagggagccgcccgtgcagtccgtctgcgccaaggacgtgcacggtgtggagtggacgttccggcacatctaccggggcaccccgcgccggcacctgctcaccacggggtggagtcccttcgtcaacaagaagcagctcacggccggcgactccatcgtgttcatgcgtgacgagggcgggaacatccacgtcgggctccgccgcgctaaacgcgggttctgcagcatcggcggcgacgacgagagcctctcctcgattcccgggtgggaccagtacaggggcttgatgcggcgcaatgcgaccgcgaccgcgaccggtgggagaaccccgcccaaggggaaggtcccgccggagaacgtgctcacggcggcgacgagggccaccaccgggcagccgttcgaggtgctgtactacccgcgggcgagcacgcccgagttctgcgtgagggcggccgcggtcaggacggccatggccgtgcagtggtgccccggcatgcggttcaagatggcgttcgagacagaggactcgtcgcggatcagctggttcatgggcactgtcgccggcgtccaggcctccgaccccgtccgttggccgcagtcgccatggcgtctccttcaggtacacctacacggcaccaacatgagacaaccccaactcgatcacgatagagtcgtagagttcttgatcaattggcctcctcgcaggtgacctgggacgagccggagctcctacagaacgtaaagcgcgtgtgcccgtggctggtggagctcgtgtcgagcatgcccaacctccacctgccatccttctcgccgccgcgcaagaagccgcgcaacccgccttacgcggagctccccctcgagggccagatcttcaccggcccggtgttcccgcccaatccaatggcgcacgaccaccaccaccaccatggtttccctttcctccccttcccggacagtagtgctcaacctgcaggcatacagggagccaggcatgcgcagttcgcttcaccgttcccggagttccacatcggcaacctgcagccgaatctgatgctctacgccggcatccgcctcccgcccgccgatcgcgccgcccccgctcctcgcccgccgagaatcatcatcagcaccgacctgacgattggcagcccgggtaaacccgacgacgccgcgtgctctccctcatccggcggcaagaagatcgacgacaccaagccgcgggggtttctcctctttggacaggcaattctaaccgaggagcagatcaagaacggcaactccgatggtcgtccggcctcgccgaactgggacgccgagaaggcgcctaacacctcggaaggctccgactccggcgtcacccagggcagccccaccaagaacaccacgccgtcgtggagcctaccgtattttggaggcaacaacatcagccgcgcatccgagtacgagctgaatcccgggcagtgcaaggtgttcgtcgagtcggaaaccgtcggccggagcctcgatctctcggcgctgagctcgttcgaggagctgtacgcctgcctgtctgatatgttcagcattggcagcgatgaactgaggagccatctggtgtaccgcagccccgccggcgaagtcaagcacgccggcgacgagccattctggtgagcacactagccgttcgcccgttcctcgtcaatactagttgtatttaccactcggttatcaattcttgatctgaaacttagcgacttttctgtcatttgcagcgcgttcgtgaaatcggcgcgtaagcttaggatactgactgatgctggcagtgacaacctgggagattagaagaagtaataaatcagccgaataacttagggcgctactcctagtcttttagaagcaaaaataagccgagagctgcatgcacgtacagctgcatgagctgcggtttctccttgctccagtccagtctagagatttttattcagggtaaagctgatgcagtcttcagttaattaggtgttttttagtcctttttacagctttctcgctaggggtttcaggtaacaactactagcgcaaagtgcagacagaatgtagtctttgcaccttggtcatcaaatcaaatgtactggtacttcttttattctcattcggcggatattgagccttaatttgtttcacgaaattgaatgcttctgccgcaccagaccaaggtgacaggattagtgcaggtgcaggcttacctgtatgcagtaattactatctgccggaatatttactcggcgctggcactgctgattctgaattctgtatagaggctctcagctccaggc

SEQ ID NO: 5920 - DNA, 3026 bp, Oryza sativa
  Predicted polypeptide sequence is orthologous to G1017, G2567
gtactcctcttctcctctctttctctctcctttcccctctctctctctctctatttagttcttttgcccccatgtcagctgcagtctgggggaatctgaggctgctgctcacctgggagactgaaaggaggcagaagcagcagcagcatcagcatcagcagcagagcagatagctgagctgcagagggggaggagagaagatagtagtggtagtagtagctgagctgtgtcaagattgcccttcaaattcatcatcttttgctcttgtgagaaaaggtgagtagtggtttctgggttgcgtctccctttttctgcaagatttctgagccaaaattctctcttttgctcgctttgttcccttttctttcttttctttttttcccttcttcctcctttctgctctgctggttggttggttctttctcctcccccagcctttttcagctatgagctctgattgatgatgacgatgatggcggctgtgcagctgaaaagcttcttcaccttgtggtagtggtaaaagctgtgggaaatttcatccataaagatcgccgtggcgctcgaattccgctgaattttgtttgtgctcgagctgatcggtggaggtgaaagatttttgcgtcgaagagatgataactttcgtggattccgcggcgaaggagcgggagcgggagagtgacaagtgcttggacccgcagctgtggcacgcctgcgccggcggcatggtccagatgccgccggtgagctccaaggtgtactacttcccgcaaggccacgccgagcacgcgcaggggcatggccccgtcgagttcccgggcgggcgcgtcccggcgctcgtgctctgccgcgtcgcgggcgtcaggttcatggccgatccggacaccgacgaggtgttcgccaagatccgcctcgtccccgtccgcgccaacgagcagggctacgccggtgacgccgacgacggcattggcgccgccgcggccgcggcggcgcaggaggagaagcccgcgtcgttcgccaagacgctcacgcagtccgacgccaacaacggcggggggttctccgtgccgcgctactgcgccgagaccatcttcccgcgtctcgactactccgccgatccccccgtccagaccgtcctcgccaaggacgtccatggcgtggtctggaagttccgccacatctaccgcggcacgccgaggcgccacctcctcaccacggggtggagcaccttcgtgaaccagaagaagctcgtcgccggcgactccatcgtgttcatgcgcaccgagaacggggatctctgcgtcggcatccgccgcgccaagaaagggggcgtgggaggcccggagttcctgccgccgccgccgccgccgccgccgacacctgccgccggcggcaattacggcgggttctccatgttcctgaggggcgacgacgacggcaacaagatggcggcggcggccaggggcaaggtcagagcccgtgtccggccagaggaggtcgtcgaggcggccaatctcgccgtgagcgggcaaccattcgaggtcgtctactacccgagggcgagcacgccggagttctgcgtgaaggccggggcggtcagagcggcgatgcggacgcagtggttcgccggcatgaggttcaagatggcattcgagacggaggactcatcaaggatcagctggttcatgggcactgtatcggccgtgcaggttgctgaccccattagatggcctaattcaccatggaggcttcttcaggtttcatgggatgaaccggacttgttacagaatgtgaagagggtgagcccatggttggttgagcttgtgtcaaacatgccggccatccaccttgctccattctcgcctccacggaagaagctttgcgtgccgttgtaccccgagcttcccatcgacggccaatttccgacaccgatgttccatggaaacccgctcgcccgtggggttggtcctatgtgctatttcccggatggcactcctgcaggcatacagggagccaggcatgctcaatttggtatatctttatcagatctccaccttaacaaactgcagtcgagtctatcgccccacggccttcaccagcttgatcacggcatgcagccgaggatcgccgctggtctaattatcggtcatccggctgctcgggatgatatctcatgcttgttgaccattggtagcccccagaacaacaagaaatcagatggcaagaaggcgccagcccagctgatgcttttcggaaaacccatactcacagagcagcagatatccttgggtgatgctgcttcggtggatgttaagaagagctcttctgatggtaatgctgaaaatacggtgaataagagtaactccgatgtttcaagcccgagaagcaatcagaatggcaccacagataatttgtcatgtggaggagttccattgtgccaagacaacaaggtacttgatgttgggctggaaacagggcactgcaaggtattcatgcagtcggaggatgtcgggcgcacacttgatctctctgttgttggttcatatgaggaattataccggcggcttgctgacatgttcggcatcgagaaagctgagctgatgagtcatgttttctaccgtgatgcggctggggcactcaagcacactggagatgaacctttcagcgagttcacgaagacggcgcgtaggctgaatatactaacagatacaagcggcgataacttagcgaggtagggtaaattaaagctattctcaattgtacagctggtggagcacggtggcaattttgaaggcaaaaattgccggtttcctagtactggtgcaatttcaaggaggcaattcagttttctttaattagagctcccagaatgggattgactgtaatccggtacccatatttatcggcagatttaccagactggatctatcctactgtcatgtaaaccgatcatattgcatttgatcgttggtgtgtactcggccatgaaccgttactaaacgaatgcgattacgggaatttttgcgcgc

SEQ ID NO: 5921 - DNA, 2355 bp, Oryza sativa
  Predicted polypeptide sequence is orthologous to G1017, G2567
atgaaggaggtgggggaggtggaggaggtgaggtgcttggacccgcagctatggcacgcgtgcgcgggcgggatggtgcagatgccggcgccgcgttcccgggtgtactacttcgcgcagggccacgccgagcacgccgacggcggaggcggggcggcggcggcggccgcggagctggggccgcgcgcgctcccgccgctcgtgctctgccgcgtcgaaggggtccagttcctggccgatcgggactccgacgaggtgtacgccaagatccgcctcgcgccggtcgcccccggggaggccgagttccgggagcccgacgagctctgcccgctcggcgccgccggcgacgcggcggagccgtcgccggagaagccgacctcgttcgccaagacgctcacgcagtccgacgccaacaacggcggcggcttctcggtgccccgctactgcgccgagaccatcttccccaagctggactacagggccgacccgccggtgcagacggtgctcgccaaggacgtccacggcgtggtctggaagttccgccacatctaccgcggcacgccgcgccggcatttgctcaccaccgggtggagcacgttcgtgaaccagaagaagctcgtcgcgggggactcgatcgtgttcctgcgcaccaggcacggggagctctgcgtcgggatacggcgggcgaagcggatggcgtgcggggggatggagtgcatgtcggggtggaacgcgccgggctatggcggcggcggcttctcggcgttcttaaaggaggaggagagtaagctgatgaagggccatggtggtggtgggtacatgaagggcaaggggaaggtgaggatggccgatgtcgtggaggccgctagcctcgcgtcgagcgggcagccgttcgaggtggcgtactacccgagggctagcaccccggattttgtcgtgaaggctgcgtcggtgcaggccgcaatgaggatccagtggtgctccgggatgaggttcaagatggcttttgagacagaggattcatcaaggattagctggtttatggggacaatatcttctgttcaggttgctgatcccaacagatggccgaattcgccgtggagacttcttcaggtgacatgggatgaaccggacctgttgcagaatgtgaaatgtgtcagcccatggcttgtggagcttgtgtcaagtattccaccaatccatttaggaccattttcgtcacctcgaaagaagttgcgggttcccccacatcctgacttcccatttgagggtcatcttctgaacccaattttccatgggaacccacttggtcctagcaacagcccactatgctgttacccggacaccgctcctgcaggcatacagggagccaggcatgctcaatttggtttaccactaacagaccaccagcttaacaagctgcaccttggtctgttacatagcggcagttttaacagacttgatgctattactccaccttcccggatatcaaagggctttgtggtcagtagtgcaccagcccatgacaatatctcttgtttgttgtcaatcagtacaccacaggtcgcagagaaatctgatgacagaaagacgacaccccatataatgctgtttggaaaggctatatttactgagcagcagataacttcaagcggatcaacagagacactctcccctggagttactggaaatagctcacctaatggcaatgcgcacaagacaggaaatgcatctgatggttctggttcatcaatttgcattggtttctcatctcaaggtcacgaggcttctgaccttggtttagaagctggtcactgcaaggtatttatggaatcggaggacgttggtcgcaccattgatttgtctgtctttgggtcatacgaagaactgtatggtcggctggctgacatgttcggaatcgagaaagaagaaatcataaaccatcttcatttccgtgacgcagctggtgtagtcaagcatccgggtgaggtaccattcagtgacttcatgaaagcggcacggaggcttacaataatagccggcgacagggagagaattgagagacctctcatcgaatgcttagttgagcaggcgtgatagttcaataaactcccgtttgaatttaattctgaaatatgaatcgtagcgtgaaaagacttcctttgttacatgtacttgcgttgggctgttaactaagcagacctgctttgtattgtcagtgttgtggattgctcaagttaaggtgtgtgtgtttttatcttgcctcggttagctgtcagtttctttgttgcaatcagtggtcatgttcttctgttcaagttcgtaaaccaaacacttggatgaatcttagtcaaa

SEQ ID NO: 5922 - DNA, 2046 bp, Oryza sativa
  Predicted polypeptide sequence is orthologous to G1017, G2567
atgatcacgttcgcggacctggcggagccggcgcccggcgccgagcggtgcgtcgaccggcagctgtggctggcgtgcgcggggggcatgtgcaccgtgccgccggtgggcgccgccgtgtactacttcccgcaggggcacgccgagcacgcgctcggcctcgccgcgccggagctctccgcggcgcgcgtcccggcgctcgtgccctgccgcgtcgcgtccgtgcggtacatggccgacccggacaccgacgaggtgttcgccaggatccgcctcgtgccgctccgcgccgcggaggatggggacgtcgaggaggatggcgccgcggcaggcgaggagcacgagaagccggcgtcgttcgccaagacgctgacgcagtcggatgccaacaacggcggggggttctcggtgcccaggtactgcgccgagaccatcttcccgcgcctggactacgccgccgacccgcccgtgcagaccgtcgtcgccaaggacgtccatggagtcgcctggaacttccgccacatctacaggggcacgccgcgccggcacctgctcaccacggggtggagcacgttcgtgaaccagaagaagctcgtggccggcgactccatcgtgttcctccgcggcgacggaggggacctgcacgtcggcatccggcgcgccaagcgcgggttttgcggcggcggaggcggagccgaggaggcctccctgcccgggtgggaccagtacggcggcctgatgcgaggcaatgcgagcccgtgcgcggccgccaaggggcggggcaaggtgcgcgcggaggacctcgtcgaggcggcgaggctggcgaacggcgggcagccgttcgaggtcgtgtactacccgcgcgccagcacgccggagttctgcgtgcgcgcggcggcggtccgcgcggcgatgcgggtgcagtggtgccccgggatgcggttcaagatggcgttcgagaccgaggactcctcccggatcagctggttcatgggcaccgtcgccagcgtccaggtcgccgaccccatccgttggccgcagtcgccgtggcggcttctccaggtgacctgggacgaaccggacctcctccagaacgtgaagcgggtgagcccatggttggtcgagctggtgtcgagcatgccggccatcaacctctcgtctttctcgccgccgcgcaagaagccccggattctggcgtacccggagttccccttcgaggggcagctcctcaacccggcgttcccgccaaacccgctggcacacggccaccaccattaccatcacaaccacccgtccttcttcccgttccccgacgttagtgctcctgcaggcatacagggagccaggcatgcgcaatttggtccatctttatcagatctccaccttacccacctgcagtcgagcctcatgtacccggggctccgccgccccgatcatgtcggtccaacatccatcccgccaccaagaatcagcactgacctgacaatgggcagctcgccgccggcgcgcgctctgtccatgggcgccaagaagcccgacgacgccaagccgccggggctaatgctgttcgggcagaggatactgaccgagcgccagatgagccttagcggcaccacctcgccggcggccaccgggaacagctctctcaactggaacaccgagaaaggtgcctcggagggctcgggctccggcgtcatccagaacagccccaccgacaacacgtcgtcggagaggctccagtggttcagggagaacagcaccgtctccgagctcgggctggagcccgggcagtgcaaggtgttcatcgagtccgacacggtcggccgcaacctcgacctctcgtcgctggcctcgttcgagcagctctacggccggctgtccgagatgttctgcatcgacagcgcggagctgaggagccgtgtgctctaccgtggcgccaccggcgaagtgaggcacgccggcgacgagccattcagcgagttcattaagttggcgaggaggcttaccatactaaccgacgccgggagcgacaacttagggagctag

SEQ ID NO: 5923 - DNA, 628 bp, Oryza sativa
  misc_feature (613)..(613): n is a, c, g, or t
  Predicted polypeptide sequence is orthologous to G1017, G2567
gatgttaccgtgggaacggcagccaaaagccaccaccaccaacctctcgtcttcgcctcctctcccaccccctcacgacgaacactcacacggtcacaccactacccctgcgagatcggttgctggcgctgctgctggtggtgggtgcgtggcgatgatcacgttcgcggacctggcggagccggcgcccggcgccgagcggtgcgtcgaccggcagctgtggctggcgtgcgcggggggcatgtgcaccgtgccgccggtgggcgccgccgtgtactacttcccgcaggggcacgccgagcacgcgctcggcctcgccgcgccggagctctccgcggcgcgcgtcccggcgctcgtgccctgccgcgtcgcgtccgtgcggtacatggccgacccggacaccgacgaggtgttcgccaggatccgcctcgtgccgctccgcgccgcggaggatggggacgtcgaggaggatggcgccgcggcaggcgaggagcacgagaagccggcgtcgttcgccaagacgctgacgcagtcggatgccaacaacggcggggggttctcggtgcccaagtactgcgccgaggaccatcttcccgcgcctggactacgccgncgaaccgcccgtgca

SEQ ID NO: 5924 - DNA, 394 bp, Oryza sativa
  Predicted polypeptide sequence is orthologous to G1020
ttttttttttttcttcatactaatataaaggaatacatcccctccacggtttagtccatctcatcgccggcatgatctgttctaattaacaaatcccaaaatgaatttcgccctcggcaaaaaaactatttacaaggcttttccgtttttcacaggctactaaacgaaaacccagaggaccaaaacttcggagagaaatttccttcaaagaaaaaaataagagagaaactccaaagtcgtcagctaacccatcctgagctagttctttaccggggggggccggttcaaatccaaatcgaaagctgccgccttgttccccgtaaccgttggaggtgacggcccaaaatcaaccaccgacgaggagtcggagtcactttgtgcaaccgccgccacg

SEQ ID NO: 5925 - DNA, 1116 bp, Oryza sativa
  Predicted polypeptide sequence is orthologous to G1020
gcacgagcccaaacccaacctcccaaaacacccacccggtttaccagagatccgcgcccgccacttgtaaacctgctgtacccatggcgcccagagcagctacggtggagaaggttgctgtggcgccacccaccgggcttggtcttggcgtcggcggaggtgtcggagccgggggtcctcactacaggggcgtccgcaagcgcccgtgggggcgttacgcagcggagatccgtgaccctgccaagaagagccgggtgtggctcggtacctacgacacggcagaggaggccgcccgcgcctacgacgccgccgctcgagagttccggggtgccaaggcaaaaacaaactttccgtttgcatcacagtcgatggtcggctgtggcggcagccccagcagcaatagcacggtagacaccggtggcggcggggttcagacgcctatgcgggccatgcctctgccgccgactctggacttggatttgttccaccgcgcggctgctgtgactgcagtcgccggcaccggcgttcgctttcctttcagaggatatcccgttgcacgtccagcaacgcatccatactttttctatgagcaggctgcagcggttgccgcagctgaggctggataccgtatgatgaagcttgcaccgccggtcaccgtggcggcggttgcacaaagtgactccgactcctcgtcggtggttgatctcgcgccgtcacctccagcggttacggcgaacaaggcggcagctttcgatctggatctgaaccggccgccgccggtagagaactagctcaggatgggttagctgacgactttgtagtttctctcttattttcttctttgatggatatttctctccgatgttttggtcctctgtgtttttgtttagtagcctgtgagagacggaagagccttgtaaatagtttttctgccgagggcgaaattcatcttgggatctgttaattagaacagatcatgccggcgatgagatggactaaaccgtggagtgtatgtattcctttatattagtatgaagaaattattcagaaagtcacaaaaatatctgtgcacactgagtttgattgacgtttttaaaaaaaaaaaaaaaaaaaaaa

SEQ ID NO: 5926 - DNA, 1451 bp, Oryza sativa
  Predicted polypeptide sequence is orthologous to G1020
tttttagcaaaacagagtgaaaagattttttcttagaagggtttctacatagtttctcatgactatcaaaataataataatacatatataatcccgctccataacaacgccggcaggatatgtcttaggtgacacacatggtgtgatcttctcttaaactacatcgccggcgaaaaaaactatttacaaaaatgtcttccctcagttaagcaagagggtctaggcataagaggtacacggaatttttctactactaaaaattaaaaagaaagaaatgaactagcggtcatcatgtaaaaactccggctgctagacctccatcggcggcggacagttcagatcaagatcaaaagcgatggctttcttcgccaacgcggcgggcggtgatggtgccagatccacgatcgacgaggagtcggagtcgctctgtgccaaggcggccacggtgaccggcgccggcgcaatcttgagcatgcggcaaccagaggcggcggcggcggcggccgcttgtccaaagaagtagtaagggtgcgatacggggtagccctcgaaagggaaacgcatgccgcctgcgccggcggccgcggccgctgcggcgcggtggaacaggtcgagctcgagcgacggcgggatcggcatggccttcatgggcgcctgcacgtcgctgccgaacgactcgacggtgctgctgttgctgctgccgctgttcacaccggcggcgggcgcgccgttagggtaggggaagttggtcttggccttggcaccgcggtactcgcgcgccgcggcgtcgtaggcgcgcgcggcctcctcggccgtgtcgaacgtgccgagccacacgcggctcttcttggccgggtcgcggatctccgccgcgtaacggccccacggccgcttcctcacgccacggaagtgctggccggtgcccacggcggcggctccggcgacaccgcccacgccaagcgcgagtccggtggccgcggccgccggtgacatagtcttgtccgacgttctcggcgccatggcgatctttcttttctccgtgtttctttcttggtgcgcgctgatggtgcggtgcggatgcgggtgcagctgcggtgttgcggcaggagtatacaagcacatcacaggtggcatgatgggtggtcatgctgccaagttgattggatggggaaccacggatgctggcgaggattacttggctgcttgcaaaccagtggaacagaggatggggcgatgatgggtacttcaagatcataaggggcacaaaccgaatgtggcatcgaagaagatgttgttgctggtatgccctcgacgaagaacatggtgaggaactatgatagcgccttcggagtcggaacggccatagtttgacttaatcaaatttacatgatcccaaccgtattgagccataaccgacgcgtggcgacgcgtggtcgacccggattccgacc

SEQ ID NO: 5927 - DNA, 291 bp, Oryza sativa
  misc_feature (2)..(2): n is a, c, g, or t
  misc_feature (4)..(4): n is a, c, g, or t
  misc_feature (15)..(16): n is a, c, g, or t
  misc_feature (37)..(37): n is a, c, g, or t
  misc_feature (54)..(54): n is a, c, g, or t
  misc_feature (69)..(69): n is a, c, g, or t
  misc_feature (75)..(75): n is a, c, g, or t
  misc_feature (95)..(95): n is a, c, g, or t
  misc_feature (104)..(104): n is a, c, g, or t
  misc_feature (107)..(107): n is a, c, g, or t
  misc_feature (110)..(110): n is a, c, g, or t
  misc_feature (114)..(114): n is a, c, g, or t
  misc_feature (116)..(116): n is a, c, g, or t
  misc_feature (127)..(127): n is a, c, g, or t
  misc_feature (130)..(130): n is a, c, g, or t
  misc_feature (189)..(189): n is a, c, g, or t
  misc_feature (200)..(200): n is a, c, g, or t
  misc_feature (206)..(206): n is a, c, g, or t
  misc_feature (217)..(217): n is a, c, g, or t
  misc_feature (220)..(220): n is a, c, g, or t
  misc_feature (237)..(237): n is a, c, g, or t
  Predicted polypeptide sequence is orthologous to G1033
angnacggttcgccnntttataaaccaaattccccancggcggttcgttcttgncgatcccgagggctngagatnaaggcgaggtcgaggtccancaattgcgnctncanggtntnggtgaggaagnccnaggcggagaaggacccgaacaagccgaagaggccaccgagcgcgttcttcgtgttcatngagcagttcangaaggncttcaaggagnagnaccccaacgtcaagcangtcttggtgatttgcaaggcttgtggtgacaagtggaagtccatgacttatgct

SEQ ID NO: 5928 - DNA, 730 bp, Oryza sativa
  Predicted polypeptide sequence is orthologous to G1033
aattcccctctcctcttcgctctcatctccgcttccagccagccactgcaaccctaaccctccgcaaagccctaccccccttccgccaccatgggcaaggccgacgccgacgccgagttcaaggccgccggcaagcgcaagaaggccggaggcgccggcaagcccaagcgcggcctcaccccgttcttcgccttcctggctgagttcaggccgcagtacatggagaagcacccaaacaccaagggcgtcgcagcggtgaccaaggctgccggggagaagtggcgcgctatgtcggacgaggttagcagatgctggcagttgttgtactagcacgctttattatgcttctgtgcggggattcccgcaactgatatttgcacgtccaataagctgattacacttgtcgcatatcatgtgaaaaagcatattatatgcagttttctgagcttttagcagttattattagttatgacctgacgctttataaccacaaattatgccattcttcttcagtacacgtgctgtacagtggctttattgtctgttgcaacatgtatcgatccttagcatgcctgtgcagcaaagctatctagagtgctagctagactcatccatggtccatggatcacatcaagctcttacaggtaatgggtggagattctatacagctgtgaggttctttgagccatgtttttgggagaatgcactataggaaataaaatcacttgac

SEQ ID NO: 5929 - DNA, 957 bp, Oryza sativa
  Predicted polypeptide sequence is orthologous to G1033
atcggccattatggccggggagaagtgggcgctatgtcggacgaggagaaagcgcaatatgggggcaagaagccagatggcgagagcaagccgccggcaagcgcaagaaggccggaggcgccggcaagcccaagcgcggcctcaccccgttcttcgccttcctggctgagttcaggccgcagtacatggagaagcacccaaacaccaagggcgtcgcagcggtgaccaaggctgccggggagaagtggcgcgctatgtcggacgaggagaaagcgcaatatgggggcaagaagccagatggcgagagcaagcccgcggccgctagcaagaagaaggagagcactagctctaagaaggctaaaactgatggtgcggaacaggagggagaaggttctgacaagtcgaagtctgatgttgaggatgatgagaatgatggcagtggcgaggacgagtagtagtaaatagcttagagagctgcagctatgcaaatcggtgttcactgcttagggctttagctttgctatgttactgttatccttgttatgtcctgttgtaaggaaaacgtgcgaatgaaggtactcctgtgacgtggaatgctggaggtgactctgtttaactagtagcgaaaaaatggcgaatatgttgactggtttctttgagaactcggaggtttttaactatttggtataccggcttgtaataagcggaatgggtttacaaacaacctacgctgtaacaagttgcggctggcgagcattacatgcacactctttcggcgaagcacgggaatgccacggggttaccggggcaacggggggtgaggcactaagcggccccgcatacgagtccacggtcgtatggacactaggtcgcgccgcagcacaggtggcggatgtgaccgaggagtacgtgagacgtggacgtgcaagatgtgaagttagtgtggtgatacacacg

SEQ ID NO: 5930 - DNA, 1041 bp, Oryza sativa
  Predicted polypeptide sequence is orthologous to G1033
agagtgtactgggtcggtcggaatcctgggtgaccacgcgtcgccacgcgtcgcacgaacgcttcgccgcttgataaccaaatccccaccaccaccaccgccgcttcgttctcgccgatccggagggctcgagatgaaggcgaggtcgaggtccagcaatggcgactccaggctctcggtgaggaagaccaaggcggagaaggacccgaacaagccgaagaggccaccgagcgcgttcttcgtgttcatggagcagttcaggaaggactacaaggagaagcaccccaacgtcaagcaggtctcggtgattggcaaggctggtggtgacaagtggaagtccatgactgatgctgacaaggctcctttcgtgaccaaggctgagaagctcaaggctgagtacaccaagaagattgacgcctacaacaacaagcaggcaggaggcccggctacctcaggcgactctgacaagtccaagtccgaggtgaacgacgaggacgagggcagcggtgacgagtgatcgatggagctcccgcctccacagggctgcaggtagtagggaaagttctctcgagtcggcctaaccaaagtggacgttgctggttgctgctccttgctagtgttcggatgttgctgcctttagctttttagtcttagaggtctcatcctgtagcttagctctcatgtggtgtcctcgctctcttcggcacttgaccaccatcttgtcgtctgttttgtctcactgtctgtaatctaagtgagtactcgtatctgttgctgttttaaatctcagatctcagtagatggtgccatctgtgttagttgctgaagaggaaacggaacatattaccagtctcttgcttcctgtgtagacaagatagaagataacacaaagaaagagtgagaatacagttaccaaaagacaacaatggggggccggtcaaaaggtcccaggttacgaagcgtttattggaggtatagagcctctaaaggggaccgaaattacgatcaggggcgcggtttaaaaggtgtgatgtgaaaccg

SEQ ID NO: 5931 - DNA, 1124 bp, Oryza sativa
  misc_feature (840)..(840): n is a, c, g, or t
  misc_feature (853)..(853): n is a, c, g, or t
  misc_feature (988)..(989): n is a, c, g, or t
  misc_feature (991)..(991): n is a, c, g, or t
  Predicted polypeptide sequence is orthologous to G1033
ctgaggtacggtcggaatccgggtcgaccacgcgtcgccacgcgtcgcgcctctcctcctccgctgcacccccgcaaaaaccctagcgcaccgacttcgcgatctccgcgccgcagccatgaagggcaagcgcgacgcctccaagaagggcgagggcaggctcaaggccgccggcggcgccgggaagcggaagaaggccgccgctagcggcaagccgaagcgcccgccgtctgctttcttcgtcttcatgtctgagttcaggcaggagtaccaggcagcgcatcctgacaacaagagtgtcgccgccgtgagcaaggctgcaggggagaagtggcgagctatgtctgagcaagagaaggcaccttatgtggacaaggctggccaaaagaagcaggactacgagaagaccaaggccaacttcgataagaaggagagcacaagctcaaagaaagctaagacccatgatgatggagaaggctctgacaagtccaagtctgaggtcgacgatgaccaggatggtggtagcgatgaggaaaatgaggacgatgaagagtaaatagtgtatccgggggcatgaggtagcaaactgtgtcttaggtcccctattagctttactagtttgctatcttcgaccctaagatgttgggaataggcgtgcgtgggtgtgaagggggaccggttagaattatggtactcagaatgttttcttacagtggattagcaaagaaaaagcctgaatgccggctgctgttctggtgctttctttggctaaccctggttccgaacttggtttcttggctaactattaccatcgattaacacaaaaaaggggggcgatcnaggtccactaatnagcggtgaggacctgagctctttagagggccactactacgggccgcgcaacagctgggaacagttcacctttgtggaactctcggctgaaaacagcccacatgggggctctttgttgttgcttctatctctaagnnanagatgaaagagcaaagcgatgaaatgagactactacgatcacgattctataaacgtgtagatcagtcattaacctagctatgagagcatctacacttgctagtcacatcagtatacgatacatcacactcatc

SEQ ID NO: 5932 - DNA, 1221 bp, Oryza sativa
  Predicted polypeptide sequence is orthologous to G1033
cactcagaaaccaatctaatacagtgtgctgaggtacggtcggaatcctgggtcgaccacgcgtacggtgggtagttacctatctcccctacttcctcctctcctttccctcctctcttcccccctctcacaattagagagagagcgccagactctccccaggattccgccatgaagggggccaaatccaatggcgccgccaagcccgacgccaagttggctgtgaagagtaagggcgcggagaagcccgccgccaagggcaggaaggggaaggccggcaaggaccccaacaagcccaagagggctccctccgctttcttcgtttttatggaggagttccgtaaggagttcaaggagaagaaccccaagaataaatctgtcgctgctgtaggaaaagcagccggtgataggtggacatccctgaccgaagcggaccaggctccctatgtagccaaggacaacaagctcaaggccgagtacaacaaggccattgctgcctacaacaagggcgagagcactgccaagaaggcacccgccacagacgaagaggacgacgaccaggaggactctgacacgtacaagtccgaggtcaatgatgacgatgacgacgagggccacgaacaggatgagacgaataccagtgagcctcccatcgccaccatggccaccccacaccctatgccggacggagtcctaaggaccctaccctcaatcacccctcgctcataacatatccgcttcaatcatcttcaataaaactttactcactcaacgaagccccttttacccataattatacaaacaaacatcacaccaaaactaccaaacatacatacaacacaaaacatccataacacacaccacaacacacacaccatcacactacccacactcacaaaaaccaaaccacacaaccaaaacccaacacacaaaaaactaaccacaaaacaaaacaacactcccacacaaaccactcaaaacatatcaaatccttaataaatccatcacctcaacgaaaccacccaagaaacaacaaataaatgaataacatacagacaaagaaacaacacccaaaaaaacaaaccaccacaaccatcacaagatacaataacacacataacatatcactaaacacctacacaaatccaacaacataaattacaataccataaaactatataaaccacacacccctacacgaaagctcaaaacagacgaaca

SEQ ID NO: 5933 - DNA, 2157 bp, Oryza sativa
  Predicted polypeptide sequence is orthologous to G1037
actcaaaacactcatcaatgaaatctgatcagcggtagctttttttttttctttctgaaggaacaaaagtgagcaatagctagcggtacatctctctctgtggcaatggatcaagcgaggatctcgttcttcccggatggtctccgtgtgatgatcatcgacgacgacgcaaaggccgtcagaagggcaacggcgacgttgtcccaactgcagtacgcagtggtggcgacgcactccaccgcaagcgctggtctgcgtgccctctccggcgacaacgtggtagaaatccaagccatcctctgcgatgtccacaaggtggtctcctccggcttcgacttccgccgcgtcgtcgagtccgagcttcgcatccccgtcatctaccttctgtcgaagatggaggaggaggacatggtcgccggcgaggacgcggagttcctgaaccacctcctgctgacggcgacctacatcgtcaggaagccgctcaaccccaccgtgatggcccggctgtggagggtggtggcatggcgcatgtactgcctggaagaaaggattcaggccaatgtcgctgccaatgctggcgctggtggcgaagacgacgacgacgacgacgacgtagttatcgtcgaggagccccaagtgcacttcaaggtggtgagaagaacgtccggtggcagcaggaagaggcagctgacaatcaacgtcgtcgacgacggcaaccgcggcagcggcagcggcggcggcggcggcggcggcgcagatgccaacccaaccaggatactgcagcacatcactagcaacttacaggaattccgcacgaagcaccagaagaaggacatggccatcgagcgtcccctcatctcgtcggactccatgttcctcaaagccatcctcccgacgctcaaaatctcaccatgcaaccccctgaccctcactggcggcatcggttcaagcagtgtcgccgcggaggccttcgctggcggcagctcttcagctgcaccacttcaaattccagttttccagcagcaatccaccggcaatggcaacacggtgattagcttcagcaacaatgcttcaccgatggccatgcgtgcgccaaccgacaatactatgatatcgttcaacaatgtctctgctgcgccggtcgccaatgcggtgatctccttcagcaacatttctaggtctgctgccatgcaggcaccagcggcaagggggcaacatctgtccggtgatgtccagcagctggattttccccagcagaagctgtactttgggcccttctcctaccaagggcctccgccaccttccatgcacaaccacatcaacctactcccgccgacgtcctcccctgtgacctgctccatggacaaaggcaaggttcctattatcgagctcccatatgggatgcctgtggatgacttcctcgtcagtcaaaccacatatggcggtgccggaccatccatcggagccactgacgctgctgccgctgcgtacccttacacagatgcaccgagcaataacgttgcaactggctgtctcatggtgccaccaatggggccagcattcagtatcactgagccaactgtggtggcccaaggtgagggcaccggcaccggtgtcgacgccggcacatcagagaagaacgcgatagtagaagcaccaaacaaccccgcgccattaatggtactggatcaggttgctgctgatgctgcaatggatgttcaagaagacatcatgttctctttggaatctcttctggggccggactatgacctgctacctatggaagacgttagtgctccggacaccgctgcagccggtgatgcagctggtggctcactggacggagaggaaggcggcatggacattggttgggatctcgacctggatgacatcctggtggagaacgttaatgacttcgcgttcctggacaaccttgccgggagcgagtagtcagtagtcatctcatcgcaaatatattatctcaagttaattaagctagagattagagagaggggatgtgtgctcagtatgataaaacaacttttagtctttgttgcaagtactctaaacattgatgatttttcctccgttatcatgccaggaatgtgaacttttaaaactccaaattcctatattgcagatatgatattatgatgc

SEQ ID NO: 5934 - DNA, 3192 bp, Oryza sativa
  Predicted polypeptide sequence is orthologous to G1037
catcagtccactcatccccatgcccccctcattctgatcctttataaatcagccacccagcaagacattcctttccaacctcactcaccttgctctagctcagctagctcttgctgctagtagcttcagctttgctactgctactaccactactactactactactttcacctccaagaaagtatagattgcaagaacaatttctgctgctgttgttctttcttgctgttctttctccttgtgtagttgtgtggtgtggttgagctgaggtgtagttaggacagtggctggctttgcttgcttgattggtcacctgggaaggtcgctgtctctgccttttgttttctttgccatctctttctttctgggctgctttcaccttttgctttccagcctcttcttgccatcaataatgatggaggagtaagatagggcttgttcttgaagtctctccaatctaatctcatttcatcttcatcatctccacccggtccaaatccacctactactgtttttcttttgtcccttctcttttttttcttcctctgatcttttcttttttcaggtgttttgtttttggcagtaggtgcttgctatcttttcattaggctttggattttcctctcgtgttctttagtctcagcctattagaggtttgaggaaagttttccatttcttagctctttttgcttccagcttcttgggattgctctgtttcttgctgagaattggctcgatttgggaggcctcatcttgtgttagctttcaggttttcttgcctgaaattgaaccgattgggtaggtttttaggtgcttcagtttcagttgctagctcgtcaggcttgttcttgggctcctgccttgaattggggtcaaattgggatgcttctgggtgctttgaggatggaggagaggaagggattgatggggagggagagggatcaattccccgtcggcatgcgggtcctcgccgtcgacgatgacccggtgtgcctcaaggttcttgagaccctcctccggcgctgccaataccatgtaacatcaaccaaccaggctattactgcgttgaagctgctcagggagaacagggacatgtttgatcttgtcatcagtgatgtccacatgcccgacatggacggatttaagctccttgagcttgtggggcttgaaatggatctcccagtcatcatgttatcagtaaatggagagacaaagactgtgatgaaggggataactcatggtgcctgtgactatcttctaaaaccggtccgaatcgaagaactaaggaacatatggcagcatgttgttaggaggaagttcggtaatcgtgagcgaaacaatcttgatttctccaaagaatgcaataagccgcaaagcgcggatactgatcatggaccataccaacctacctgtggttcttctgatcaaaatgggaggtccagcaggaaaaggaaagaactacacggcgaggacgacgatgaaggcgatgataatgattatcaagaaaatgatgagccctcagctgcaaagaagcccagagttgtatggtcagttgagctgcaccgaaaatttgttgccgctgtcaaccagcttggaattgacaaagctgtaccaaaaagaattcttgagcttatgaatgtggagaaactcaccagggaaaatgttgcaagtcatctacagaagtacaggctttacctcaagagactaggtgctgtagcatcacaacaagccagcattgttgctgcctttggaggcagagatccctccttcttgcatattggagcatttgaaggactccagagctatcaaccttttgcaccttctgctgctcttccatctttcaatccacatggcctgctaacccgaactagcgccgccgcggctttcggacttcaggagcttgctgccccctccagcacaattcagacttctacaggaaatgtcacagttggccattgcttggaagaaaaccagcaggcaaatctagcacaaggcttgaccgcggcgatcgggcaacctcagcttcaacagaactggattcatcaagaaggtaatggtctgtctgatgttttttctgggagttctctgaccaacactttgtccagcacactccaaagagttccaagcagttcattgccaccacaagaactcttggagtgcaaacaagccaaagttagcatgccgccatcgatacggataccgccttctagttcagcacttcttgagaggactcttggggtttccaccaatttgggagattctagtatatcccagcagggtgctcttccaatagatggtggattttctgctgacaggttaccattgcacagttcatttgatggcgctgttgcaacaaagctagatactagtttggcagcttcacagagagagattggccagcaggggaaattttcagttagcatgcttgtctccccttctgacaatcttgcattagccaaaaatgccaaaactggagctagttcttctggcagtactataattctccctcttgatactgcaagacattcagactacttgcagttcggaggtgcaagcaattctttgcagaaaatggatggacagaaacaagatcatatacagagctcaaacattatatggagttcaatgccaagcactcaactgccaagtgatacccaaattcataatactcaaaaccaaagattggacagcggaagttttaaccataatattggtgcccatttggctgaccaaacaaatgcaagtgcgtcaatacttccgcaaatgaagtttgacacaagaatatcagaagagaaaatgaagcagaagaatacatatgacttgggtagttcaaagctgcagggtggatttaattctagtggctgcaattttgatggccttctcaattccataatcaaagtggagaaggatgatctcccattcatggacaatgaattgggctgtgacctttttccacttggtgcctgcatatgaatccatcatttcggacaccaaagattttgcataatctaaaagagtcagctgtgctgcctgatctgtgctacttcatccaggctttgtgtatactaggatctagggacagtagtggcttgtaatcttgctttatctcttctctagggttggctatggaagtatggttagatcaagataagaagaaaatataatgctgtaatgtcagcgccttttctagtc

SEQ ID NO: 5935 - DNA, 2358 bp, Oryza sativa
  Predicted polypeptide sequence is orthologous to G1037
gctttttggtggtggtgctcgctctcgctcaccctgctttgacctttggatttttatttttaaggatccaagaaagtgctgtttcttgggttgcttggaggtggaggagtttgggagattgtttgtgtttgattgattggttgattgattggaggaagatgacggtggaggagaggcaggggagggtgggaggccatggtgtgagcggcggcggcggcgggagagaccagttcccggtcggcatgcgggtgctcgccgtcgacgacgaccccacctgcctcaagatcctcgagaacctcctgcttcgatgccagtatcacgtgacaacaactggtcaggcggccacggccctgaagctgctcagggagaacaaggaccagtttgacctggtgatcagcgacgtccacatgccggacatggatggcttcaaactccttgagcttgtcggcctcgagatggacctcccagtcattatgttgtctgcgaacggggaaacacaaactgtcatgaagggtataacccatggtgcatgtgactatcttctgaagccagtgcgtcttgagcagctaaggacgatatggcaacatgtgattaggcgtaagaattgtgatgctaagaaccgtggtaacgatgatgacgctggtcagaaggcacagggaatgaacaatgaaggtgagagtattggtgctaaccgcaacaagaggcagtcacggaaaagtagagatgagaatggagatgatggtgatgattctgatgagaacagtaatgagaatggagactcatcaacacagaagaagccaagggtcgtgtggtctgttgagctgcaccgaaagtttgtggctgctgttaaccagcttggcatcgagaaggctgttccaaagaaaatattggatctcatgaatgtagagaacatcaccagggagaatgttgctagtcatttgcagaagtatcggctgtaccttaaacggttgagcactgatgcaagcaggcaggctaaccttgcagctgcatttggaggaaggaaccctgcttacataaacatgaattcatttggaaactacaacgcatatggtagataccgtacagtcccaactgctggccatacccaggcaaacaacattcttactaggatgaactccccttctgcgtttggtgttcatggtttgctgcattcacagccaattcagttaggacatgcccaaaataatctgagcacttcactgaatgatttaggagggcttaataatggtaacatgatcagaggtgcacagatgtcaacaattctaactggtccttctggtaactcctttccaaacatatcgaatggtgcaccgctggcaactgcaaacagatcactgcaacctcttgagtcgagcaatcagcaacaccttagtcgggtgcattcatcttctgcagatccatttagcacacttgttggtgagtctccccagtttcctgatcttggaagaaccaccaatacttggcaaactgcggttccatccaacattcaggatcgtggtcacaatgataacatgtcgcaagccaccctgcatatgaatggccccaaaattgaacctgtctcaagcttcacatcatccaatcagattccgctgctgggaaatgagatgcagggccaagtagcatcactagctagcaatgttccaatagcattcaatcaggacacatcaccattcaactatggaagcagcacaaactcaagagacatgctaaataacagccatgtatttagtaactccagcatcaacacatcgttgcccaaccttagcttagacaatccggctgtaccaaggcagacactggatcgtgggaatacgggcattgtttctcccatgcaagatggaaggattcatcaccaagctgttagcaatcagctaaactataatgacgatcttatgcggacaactgggctgcaaaggggtctcagtggtggtctagatgacattgttgttgacatgtttaggccggaccgcgaagacgacggcgttccttacatcgatggggactgggagctggtctagccagcctccatttcaatcattagtccgcgtacgaggtttttctgcattcgcggtgtcggctgctgattggtccatgctcacttgtcagcacaaagtggtgttcatagtggctagccttcatcacaagtgcatttcacatttggcttcttttttcagcttagtgattattagttggccagtcagtctgtgaaatttatgtggagaaacggctatgtggtgtgtttttatcatgacttatactataataactatgttagttcaggtataaccggttatcctgataatatagtatgcttggtaaaattctcgttaatcatcg

SEQ ID NO: 5936 - DNA, 3142 bp, Oryza sativa
  Predicted polypeptide sequence is orthologous to G1037
ggcggggtagtacatactacagactacagagggatggcgtttcgtctgtagcgatcggttggagcttgtggatgaaatgggccccaatttctgttgccctccaccatttttgaccccttaaaattcagacagatggacagtctacttacattctctccctcatcttcttctcccttgagatgttcttgctgttcttgctccaatctcctcttgttttcttgctgggagttgtggtggctgctgctgctgagctaggagtagttcacatgtgtgtgagctgaagctgaggttggttgcttgcttgcttggccatctggaacagtcagtgtctctgcttttttcctcccatttttttagtttatttttttggctgcagagagagagagagagagagagaactctgctttcttctccaactccctcccttttgctttcccacctctttgcctcaataatgatggggtggtggagatggtggtgggtttggtcctgaagctccatgcccactctctccagctctctcctctccctgtccaaatccaccaccagcttctttctttccattttgcttctccctttctcttttcctgttctagttggggagcagcagcagcagcaggagcagtagtagtaggttgttggttttgtacctttgggctctttgcctttgctttcttgctggggattgggaggcctgccttgaagctgaatcccaatcttcccctgcccacatctgcttcccagcatcctgcaactttggttataaggtggttggtttttgttcttgatttgcttcatcgattgggaggtttcttgctgttcttgggttttgtgctgtgaattggattgggaggttttttgttgccatgagggcggcggaggagaggaagggtgtggtgccggcggcgaggaggagggaccagttccccgtcggtatgcgtgtcctcgccgtcgacgacgacccggtgtgtctcaaggtgctcgagaccctgctgctgcgctgccagtatcatgtgacgacaacaaatcaggctgctatcgcgctgaaaatgctgcgggaaaacagggacatgtttgatctagttatcagcgacgtccatatgccagacatggacggctttaagcttcttgagcttgtggggcttgaaatggacctccctgtcatcatgttatctgtgaatggagagaccaaaactgtattgaaggggataacccatggtgcctgcgactatctcctaaaacctgttcgaatcgaagagctcaggaatatctggcagcatgttatcaggaggaaattcagtactcgcgaccgtgctaatctcgatttctatgaagagtgcaacaagccaccaaatgcggattcagaccatgtgcatggccatgttacatgtggatcacctgatcaaagtgggaggcccagcaagaagaggaaggagtactgtagtgaagaggaggatgagggtgaggtcaatactcaagatattgatgatccctcggctccaaagaagccgagagttgtttggtcagttgaactacaccggaaatttgtcgctgctgtcaaccagcttggaattgacaaggctgtgccaaaaaggatacttgagctcatgaatgttgagaaactcacaagggaaaatgttgcaagtcacctacagaagtacaggctctatctcaaacggctaagcgctgtggcgtcgcaacaagttagcatcgttgctgctttgggaggtagagacccctttctgcacatgggtggatttgaaggactacagggttatcaagcttttacctcttccgcagctctatcatcttttactccacatggattgttaaacagtcctagaaacaatccagcagctcttggaactcagggggtacctgcttcaaaatcgattcagactatgagcggaagccatacattgagccattccattaatgatgcaaataagtaccaccttagcttaccaggaaaccagaaaggaaacttgggacaaggtttggcaacatcgcttgggcagacccaaatgcaacagaagtggatccatgaagaaaccgatgatctgtccaccatcctttctgggaatggcctatctaatggtatgtctggcacactccaaagtgtcacaagcagtcctttgctgcctcaagaactagccgagtgcacacaagccaaaattgtcagtcagccatcaattcgaacttcctctgtaagttcagaacatattgaaggcgccgttggagtttcatctggtctgcttgaatctcgtgtatcccagcagagtactattcctttatcaggattttccgccaacgggttgctaatccatggttcgtttaacaatacctgtgcaaacaaattgggtggtacatcttcatcgtgtgcacctgctcgctcttcaaatgaccttatggtagcaagagacacaaaaggtggagctagctcttttggtggcgcgatgcttttacctccagatacagagcaaaagtacttgaattttggaggtggaaacggtttgaaacagaagttcgatgataggactgcagacagtctgtttgatctcaagttcgtatggagttctgtaccgagctctcaattggcaagcaacattggggctcatcatgctatgagccaaagatggaacaatagcagtagtaacagtaccaatattggtgccagaatgattgggcaagcaacctcaagtggttcaacagttatcccacaaatgaagacagatttcctcgtttcgggagatatggcgatgccgaagaacgcctccgatttgagcatcccgaaacttcagagcgaacttagctctagcagctgcagcttcgacggccttctcaattccatagtcaaagtggagaaggatgatgttaccttcagcgacgcactggggtggtgcgacttctactcccttggagcttgcatatgacagatctctcgtctgcatctgtgtacatgtccccccattgtatgctgtgtactagctagcagtgttagtttgtgatgtaatctagtttaggcctgtgtatttaagtaaaaatatgtattgtagtagtaatttggaggacgagatgggttgtcaactcgacctaaaaaaaaagacattgactggcttgtataaacctgagcttactgctt

SEQ ID NO: 5937 - DNA, 762 bp, Oryza sativa
  Predicted polypeptide sequence is orthologous to G1037
atggcttcaagtggagacacaaatacagtgatgaaatatgttgcaaatggcgcttttgatttcctgctaaaacctgtgaggatcgaagagctgagcaacatttggcagcacatattccgaaagcaaatgcaagatcacaagaacaataacatggttggaaatctcgaaaaacccggtcatcctccatcaatattagccatggctcgtgctactccggctaccacgagatcaacggccaccgaagcttcgctagcgcctctagaaaatgaggtgagagatgacatggtcaactacaatggcgagatcacggacatacgagacctcggaaagtccaggctgacctggaccacgcagttgcaccgtcagttcattgcagcagtgaaccacctcggagaagacaaggcagttccaaagaagatactagggataatgaaggtcaaacatttgacaagagagcaagttgccagtcatctgcagaaatacaggatgcaactgaagaaatcgattccaacaacaagcaaacacggagcgactttgtcatccaccgctctcgacaaaacacaagaccacccttcaagatcgcagtatttcaatcaagacggatgcaaggaaatcatggactactctttaccgagagatgacctctcaagtggctcagagtgcatgcttgaagaactgaacgattactcatccgaaggtttccaagatttccgatgggattcagacaaacaggaatatggaccatgtttttggaatttctag

SEQ ID NO: 5938 - DNA, 759 bp, Oryza sativa
  Predicted polypeptide sequence is orthologous to G1037
atggctcaaagggtaggacactctgctgatggggtttttgtcatgatcgttgatgaagataagtcacatgccaacttcgcaagaggcatgctctccagcctcaattttcatgtgatagtgtactcaagtcctgtgaatgcactcgtttttctggagaataacgcacaagacgtcgctgtagtcttggcagcagtggacatgaaacaattgagtggttttcagttcctcgaagctgcaagagtgaaacgccaggaccttcaagttatcatgatgtcagctgagacaacaatgtccacaatgatgaggtgtgttaaactcggtgcacgttttctagtgaagaagcctcttaacgaagaaactgtaggtaatctgtggcagcatgttgacctgaaagttttgaagatggagaagatcagggaattactgcaagatgaaaataatgaagaggaggaagtgaattcctttgaagctaagaaggctgattcagttaaagttcaatcagatgagaagggacatgacaatgctaaaatctctaacactgctgctgctgaagggtctgatgaaaaagtctctagtggtgatggtcatgtagtgcctaaagcgtataataatgtgaatgttgaagagagcataggtagtaacaatacttcaggtgaacaagtctccgacaagatcaagagtgatgcaagagttggggtgatccttgtggactacccagattttgaggatgatgagaccaagaaacccacaagcacttag

SEQ ID NO: 5939 - DNA, 3142 bp, Oryza sativa
  Predicted polypeptide sequence is orthologous to G1037
gtgcggggtagtacatactacagactacagagggatggcgtttcgtctgtagcgatcggttggagcttgtggatgaaatgggccccaatttctgttgccctccaccatttttgaccccttaaaattcagacagatggacagtctacttacattctctccctcatcttcttctcccttgagatgttcttgctgttcttgctccaatctcctcttgttttcttgctgggagttgtggtggctgctgctgctgagctaggagtagttcacatgtgtgtgagctgaagctgaggttggttgcttgcttgcttggccatctggaacagtcagtgtctctgcttttttcctcccatttttttagtttatttttttggctgcagagagagagagagagagagagagaactctgctttcttctccaactccctcccttttgctttcccacctctttgcctcaataatgatggggtggtggagatggtggtgggtttggtcctgaagctccatgcccactctctccagctctctcctctccctgtccaaatccaccaccagcttctttctttccattttgcttctccctttctcttttcctgttctagttggggagcagcagcagcagcaggagcagtagtagtaggttgttggttttgtacctttgggctctttgcctttgctttcttgctggggattgggaggcctgccttgaagctgaatcccaatcttcccctgcccacatctgcttcccagcatcctgcaactttggttataaggtggttggtttttgttcttgatttgcttcatcgattgggaggtttcttgctgttcttgggttttgtgctgtgaattggattgggaggttttttgttgccatgagggcggcggaggagaggaagggtgtggtgccggcggcgaggaggagggaccagttccccgtcggtatgcgtgtcctcgccgtcgacgacgacccggtgtgtctcaaggtgctcgagaccctgctgctgcgctgccagtatcatgtgacgacaacaaatcaggctgctatcgcgctgaaaatgctgcgggaaaacagggacatgtttgatctagttatcagcgacgtccatatgccagacatggacggctttaagcttcttgagcttgtggggcttgaaatggacctccctgtcatcatgttatctgtgaatggagagaccaaaactgtattgaaggggataacccatggtgcctgcgactatctcctaaaacctgttcgaatcgaagagctcaggaatatctggcagcatgttatcaggaggaaattcagtactcgcgaccgtgctaatctcgatttctatgaagagtgcaacaagccaccaaatgcggattcagaccatgtgcatggccatgttacatgtggatcacctgatcaaagtgggaggcccagcaagaagaggaaggagtactgtagtgaagaggaggatgagggtgaggtcaatactcaagatattgatgatccctcggctccaaagaagccgagagttgtttggtcagttgaactacaccggaaatttgtcgctgctgtcaaccagcttggaattgacaaggctgtgccaaaaaggatacttgagctcatgaatgttgagaaactcacaagggaaaatgttgcaagtcacctacagaagtacaggctctatctcaaacggctaagcgctgtggcgtcgcaacaagttagcatcgttgctgctttgggaggtagagacccctttctgcacatgggtggatttgaaggactacagggttatcaagcttttacctcttccgcagctctatcatcttttactccacatggattgttaaacagtcctagaaacaatccagcagctcttggaactcagggggtacctgcttcaaaatcgattcagactatgagcggaagccatacattgagccattccattaatgatgcaaataagtaccaccttagcttaccaggaaaccagaaaggaaacttgggacaaggtttggcaacatcgcttgggcagacccaaatgcaacagaagtggatccatgaagaaaccgatgatctgtccaccatcctttctgggaatggcctatctaatggtatgtctggcacactccaaagtgtcacaagcagtcctttgctgcctcaagaactagccgagtgcacacaagccaaaattgtcagtcagccatcaattcgaacttcctctgtaagttcagaacatattgaaggcgccgttggagtttcatctggtctgcttgaatctcgtgtatcccagcagagtactattcctttatcaggattttccgccaacgggttgctaatccatggttcgtttaacaatacctgtgcaaacaaattgggtggtacatcttcatcgtgtgcacctgctcgctcttcaaatgaccttatggtagcaagagacacaaaaggtggagctagctcttttggtggcgcgatgcttttacctccagatacagagcaaaagtacttgaattttggaggtggaaacggtttgaaacagaagttcgatgataggactgcagacagtctgtttgatctcaagttcgtatggagttctgtaccgagctctcaattggcaagcaacattggggctcatcatgctatgagccaaagatggaacaatagcagtagtaacagtagcaatattggtgccagaatgattgggcaagcaacctcaagtggttcaacagttatcccacaaatgaagacagatttcctcgtttcgggagatatggcgatgccgaagaacgcctccgatttgagcatcccgaaacttcagagcgaacttagctctagcagctgcagcttcgacggccttctcaattccatagtcaaagtggagaaggatgatgttaccttcagcgacgacctggggtgcggcgatttctactcccttggagcttgcatatgacagatctctcgtctgcatctgtgtacatgtccccccattgtatgctgtgtactagctagcagtgttagtttgtgatgtaatctagtctaggcctgtgtatctatgtcaatatatgtattgtagtagtaatctggaggacgagatgggttgccaactcgacctagaaagagagacattgatggcttgtataaacctgagcttactgt

SEQ ID NO: 5940 - DNA, 1283 bp, Oryza sativa
  Predicted polypeptide sequence is orthologous to G1038
ggacttgatgaatgttcctggcttaacaagagaaaacgttgctagccatctacagaaatatcgcctctacctgagtaggttgcaaaagcagaatgaggaaaggatattaggcgctgctaggcaagatttcagtcacaagggaacatcagaaaaccttaacctccgaagttccttccaagagcaaccaagcaacatagcaaatggatatccgcatgcttctcagaatatacaaactcaggccaacatgctagattctcagctagaggacaccaagagcacagtgcccttgcctgtgccagataaaaaaagaactctagcaagtgatgctgctgactcacagaatgtcaccagtgcttcaagtttaggtggggttctgtctttcaaaagcatgccggtgaatcaggacaggaagccatcagaaacaatgatcttggaatgccaggcctggaccggaggcattccatcgaagcagttcatgcagtatccaaagcataaccatgaacgctgtgacctattaggggattattcatgcctgccaaagccagacttagaacacccagttggccctagtaatctgtatgctccaccacctcttatctcaatgagttgcggtatggagggggatgccagagacttctcagacgtgaagccagctattatggactgcatcaagtccttatcaccggcgttgacatgtacagtggattcagtttctgttcaacttagcgacagtgtggtgacctcgattgacggtgacctgaagtcttccggtgtggacgggttgcccagcattaaagattgttgccttgatcagacgaacagccaaggaagtttgcgtccttcgcaagagccaagtatcataggcagcacagagttggcttctctgcctgaggacttacccagttatccacttcacggtgtctccctcgagaatataggactgagtagcattgacttactaaactacagtgacgcaatgatactatccggactacaaagtaactggtatgatgatctagagtttagcagcgaaatgatggactatccatcgatagatgaatgtctctttgcatcatcctgagctgccgcccttctttcgacaatgctattttgcgaggaaggatgatgttctttggtatgttcccatatagctcctcttgtagggctatagtcagctaacttgatcctacggtggaaggatttaattgtagtatctccacttttgataaatgtctgtattatagactgtgccatggtataagctatataccttttgaatgatc

SEQ ID NO: 5941 - DNA, 1483 bp, Oryza sativa
  Predicted polypeptide sequence is orthologous to G1043
attttgcacggtatatatcccagtctgtgtgtgagtgtgtgtggtctgtggagtgtatggttgatttggttggtaattggctaagctagctatagcatggcgttctcgtcggagggcggcgtgccggcggagagggtggcggcggcggtgaacgacctggtggaggtgcgcgacggattggtgaggctgaggggcttcttgccgccgccgccgcaggccgagcaatcgtcgtcgcggccgccgtgcgcggcggagctgatggacgcgacgatgagcaagctgatgagcgcgatggccacgttgggcggcagcggcgacatcgccggggaggtggacgctcctctaacaagagagtcgccgcaacactagaagacggtcacgtgtggcggaaatatgggcagaaagatatccaaaactcaccttatccaaggagctactacaggtgcacgcacaagctagaccaaggctgcggtgccaggaggcaaacccagcgctgcgaggccgacccgtcgaattacgacatcacctactacggcgagcacacctgcagggacccttccacgattatcccgacggccatcgccaacgccgccggcgcggcgagcgacgggccaaacaacaacatcatcagcttcgccacaggcggcgtcgttgttgctaattcgtctcggctggcgagggaagggacgacggcgacgacgacgagcgcggccacgcagctgtcctcctcgtggggcacgagcggcggtggcggcggcggcgacgacgtgttcagctcgtcgggggagcggttcatgcagtgggacgagctcgcggcggccgtcgggcacgtgagctcggtgggggtgacgtcgtcgacggtgggctccgcgccggcggcggagaacgacggcggaaacggtgacacggctgcgggaggaggaggagacggcggcggcgcgggcagcttcccgtcgtctccgagcgccggcagcctcggttttgtggtcggcccgctcgggagcatcgaggacgtcgatgacttcttcccgttcgatccctgagatgagatcggcgccgtcgattgaaccagcagtttgcagcggacggatttacacaacgttcgtagtatactaccagtacatagtagcaaacgcatcaaggctttagtattaagttgcataatggcatctctgtggaaatcaaataagcaaatatagaaccatctagtacattaagtaggttgcttatctacagactagactacagtgactcacacagcttctagctgtgcaagttggttaaggtgatgttttagattgaaatccaagccacgcatgttgatgagccggaattgggctcactaaaatgtggcttaagtttttgtttttttgtttggattgcttgttggcggcccaatggtaaacggtcactcttttcttctcagtttgcaagcctagcccactataccgacaaggaaaaacccatgtaatctgctaggctc

SEQ ID NO: 5942 - DNA, 1453 bp, Oryza sativa
  Predicted polypeptide sequence is orthologous to G1043
gggtgctttgagctccatcaccagctgagctgcgaggaagagagagtgcgagagtgcgcggcagcggcagtgtagtgtcagtcactgggtgtgcgcttgcttgcttggattgaggatgacgtcatcgatgtcgccggcgccggcgccggcgtacgcgcaggtgatggaggacatggagaaggggaaggagctggcggcgcagctgcaggggctcctccgcgactcgccggaggccggccgcttcgtcgaccagattctccacaccttctcccgggcgatgcgggcgctcgacaaggcggcggtctccgccgccggaggagaagggtcggaggtgcagagcgaggtcacctgcgggggcggggccagcgccggcgggaagaggaaagcccccgccgccgaccggaaggccaactgccgcaggaggacgcagcaatcgtccgggaattcggtggtcgtcaagaacctcgacgacggccaggcatggcgcaagtacgggcagaaggagatccaaaactccaagcacccaaaggcctacttccggtgcacgcacaagtacgaccagctgtgcacggcgcagcggcaggtgcagcgctgcgacgacgacccggcgagctacagggtcacctacatcggcgagcacacctgccgggacccggccaccgcccccatcatcgcggcgcacgtcatccaccaggtcgccgccggcgacaacgacgacggctgcggcggcctccaagcggggtcccgcctcatcagcttcgtcgccgcgccggcggcgccagtagacgctgccgcggcgccgacgaccagcacgatcaccacggtcaccgcgccgggcccgctgctgcagccgctcaaggtggagggcggcgtcggctcgtccgaccaggaggaggtgctgagcagcctcacgcccggcagctccgcggcgcgcggcggcggcggcggcggcggagtcgcgggtcccttcgggccggaccagggcgatgtcacgtcctccctgcactggagctacgacgccgtcgccggcatggagttcttcaagaacgacgaggttgtcttcgatctggacgacattatgggtttgagcttttgatcaccgaagaatcatggatggacacgggccgggtaaaacgatcgaaagaagatggattccacgcgtgtgtacagaaataattagcggcagcgcggatcttaatttggaacttgcaaagatactcctaattagcctggctagattagtttgtaaattccttgttgatgtgtcgtctcagctttaagctgcagacatgctagcaagtaacaacacgattagtacgtagtaatgtggttcttgattatgagctgggggtcttaaccttttttgtgtgacaagcaagagaagaggatttgggtacaatgtaatcctgttcttccgctttcgaaaaaaaaaaacatatagcttcacgtgcct

SEQ ID NO: 5943 - DNA, 540 bp, Oryza sativa
  Predicted polypeptide sequence is orthologous to G1043
gagctactacagatgcacctacaggcaggaagagaagtgcaaggctacaaagacggtgcagcagcgagaagacctgcaccacgccaacagctacaatggcgatcaccccatcatgtacacggttgtctactacggccagcatacctgctgcaagggccctgcggcattagctgatgatcatgtcgtcgtcgaagcatcacagattagcaccgacagccattgccagagtccgagcagcagcagcgatctgcaggctgcggaagtacacgccggtaacagcagccagtgcagcaacatctccgtcacatgttcaccatcagtcgtcgttgaggattgcaataagcttcttgacatgatgccagctgctgatgaactgaccgctgatgtcttgttgttcgacatgactgcatatgcacctttagatttggatatcaactgggaaatggatacaatgctctgtgggtttgaaaaggttttgtaattaaactgatctatctgtaacacgtcaacaaccgagttaaattatctatacccttttgc

SEQ ID NO: 5944 - DNA, 269 bp, Oryza sativa
  misc_feature (246)..(246): n is a, c, g, or t
  Predicted polypeptide sequence is orthologous to G1048
gagcagccggagggatgctctgtcatgtgatcgaacagctgccgtacgtgcctcggaaatcggaataattaaacgcgttaattacttatgtctggtagtggtatttttttcttaattaaatcatgtaattttattaattgtctatattactacacatgtaatttgttgtgtgtatacagtatatacatgtatgtaatttgttgtctatatatttgacatgtatatatattttgctcaacgcagttnccagctaaaaaaaaaaaaaaaaa

SEQ ID NO: 5945 - DNA, 1128 bp, Oryza sativa
  Predicted polypeptide sequence is orthologous to G1048
gagagacaaaaatatctccatcgcgatctccatggatgtagagttcttcgccgacctcgacctcgacgcgctcctcgcctccttctcctcctccgccgccgccgccggctccggcgtctcgggcctcttcgccccgtcaccgccgcacgatgcggaggcggggtcgccggagtcggtgagctcccggcggcccagcccttcccgggaggcggcgctgtcggaggtcgagaggttcctgatggaggagggccccgcggcggaggagggggtcggcgcggaggatttcttcgacgcgctgctcgtcgacggcggggaggaggaggaggaagaagaggggaaggggagtgaggcggggggaagcacggatggggattccgggaaggagaatgaggtggctaccccggacgcggagaaggaggatgtggaggcggaggtggatggcgatgatcccatgagcaagaagaagaggaggcagatgagaaatagggattctgccatgaaatcgagggagaggaagaagatgtatgttaaggacctagagactaagagcaagtatctagaggccgagtgtcgtcgcctcagctacgcgcttcagtgctgcgcagctgagaacatggcgctgcgccagagcttgttgaaggataggcctgtcggtgccgccacagccatgcaggagtctgccgtactcacggaaaccctgccgctggtttccctgctttggctcgtgagcatcgtgtgcctactcccggtgcccggtctacccaaccgaaacccggtggctcgaagcagcgccggaagagatctcgcgacggtaaccggaaagaagacaagcagtgaacaacagctagaagaaacattactactccatgggaggcgttggaagggctcgagggcgaggatcaagctagataccggaccgttccgtttagcagcagctgcttgctaggctgccgcttccttgcaaagttgtttccagtctgtattgtagctagcaaatcaaattggcgtgtctatcgcctgtcgtgctgccgcttatccatggactatctttttccttttttggttccctccccccttgtttttataatatcctcctatgcataatgcattatccaggtagttttgaag

SEQ ID NO: 5946 - DNA, 885 bp, Oryza sativa
  misc_feature (697)..(697): n is a, c, g, or t
  misc_feature (720)..(720): n is a, c, g, or t
  misc_feature (724)..(724): n is a, c, g, or t
  misc_feature (775)..(775): n is a, c, g, or t
  misc_feature (780)..(780): n is a, c, g, or t
  misc_feature (812)..(812): n is a, c, g, or t
  misc_feature (880)..(880): n is a, c, g, or t
  misc_feature (884)..(884): n is a, c, g, or t
  Predicted polypeptide sequence is orthologous to G1049
ggattcattcagagcacccaactccttgaaactaaaatccaccgcctctttcctcctccacattgcaaaccttccaaaatccccctccctatcaaacatgcagcatgatgccatatccaacattgcataccatcctagcatggatttcacaagctttttcctgccgcaaaccgacgcttactcgcatgatctcagtgcattgctggacatggctgtggttgatccatacatcagctgcaatggcagcagcatcaccatgattccagtgactgaagatgaagcaaatgctcagccgatgaaccatggcaatgacgagaggaagaagagaaggctggtgtcaaaccgtgagtctgcaaggaggtcccgggtgaggaagcagaggcgcctggatgagctctcatctcaggtttcagagcttcgagacaccaaccagaggcttcttgttgagctgaatcacatgatctccaagcatgctcgcattgtcagggagaattcccagctcagagaagaagcttctgacctgcagagaaagctcagtgagatggaaatggaagatgctgaagtggccgctgctgctgctgcagcaccacgaacattagaagtagcttaattaattatttaagctagttctaatgttcactaattaattgcagcatatcatggctagtagccttgggagtgttgcatactgcatagntgtactactaattaattataggngaanattctttttatattatttttatttttccctttgggcaaagagagcatatangtagntcgagactactacctttggattttggactaanatcgattgaattgagaatggctgaattctctttaaaaaaaaaaaaaaaaaggaaaaaaagcggcgccnccgng

SEQ ID NO: 5947 - DNA, 912 bp, Oryza sativa
  Predicted polypeptide sequence is orthologous to G1049
cgcatcgtgttggtaccgggaattcggccattatggccggggagagcaatcttcagtaagcagaatcaagcagattaccctcatctacttctggccctctaagagttctccactaagcaagcgaaaacagccatgctgcaccaccattaccatggcgaggtggccagcctgcactgcctctcacctccaagcctaccattcagttcccactaccacagcaacatgatcaccatggcaccctcgcccttccacttcccagcagctacctgtgaacctatccaggaattgctccctgtggtagcgggcaatcgaccagccggctctggcagcacagatgacgcctaccagatggcagcggaggaggagcggaggcggcggaggatgatctccaaccgggagtcggcacggcggtcgcgcatgcgcaagcagcggcagctcagcgagctgacggggcaggttgtccacctccgtgacgccaaccgacgactccttgatgagctcaaccaagcactgaggggctgcagtgatgtccactgcgagaacgcccggctcaggaaggagagggccgagctccagaacaagctcgagcacctcatgcaagcacgcaaacacacaaacacaccgaccccaaccaacatgtcggccgcctcggcaccgccgactctaaaaacgagcacagataagcatgcggcccaaatcgagcaaactggaaaaacgccataaatacgcgaatacaatcacggcccagataacacgtccgactggaaacctgcgttacacataacagctgaaagatccccttagcaagtggataaacaaagccgcagggccgtcaaatggcccgatggacggactgcagcaaaggaacacacataggcgaagcttacgagcacacaccctacaacaccgcgg

SEQ ID NO: 5948 - DNA, 713 bp, Oryza sativa
  Predicted polypeptide sequence is orthologous to G1050
ttttttttttttttttttttaaatccccaaaatgaactgatgattctaattaaaacatcggtacagattcaggcaaatttgatattacagaagcccacatgggtgtcagttcacccaaacttttagcaaaataactgtagcacaacactcagtaataggtgaattatctattggttcggctgtctaagcgaattcatgtttgaatctgcagtatagtttgacattcccctttcaaaagtttcctctcatcagaaatcaccctaaagcttcaaactttgttatggctgatatccctggatttgtgatggtccagcctgtgtttctggctccagcagttcgatcaaccgagcgaccgtttcttcgtgtgtaccatttggcatgacgaactcaccatcaacaacaacttgaagtgactcataacctattgatttgaatatagcttctttcatctggcgttccctacccgtttcttgtatcttgattttcagctcattgttttgagctaaaagctcattaaatgttctctgagccgtcgccaatttttcagacaacttctcaatctctatcttcaacaccagcaccttactttcaagctcaagcttatagttcaacctgcgctccttggacctcgcagcagatctcctattgcatagaaccctcttgaccttcttcggatcactcaacacgagctgcgagaggtactcactcgccat

SEQ ID NO: 5949 - DNA, 709 bp, Oryza sativa
  Predicted polypeptide sequence is orthologous to G1050
gggtgcagatcggacggcgatgacttcgccttgtacgacctcgtcaactcctacatggacctcgacgggatggaggctctcaactcctccgaggagcggcacgaggaccgcgacagccgcgccagcggcacgcgcaccgggagcgtggccgacagcagcgagaacgaggccgagagccactcgactccagtggagaggaaggacggaggaggcaaatcccggcattgccgcagcttatcggtggacagcttcatcgagaagctcaacttcgacgagtcaccgaagctgccactgccgtctcccagcggtggcctatccagaagcgggagcgggtccttggatggcggcgctgcatctctgtttggtgctgagtttgccaatggggagttcactgaagctgagaagaagaagatcatggcaaatgagcgccttgccgagatcgctttgactgatcctaagagggttaaaagaattttggcaaatcggcagtctgcggcaaggtcaaaggagcgtaagatgaggtacattcaagagcttgagcacaaggttcaggtgttgcagacagaggctaccacactctcagcacagttgacaatgctgcagagggactccactggactagccactcagaacaatgagttgaaaatcaggctgcaagccatggagcaacaagcacagctaagagatgccctgaatgaagcattaactg

SEQ ID NO: 5950 - DNA, 1505 bp, Oryza sativa
  Predicted polypeptide sequence is orthologous to G1050
gcgtcgatcgtgctcgtccgtgcgcgcagcaaaacgccaccaccaccaccaccgcatccccaacacctcacctcacctccttacaccataggcgtgcgtgcgtgatgaacaccacgtccgcgaacgagctgatgatgcaccgccacgtccaggccgcgccctacgcggcggcgccgcagcagcaaggaggcaagcagcgtgcgccggggctgccaccgacgcctccacctccacctgcggcggcgagctcccactcctctcacggcgacgtgtgcatggacgacacggcgcgcggcgggctgctgccgccgcgcaaggcgcaccggaggtcacgcagcgacgtgccgttcgggtacttccagccgctgccaccgccgtcgcccaagatggaggccggcggcggctgggcactccccgggtgcggcggcgccggcgacgtcgacctgctcaatgcgtacatgagcttggagggaatgggcggcgccgacgggctgaacaactccgacggggacagccgcgggagcagcatgcggacgaacggcgccgacagcagcgagaacgagtccgaggactacgtcggcgccgacagccaggccctcctctggggcggcgccggcggcggcgaggctgcgggcaagaagagacggaataacgctgccggcgagaaggcggcccggcacgcgaggagcctttccatggacagcctcatggggaagctcagcttcgccgccaatggtgagccggccaagttcagcctggagttcggcagcggcgagttcacccccgccgagatgaagcggaacatggccgacgagaagctcgccgagatggcactcgccgacccaaagcgcgtaaagagggtgctcgccaataggcagtcggcggcgaggtccaaggagcggcggatgcggtacattgcagagctggagcagaaagtgcagatcctgcagacggaggccacaaccctctccgctcagctgactcttttgcagcgcgactcgtcgggaatggccacgcagaacaacgagctcaagttcaggctgcagtccatggagcagcaggcgcagctacgcgatgcattgaacgaggcactgacagctgaggtgcagcgcctgaaactcgcggcgaatgaggtctgcgacacgagctcgtccagcaacctagcacaccaaatccagctccgccgtcagaaccagatgcttgatctgcacaagcagcagcagcagcaggttgagcagataccattctatcaactggaactgccagagcagcagaatggcgcggcgaggaatcacgagtccaaatgattgttcgcggggactgcgtctaggtgctcatcagggccatacagaaaaaatgtcactagtagaaatttagacgatctgaagaaattccttttcctaacccatttgttttcagcattgatgtctccgtaaatttgcttgtgtaacttgtatgtccgggcaaacacccagtaatattctgaatgttcttcgttctttcac

SEQ ID NO: 5951 - DNA, 1281 bp, Oryza sativa
  Predicted polypeptide sequence is orthologous to G1050
atgaacggtggcattggcgacgcgctgatgcagccgcagcacgtgcaggtcatgtcgtcgtcgttgccgatggtggcgtcgacgttcgtggcggagccggcggcggcggccaacaagccgagggccgcggggctgccgcccacgccgccgcaggtgttcgccgcccagcgcgcggcggcggcggcgggcggcgacgtgtgcatggaggagtcggcgcaggggggtggtggcgggctgccgccgcgcaaggcgcaccgccgctccagcagcgacgtgccgttcgggtacctggccgggcagcaccagctcctgccgcccaaggtggaggccgggtggggccacctcggcgccggcgccggcggcgcggcggccgccgatgacctgttcaacgcgtacctgaacctggaggggctggacgggctcaactcctccgacgaccgccacgacgaaggggacagccgcgggagcagcatcaagaccaacggcgccgacagcagcgagaacgagtcggaggagtgcgccgacgacacccgcggcgggatccgcctctggtccgccgacggcggcgagaggagggagggcgtcaagaggaacgccgcgggggagccggccaccgcgccgctggcccgtcacgccaggagcctctccatggacagcctcatcgggaagttcaacttcacggcggggacggcggcggctgcggggaacggtgtcgcgttggggccgaacaggttcagcctggaattcggcagcggcgagttcaccccctccgagatgaagaagatcatggccgacgagaagctggccgagatggcgctcgccgacccaaagcgcgtcaagagggtgctggcgaacaggcagtcggcggcgaggtccaaggagaggaagatgaggtacattgcggagctggagcagaaggtgcagatcctgcagtcggaggcgaccaatctgtccgcgcagctcacgatgatgcagcgcgactcggcggggctcgcgacgcagaacaacgagctcaagttcaggctgcatgccatggagcagcaggcgcagctgcgcgacgcgctgaatgaggccctgacaaccgaagtccaacgcctaaaactcgccaccgctgagctcggcgattcttgctcgtccagcagtctagctcagcagatccaactcaatgctcagaatcagatgtttcaactgcagcagcagcaggctacgcagataccattctatcaactgcagcagtcacaacagaacggtgcagcgaagaacaatgaatcaaaagaatga

SEQ ID NO: 5952 - DNA, 634 bp, Oryza sativa
  Predicted polypeptide sequence is orthologous to G1050
tgcaggaattcggcacgaggattttcgccatctcctccgcctcgtggtcggcgctccacactctaccctcgccgaagccttctagaagatccgccgccatggacgaccccggtgcggccgatccgggggcgcgcccccaccacgtgtcgccggggcagccgccggtggtgccgcgctccccgaccccgctcgacctgtcgagcgccgcggcggcggcggccgcggcgtcgtacaggaggctctcgccgtcgctccgaccgcccgcgcacccgcaggcgcgtctcccttcgccgtacccccagatcccctcctcgtcgtcgtcggcggcggcgggctcgtcggggcaccacgcgcggtcgctctcgcagccgctcttcttctcgctcgactcgctcccgccgctgccgtacgccgatctggccgcgccgcccgccatcccgccctccccgccttcctcgagctccgacccgccgccgccagggctgccgccgcggaagggcgggcaccggcggtcgcagagcgatatccccttcgggttctcgcacctgagcccgcccctgccgcctcccgcgcccgtgaagcgggaggccgccacggcggcggaggggtgcagatcggacggcgatgacttcgc

SEQ ID NO: 5953 - DNA, 1111 bp, Oryza sativa
  Predicted polypeptide sequence is orthologous to G1051, G1052
gcgccgtccaacgcgcgcgccagagctaggtggttagcccaagctcgcgagatcgatcgctactataggctaaggacacgtacatggcgcagctcccgcccaagatcccggtggcggcgccggggcaccaccagcactgggcctcggccgggggcgccggcgacgcggcgtgggcggatgagttcgccgagttcgcggcgtcgcggcggggcgcgcaccgccggtcgctgagcgactccgtggcgttcgtcgaggtggcgccggcggggtgcggggcgggcggcgagttcgacaggctcgacgacgaccagctcatgtctatgttccccgacgagggcgggtcgtcggccccggggtccgacaacggcggcagcgacagcgacggcggcggcgacaagcacgccgcggcgcagagcgacgacgggcagcacgccgccggggagccgacgcaggagcaggcggcggccacctcgccgacggagctgatccgggaccccaagagggtcaagaggatactggctaatcggcagtcggcccagaggtcgcgagtgaggaagcttcaatacatctccgagctcgagcgcagcgtcacaaccctgcagaacgaggtatccgtgctgtcccctcgggtggcgtttctggatcagtagcggacgatcctgaccgtcggcaacagccacctcaagcagcggatcgcggctctagcacaggacaagattttcaaggatgctcatcaggaggcgttgaggaaggagatcgagaggctgaggcaggtataccagcagcagaacaccaagttgtccggtggtctggccgctgaccacgcacatgtccatggcggcccgccgcctgtgcgagcagagaaggagctcatgagctagctgatcaatttgcctactgtcccctgtgcagtctgccttagcattaactttggagggaacattgcatcatgaacctgtggatgttttcttcttcttcttctttttgtttttttattcttttacattgacttgtgtattcttgattcggatgttgattggagttctggtttacaatgggaattgtgggagatgtcaataagaaaatgtgaactgcaataagattaactgtg

SEQ ID NO: 5954 - DNA, 1484 bp, Oryza sativa
  Predicted polypeptide sequence is orthologous to G1051, G1052
gaggtttcgggcgtcgcgccatcgatcgcgggcgcgcatttgcgttgattccgggccaggctccctccccggccatggcgcagctgccgcccaagatcccagccatggcgacagcttggccggagttcgggggcgggcaccatcaccatgctgcccacggccaccatcaccagcgcagcccctccatgggggcgttcctcgcggcgccattgccgcccttcccgctcccgccgccggcgccggcgaacggcggggcgcagcagcagcagcagcagcagcagcatcagccgtcctgggtcgacgagttcctcgacttctcggcgaccaagcgcggcgcgcaccgtcgctctgtgagcgactccgtggccttcctcgaccccgtttccgacgacaatgccggcgtcggggcgcacgacttcgaccgcctcgacgacgaccagctcatgtccatgttctccgacgacctgcagccgcctccaccgcagcaacagcctgccgcgcccgcggcgagcgcgtcgtcgccgtcggaccacaacagcatgaatgacgagaagcaagacaagggcgagacagatgaggcgcagagcgagtgcgacggcgccacgcccgggcagccggcctcccccgccaccgtcgatcccaagcgcgtcaagaggatcttggcgaaccggcagtccgcgcagcggtcgcgcgtacggaagctgcagtacatctcggagctggagcgcagcgtcacgtcgctccagacggaggtgtcggcgttgtcaccgcgcgtcgcgttcctcgaccaccagcgctcgctgctgacgctgggcaacagccacctcaagcagcgcatcgccgccctcgcgcaggacaagatcttcaaagatggaggcactgaagaaggagatagagaggctgcggcaaatctaccaccagcaaagcctcaagaacgcggaatcccaaccggcggacgcggccccggtccgcggccgcgacaatgccgacctgatcggcagcgagggggccgccgcggccgcgccatgcccgcactcgtgatcggccgagatccggacgctctctagacctctagcgaggtggcgccggcccgtcgcgacaaccacgagcgttgccgcgggggtgggccggcgccgtgttaggattggtgcattgttaatttgggttttgcattctttggggtgtaatgtaacatgatttgttcattcgggttgcttttgttcattcttgtgcatcctctgctgctgctgctgctgctgctgctgctcctgattcttctctacttccctgatttgtaattttattccggcattttgggcgaaggttgtagctaagaattgtaattcagattgggtgaggtcaagtgttttgtttggctggtttttttttctctttttcttttttgtatctgataaaatcaaatgtaatgttccttcatttttcctgtatgatccactgtatgtatttacagctatccatcagtc

SEQ ID NO: 5955 - DNA, 1170 bp, Oryza sativa
  Predicted polypeptide sequence is orthologous to G1051, G1052
atggcgcagctcccgcccaagatcccggtggcggcgccggggcaccaccagcactgggcctcggccgggggcgccggcgacgcggcgtgggcggatgagttcgccgagttcgcggcgtcgcggcggggcgcgcaccgccggtcgctgagcgactccgtggcgttcgtcgaggtggcgccggcggggtgcggggcgggcggcgagttcgacaggctcgacgacgaccagctcatgtctatgttccccgacgagggcgggtcgtcggccccggggtccgacaacggcggcagcgacagcgacggcggcggcgacaagcacgccgcggcgcagagcgacgacgggcagcacgccgccggggagccgacgcaggagcaggcggcggccacctcgccgacggagctgatccgggaccccaagagggtcaagaggatactggctaatcggcagtcggcccagaggtcgcgagtgaggaagcttcagtacatctccgagctcgagcgcagcgtcacaaccctgcagctaggaaaccgaacaccctacctcaactctacaaactcacgtcagatcaaccgttcgtggctgtgcaatctgcattctgtgcgatgtagtaagcgacccgtcgatgagtttcacggacagaagtggcgccagtttgagaccgaccgatggacacagccacactggttggctggcaatagcacacaatgtggcgaggagatgagcgagagcgtgagcccccaccctcgtgcatatgcacgcctgcggatgtcttacttcacctcaccccccgtacggcaccaaccagcccacgtagacgtagtggcaatggcatgtcatgccatgatccagacgcacatggttctgcttctgcatggatggattggccagtgggcagtgaacgaggtatccgtgctgtcccctcgggtggcgtttctggatcagcagcggacgatcctgaccgtcggcaacagccacctcaagcagcggatcgcggctctagcacaggacaagattttcaaggatgaaaccaccggaggcgaaaaacctgcgcagcatatcgttatcgtggaacaccgttactgctccagtttcaaggacaagtcgcacagcgtgcaatacaacatctgcattattcagaatttgcagtatatggatctggatcagcgatga

SEQ ID NO: 5956 - DNA, 2373 bp, Oryza sativa
  Predicted polypeptide sequence is orthologous to G1051, G1052
atgaggcccaagcaaacggaagggagcagcatacaagcagtagcatcggcaacaccagggggcatcgaaagatcatttggacttggcggagctgaagctcccggcggcagcggtgacttgggcggccgcatggagttgataggagagtactgcagcaatgccccatgcaagtggttgttggatttgggcaagggtggtgctcatgacaccaacgcccacaacctgttcgatggaatgcctagccaatctgagatacccaaggaagatcagaggacatctaagcctgtccccatcaattctaccatgaacaaagaggagaaatggctagacaaagctctagatcggatattggagaagtttgaacaaatggaggccaagcgcatgcaagaggagaagatcaatcagatatttcaaaagttggaggacatagaggttcttaggagcaaggcttccgaggaaataattgaagccatcagggcaaccaccgctgttctcaaggctaagtcacctatagcacccatcgcaccacctactccagcgcctaccaagtgtttgacagaatgccccaacaacaactttacttgggcaacgacgagttcaagtcacattggtgaggatactgctccaacagctacctgggagctaggagacaacaaggacaagggccacgccccctgcatcgtcgccaaggactcacccgaggtcacgcccaccatgtgttcaacgaaatactccggtcctaccatcaagcccgatctcactatggctgtagtggttacgtccgccaccactgctatggcctctatggagttggtagctgctgggaatgcaatcggtgccactgacatcaacaatcttgaccaccccaaggtgacgcatgctaagtgttcgatgtctagctccggcgtcaaacggggcactgaacaagttgtgcttgcgtttccgcttatggctagccctatggagttcatgacatcattggtagaaccatctccacccacagggctgaagcttggtgatgccatttgcgtgggagatcaggtgcctatgaagtgttcgatgaaatgtactgagagtgacaataagccactgatggaacaccccaagagaaacccatggccacctgcctggtcaggatggaagaagtggtatatgacctggactacaatcaatcatcaaaggatgagattatatttcgtcccaccctggcctccaccaagtctagtaagttctttggcatgggtgcatttttgtattggagctcttatatttcaaagggtggttttatcaaatgaaatggttgagttggagccctggcctccaccacatgaagcaagtttcagaattttgcctttccaaactagtagcaggaaatgttgcaattatgtcactgctttgagtataattgcatgggatgagaagaggacaaggagtagtagaattattgacactagttttgaggaagggacacaggaatgttggaatccatatctagccttgccaatcctcagctattttaggaccagattgcaatggatgccaccttggctgccattagttggtttgctggaagctagagtagggaagggttgcactactgattttgctgcaagtataattccttggaatgagcaaaagaaaatgattactattgaaacttccacttgctttgagcagaaaatgcaccaaattcgggctttgattttccacgtcagtttgacatcacttgctagcaaggaaagcaatctagttatttgtgatcctgaatcattatctatttggttatcatatgttgatctctgggggatgttgctcaactactacccaactatagtggagaaatggaatatgagaataatttgcatggtgatatcagaatctgaatcatgtttggaatcaaattacattggtttgaatgttgaaagagatttgctatatatgattgctgaagaaaaaggttgcaaaagggtttcacgtaaacagaagtataccactgcggcattggcattaggggatgttaatcacgagattcggcggccattgatttcctacgttgcttgcatatggaaagcaaatacatgcttgcatggaaacctaggaaatcaaaaggcaaggcagctcaggatgaaaatttcttgccatgagcagtgcgcacacgcgggaggagcaaggtatgtcgagcgccacacttcgctataccgagccctccgcccctggttgtcggaccccagggccgacaacccgccctcgacgaacgccacagagtctctcaacgaacggcggtgcgcaccccgctacaacaccgcaaactcggcgaactcatccgcccatgccgcgtccccaacgccggccttcgacttcaacggcatctga

SEQ ID NO: 5957 - DNA, 810 bp, Oryza sativa
  Predicted polypeptide sequence is orthologous to G1051, G1052
atggcgcagttgccgccgagggcgccgagcgcggcggcggcggcggggcaggagtggtcggcgatggcggcggcgggggagtttcttgggttcgcggcggcgaggaggggggcgcacaggaggtcggcgagcgactcggcggcgttcctgatggaggcggcggtgccgatggacgacgtcatcgtcggcgtcggcggcggcggcgagttcgaccggctcgacgacgaacagctcatgtccatgttctccgacgtcgaggcgccggcggtgtccgacggcggcggcgagagggggccggccggggaggcgcacctcatggacatgggtgacggggacgacgggatgggggcgacctcgccggccggcgctggcgcaatggcggcggcggcggccgccgccgccgcggacggcattgccgaccccaagagagtcaagaggattttggcaaacaggcagtcggcgcagcggtcaagggtgagaaagttgcagtacatctctgagcttgagcgcagcgtcaccactctccagatggaggtgtcagcactgtcacctcgtgtggccttccttgatcatcagcggtcgctgctcaccgtcggcaacagccatctcaagcaaagaatcgccgccctcgcacaagacaagatcttcaaagatgctcaccaggaggctctgaagaaggagattgagcggctacgccaagtgtaccaccagcagcagatcaaggccaccggaggcgccgacatcgccacggcggcctcaatgcaggccaagcatgagctgctggcgtgcgagggagcggcgatgcgatag

SEQ ID NO: 5958 - DNA, 550 bp, Oryza sativa
  Predicted polypeptide sequence is orthologous to G1051, G1052
agatggaggtgtcagcactgtcacctcgtgtggccttccttgatcatcagcggtcgctgctcaccgtcggcaacagccatctcaagcaaagaatcgccgccctcgcacaagacaagatcttcaaagatgctcaccaggaggctctgaagaaggagattgagcggctacgccaagtgtaccaccagcagcagatcaaggccaccggaggcgccgacatcgccacggcggcctcaatgcaggccaagcatgagctgctggcgtgcgagggagcggcgatgcgatagcggaaggccaccggtgaccggtgaccgtcggccggtggggattttttttttttttttggcaatttgccatgtgtaagatgacacagcttggtcagtagttttgtgcagcttgttaaaaagttggttgattttgttgtttctttataatgttatgtttcgttttgctcatcctagcaaaaaaattgtgctgggatgggagaattgatgtggatgtattgtttggaccccaattacatttgtccagaaaaggtggttgctttcaaaaa

SEQ ID NO: 5959 - DNA, 1656 bp, Oryza sativa
  Predicted polypeptide sequence is orthologous to G1053
atccgatcacacacacaccatagccaaaaaaaacacaatcactcgaccaaaccacacctagctactacaaagctagtgatcataagctaaccttaattagctttaattagccaagaagagacaaagagcaagatcgatcatgtaccaccaccaccatggcggccatggcgaggtggcgagcctccacctcctctcgcctccaaaccctcccttcttcggcgccgccgcgcaccaccaccaccaccaccacggcctcatcaacatggcgctgccgcctcaggcctacttcgtccccgccgcgccgccgccgccgttccaagaagccactgctgcgctcgccgccggcgacgacgccaccgccgcgttggcggtgtttgagctggagcgcatcctggaagaagcggccgccgcgggcggcggcggcggcaatggctcaccgagctcgggctccgacgggtgctgctacggcctgcagggcgtggctccggcggcggaggaggagcggcggcggcggcggatggtgtcgaaccgggagtcggcgcggcggtcgcggatgcgcaagcagcggcagctcagcgagctgtgggcgcaggtcgagcacctccgcggcgccaaccgccgcctcctcgacgagctcaaccacgcattgaggggctgcgccgacgtccgccgcgagaactcccgcctccgggacgagaaggccgagctcgccggcaagctccagctgctgctcccgcggcagccggcgccggagaagaacgccgccgacgaccagagtagctgctcctcggagccatgcaagaacagcactacgactaccgctgctgaatgaattatattattcattattattattattatccaccaaattttcacttgagaggataataatattaacaataatatgtttatcaataagaaaacgtgtataactaaacaaggataattactggggatggaggcatgcatgcatgcatgcgccatgagatcgatttttctgtttcgaggaggtttttgctgtgtatttttacaactaattatatacttatacctgcggttaaattaacatggatcaatggatcatatatattatttctatttacaagttgcaaaactgcagttaatagaacactagtaagacaaaatgatggggtagaagaggcatgtacaactctaaaagtagtagactacttgtcaaaacgttgtgcaactatgaagttaaaaaaaatagtgcctttcatgtaatgatgtcacggggttcaactaacttgtaatggattatgctttgggattgctaatggatggcatactttcttgatgttaagttacccataataacccaactgctgctgctctgttctgtagttcattagctattttacctagttgtatcaaacaaggttctggatgtgtatcaaacaattttggtactcctatatgaatgttcccatcaagatctgaaccacatattcctattcattgagatgcttatcgaataggattccaaagaatcttaaggacgagcccggcaacatgtgccacgaaacaaatctaggcttttgtcaatacataaacgtgagtgttcatcaaaacaaacgagcaaattcaaaaacatagcatatatatatatatataagacaaaaaaaaaataaatat

SEQ ID NO: 5960 - DNA, 1961 bp, Oryza sativa
  Predicted polypeptide sequence is orthologous to G1062
gcacctctgcatctctgccatctccttccccaccccaccgccattgccgccgcggcgatgctgccgcggtttcacggcgccatgtggatgcaggacgacggcggcggcgaccaagaacacgggcaggcggcgccgcctgggcaggagcagcaccaccacgaccagcatctcatggcgttggcggccgcggccgcgggcggcgccgggttcggcgcggcgcaggcgccggcgccgctgctcgatgaggactggtacttcgacgcggcgggtggtggtggtggtggcgcgcatgggtccatgatgctgggtttgtcgtccgtccatggcgggattggggcggggacgtctggtggtgggcatgggcagcagttctcgctgctcaacatgggcgccgcggccgcgccgttcgacgtctccgggttcgacctcgggatcgcctgcggcggcgttggcggcggcggcgacgtggtgtcgtttcttggcggcgggaacgcgtcgaacaccgcgctgctccccgtcgggaacgcggggttcctcggcacgttcggcgggttcggcaccgcggcgtcccaaacgccggagttcggcgggctcgccgggttcgacatgttcgacgcgggcgccgtgaacaccgggggcagctcctcctcctcgtcggcggcggcggcggcggcgtccgcctcggcgcacgtgagcaacaccgcgccgttctccgggcgcggcaaggcggcggtgctgcggccgctggatatcgtcccgcccgtgggcgcgcagccgacgctgttccagaagcgcgcgctccgccgcaacgccggcgaggacgacgacgacaagaagcgcaaggccgccgcgggcgcgggcgcgggcgcgctgtccgccgacggcgccgacatggtgctcgacgacggcgacgacgacggcctcagcatcgacgcgtcgggcggcctcaactacgactccgaggacgccaggggcggcgaggacagcggcgccaagaaggagtcgaacgccaacagcacggtcaccggcgacgggaaggggaagaagaaggggatgccggccaagaacctcatggcggagcgccgccgccggaagaagctcaacgaccgcctctacatgctccgctccgtcgtgcccaagatcagcaagatggacagggcttccattctcggcgacgcgattgagtacctgaaggagctgctgcagaagatcaatgatcttcagaatgagctcgagtcgtcccccgcgacgtcgtcattgcctccaacacccacaagcttccatcccctgacaccgacgctgcccacattgccgtcccgcatcaaggaagagatctgcccaagtgcattgccaagccccactggacaacagccaagggttgaggttaggctgagggaaggccgggctgtcaatatccacatgttctgtgctcggaggcccggtctactgctctctgccatgagggccgtcgaaggccttggtctcgatgtccagcaagctgtaatcagttgcttcaatggctttacgttggatatttttaaggctgagcaatgcaaggacggccctgggctgttgcctgaagaaatcaaggccgttctgatgcaatccgccgggctccataccatgatctaggacaggagagctcaatcaaactccaaaggacagagtagctcaggaattgacaaagtaccggtgtttcctggtcatgtggcattttcgacagaaggaagttcctctttttagtagttttagacctgctcagggcttgctgaaccagtttatcttctagtatttagagtccccaaaaaaaataatgtcagtagtctcttggtgctttaacattgtgttttgaaaccttctgcctgttttttttacttcccggtacatgttttcgtcttgtgtaagtctgaagatgaattcctatcaattaacaggcaaagaaacaggatcattccaagaac

SEQ ID NO: 5961 - DNA, 1493 bp, Oryza sativa
  Predicted polypeptide sequence is orthologous to G1062
gggactcctcttctcttctcttctcttctcagagcgctgcgaggttgccatggacgaggcggaggcggcggcggcggcggcgaagatggacgagctggcgggaggaggaggaggaggcggcggcgactggtcgtacctcgcggcggacgcgctggcggcggcgtcgttcacggcgttcccgttccaccaccaccaccaccaccaccaccgcgacgtgctctcggcgtcgaccccgtcgtcgctgctcctcaacatggacgcggccaccgccgcggccatgttcgacttccaggcggccttcccgtcgtcctccgtcccgccgccgccgcccacgacgacggcggcgctcccgccgttccacgacttcgcctcctccaacccgttcgacgacgcgccgcccccgttcctcgcgccgccggggcagaagctcgggttcctggggccccccggcggcgcgttcggcggcgggatggggtgggacgacgacgacgagatcgagcagagcgtggacgcctcgtccatgggtgtctcggcctcgctggagaatgccgcgcccgtggcggccggaggaggcggcggcggtggcggcggcggtgggaggggcaagaagaaggggatgccggccaagaacctcatggcggagcggcggcgcaggaagaagctcaacgaccgcctctacatgctgcgctccgtggtgcccaagatcagcaagatggacagagcttctatccttggtgatgcaattgagtacttgaaggagctcctgcagaggattaacgatcttcacaatgaacttgagtctgctcctagctcttcgcttactggaccatcatcggctagcttccacccatcaacacccacattgcagacgtttcctggccgcgttaaggaggaactttgcccaacctcatttccaagccctagtggtcaacaagccacggtcgaagttaggatgagggaaggtcatgcagtcaatatccacatgttctgcgcacgcaggcccggcattctgatgtccacattgagggctctcgacagccttggcctcgggatcgagcaggcggtcatcagctgtttcaatgggtttgcaatggatgttttccgcgccgagcaatgcagggatggtcctggactcgggcctgaagaaattaagaccgtgctcctgcactctgctggccttcagaacgcaatgtaatcagcaagtcagaaagcagtcaagaccaatgcactgggatttgatcagtgatcatttgcatcagatgatctggtttatcaaaaagttatagtaagtatggcatatatgctgtttatctaggagaactgatgagatgaggctcgccatctagagacatgtgtgatgatgatgatgtaactgggtttctttctttctgttgtcgtttttttttctgaatgttgtttgtgatgtaataggatctttgtccattgaaaccatgtccattatcatgatgagaatatgaacccagtgtcttttg

SEQ ID NO: 5962 - DNA, 1263 bp, Oryza sativa
  Predicted polypeptide sequence is orthologous to G1063, G2143
gagcacataccattgcaagaaacccttcacatcttactgaaacagctactactcctgctagctagctcaagctcaagctcaatctcaagctctttccactaagctccgtgtgtctagctcatcaatacctggctagctagctagttgcttgatcgatatatatcctagctaagtgatggacttcgacttgttcaattcctacccggaatcgcagcttgacctgatgagcacgatgcttcagctggagcagctcactgcgctcagtgaccagtcgctgttcatggcggcgccgacgtcgccgccggtatcacccatggggaccccttctccccagttctcaccaccgccgcagatgtcggtcaccaccaccaccgccggtggcggttaccaggatcagtataactccatgccggcaacgtacggcgccggtgcgggcgtgcaccagctggacttcgcgatgtcgtcaccgggctccgactccggcgcgccgcagggctcgtcgtcgtcgtcctcgtcggaggcgatgcgggagatgatcttccacatcgcggcgctgcagccggtggagatcgacccggaggccgtgcggccgccgaagcggcgcaacgtgcgcatctccaaggacccgcagagcgtggcggcgcggctgcggcgggagcgcatcagcgagcgcatccgcatcctgcagcggctcgtcccgggcggcaccaagatggacaccgcctccatgctcgacgaggccatccactacgtcaagttcctcaagtcccaggtgcagtccctcgagcgcgccgccgccgccaccggcgccgccgcccaccgcgccgccgcattcggcgccgcctacccagctgccttacccatgcagcaccacgctccgtggtagctgcacgctactagctcccacatggatagatggtgatgagacaatcgtttcccattactatcgcgtctcacatgcttgtcgccgtcgtcgtcgtcgatcgatcaatcaccactgctgctgctgcagcatgcatgatcacatgcatgtgcaaattagtagtacaagatgtaggagactacctgattactagtaccatttattattgctgttgtacgttaccgcatgctagctcgtacgtacgtggctgctccgagcttttgttggactcgcagcccgtacgtgcatgcgcgtttcattcgaccgtaggcttgtactgtactgtacacatttccttctattctacccccctgttcaatgcagtacgtttcccgtacctc

SEQ ID NO: 5963 - DNA, 2228 bp, Oryza sativa
  Predicted polypeptide sequence is orthologous to G1064
gattcacccatctctctctcctcctcctccatgccctacaaactacaaagtacacttcctcttcctcctccaccctctccctctcccactccagtggctggcctggctacctagccacctagggtcatctgctcctactctctagctctctctctctctctaagatcacccggccggccaccagctggggatgaacctgaccaaaacaccataaaatagtgtgtgatctccccacacgcacacagaagctagcagcaacaagcttcattcgcctcaccctctcccatcatatcatatgaggaagcaggattctttccaacctacaatatatcttttccctgatggctagctagctctttctcggactttctttctttctctctctctatccgtctctaccacatcgcaccacctaaccttctcgagctagacccacccacaacgagagggaggcaggcaggccgcccggagacatcaaattcattctcctcttctcttccaaacaaccacctcacttaccagcctaaaaaatccaatcaaagagaggtatagttggtttatatctgtgtatatataccatggcctaattgatgaccatggacgtcgccggagacgcaggaggtggccgccgcccaaacttccccttgcagcttcttgagaagaaggaggagcagccgtgctccagctcggctgcaggaggtggtactgggccatcatcggcgggtggcaacgggaacaatggatcgggaccgggcggtgccggaggggagatgcagctgcggaaggcggcgccgaagcggagctccaccaaggaccggcacaccaaggtggaagggagggggcggcgcatccggatgccggcgctgtgcgcggcgagggtgttccagctgacgcgggagctggggcacaagacggacggcgaggccatcgagtggctgctgcagcaggcggagccggcggtgatcgcggccaccggcaccggcaccatcccggccaacttcacctcgctcaatatctccctccgctcctccggatcgtcgctgtccgccccggcgcacctccgcgcgttacctagccccgccgccgccgcccggttcggatcccgtgcggacgcgtgggaccgggttgtcagcctcgggttcccgtccgagggccccgcctcgtcgtcctcgtcgccgtccccgcttctgttgaacttccactcgggcagcgtcggtctcgatgtgcaaccttcgccttccgccgctgccgccgccgccgacctctccaggaagcggcgctgggagcaggaaatgcagcagcagcaacagcaacaacagcagcagcagcagcagcagcagcaacagtaccagcagcagatggccgggtacacgcagagccaaatgccgggcaccgtgtggatggtgccgagcaacagcacgcaaggaggtgggccgtccggtggtggcggtggcggcggaggaggcagcggggagtccatttggacgttcccgcagatgagcagcgccgccgcggccgccgccgtgtaccgggggagcgttccgagcgggctacatttcatgaacttccctgcaccgatggcgctcctaccgggacagcagctggggctcggcccagttggaggcggcggtggcggtggaggaggcggggaggggcacatggggatccttgccgccctcaatgcttaccggacacaggcggcgacggatgccgccggtcagcaaggcggaggaggaggtggaggaggatctagccagcagcaacacggaggcggcggcggcggcggcgagcggcatcagagcataagcaccagcgactcgtagggctctgaagatcgcgtcgcgtcgcatgcattggcccggtcggtgtgactttgatctgttctttgtcttggtttcattctttcttcttttgttggtttccttccactctctccctaggcaagagcttgcaaggactcacacacttagctgcattccatggcattcttacgtacgtatgctaggctagctagctacctgaacttgtgcttatgggtgagagcgaggtgatgatgcctgggaggatcaagaggagggaaacgcacgcagctgcatgcggagagattgttctttttgttcatttagctctagagtttgatcgagtgcgagcagaagagaaatttttttttatcaagcatggcaatccattatctgcatgccatgacgatggttcatttttttttctcc

SEQ ID NO: 5964 - DNA, 1582 bp, Oryza sativa
  Predicted polypeptide sequence is orthologous to G1064
tacatcataccagaagaaaaaccaattcgattttgccaaattacctagctatagcatataggtaggtagctaggtagcttggttttccctaatagctctagcttgatctctttctagctctaccggcggcgtggcggcggcggcggcggccgcaccactctacatcatcacgtacacctgaccagcttagcgggaagccccacaagaagagtttgtaggtcaccaatcagatcatcagttcatctttgtggttgtgtgggtgtgtgtgtatatatatgccatggcgtgagagtagccatggatgtcaccggagacggcggaggaggagggcaacggcccaatttccccctgcagctcctcgggaagaaggaggagcagacgtgctcgacgtcgcagactgccggggcgggcggcggcggcgtcgtgggcgcgaatgggtcggcggcggcggcgccgccgaagcggacgtcgacgaaggaccggcacacgaaggtggacgggcgggggcggcgcatccggatgccggcgatctgcgccgcgcgggtgttccagctgacgcgggagctcgggcacaagaccgacggcgagaccatcgagtggctgctgcagcaggcggagccggcggtgatcgcggcgaccgggacgggcaccatcccggccaacttcacctccctcaacatctccctccgctcctccggctcgtcgctctccatcccttctcacctccgccttgccggcttggctggccctcgcttcggcggcggcgcgcgggcggcggacgcgtgggaccgcgtcgtcggcctcgggttcggcggtgcggccgacgccccgtcctccgccacctcctcctcctcgtcgccgcttctgctgagcttccactccggtagcgtcggccttgacgtgtcgccgccgtcggcgtcgacctccccggccgccgccgacctctcccggaagcggcggtgggagcaagaaatgcagcagcagcagcagtaccagcagcagatggccgggtacacgcagagccaaattcctgcgggcacggtgtggatggtgccgagcagcaacgcgcaggccgccggtggcggcgctccgccgggaggcggcggcgagtcgatttggacgttcccgcagtcagggagcggcggcggcggcggcgcggcgacagtgtaccgtggcgtgccaagcggactacatttcatgaacttcccggcgacaccaatggcgctgctccccggcgggcagcagctcggcctcgccggcgccggcgggggtggcgaggggcacccggggatcctcgccgcgctcaatgcctaccgcgcacaggccgcgcagccggacgccggcgcggcggcgcagaatggagcgcaaggctcaagtcagcatcgtcagcatcagcatcacggcggcggcggcggcggcggcgacgagcggcatgagagcatgagcgccagcgactcgtagggcttccgttccgtccggtgtgtgccccgcattttctctggttttgatctgttcttctttaattttctccgtttttgtttgagttgttgtctactaatgtctatggctttcttcctcgacc

SEQ ID NO: 5965 - DNA, 1398 bp, Oryza sativa
  Predicted polypeptide sequence is orthologous to G1069, G2153
agcttgagatagagatcgaggtcgatccctccagatcaggccttcaaatcatctactcttccatcaatcctcgactgaaaccccaaggtggcgcagcgagcaagaagcactagctagccagaagctaatcaattgaagggatctatcgatcgatcggaagccgagaagaagaagaagaagaagttaaaccctagcctagcctggatatataggccgcaggtagaagctggcgagccggtggtgggacgaggggcggctcagcctgccggtgacagccgccgacccatccctcggccttggcaacaacgacaccaccggcgccggtgacgacgacatggcgtccaaggagccaagcggcgaccacgaccacgagatgaacgggaccagcgccgggggcggcgagcccaaggacggcgcggtggtgaccggccgcaaccggcgcccccgcggacggccgccgggctccaagaacaagcccaagccgcccatcttcgtgacgcgggacagcccgaacgcgctgcgcagccacgtcatggaggtggccggcggcgccgatgtcgccgagtccatcgcgcacttcgcgcggcggcggcagcgcggcgtctgcgtgctcagcggggccggcaccgtgaccgacgtggccctgcgccagccggccgcgccgagcgccgtggtggcgctccgtgggcggttcgagatcctgtccctgacggggacgttcctgccggggccggcgccgccgggctccaccgggctgaccgtgtacctcgccggcgggcaggggcaggtggtgggcggcagcgtggtggggacgctcaccgcggcggggccggtcatggtgatcgcctccaccttcgccaacgccacctacgagaggctgccgctggatcaggaggaggaggaagcagcggcaggcggcatgatggcgccgccgccactcatggccggcgccgccgatccactacttttcggcgggggaatgcacgacgccgggcttgctgcatggcaccatgcccgccctccgccgccgccgccctactagctctctagctagattaattaattaagcttcatgaattaaatccttgcttaattaattggcatatatatatactcacatgatatatatgatcaacaagctatatatagctagccagctcgagctaattaattaacaaaaggtgagccaatataatgcaagatcgatccaagctatataagtacgtttatacaggtaaattttagtggttcaagtgccagggccatatatatttctctttctttagcatttgtgtgtagtatagcagcaatagcttaatcaaacatcaccaagtaattgctgtgttgtgtgtttggtttacttcacatatctatatatgagtgctaattaaacagatt

SEQ ID NO: 5966 - DNA, 735 bp, Oryza sativa
  Predicted polypeptide sequence is orthologous to G1069
atgtcgccgccggtggcggaggaatcagaggggggtggcagtcgaatgcctgagtcgatgggtcatcctcctccccttctcggcttttcgctcactcccgacctctctccactctccccgacgccgccgcttccccaagaccggcggcgagcagcgagctggggatgcgctctctctgctgccggaaaatctggattcggccgtcatcggcgacggcgacggccgggcggcgggaaacttcaccagcatggccaaatcgacggcgccgtcgacgtggagtggagagcaggtatgccatgcacctctactcctagccctaggtcgctctgcgtgctgttcttctcgccgctggttcccgccgccgtcgcactcatcagaggagcccagcgtggtggcgcgccgcagcgacgggagcggacggagctccgggctcgggatgccacgttagcgaaacaacccacatatactgccaagggacctccgggaaatcgttcggagatgtactgcggtggagtatacatcgccgaacaatctgaaaagcagcgtcttttcttcttctctttttccaattgcaaacggccgcatttggacataaaagttgccattgcaactcatttcggcaattgcaacgagaataaccgtttgttagaaaaggctgcatacacgctagatcaatcaatggagaacaagcccttggaagcacagatgccacctcttcaggacccgagcaggtga

SEQ ID NO: 5967 - DNA, 3213 bp, Oryza sativa
  Predicted polypeptide sequence is orthologous to G1069, G2153
gagtggctggccatgcagggaggtgtgttgggcgtggagaaagctaccgtcaccgccgtcgctgctggtggtggaggcatgggtgtaaaggaggaaatcgtgaaactgtttgtggggtaggtgcccggccaagcaaatgatggaggcgaagctactcaccacattctaggaggtggccatcgtcgacgagatcactgacatgaaggacaaggcctctcgaggtgtggatccgtatgacagatttgggctcatgaccccaaagcactcatgttggctttgttttggtgtttgatttggggctttttacatattctatgggtgtttttatagctatggcaacttttttctataattgatttattttgtcggtttttattgacctctctcttgataaatatatgatttttttgttcttattgcgatgatactttagtggcatcatgatattttggtacctataggtatcagacatggtactcatgtactacggctggtacatatatgtcttgtactgggtccttataggtacaagacttggtgctcacgtattatgtttggtactattaagtatactacatggtaccacataccgacatacgtatacattgacatcatcattgacgtgatagatatagtatattagacctgatactcgggtatcatgttttgtaccaataaatatcatacatgatattccctccgtttcaggttacaagacattttgactttggtcaaagtcaaattgttttaagtttgaccaagtttatgggaaaaagtagtaacattttgaacccaagagaaatttattatgaaaatatattcaattattgatttgataaaactaatttagcattataaatattattatatttgtaacttagtcaaatttgaaaagttaaaacgttagggagtaccacgtaagtataaggtgacgtcaattttaacatgaatatgacgtcattacttaagtatcccgtccgaacggggtatcatttccgagctgctctctttttctaaaaggatagagttattacatagtaatagtaatgatacaatattgaaatattttacgtcaaatataaaatgataaaaaatataatttaatttaaaattaagctctaaagtccccaattctttttttttcaacgtggcgatgttattttctatgttccttaacaacttttatactactctaaacaaattagcaaacataagggattaatgaacaactgggccggcttgtgcggttgtgcctgagtggaatggccgacgctgcccaggaagaaggaaaaagtacaccgaaggtccctcaacttgtcgtggagttacaaaatcgtcccccaaccacaaaaccagacatatgacatccctcaacttacaaaaccgttaactttagatccttcggtggttttgaacccggttttgtccaacgtgacggctgagtcggcgtgggacccacgtgtcaggtgtccacgttagcatctctttcctctcttctctttctctgtttctctcttctcttctccacccttacgtccatagcgcacttcgcgcggcggcagcggcgcggcatctgcgtgctcagtagggccgacgccgtgaccgacgtggccctgcgccagccggccgcgcctggcgccgtggtggcactccgtgggcggttcgagatcctgtccctgacggggacgttcctgccggggccggggccgcccggctccaccagactgaccgtgtacctcgctggcgggcaggggcaggtggtggggacgctcaccgcagctgggccggtcatggttatcgcgtccaccttcgccaacgccacctacgagaggctgccgctcgatcaggaggaggaggaagctgcggcaggcggcggaggacacatgatggcgccgccgccactcatggccggcgccgccgatcctgtactgttcggtgggggaatgcacgacgccgggcttgctacacctgcatggcaccatgcccgccctccgccgccgccgccctactagctctagctagagcttcatgaattccttgcttaatgggcacatatactcacatgatatatatgatcaacaagctatagctagccagcttgagctaattaattaattaacaaaaggtgagccaatataatgcaagatcgatccaagctataactacgtttatacaggtaaattttagaggttcaagtgccagggccatatatatttctctttctctagcagttgtgtgtagtatatcagcaatagcttaatcaaacatcatcaagtaattggtgtgttgtgtgtttggtttacttcacatatctatatatgagtgctaaacagattaattctgaatgcctctctcgaagtcaagtcgcatatgcatgcatagatcgattaatgcatatctatcgcagtcaagtcgcagtgctcatttgctctcttctctcgcacggggcatggggatgccgacgctagggcgcccacggcgcgaggtgacggcgcgagctcactggcctccccgcccccctcgtgcgggccggccggtggggcgaggcaggaaagggaggccggggacgggcggcggggtggcgtagcgacgcggcggcgccgggccgggcgacgcgacggcggcctccacgcgctcctcctcgcggacgcggactgccgactccgcgtcgactccttcccgcgccccctctgctccgtcgccctccgccgttgcgacgctggttgccgtcctgcaccgcgccgtccatcgccggccccgcggcgacacccttcccaggccgccgctcctcccccgctctccgccgctggcgcgccggggcgagcgccgccgccaggatgccgaccccgcacagtaatccttccctaatctcactctaatgtctcacaaacatgcgggccccaccatgcctagtttctctgttaaatccacccatttacctttgattcacttatatatgggacccactgtgccggtccgaccatgcgcccggtcaggagaggaagtaagaggttggctgccgacgtgtatcctgacatatggggcccacgtgggtcccacgctgactcagccgccacgtcaggcaaatccgggtcaaaaccgccgaggcatctagtttgcaccggttttgtaaatttggggatgcgttgtatccggttttgcggttgggggacgattttgtaactcgatgataagttgagagaccttcggtgc

SEQ ID NO: 5968 - DNA, 801 bp, Oryza sativa
  Predicted polypeptide sequence is orthologous to G1069, G2153
atgggcttgccggagcagccgtccggctcgtcgggccccaaggcggagctcccggtggccaaggagccggaggcgagcccgacggggggcgcggcggcggaccacgccgacgagaacaacgaatccggcggcggcgagccgcgggagggcgccgtggtggcggcgcccaaccggcgcccccgcggccgcccgccgggctccaagaacaagccgaagccgcccatcttcgtgacgcgcgacagccccaacgcgctgcgcagccacgtcatggaggtggccggcggcgccgacgtcgccgacgccatcgcgcagttctcgcgccgccgccagcgcggcgtctgcgtgctcagcggcgccgggacggtcgccaacgtcgcgctgcgccagccgtcggcgcccggcgccgtcgtcgccctgcacggccgcttcgagatcctctccctcaccggcaccttcctccccggcccggcgcctccgggctccacggggctcaccgtctacctcgccggcggccagggccaggttgtcggcggcagcgtcgtggggtcgctcatcgccgcgggcccggtcatggtgatcgcgtccacgttcgccaacgccacctacgagcgcctgccattggaggaagaagaggagggctcaggcccgcccatgcccggcggcgccgagcccctcatggccggcggccacggcatcgccgacccttcggcgctgccaatgttcaacctgccgccgagcaacgggctcggcggcggcggcgacggtttcccatgggcggcgcacccccgcccaccgtactga

SEQ ID NO: 5969 - DNA, 1291 bp, Oryza sativa
  Predicted polypeptide sequence is orthologous to G1075, G1076
cacacaaaccctaaacaaacacacacacacacacacacacacacacactctctctctcttctcctctcttctcctattatcatcatcatcatcatcatcatcatcacttgcatatcgaattattaataatatcgatggcaggccttgatttgggcaccagctacctccaccaccaccaatcactgcatctccgccacgacgatggcggcgccggctccgacgacggcggccacgacgacctctcgccggggagcggcggtggcggcgggcccagcagcacggccggtggcgccgggatcggcggcggcgaggtcgtcgctcgccgcccccgcggccgcccgccgggctccaagaacaagcccaagccgccggtgatcatcaccagggagagcgccaacgcgctcagggcgcatatcctcgaggtagccgccggttgcgatgtgttcgaggcgctgacggcgtacgcgtgccgccggcagcgcggggtgtgcgtgctctcggcggcggggacagtggcgaacgtcacgctccggcagccgcagtcggcgcagcccgggccggcctcgccggcggtggcgacgctgcacggcaggttcgagatactctccctcgcgggctccttcctgcccccgcccgcgccgccgggcgccaccagcctcgccgcgttcctcgccggcgggcaggggcaggtcgtcggtggcagcgtcgccggcgcgctcatcgcggcggggcccgtcgtcgtcgtcgccgcgtcgttcagcaacgtggcgtacgagaggctgccgctcgaggacggcgacgaggtggtccccccggcgccggcagggagcgaccagggcggcggcggcagcggcggcatgccaccattaggcgttgatccgtcgggcggcgccgccaccggtgggctcccgttcttcaacatgccgttcgggatgccgccaatgccggtggacggccacgccggctggcctggcgccggcgtcgggaggccaccgttctcatgatggatggatccccatattccggcgagcggccggcggcgaggtggtcggcaagattgaagacatggacatggacatgtacaacaacaagtagcctttcttatctctgaatctttttctcctcttgttcgatctctgtgatgtctgtctttgtgatcttttcgtgatgttttttgtgttaacctgtatgagagtacttgtgttaattgtttcagtcaggtgtctttgctgcttcgaatgtgttgtgaggacatgcactcataaattgatcaaatcaattattattgtct

SEQ ID NO: 5970 - DNA, 918 bp, Oryza sativa; identical to SEQ ID NO: 5144
  Predicted polypeptide sequence is orthologous to G1075, G1076

SEQ ID NO: 5971 - DNA, 916 bp, Oryza sativa
  Predicted polypeptide sequence is orthologous to G1076
ctcacttagcagaaatcctccgcctccatccctcatcgaagttggctccctcttccccgcctccatgactgccgccaccacgacgactaccgcgaccacgacgcgaggacaacgacgacgactgtcgcgaggatgacaacgacacgacgacggtgccgatgcctgtgggggtggcggcggacggaggagagctgtcatcggcatgagagagaggccggcggcagcggtgtggaacttggcacctgacacagggctgcatctgtttagttcgattttcggcgaagaggtaagtcctacgtttcgccggccctggtgaatctatcggctacgttggcgttgttcaaggctacatctgtatattcgacctcttggattgctctggttcggttgatatttttgcctaccaatttatcatgtctctgttaatctagtcttagcatatcgatttagctctatccgctgcttctcgctttagggtttctgccagtatcggctaaatcgtcttgctagattagattatcttggacatctaccaccctaaaaatcagtcaatggcttgattgtatagatattatgtttcttttcatacttagtgctgcatcagttaagtttgatatactaagccgtgcttagagccatgatccctagcctgcttcttgattacctagtgctgcatcagttaagtttgatctactaagccgtgcttagagtcatgatccctagcctgcttctttgattgcaaataagggtttcattggggtttcagccgataaggtatctggatgttgtatcagcttacaaggattacatatagattagatttagccgatgacaataaagattttattatttatctaatattgtggattttatgacatcggatcttcatcttcagccgatgaatactttaaccttc

SEQ ID NO: 5972 - DNA, 456 bp, Oryza sativa
  misc_feature (388)..(388): n is a, c, g, or t
  Predicted polypeptide sequence is orthologous to G1076
ttaatttctctctctgtttgcttctctgtgcatccaaaaattttaaaaacaaggaggagtataaacaactcccccactttaaaaatcattgcttccttttccaacaccgccttttaaccctaaaaacaaaacaccacccctgttccaattcggtttttttcctctcttttttctccactttttttttagattttaaattttttttgctagagctagagaggcgctctgctgctgctacatcagtacatgagctagtggagaagcatggcaggtctcgacctcggcaccgccgcgacgcgctacgtccaccagctccaccacctccaccccgacctccagctgcagcacagctacgccaagcagcacgagccgtccgacgacgaccccnacggcagcggcggcggcggcaacagcaacggcgggccgtacggggaccatgacggcgggtcctcgtcg

SEQ ID NO: 5973 - DNA, 2575 bp, Oryza sativa
  Predicted polypeptide sequence is orthologous to G1078
atggggtgcacggcgtcgaaggtggagcaggaggacacggtgcggcggtgcaaggagcggcggcggcacatgaaggaggcggtggcgtcgcggcagcagctggcgtcggcgcacgccgactacctccgctccctccgcctcaccgccgccgcgctctcccgcttcgcgcagggccacccgtcgctcgccgtgtcgcaccacaccgcgccggtgctcctcaccacggccgcgcccgcgctggcgccgacgccgacgccgccgccgccgtcatccacggcgtcgtcctcgctcccgccaccgacgccgctgctccccaagcaccagcaggcgccgccgccgccaccgcccacgcagtcgcatcagccgcctcctcccgtggcggtgagggctccccgcggcgggccgcgtcgcctcaaggtgccgcacatcctgtccgactccagcgtcgccagcccggcgcggtcgtcgttccggaagccggtggtggggacgccgtcgtcgtcgtcggcgtgggactgggagaacttctacccgccgtcgccgccggactccgagttcttcgaccgccgcaaggccgacctcgaggaggccaaccgcctccgcgagctcgaggaggaggagaaggcccggggctacctccacccccaccacctcaaggaagaggacgaggtcgacgacgacgacgacgagagggaggaggagatgcattgcggcggatgggaggacgacgacgaccactacgcgtcgacgaccacctcggagaccagatcggaggagggggaaatggggaacagatcggagtgcggcttcgcggccagatcggagtacggcggcacggcgccgtcggagtacgccgccgcgccgctgccactgccgctgaggaggagggacgagaggtcggaggccggggactcctcctccacggtcacggcggccgccgagatgcggatggtgatccgccaccgcacgctggcggagatcgtggccgccatcgaggagtactttgtcaaggcggccgaggccggcaatggcgtctcggagctcctggaggctagccgcgcgcagctggaccgcaacttccggcagctcaaaaagacggtgtaccactcgaacagcttgctatcgtcgctgtcgtcgacatggacttcaaagccaccattggctgttcgctacaagttggacaccaatgcgttagagatggagtcaatggaagggaagagccatgggtcgacactggagcgtcttttggcctgggagaaaaagctctatcaggaggtcaaggctagagagagcgttaagattgagcacgagaagaagctttctactctgcagagcctggagtacagagggagggatagtaccaagctggataagaccaaggcctccataaacaagctgcaatcgttgatcatcgtgacttcacaggccgcaactaccacatcctcagccattgtcagggtgcgtgacaatgagcttgcaccacagcttgtcgagctttgcttcgcgctgttgagcatgtggagatcaatgaaccatttccatgagatccagaatgaaattgttcagcaagtccgtggtctggtagacaattccatggctgagtcaacatctgatcttcaccggcttgccacccgtgatcttgaggctgctgtctcagcatggcactcaaacttcaaccgtctcatcaagtatcaacgtgattatatacgtgccctctatggctggctgaagctcacactcttccaagtggacagtaatatcccacaagaggcttacacctcgctgatctctcgtgaactcaccaccttctgtgatgagtggaagcaagcactggaccggcttccagatgcttcggcttcggaggctatcaagagcttcgtgaatgttgtccatgtcatctacactaagcaggcagaggagatgaaaataaaaaagcggacagagacatattcaaaggagctggaaaagaagaccaactcacttcgagccattgagaagaagtactaccaatcctattcaatggttggccttggccttcctggcagtgggcgcgatggcattgaaagccattcgttcgatgcccgcgatcctcttgcagagaagaaaaccgagattgcccaatgtcggcggaaggtggaggacgaaatgacaaggcatgctaaggcagtggaggtaactagatcaatgacactgaacaacatccaaacaggcctgccaggaatgttccaagccatagctggtttctcaggaacagttgttgaagcccttgacgttgtctgcaggcgagctggatcggtgcggtagaagcttgcgctgccagactttccaagaaaccgttcgttaagtctttttgggtggttcagtaatttatatagggaaaatgcaatatatatagctaaaattagtgatgagaatatgggggagaaggctcccttgatgttttgccttgttgggagttggtcattttggttgtagataaatgattttactcaggattgttgatgttcttttgcttgtcctgtgaagtgcaagggaagattacattgtacaaaaaaaaaaaaaaaaaaaaaaaaaa

SEQ ID NO: 5974 - DNA, 336 bp, Oryza sativa
  Predicted polypeptide sequence is orthologous to G1078
atgacagaggcacggcggaggaaaggggacaatcaggacggcggcggcgcggggacaccatgcaacgacgcccacgcccgaagcgatgacattagcggtgacagttgtggcgtagatcaagtgaggcgcgagaggtggaagcggggagcaccgacggcagcatgcggtgcacaggccgaagttggcggtagcgtcactagttcacggggggcgacgggatgcacggcatccaaggtgcagcaggaggacacggtgcgggagtgcaaggagcagtggcgacacatgaagggtgcggtagcattgtggcagcaactcgcctcggcccacgctgactaa

SEQ ID NO: 5975 - DNA, 1767 bp, Oryza sativa
  Predicted polypeptide sequence is orthologous to G1078
atgaagcggtgcagggagaggcggcggctgatgcgggaggcggtgcggctgcggcgccacctcgcggcctcgcacgccgcgtacctccggtcgctcacccacgccgcgtccgcgctctcccgcttcgcggtcggcgagccgctcccggtgtccgaccacgccccgcccgccgtgatcgtccaccgccccgtcgtcgcgccctccacgccgccgccgctcctccgctccatcgagcagcagcagcagctgcggcggcgcgcgcaggagttggaggaggaggtcggcgctgctgttgatgatcatcttgttggcggcggggccggggtgccgtcggtcacgcgagaggaaggcggcggtgatgaggagctgaggatggtggtgaggcaccgtagcctcgcggaggtcgcggcggggttggaggagtacttcctcaaggccagcgtcgccggcgacgccgtgtcgagccacctcgaggccagcaacgacgagttcaagcgtaagccactagcaactctacttaattcgcacattcacatttactgtacatgtggccactgcctcactggccaatacaaaggtggaccgcacagcatcttgggcgcgctttgctgcctgtcggcgccgtcggttgcgcacgaccgcgtcgacagcatcaatggcgagcagaggcatagctccaacttgcagcagctgctggcctgggagaagaagctgtatcgagaggtcaaggcgagagagcggctgcaggtccagcacgacaagaagaaggcggagctgagtgaccaggagtacagcaggaagatcgacgtggacgtcctgaagctcaaggccgcgtgggagaaggcgcgcgcgcagctcacgacggcctcgcaggccgtggccgcgacctccgcgtccatcgcggagctccgcgacacgcacctggcgcgccagctgctggggctctgccacgccacgctcgacatgtggagggcgatgcggcagcaccacgaggcgcagggcctgatcgcgcagcagctgcgcgggctcagcagccggacgtccatggaccccacgacggagatccactacgagaccacgcgggcgctcgaggtcgccatgtcgtcatggtgcgccgccctgggccacctggccaagcaccagcgcgactacgtccacgcgctgcacggctggctcaagctgacgctgcaggaggcgccggccgtcgtcgacggcgccgaggcggtggcctcccccgtcgccgccgagctcgccgccttcgtcgagcggtgggggcaggcgctcgaccgcgtgcactgcgccgacgtgctcaagtcgatcaagagcttcgccggcgccgtccggtcgctgtacggtctccagagcgacgagctgcgggtagcgcggcgcgtcagccagtactcccgcgagctcgaccgcaagtcgcggatgctgcggcaggtggagaagagctactacgactcgtacgtgccgccgatgggcctctcgctgtggcaccgggggatgaggcattggggggacgacggcatgcacgcgcgcgacgcgagcaacgaggtggcgcagcggagggacgagatagcggcgtgccggaggacggtggaggacgagatgcggaagcacgccaaggccatcgacgcgacgaggtccgcggcggtgacctgtgtgcaggggaagctgcccgccgtgttccagtcgatggccgtgttctcggcgtcgctcgcgcacgcgctggaggccgtgtgccggcatggcacccatgtgcagtag

SEQ ID NO: 5976 - DNA, 617 bp, Oryza sativa
  misc_feature (517)..(517): n is a, c, g, or t
  Predicted polypeptide sequence is orthologous to G1078
tcaagagcttcgccggcgccgtccggtcgctgtacggtctccagagcgacgagctgcgggtagcgcggcgcgtcagccagtactcccgcgagctcgaccgcaagtcgcggatgctgcggcaggtggagaagagctactacgactcgtacgtgccgccgatgggcctctcgctgtggcaccgggggatgaggcattggggggacgacggcatgcacgcgcgcgacgcgagcaacgaggtggcgcagcggagggacgagatagcggcgtgccggaggacggtggaggacgagatgcggaagcacgccaaggccatcgacgcgacgaggtccgcggcggtgacctgtgtgcaggggaagctgcccgccgtgttccagtcgatggccgtgttctcggcgtcgctcgcgcacgcgctggaggccgtgtgccggcatggcacccatgtgcagtagttagctacacatagacacagttcattcgtttgagtcggccatctccatttcctttttccattttactnatctatacgaccatacagtatacactatacaccaaagatatactccgtatacacgaaaccctgctaggatgtaggaatgtataaagactaaataaaaatc

SEQ ID NO: 5977 - DNA, 559 bp, Oryza sativa
  Predicted polypeptide sequence is orthologous to G1078
ttattgagaccaagcttctggagcacagacctgagcaggacgcgaagcagcgcatggagcacctgtcggagaagaaggaaatgctgaatgtgctgaggaagagggtcgaggccgagaaagcgaagcaccacgcctgtatgcgcgatacgcacgatgttactctcaacgggttcaagatcggcctggccagcatattcgagtcgctgaccgaattctccaaggattccgtcaaactctacgaagaccttctaacgcatgccgaacccaaaggttcggaggacgctaccgagaaacggccctgcgtggaggggccatactctcagatttcagtggatgctacgtgactgtctcagtgcccccacattcagtaggagcttgttgcatttgccccagtttttggacccctagaatgtgcgtgctgatgttaacctgtagagtagtgtagtagtaccatgttggttgtgtgtggtggggcggtagggtcattcttgtgggcatctacttactgcttgtaattattcgttttagtttgatatcagagaggattgattcaaaaaaa

SEQ ID NO: 5978 - DNA, 3145 bp, Oryza sativa
  Predicted polypeptide sequence is orthologous to G1079
gaccaccatcctcaacctcaatccccatccattccattccatcctgcacgagttctccactggagtggagatccgtactatacttttttttattattaccacctgcccgcaaaaccaaatccccgcaccttcctctttccccttctttctcctcccaaaaccgctctctttcttctcccaattgcccacctaccggaagagaggaagagagagagagagagatgggttcttgcggattgaggagggtcagatgatgccattaccaatttaacatcttctgcatcttttttttgcctttcttggcatattcttctcttctggatgtgtagatccttctttccccagtcctgcttagctttcaagcagaccaacaggtccgagattggtgacctgggagcggtttcttgaggtgtggtgccgttctgggtaagatcgactctgttgccctgcaagaattcgatgcaggagtaagggcggcggcagtatgtaatttggtgggcggttgttggagaagaggagcaattttgcccatcggtttcttgggtgcaaattgagggcaaatttcggtgaatttcgtcggaaattgaggaagcccgtttggcaatcggtcctgtccatgtcccatgcctagaagctggggcattttgggtgtgaattgtgacgaattccagccaatttgggttgggccaggaaagtaccctttgggggtttcagtttgtggtgtgatctgcaatctttccaagattggtggggagttctttgtgtgtgctggtggcaaatgggttgcacacactccaaggtggaggatgaggaggccgtcaggaggtgcaaggataggaggaagctgatgaagcagctaatgcggcgccgagttgagcttgcggctgcacaaaccgcctacctgcagtcactccgaaacacaggagccacacttcgacaattcgccgaggtggagtctgcattgtcacagcagccccctgcaggtattgcagtgcatccatcaccaccaccacctccacctccacctccaccgccaccaccggtgccagtacctcctgcatactcagtgacatcctcagtgccaccgtactcgatgacatcctcattgccaccctcaccacgccctccaccaccgctaccgtttagtccaatagtgataaggaggaaaaagagagacggtgaacttgatgaggatgattctacagacgacgacgacgacactgacagctgctcgactcctctaccacctcccccgccaccaggggttgagtgggagtacttggaaccttttgcaatgcgtcccttaaattttccatcttcattggctgataggattgataaagaagcggcctcacaggtgaccatggatgatgataactgggtggagactaacacagaatttgatggatatgacgatgaaagtgtgtctggtaatgttgaaggcattgtgagcagtgtccagttgaatcaagccaagagtagggctctaggtgatgacaattcatcaatggttagctgggtgacaaaggactcagacacttcagcgatggcctggaggagtaagaagtcgctggcaggaattgccaaggagattgatgaatacttcttgaaagcagcggcgagtgggagtgacatcgtcatacttttggactcttctggtgggcagccagatccctcagagttagaggcaaacagaggaaaaaattccaaatccgccaaggttttttccacaatttcttggagctggtcattcaaatctgcgcaagctaatagacaatcctcaatgcattcaagtgatgcctctggatatggttaccatggcaaaacactagagaaactttatgaagaggagcaaaaactctacaagttagtcaaggatgaagaatttgcaaggctccagtacagaaagaacacctcgttgctacaaagactagaatcaggtgaccatgataaattgcatgcagagaaagtgcgagataatatagaggaattgcaagctcggataatctctttggaggaagctgttggtttgacatgtttgtccatatcaaagctcagagatgaggagttatatcctcagattattgaattatctgcagggcttgtgcatatgtggagaaacatgtatgagtgccatcaggttcagaaccacattgcccagcaagccaatcttctaggcaatttaccagggaatgaaccaacaactgacactcattgtcaggcaacatctcagctggaagttgaagtttctgcatggcatagttcattctgcaatctcatcaccttacagcgtgactacgtaaccatccttaaccagtggattaaactcactgattgcctgcctgataacgatggctttatgaaaagttcgtcaggaattcgtagtctctgtgcagaactccagcgagctcttacaggattacctgagaaggtagctgcagaagcaataaagacttttctgtcagttatacacactatagttgtacagcagactgaggagcgtcaactgaagaaaaagtccgaccaaatcgagagcaagttccatacccagttagagaaacacagcaacaatgcaacccaaaattcgggccagcctacacttgcaaagctggacacgttcaaaaagcaggttgaagaggagaaggctaggtatctgaactccgtgaggactagtcgagccatgacactgaacaatcttcagacgagccttccaaatgtgttccatgctctgatggggttttccggagtatgcgtgcaggcgttcgaaggtatcagtagatgcagtgagattgtcgccagccactcgggagcagtttcacctgccatttcttcgtgactgcatccggcatggttcgttgtgattgttcattgtaagtaggcaaagaaactggttctacgtgaatacacttctcttccaaaacttaaaaagggaaagaatttagcgacgattttaagtcagtacaggcatagtagtcttttgaatagatcaacatagtctcgatttgggaagaggtggatgtctatgaggttactgggaaatgattcatgtgtaactagatacttgaacagttgaacagtagtctgttgctgcatgttctcaacttctcaattctcattatatgatgctattttctatttctcaact

SEQ ID NO: 5979 - DNA, 4052 bp, Oryza sativa
  Predicted polypeptide sequence is orthologous to G1082
gactaacctagttagccactctattactactacctccgttgccaacgccggaatccatccatccatccccgcgccgcgctgtgccgccgcgagagctttgcggcgggcatgcgggtggggattcaccgcggggtggaagaagctgaagcagcagctggtggcgcaacgccacgaggcgcaccccgctggcacccacaccaacaaaaggagaagattctcgccaccaccactcccactgatcccctcttcttcctcctcgttcgcctgccatctccggagccggaggaggaggaggagtagccgccgcccagatctgcgccgccatgctgccgctgctgcggaggcggcggctgtgaatagctaggtcgtttttattgttgtttttgggttggtttggtttgattccgatggggtgcgggcagtcgaagatggaggaggagtacgcggtgcggcactgcagggagaggtcggagctgctcgccctcgccatccgccaccgctacgcgctcgccgacacccaccgtgcctacgccgaatccctcgccgccgtcggcgccgtgctccacgacttcctccgcggcgtccagtcgctgcccccgccgccgctcgagcccacgctccgccttcccgcccaccgcaagggcgacaacctccccaccgcctcccccgtcccggccaaccccgccatcgcctcctcctccgccgcccagccgctgccgcccgtcgccaagcaggtacgaatcgccgccgcccccgatgacggcggcggcggcggccacatccacttctcggacgacgactccgattccgagggcggcgggcacatcaagttccactccgacgacgagggcgacgcgcccgctcaccgccgcccagagatcgtccgctccgccgcgccgccggtggctccgccgccgcagatggggccaccaccaccgtatggctccggatatgctcctcctccgccttatggttcgggatacgggtatggatacggccccgcccccgattacggcggcggcatggccgttgccaacggcggctatgacccagggtatggtggtatgggcggagccagtggcggcggcggcggcggcggctatgcgcctggatatggaggcatgggagttggggatggcggcagcggtggcggctatgagccagcctatggcggcatgggcagctatggccaaagcttcttcaacatcagctatgcgcgcagccagccgcctccgccgtccgtctcatacgagcaccggctgcaggccaccgatgccagggtccactactacgccggagaaggcaaccctcaagcacccccactcgggtatggcggtgggtatggttatccgccgcagggctcgagctcttacaaccagtatgcgtacggtggttactatggtggtgcttctcctccgcctccggccgatataccttctacctcccgcggggaggttacgccaccggcacctccatctccgccgagggtgtctacttgggacttcctgaacccatttgaaacctatgagagctactatgagcagccaactgctgctcaagcgtcatacactcccagcagaagttccaaggatgtgcgtgaggaggaaggcataccagatttggaggatgaggatatggaggtggttaaggaagcttatggtgatgagaagcacgccgccaatgggtacagtggcaaggggaagatggcaaaagaggaaggtggtaggagcagcaccggggatgaactgccccatgaatccaagttatcggaagcgagcagtagcgggagcaaccaggagcatgatgtccatgtagtggagaagagtgttgtgggagaacaggtgcagcggtcagagcctcgtcagcatgtcgcaggcctgccgcccataggatcggagaagacgtactttgatgatgctgaggtggtgctggagatcaggactcaattcgagcgtgcctcaaaatctgccattgaggtgtccaagatgcttgaggttgggaagatgccttactacccgaagagttcaggtttcaaagtgtctgcgatgatgatttgcgggataccaacaatggaggaagagttcctgcggtttgaagaagacaaggcgatggggtgtggcaatctttcctcaacactgcagaaactgtacatgtgggaaaaaaagcttcttgaggaagtcaaggctgaggagaagatgcgggcgttgtatgacaggcaacgtgaggagctgaaaatattagatgagaaaggtgcagaagctgataagcttgaggctactgaaagatccatcaggaagctatcaacaaagataagcatagcaattcaggttgtcaacactatctcagacaagataagtaagctgagggatgaagagttatggccgcaaacatgtgagctcatccaagggttgatgcggatgtggagcactatgttagaatgccatcagatccaattgcatgccatatcccatgctaaaaacatagattccatgataaacggtgcaaagtttggtgaagctcacatggacttgatcaagcgcctagagcttcagcatttggattggatagcctcttttgcctcatgggtgaatgctcaaaaaagctacgttggtactttaaatgactggttgaggaaaggagtcacatatgaacctgaggtaactgatgatggtgtgcctcctttttctcctggacggctaggagcgccacctatttttgtcatatataacaattgggcagttggtgtggggaggatatctgagaaggaagtagttgaggcaatgcaggcctttgcatctaatgttcttggcctctgggaaaggcacaggtcagagcaaagacaaggtcttatggctaataaaggtatggacaaggaccttagggtgatggaaagggatgaacagtcgatgcgcaaggctctggaagcacaaaataagaagctggtgctcatttctaatcagagcggtgtatccttatcagcacaagcacaggccttacaagatggaggttcccatggtgatactggtagtttgcaactaagtctgaagaatatttttgaagcaatggagaacttcaccgccaactctgcaaacacctacaaggatctccacctgcgtgctgaagaagagaaagctcgcgttgcccaagagagttgcagagtttcctagttcctttcgtggtttccatgttacatgagggcatgagccctttttaacgcaaaggagctgactgcagtggttcagatgagcactatagtttgcatggcagcgtcacaattcaagtggcaagtgatgcaccttgcatgaaatagcttctacccagggctgcgggctgccagacaaacctgtggcgtaaatggagacttgctagattgtgtttttttgaattggagcaacactcctcatgccatacagcccaggaactcaattttgctaatagctgaatcacaagacattgccgataggggaagaaaaatctgaagtggcgagtgacaagattcactcaatgttgggaaatcccagtaaatagttggaagatgtaagctgcataaacgaaatgcatggtctaagcatggagcagtaaaatgttccgatcatgagtccaagattcatgaagttgtatccatccatatgaaatagtcaaatgtgatcatgctgccaggttcagggaaagagtcactggaagagtgcaacaatgctagcatgccagtgtacatagttgaaggcaatgcgatatgggatgaaccaaagctgatgctgtgggagatgcttccctcccagctgggaggctgcagcctagctagttcacctgttaggggagtgatggatgatgatgagcttgtaggatagagaaaaaaagtggatgccctgaccccgttctgcagttcactaactgttggatttttttgttccgttatttattatacatataattcatttgtatccctgtacagccggtggctaactcataaacccccccttttttgtgtcatgtttattctatttctcccccatcgactttgcctgtttctgcttctctctcttttaatcgcg

SEQ ID NO: 5980 - DNA, 1661 bp, Oryza sativa
  Predicted polypeptide sequence is orthologous to G1082
taacgtcgccgcgtccgttccgactccccggagagccgccgatggtgcagacgttgccggcgagatcaaggcgcagtttgtccgagcggcggacgcggtcagggcgctcgcgccgattcttgaagtcgggaggcggagctaccatccccggagctcagtgtaccatgtttcatctcggatggtgtcagtgattgcgctgccgcattcaggatacggaggcagcgacctgttggatgtcggaggaggggagaaggtggtgggagcaaggaacttgtctttgactctgcaaaagctctatatctgggagaagaagctgtacgacgaggtgaaggctgaagagaaaatgcggctcctgcttgccaagaactctaagaggctgaaattcttggatcaaaaaggcgctgaagctcccaagattgatgcaactcgtaatttggttaggaagctatcaacaaaaatacggatagctgtgcgagttattgctaaggtgtcgaaaaagataaacagagtaagggacgaggagttatggccacaagttaataccttaatccaagggtttgtgaaaatgtggcaagataagctgaactgctaccacatccagtgtcaagcaatatcagaggcaaaaaacttggattcaataatttctggtggaaccagtcgagatctggcaatggagcttgaactagagttgattaaatggatcgtcaatttttcctcctgggtgaatgagcagaggagcttcatcaaggcactgaatggatggctggcactctgtcttaactatcagcaggaggagacggctgatggagttcctccgtattctcctggaagagtgggcgcaccccttgtgtttgtcatctgtaatagctggtcccaagctatggatcggatttctgagaaggaggtgattaccagcatgcaagctcttgtgtctagtgtacggagcctatgggagaaacaaaatgttgagcaaactgaacagctgattgcaatccgggaaagagaaaaatggaacaagatattggaaaggaagaccctggagattaacaaggaggccgacacactcaacagaaagctagctctagtaccgggccggcaaagccttcttccaacagcacaaacgtaccaggtccattttcttgaggcaaacagtgtgcaggttagtttgaagcgtgttcttgaagccctagaaagttactcttccaattccctgcgagctttggatgagaccctgaggcatgccgaagaggaaaggttgtctagagaaagagccaaagtttcataggcattggcatagaggttccatctgacactacagtgaacacagcttgtaaaatacaagggtctcctctccaggtggttataatttatcagatcaatgcagaatgttctgggcaaatgctgcttgcagatcaaatttttgtggggaagttctgactttggagttttgctaactgaccgttgtttgtcgatgcagttcaggcaaatgtcctgtgttgatccatcataatagatatagttgtgttgaagtagcaggtacattaggtacatataggtgaagtgctcgtttcggtgctagtatgcaatgtactgatcttctgtgttgcctttttcttggcctccatacaattgaatgaatgagcaagagtgcacttggaatg

SEQ ID NO: 5981 - DNA, 2814 bp, Oryza sativa
  Predicted polypeptide sequence is orthologous to G1082
atgttatctcgccggcggcgtgggaggagaccacgagccgacgacgacagcgaccagctgatccacccgctgttcaagcgcagctggacctcggcgtccgggacttcgagagcgggacgttgcattgcaccatcgatccttggcgacgtgtgcctttttcaccgccgcccacgtacggctgtcccccccgcttttgctcatctccgctcgccgccggcaaccgccaacccgcgctgtccagtccgtgacgttttcaccgtgcgccggcccgctcgactcgaggacgaagccgaaaagcgcgaagattctcgcgtcgccatcgcccatcgcccatcgccactgtacatggggtgcggccagtccaagactgacgggggcgggggcgggggcggcgcggctgtggcgctgtgccgggaccgcgccgcgctgctggccgacgccatccgccaccgctacgcgctcgccgacgcccaccgcgcctacgccgcctcgctgcgggacgccgccgccgcgctgcacgacttcctccgcggcgtccaggcgctgccgccgccgtcgtcgtccgacgtcgaccacgccgcgccgctgcgcctccccgacctgaggaagggggaccactcgctccccgccgccgtggttcccctccccgtcgacgcggtggtcatcaaacaggttgacgacgacggcggcggccacatacatttcccctccgacgacgacgacgacgagggcggttctgatggtagtggtggccacatccatttcccgtccgacgacgacgacgacgctgagccgcctcccccacgccccgccgcggctccggcgccgcacgccgccacgctatacacctacgctccgccgtacggctacggccccggcgccgggcagtatgaatacggcgtcgacatgggcggctacggccagagcttcttcagcatcagctacgcccggagccagccgccgccgccgtcgtccgttgtgtcctacgagcaccgcccccaaacggtcaatgcgactgttcactactacccgggggacggcgccgccgggccaccgcttcccggctcctactacggcagcgccgcgccgccgccatcgccgccgcgggtgtccgcctgggacttcttcaacccgttcgagtcattcgagagctactaccaccaggaccagccatctcctgctccaccggcctacacgccaagccggagctccaatggcgcgcgggaggaagatgacaatggcatccccgaggtggagcacgacgaggtcgacaaggttgacaaccaccaggatgccaatggcatgccattgccggcgaaggatgtcagtgaggagcagcacaggaagtccaagtcctcggaggccagcagtagtaccagcagcagcatgatcagtgatctccatgtagttcagaagagtgtgattgaagaacagctgcggcattcggatgccgcggggcctcccgcgatccccaggaaggtttacaatgacgatgtcgaggtggtggaggagatcagatcacaattcgagcatgccgcaaagtccgcattcgatgtatccaaggtgcttgaggttgggaagatgccttactaccagaagagttcaggattaaaagtatcctcgatgatgatttgtgggctatcttcggtgggggaggagttcctgcaatttgaggaggacaaggctatggaatgtggtaacctttcttcaacattgcagaagctgtacatgtgggagaaaaagcttcttgaggaagtcaagtgttgggttatactcaagcaactttgtttatcacagactgaggagaagatgagggtgctgtataaccaaaagcgtgaggagctgaaagttttgtatggaaggggtgccgaagcacacaagcttgaggcaactgaaactcatatcaggaagctatcaacaaagataagcattgccattcagattgtcaatactatctcaaaaaacatcaataatctgagagatgacgaactatggccgcaaacatgtgaactgattcaagggttaatgcaaatgtggcatgccatgtcaaaatgccatcagatccaatgccacgccatatcccaagctagaaacttggactctaagctagattctgcaaggttcagtgaagctcacatggacttaatcaagcggctagagcttcagttactggagttgatttctagttttgctacatgggtcaatgctcaaaagagctttgttggcactttaaatgagtggctcaagaggggaattgactatgtgcccgaagttaccgatgacgggactccccccttttctccaggacgcttaggagcgccccccattttcatcatctgtaataattgggcaatcggcacgggaagaatatcggagaaggaagtagtagacaaaatgcaggcttttgcctcaagtgtcctgcacctctgggagaagcacaggttagaatggaggcaaggtatgatggctaacaaagatatggacagggaccttagagtgatggagagggatgaactctcaatgcgcaaggctctcgatgcgcaaagcaagaagcttgtgcttgtttccaatcagagtggcgtgtcgttatctgcgcaggtggttcacgatagtggtccaactgctgaagttggtttgcaatcttgtatgaataaggtctttgaagcaatggagagcttcactgccgcttgtgcgaatgcatacagtgatctccatcttcgctctgaagaagagaagactcgactcggccaaaacaatggcagagttcctagcttcatttcagacttagctggtaagtacatagcaagtaactga

SEQ ID NO: 5982 - DNA, 2289 bp, Oryza sativa
  Predicted polypeptide sequence is orthologous to G1089
atggggtgcgggcagtccaagatcgaccaggaggaggcggtgtgccggtgccgggaccggaggaagctgatggccgacgccgtccaggcgcgcaacgccttcgccgccgcccactccgcctacaccgttctcctcaaaagcaccggcggcgcgctctctgacttcgcccaaggcgagacgcccgacctggtggcctctcacgcccacctcgccgcccccacccaggcggccgcttccgtctccgcgcctcctcccccgtccaccgccgccgtgctcatcgcgccctccccgccgcccccgcccttcctcgacttctcccacgccacactccagcgctcctcttctactccaaacatcccgatgcccgaccctaaggccgccaccaagacccaactcgccgctggcgcatccatccgggaagaggacgaggtggaggatgatgctgacggccatatcagaacagaaagcgaagatgatgatgacgacgacgaagacgacgatagcgatgatgaccaccatgagcacgatgatgtcctcgtggaagaaatggtacacggacagccgcagaagcgggttatgatgggcagcgtggggtcttctccagtaacgccgccacccccaccacggccgaacccatccccgccagccaccaggacaacaccaccacccccaatgcctgagcctcagatggctactacctgggattacttcttcggtccaaccaccacaccgccgcccaccctggagcaacctcctgaggagtcttggatggataagcgggagaaggagtcagtgccggagatgaaggcaccgattatgaaaccagctgttgatggatcagctgctcctatgcatgttgcggaggagcaaccaccacagacagcactggagaaggaaaaggccattgaacagcttgcggcaaaccttcctccatcgaagccacttattagaaagccgcccaaagcggcacctggccctccagcagaagttcgctaccagcatgcctcatctatgggtgcggttgaaactcggaaggggaagacgatgtcaggtactgccagtttgctgcaaattgttgctcagcttgatgattctttcctcaaggcttcagagagtgcacatgacgtgtcaaagaagcttgaggccacccgaatgcattaccactccaaccacgccgacagtcgaggcaagtttgaaactcatgccacagtacttgataggatgcttgcatgggagaagaaattgtatgatgaagtgaaggcaggggaacttatgaaaattgattatcagaagaaggtagccctacttcataaacaaaagaaacgtggtgtgaaactcgaaacccttgagaagactaaggctgctgttagccacttgcacacaaggtacatagtggatatgcaatccatggattcaaccgtctcagaaataaaccgactacgtgataaacagttatacccgaagttagtggaccttgttgatggaatggcaaacatgtggagttctatgcatcatcatcataagtggcagttggttatcatatcaggaataagaaattttgaggctccaccggttccaagagagacaactgatcagcattacaagcagacttgtgacctgcgtgacattgtcagggagtggcacatgcagtttgagaaactcatggaccatcagaaagggtacattagagcactaaatgcatggctcaagcttaacctcatccccatcgaaagcaacttgaaggagaaagtttcgtccccgcctaggctggtggaaccacctataaaagatctgctatatgcctggcatgaccagcttgaaaggcttccaattgaacttgcaaaaactgccatcaaaagttttgctgaagtcataagcaatattgtactacttcaggaagaagaagtcaatctaaggaggaggtgtgaggaaactcgcagggatctcaaccgaaaaaaagcacagtttgaagaatggcaccaaaggtacatggagagaaaggcatcacaaggcgaggatgctaataacagtgaagtggctgaagctgtgaactcagatcctgtcgccgacaggaagacggccatcgaggaagtagagattaggctgagggaagaaatggggcatcacaataggattgccaggcaggttagggagaaatcacttgccaaccttcggatgcacctgccagagctcttcagaaacatgactgattttgctggcttctgctatgaaatgtacagcaatttgagaaaatctgctgtactgcccaaagatgaagtgcaaggctga

SEQ ID NO: 5983 - DNA, 630 bp, Oryza sativa
  Predicted polypeptide sequence is orthologous to G1089
atgaagttaagcatgaaacgacccccgtacaaccgcacttctcgtatggaaacatggacgcctagagtgcatgaggatttaagttcatggatcgggtactgccaatgcgaggttatcgaaaagctttgccgtgacgcgtctcatgtgttgggacgaggctcatgtgttgggcagtcgcggagtgcgggtaaagtgtacatccactgcagtttgttggcctacctggccctaataggggagggtgccgccggctgccggctcccgcccccctcccatccgtccactgccatgctccctgccaccctccgcgcggccacgccgccagccgctgcccgccgacagccaccagcagccaccagccaccagcggcgccctccgcgccggccgccgccgtcccgcccggcctcggccgcctgggcttgctcgggtataggaggaggaggagatggggagggggaggagaggggaaggggagaaggtcggatcggatctgaggaggaggctgagagggagttgtttaatgagagggaggagagagaggaagggggagggataagatcgatactggcacgcgcgcggctcggggtggttttatttttggtccctgttgtttataccaaccgggactga

SEQ ID NO: 5984 - DNA, 2214 bp, Oryza sativa
  Predicted polypeptide sequence is orthologous to G1089
atggggtgcgcgcagtccaatgaggacggcgagggccccgtggcgcggtgccgcgagcggaagcacctcctgcgcgacgccgtcgccgcccgccacgcgctggcgggcgcgcacgcgggccacgccgccgcgctcaagaacgtcggcgccgcgctctccgactacgcctccggcgagggcgaggcccacgccggcggggctctgcggtcggggtcggctgactcttcggccgcggcggcggcgctcgtcacggcgtcctccgatggcaagcccgtgctggctatcctgccgccgccgccgcccgagcttcccccgcctcccccgcccccgccgctgcctccgcatggcgacgttgaggcggcgccgctcgcgaggtcgatgagcgcgccggacctgcacctgcagcagccgatcaagaagaagccgtccggcgaggcgcccatcatggaggaggaggacgacgagggcggcgacggcggcgacgcgggaggacggcgaggtgacgacgacgccgaactgaagccacccccgccgctcccctcgcagcgcccccctccctcccgctccccgcctcccctcccgccggagaatgaccacaaggtggacacccccggcgggttcatcagctccttgttcgactccatgccgccgcccactctggacaccgccgccgccgagccatcgtcttcggcgtcggccgagcggagagaaccaccaccccccgcgccggacgaacaccagccatcggcggcggcgagagaggtggcggagggcaagaggccggccgcggcagaggcggcgacgacgcggcgggcgatgacgcagaaggcggcgaggaaggggaaggcgaaggcggtgatgctggtggcgccgccgcagccgcagccggccaagctgggcgtcggcgacatcctccgcgccctggacgaacacttcctcaaggcgtcgcagagcgcgcacgaggtgtccaagctgctcgaggccgccaggatgcactaccactccaacttcgctgagacgcgaggatttgtggaccattctgccagagtgatgcaagtaatcacttggaatcgctcgtttaaagggatacctcaaccggaaaatgtgaggaatgaaatggacgatgacgaatgggagacacatgctaccactcttgataagctgcttgcatgggagaaaaaactataccatgaagtcaaggattttgaggttatcaggagggaatatcaacaaaagctagctgttctcaacaaaaagaagcagcgtggtgtcacttcttcctcacttgagaagaccaagtcggttgttagtcacttgcacacaaaatatgtagttgatctgcaaacaatggagtcaacagttgcagagatcaaccgtctcagagatcaacaattatacccaaaacttcttgaacttgtgaagggaatgtggcacatgtgggatgcaatgtaccttcatcacaaaacacagctcaagatcatcttggagctcaagtcgttggacatctcggtcgccccgcgggaaacaagcgagcaacaccatgaccggaccgtgcagctgtggaatgttgtacatgagtggcacactcagttcgacaagttcatgacataccagaagcagtatgtgggatccctctacacctggatcaagctgaatgtgatccccatcgacaccaacttgaagccaaattcatcacagccacatgagaccacacctcccatcaagagggtgctgcatgcttggcatgaaatcctcggaaagctccccgatgaggctgccaagaaggcgataaacacgtttgcagagatcgtaaagacaatcctggttcatcaggaagacgaactgaagctccggatgaagatcgaggataccaggagggattatgggaagaagaggaggcaattcgatgactgggcacaaaagtacatccaccaaactgcgggtatccttcctgaggacaggaaccctgacggtgcacgccccgatccgatggcggaacggaaggctgccatggaaaagttggagctttctatgaaggagctggaggagatgtatgtcaagcagtgcagggtggtcagggagaagtccctcagccttctcaggacgaatttgccggagctgttcagagttgtgtcggatttctcacttcagtcagctgggatgttcaagggcgtgtggtcgattgcacacaccaatgaccaactggatgaataa

SEQ ID NO: 5985 - DNA, 1144 bp, Oryza sativa
  Predicted polypeptide sequence is orthologous to G1095
gtgttgcgatggatgcggcggggatggcaggtgcgcccatggcgtcgcccccgccgtacgacaacccgacggctgggttccccatcgcgatcgtgatcgccatcgggttcatggtcacctcgctcatcctcgccagctactacttcctcgtcgtccgctgctggctccgtggcacgggcggcggaggcgccgccggggccgggctgctgcaccgctcgcgccgcgagagcgcggcggagcgcgtcgccgcggtgttcttcaccgactacgaggccgaggttggaggcgggctcgacccggacgtcgtggcggcgctccccgtcgtcaagtaccgccgcgccgcctccgggaagtcggcgtcgccgcaggagtgcgccgtgtgcctgtcggagttcgtccgggacgagcggctcaagctgctgccgagctgctcccacgcgttccacatcgactgcatcgacacgtggctccaccacaacgtcagctgcccgctctgccgcacggtggtcaccggcggcgcgatcggcctcctcgtccgcgacgaccagtatgacgcgtccagccgggaactggccgccggcgagaggcgcatcgacgccgccgcgaggatgggccacgggatcagctcgtgcaggttccccaagaccggggccgagcaggagccgatccggcgatccttctccatggattgcttcctaggcgatctcggccggaagccaccgccgccgccgccgaaggatcccgcaggctcggaggccgggccgagccaccccgacgcggccggtagcagcagtatcgtcggcaccgccggcgccggcgagaccagcggccggtttcggcggttgctgtcgtcgttcgggctcggccggagctcgcggagcacggtgttgcccatccacctcgacccatgaaccacctcgggttcgtgcaacctaattaactcgctcttaccgcttaattaattgagagttactagccatttgtgccacttgtgtgcgtgcaatgtgtacagcagatagcagaattggggttggaattttgccgttccattgattacttcttggctccttgcatctcaagtgttcccgcccggacatgtcaatctttcgtacgtgatcgatcgatattaattagttggtacatc

SEQ ID NO: 5986 - DNA, 1175 bp, Oryza sativa
  Predicted polypeptide sequence is orthologous to G1095
gtctatctagctcagtagctcacctgcttgtgtgcttaagctcgtgtttgcagcaaaccatggatgcagacagggaccccatcttcccggtgcaacagatgccatcactgctgttcccgccaccgccgccacggccattggcactcgactccacttcttcagcatcttcttcttttgtgcctcaccatccatccatcacgagcttcccaatactggtgctcaccgtcctgggcatcctcaccacctccgtcctcctgctcacctactacatctttgtcatccgctgctgcctcaactggaacagcagcagctcctccgacacgcggacggctggcctcatctcccgccgtcgacgcggtgccgcctccagcagcctcccggcagtggccgagccgcgtgggctggaggaggcggccatccaatcattgccggcgttcaggtacaggaaggccatcaaggacactactgctgattccagcaagtgtgcagtgtgtatcagtgagttccaagaagaggagagggtcaggctcctgcccagctgcctccatgtcttccatgttgactgcatcgacacttggctccagggcaacgccaactgtccactctgcagggcagccatagccaccaacgacagccagcttccattggatcagttcgtgagacctgaggtggtagtcattcaggtgatcactggcgcggaagaagaaggtgcacaagcaccacagcaggaggccaatacggcagcttctgatcctgcagtagatgctactagtacaaatcaacaggtcagtagtaagaagacgaagaaccagaatgcatggcatgtcagcatcagtaagggagatgagtgcattgcagtgaggagggacagaaatgttcttccattgaggaggtccttctccatggactcactgggtggtgctggagaggtgcatttgcagattcagaatattctgcagaggagcacccacttccacagggatatcagtgacagcagcagcagcagcactggaacattgtagggattactatgcctgcacattctatggccatgttctatgcgaattcttttggtggtcttgttcaccaatttttcttttctttttctgcaaaatgcaatattacatgtcaatttttctctaatggacacctataacatggtttgtgtgtgtccg

SEQ ID NO: 5987 - DNA, 556 bp, Oryza sativa
  Predicted polypeptide sequence is orthologous to G1100
gcagcactcaacatgcccgttttgtagaatttcattgtgtgactaccctgatagcaagcagacaatgtctcctctaccaagtgaagtgataatacctccatgttcgcctgaaccatcaaggtcagatcaatgcaattgcctgtttgtcggcacggggcattcaccaaggacatctcaggttcttataaatgaacctgaccagtcgaatcggacattatatagtccatcagtggaaggggataacaacttgccatcatctgaagttaatcctcctggtgaaattaacaaccaaacaatgaaaaagcatgtggagaatcatcgtattcaagacagatcatgatctacctagctaagatcctgcaagtgactgttgtgcagtctgctgtcttcagggtaaactacatgtaaaattataagcagcaatacaggtggattcatggatggctgttataggacataggttactttgaaggatgtaaatatgagaaaattgttcaggtttcttgttagaaaacacatttatttgttaatcatattcaagggctcattgcattaa

SEQ ID NO: 5988 - DNA, 2106 bp, Oryza sativa
  Predicted polypeptide sequence is orthologous to G1108, G2394
gggggagaagaaagcgtaagaaaaataaaaggagaaaaaggaatagagaaattggggaagagagctacctcgaatcgaagctgcgatctccacctggtgaaataggagaattgatgaattgctgagatttggtgattagagggacctttgctgctgaggcattgaggtacactaaaagcaagggtgtgaaaaaggcaacttcaattgaaaacatctacatatctaggaatgtcctgaaactaatgtgtggagtaaacttctagtttattgctgtccgtcctgttgggccacagtgcgaaggtcaggcagatagtcatccattactgatgggggactctggaaatgccagtcatcgtgatcacacgatcgacatactgagaaatgatgcaactttcccatcaacatctcatcaggataatcataataacttggatgagttgcaccaaactagagggcctctaaatgatgttcctcatgtcccagaaagttctgctagtgcaactcctgcatctatctcccgaaacgcttcttttgcaagaagagatcaaggacaccgtcaaccaaatcctttgaattctggcttctggatctcaattgagcttattgtaagtttaagccagattatagcagctattactgtcctgtcagtatcaaggaacgagcatcctcatgctcctttggctcagtggcttattggttatacgataggttgtgttgctactcttcctcacctttattggcgatttctccaccgcaatcggcagaacacagagcaagaatcaacaaatcaggtttcatctgaaagggacgtatatgagcctaattcttatgtagtagtttcgtctgctcatggatcagaagttgtggacagtggtaataatggtggagtagcaaggattgcaagtccaagggtctacgcattggttgcgtgcttcaaattggctctggattgtttctttgctgtgtggtttgttgttgggaatgtgtggatattcgggggccgtacttctctccatgacgctcctaacttgtacaggctgtgcatagtattccttgcattcggcttcatcggctatgccctgcctttcatcctatgtacaatgatatgctgctgcctaccctgcattatctccatgatgggcatccacgaggatttggattttaacagaggcgctactgcagaagcaatcgatgccttggtggcatacaagttccaatcgaaaaagtttcaagatggagaagcgggagaagataatggtggagtattggcagctggaacagacaaagagcgaactatttctgcagaagacgctgtatgctgcatctgcttgtcaaagttctcaaacaacgaagatctacgggagcttccctgcaatcatgttttccacttggaatgcgtcgataaatggctcaagataaacgcactgtgccctctttgcaaggctgacttaggcggctcgacgaatgctccggactcgagctccaggagcagccatgacagcaacaacagcagagtcaggaacgacgtcgagtcacaacagtagctgctctcatgccctttcccatgagcatggggatggaacacattcttgacaatctacaaattggcatgcaacttctcaagtcccttttttttcagacagacttgaatagagcatttgcctacactgctctctggtgttaacccagaaactcctatgaggctgaggctatggctatgagttgctgcctgcagtttgttctgaactgaagttgcctgtaaggctgtaacagattatagatggtgttggaatagttatcatgatgatcacctgagttgagcatattaggttgttgaggttaaccttcaaccggggaggttcaatgtaattatctccttgtttaggaaaaaatcccctcccctttgtatctgctcccttgtatagaaaacaaccatctccattgtatatcagatcaattttgcctgcattttgtaaattcagttagtaggcagagatctcccagcactcatcaagtgcttgagcaagtacagattagcagttgagtttattctactgtaatgcaacacttatagatgatattaccatgacataatcatttgagccc

SEQ ID NO: 5989 - DNA, 1869 bp, Oryza sativa
  Predicted polypeptide sequence is orthologous to G1108, G2394
gaggagtcaagtcgccgacttttggagttctcctcgccccagctcggtaaattccttcgctttttctccgctggttcggagatttccatgttcacttttgtttttttttttaattaagggctttgctttgatggaagggttgggtactggttccttccctccggatcaatcttgcttcttgcgctcacccaacctagtaattttttcctctcccgatttgtttaatgctaatctaggtggttgatgatgcttgcgagccaggcattgattcggctttaagcttgcctgcttgcttcgccgtcttgttctttgagttcttggttttcatggatccttgatccgatttaggggttgctgctgctagccgtggttggtgagacggttcttggagaagggggatttcttgaggtgcttttctgggaggtgtaaccaactaaattcctatgctaccttctggttgatggccgtccctcctgttgaatcagaaacaagaagtgaagaaacagataatttccctttacttgcagaccacatggaaaatactggacatcatgcacatgcagttgatatcccatgggattcttcaccatcgacatctcgccgagataatcataatggatttgatcaattacctcgtatcttagaaggttctcctgggacatctactccatctaactctcagaatggtcctctagcaagaagagatgataatcgtggtcgtcgtcagcctagtcccttgaattctggttgctggatctcagttgagctagttgtaaatgttagccagatcatagcagctatttgtgttctgtcagtatcaaggaatgagcatccacactctccgttatttgagtgggtcattggttatacagtaggttgtactgccacgctgcctcatctttactggcgctatctccatcgcaacctcccaaccactgggcaagagccaacagttcagaatatccctccaaacaacacccctgaagctaattcatatggagtaaccggcacaaatggagtctcaagaaacaatgaggcaacagtaaatccaaggttccaagcttttgctgatcacttcaaaatggctctggactgtttctttgctgtgtggttcgttgtgggaaatgtatgggtatttggtggacattcttctgctcacgacgcgcccaacttgtacaggttgtgtattgccttcctcacattcagctgcatcggctatgctatgcctttcatcctctgcgcattgatatgttgctgcctaccctgcataatctctatcttgggatttcgggaagatctaaaccaaaacagaggagctagtgcggaaacaatcaatgccttgggaacatgcaagttcaagtcaaagaaaactcgtgatggagatggaaacgaagttggtgtcggtgttgtggctgctggaacaaacaaggagcgagtcatttctgcagaagatgctgtctgctgcatctgcttggccagatatgtcgataacgatgatctccgagagctcccttgtgcgcacttcttccacaaggattgtgtggacaaatggctcaagataaacgcgctgtgccccctttgcaaggctgagatagatggtgtctccacaagtgctccagccattggctttgggcgtcgccacagcgacaacagggtaggaaacgacattgaatcacaactataactctcttcccacttcgttggcagcgtggatcacgcctttgatgaggccttccacacatcaacctgtaaattatagaggtagacatcaagatgtaaagggtcctcttacgatccaacaaagttcttttctgaatgactactgcctccactgtcagtatatattgcttccagcatttgtttcttctc

SEQ ID NO: 5990 - DNA, 2001 bp, Oryza sativa
  Predicted polypeptide sequence is orthologous to G1108, G2394
ggctttcgcgagagagggacacctgctctgcttccgcttccgcttccccctctcgagtctctcgcctctcccccgtggccaacccacacaccgcgggttggaggaggaggaggaggaggtaggggaaatccccgtcggccgtcggctcggcgccgaatcgatccgcttaggcttcttctgctgggctcttccatgaagcaaatgaagtttataatgcacatactaatgttcagtatattatactgagaatcaactttattctcagctgtatatacactagtatgccagccattggtagctacttgaaaggatggtgaaacgcatatgattacccatgatgagcatgtgtgttccctttttttattagtgctaagctggaaatcaataaatccaagatattcatggagcatgctacctgtgatgatgtgcatgagcatgctataaatgtatcacatggagaaactgcatcaacatcaaccagtcatcaagatttgcacagtgattcagatgattcacatcaggatgataggccttcaacaagcacacaaaccccatcaccacagtcttcagcatcaacttcgcccactgcatataacaccagaaatttatcctttcctagaagagatagtatgtatggtcatggaagaagtatttggaattctggtttgtggatctcgtttgaactggtcatatatgtagtacagattgtagctgctattttcgtccttgtcttttcaagagacgaacatccgcatgcccctttatttgcatggataattggttacacaattggctgcattgcaagcattcctcttatttgttggcgctgtgcccatcgaaacagaccttcggaacaagaacctgaacaaccacccgcagcctatcctaatttgacttcctctcaatcatcagaaggacgcaatcagcgtagcagtggtactgttttgcattttggatgtatcacaatttcgtgtccaaggcctagcatattggcttatcatttcaagacagctgtagactgtttctttgctgtatggtttgttgttggcaatgtgtggatttttggtgggcacagcactttgtcagattctcaggaagctcccaatatgtataggctatgcttagcattccttgcacttagttgtgttgggtatgctattcccttcgtcatgtgtgcagccatatgctgctgctttccatgcttaatttctcttctgcgccttcaagaggatttgggtcatactagaggagctactcaagaactaattgatgcactgccaacctacaaattcaagccaaaacgaagcaaaatgtgggttgaccatgcttcaagctcagagaatcttagcgagggtggcatcctgggcccaggaactaaaaaggaaaggattgtttcagctgaagatgctgtgtgctgcatctgtcttactaagtacggagatgatgatgagctccgtgagcttccttgcacccacttctttcatgtgcaatgtgtcgataaatggctcaagataaatgcagtgtgcccactctgcaagaccgagattgggggtgtggttcgatcattttttagcttgccctttggtcgccgacgtgttgataggatggcaggaagaggtatagctagctcgagattcactgtatagaacacgtcttcttctctagcatgtttgcttgtttcatctgctcatatgcacataaaagacgtgctcatggattgtagtttgttgatttgcaatgaaagcgataatctgctttcatcacccttgagttcaccaaagtgatgacagaaaagtggagacctgatgcttgcagtgacaagtttctgcagtacagtagaaacataagtatattctgatgtaacatttgatgtcaagattgtaaataaagagcacaaagttcacttcgggggtgtatatctgcatgtgtatgggaaaggaaagcctaattagttagtaactttgtaggcattttattgtgtgcaatcattgatcttgtttt

SEQ ID NO: 5991 - DNA, 1504 bp, Oryza sativa
  Predicted polypeptide sequence is orthologous to G1108, G2394
gtagaatcgtagataattcctgcactcagttttgagaaaactggaggtctcagaaatttagcagcttgcttctttctttgttgcatctaagaattgatgacctcagccttcaacgttacttgaaattcaaggtcataccgatatgcacgcttcgaggatggaacaaactacaggtgttagtggccatgagcacataattgatattccaagggacagtggtccatctacttcgacttcccatagtgttgctagagaaaaccatggagaaccaaatcctgttgatagatctgcaaccagagcgctagtacctgctttgcaggcaccatcagcagttggtgcacctatgttcgccggcacagaagccctttgaattctggactctggatttcaatagaagttcttgtcaatgtgagccaaattgtagctgctattgttgtgctttctctttcaagaaaggaacatccgcaagctccattatttgagtgggtcataggttatacagttggttgttttgctacactaccccatctttattggcgctatatacaccgcaatattgtcaatggtgaaaatgagccagcacatacacttcaaggctcctctcagaacaattcaactgagccttctgctagtgcatcagagcgtcgaaggaatgctgcacgaaatgcagtgctcgctaatccaaggattaatgctctttttgaccacttcaagatggccttggattgtttctttgctgtgtggtttgtcgtaggaaatgtgtggatatttggcgggcgttcttctgctgccgatgctccaaacttgtacaggttatgtattgtgttccttacctttagttgtattgggtatgccatgcctttcatcctctgtgcaatgatatgctgctgcctgccctgcatcatatctgttatgggatttagagaagatacaaacaatacaagaggggctacctcagaatccatcaattctcttccaacatacaaattcaaaaccaagaaacgccgtcatagttcaggaaatgaagctgaaggccaagatggtgggatagtagctgcagggactgacaaggagcggtcactatctgctgaggatgctgtttgttgcatctgtcttgcaaagtatgcacacaatgatgagcttcgtgaacttccctgcacacattgtttccacaaggaatgtgttgataaatggctgaagattaatgcactttgcccattgtgcaaatctgagatagcgagctcatctggaacatctgatactcgtcgctctgaccacacagatattcctgtgcaggagattgaaatgcattagggtgatctgctttctgaggtaatacggcagaatacagttacttgtggtgaccgtgtgcttgtataaagttcaagctttgatatgtggattgtaatgatgcatggggttatttttgttgctgttattttggagaagacagttctcactgtcaacatacacgaggaaatatacaatatctactcgttccatc

SEQ ID NO: 5992 - DNA, 1109 bp, Oryza sativa
  Predicted polypeptide sequence is orthologous to G1128
gggccgccaccacgccttccgtcctgcgctcttgccgctgccgctgttgacccggttgctgccgccgtatttgcgccgccgccatggccatacccggaggccgcagccgtcgtcatccatcacaaccggcgttttctttccgttttccttcttcccgagagaagggtaccgagagggtgtacaggaggaagaaggaaaggaaaagcagagcaacgttgaggaatttcagcgatttcgcaaattagggaaatttgtcgcaagctatgccgcctcggatagccaatcgaggccgtgggagaggcggtggtagaggtcgtggtaggggccaccataatgaagaagttgagaataatcatgataatgaagacgttgggaacaattcgattgctgaatccactattcctaatcgtggaggttgttggcggttgttaaatgccgattctataccgccaacatctgcataagttcggataataaaacatccaacatagtgataggtgcttaatctcacatattccacaagtgttggtgtatatttgtatgcagatgataaaccctgaagttgggaggaaaatcagacaaagtgaggagaattatgtatccatgcaaggaggggttatgaacttcatcgaaacatcagcaaggaggggttatgaacttcatcgaaacatcagtgaatcaactcaaaactccgagaaatggataaaggaggtccaggggagaagatgggccaagggctagaccaggagggcctagcctaggttcggccgaacccccctgatcaccgttgatcctggggtttggcgtggacgctccagatcactccccaatgacggttgcggggcagttcagacattaccccttcgccaaccgtcatacctaactctatataaaggcttcactccctcatttcacacacacactttcaagcttgacctgaattataagaggctctattgtactatattgtatattagaataggaagagagtagagtaggagtcagaagaattccggagttgtcggtaatcttctcctatttcttttattttgtttattactctgaattcaatataatattcttcttgagtaatttagatttgtcttgtg

SEQ ID NO: 5993 - DNA, 2512 bp, Oryza sativa
  Predicted polypeptide sequence is orthologous to G1133, G1137
gatttccgtccgagggggccgataagagaagccgcgccgcggcgcacgctctcgctgtctctctctctctctctctctctcgtcctcgtctcggtctcgccgtgcggctctctctcgtgagcaacagcacgcgccgcggtcggcctccccttcaattccttcggctttggcccgggcgggtgtgtgagtgctcagctcctatcgccgattcgtcgtcctcctcctcctcatcctgctcgatctggtaattctagtgttgagggtctgaggagctgaaactagcacgggtaccctggcagcatgcggtggctggctctctcggtagacatcttccgcaaagggatctccttgaacctgtactgccgggttattctgtaaattgcctccattattgctctactccaatcctgatcttctagtctctgaagtttgggattgaagatctggttgctggcattgctgtttgggtttctgtggttgcctggcaattctttcaaggagaacgggcaggagtactaatggtgtggcaaccggtggctcagacgagattccgcgtgtttaaacatgagaatggaatcgctgtgagagttatagcttgcttccagccatcccaagattgccaggccgagtacttccgccatcttcttaagcccgtgacgtagttcgactccctcccttccatttgctgttgaatagaacctgtgctgctctaagtttttctgaagcaaaagtaaagcaggagaatttcctgttcatctcaattttctggtgatcctgtttgctggttgtttcttgatgggggagaaggttaatccctggtgccattggtctaatcccccatggaccgagagctctgcaaacaatctccacccacccgatgttagcctcgacaacacaaattcagtggcgttgccaacatatctgaacagcgatggctacatttattctggagttgctgcatctatgccgtctattgcagcatcagttactgacagacctgtttcattctcttctagatttgtcacaacattggtacccagtgtaggcttatcaacagctgagacactgagaaagagacctctggttttctttcataatgtgaataataccttcactgtaggtcctctcctgagcaaggggacattggatacagttccagagctccaaggtagcaatgagaccaatgtaactgatgttggagcacaaaatactgagtgtatgcatgagaatactgaggagattgatgcactcctgtgttccgactcagatgaagggtgcttgaaagtgcaagaactcaacaacagagtcaggaaatacccaatgcagaatgacaccatgagtgtggagtcggtagcaagcgctggtgcttcccaaccagcaaagaaaagaagactaagctctggtaccgacagatctgtggttgacacagccagctcagcaaggcctgaccactccgttgatcagaaacatctcagccatgacgacgacgcacagtcgtgttgtattggtgaagtggaaagcgatcaccagtttgctctgagggaaggtgaagaagcagaaggtgatgatggccccgatgatcggaagcggagaagagagaggatccaagagactgttgctgcactcagaaagatagttcctggaggcattgccaaagatgccacagccgttcttgatgaagcgatatgctatctcaagtatctaaagctcaaggtcaagacactgggagctgtttccctctagctcctcgatcgatgacggttctgttctggttcctgaacccaatacctatccctctctccatatatacaagtaatgagctaaaactatagcagcaataaggtgaaatgaaactcagtcagttccattcggtgattctgaggactactggagtgaaagctcaatggtgctttgcttacaagggtccaatgatttgagtggttacaatgaagattcagtattgcagtatattactagtgaatcaccgaccactgcaccttcatccatccatccactgatggagagtactacctagcagcaagccggtgtcacatctttcttctgggtcagttcagtgcagtgcctcttggtaggcacctcctccctctcataaaaaaaggctctcatggcgttgatggcgcaataagtaaaacagggaggctaagctataaagatcttttttctcccctccattgtggtgtgatccaaagcaaaggaaggaaggaggaatgaatgaatgaagtccatgcaaagtgcagtgctggtggcctggtgctgcatgcgtcgatggctttttgacccccaaaggttgagagatgagatggcggggccgcgcccgaggttagttcgggctccttgtgtgtgtttgtatggtggcgtgtgtagctagcagagtgtgcgtgatggcgtcgtccctcgcgctttttctgcctttctactagtactatacatatatgctactgtatactgtactcctatgtatgaatactgcatgtgtttgtgtttgtgtttg

SEQ ID NO: 5994 - DNA, 2423 bp, Oryza sativa
  Predicted polypeptide sequence is orthologous to G1133, G1137
ctcgccgtgcggctctctctcgtgagcaacagcacgcgccgcggtcggcctccccttcaattccttcggctttggcccgggcgggtgtgtgagtgctcagctcctatcgccgattcgtcgtcctcctcctcctcatcctgctcgatctggtaattctagtgttgagggtctgaggagctgaaactagcacgggtaccctggcagcatgcggtggctggctctctcggtagacatcttccgcaaagggatctccttgaacctgtactgccgggttattctgtaaattgcctccattattgctctactccaatcctgatcttctagtctctgaagtttgggattgaagatctggttgctggcattgctgtttgggtttctgtggttgcctggcaattctttcaaggagaacgggcaggagtactaatggtgtggcaaccggtggctcagacgagattccgcgtgtttaaacatgagaatggaatcgctgtgagagttatagcttgcttccagccatcccaagattgccaggccgagtacttccgccatcttcttaagcccgtgacgtagttcgactccctcccttccatttgctgttgaatagaacctgtgctgctctaagtttttctgaagcaaaagtaaagcaggagaatttcctgttcatctcaattttctggtgaagatcctgtttgctggttgtttcttgatgggggagaaggttaatccctggtgccattggtctaatcccccatggaccgagagctctgcaaacaatctccacccacccgatgttagcctcgacaacacaaattcagtggcgttgccaacatatctgaacagcgatggctacatttattctggagttgctgcatctatgccgtctattgcagcatcagttactgacagacctgtttcattctcttctagatttgtcacaacattggtacccagtgtaggcttatcaacagctgagacactgagaaagagacctctggttttctttcataatgtgaataataccttcactgtaggtcctctcctgagcaaggggacattggatacagttccagagctccaaggtagcaatgagaccaatgtaactgatgttggagcacaaaatactgagtgtatgcatgagaatactgaggagattgatgcactcctgtgttccgactcagatgaagggtgcttgaaagtgcaagaactcaacaacagagtcaggaaatacccaatgcagaatgacaccatgagtgtggagtcggtagcaagcgctggtgcttcccaaccagcaaagaaaagaagactaagctctggtaccgacagatctgtggttgacacagccagctcagcaaggcctgaccactccgttgatcagaaacatctcagccatgacgacgacgcacagtcgtgttgtattggtgaagtggaaagcgatcaccagtttgctctgagggaaggtgaagaagcagaaggtgatgatggccccgatgatcggaagcggagaagagagaggatccaagagactgttgctgcactcagaaagatagttcctggaggcattgccaaagatgccacagccgttcttgatgaagcgatatgctatctcaagtatctaaagctcaaggtcaagacactgggagctgtttccctctagctcctcgatcgatgacggttctgttctggttcctgaacccaatacctatccctctctccatatatacaagtaatgagctaaaactatagcagcaataaggtgaaatgaaactcagtcagttccattcggtgattctgaggactactggagtgaaagctcaatggtgctttgcttacaagggtccaatgatttgagtggttacaatgaagattcagtattgcagtatattactagtgaatcaccgaccactgcaccttcatccatccatccactgatggagagtactacctagcagcaagccggtgtcacatctttcttctgggtcagttcagtgcagtgcctcttggtaggcacctcctccctctcataaaaaaaggctctcatggcgttgatggcgcaataagtaaaacagggaggctaagctataaagatcttttttctcccctccattgtggtgtgatccaaagcaaaggaaggaaggaggaatgaatgaatgaagtccatgcaaagtgcagtgctggtggcctggtgctgcatgcgtcgatggctttttgacccccaaaggttgagagatgagatggcggggccgcgcccgaggttagttcgggctccttgtgtgtgtttgtatggtggcgtgtgtagctagcagagtgtgcgtgatggcgtcgtccctcgcgctttttctgcctttctactagtactatacatatatgctactgtatactgtactcctatgtatgaatactgcatgtgtttgtgtttgtgtttgatc

SEQ ID NO: 5995 - DNA, 653 bp, Oryza sativa
  misc_feature (644)..(644): n is a, c, g, or t
  Predicted polypeptide sequence is orthologous to G1142
gggacaaagctgggtaccgggccccccctcgagtttttttctttttttttttttttgggcttaattagttgggtaagtctgcaaaccttgcatatattggggatgctgacattgttattcagtggctgggtttgcattggctttggaacagcttttggtgaaagctcaagcaaaccctaatggtaatatatatcctacttaatcatatatggcatatcaattggcaatattggtatcaccatgaagagccatatatatatggagatggcaactaattagcacacaaaaactaagtaaaacatggcaagcaaaatacgtagtatagtataccaagcaaactgatagctatgttgagctatggccgccggctaggctgcagcttgcatgttcatgtcggagacgacgcgcctcctcttcggccggtcgccggcggcggcgcccggccgctccacaagagccctcagggcttcctttaggaagtcgccgccgtcgttggagacggccgaataaccggcgcggtcgtcgtcgccgtcgccgccctcgccggcgccgccggcgtcgcgcgccaggacgagcacgttgcggacgcggccgccgagggtggccatctccgcgcggagcgtgcggaggcggaacgcgcgcancgtctcgat

SEQ ID NO: 5996 - DNA, 837 bp, Oryza sativa
  Predicted polypeptide sequence is orthologous to G1142
atgtggctaaactgtctaccgtcactgctgaaacgatcgcatccctgcgtgtttcgtccgcgtcatccaaacgcatccgtttccatctaccgtctagattccgaccctcgggcgcattgtttcatgaatccaagtactccacgatcattagcatcaccggtctccacgccaccaacgatgcatgtagtttatcgcatatattcaactggttcatggaaatgcagttggaaggcctataacccttatgtgacctacaagcacccttatgcaggacatgtcaacttatttcttaagcaacgtatatcatggattctagatgaacatatgcttaaccatcagggccggccctggggggtcagccgtgcgcaggcccgaggccctcaaaatccaggggcccacatggctgatgggccatggcccatggcgaagacggaagacgaagaggagcgaaggaaaggctggaaagcgaagcgatttgactcctgttcccatcgccttgatcacgcctcctgcgtagcctcgatcacgccactggtcaatcactcatcgctgcaaacgctgcgtcgcaaggatcaatctgagttgcaaaaacccagcaggcaagatcgaccggacgagatcctccgcctcgcggattatcacgctgctgggttgagctctcgcctagtcgcctctcggcgtctggcgtcgcaaggagtcgagccgtcgaggccatcaggccaaccgcccggcggcggcggcgcggcgcgccctcatcggccaatcgacggctcggcggcgccaggtgcctataggctgcagcctgctgccctgctcctcgagatcaaaaattattag

SEQ ID NO: 5997 - DNA, 1307 bp, Oryza sativa
  Predicted polypeptide sequence is orthologous to G1142
ctcgccctcgccttcctcctcctcgccgttgatcgatcgatctcctgctcgatctcttgtgccctagctacgatcaccaactagcttcaagcttcctctcccagcagctgcagcggcagctagccagcgatcgatcgatcgatcgagctacacgtgagatcgagtgcgtgcagtagtgtgtggtgtgcatgtttccggtggaggtggcggcggcggcggcggcggcggggaggatgcaaggggaggcggtggtgccgatgatgctgccgcccttcttcatggactcggggatctggccggcggcggcgggggtcgtggatgtcgccgcgtcggcggaggaagaggcggcggcggcggcggcggcggcgcaggaccgcgcgctggcggcgtcgcgcaaccaccgcgaggccgagaagcgccgccgcgagcggatcaagtcgcacctcgaccgcctccgcgccgtcctcgcatgcgaccccaagatagacaaggcgtcgctgctggcgaaggcggtggagagggtgcgcgacctgaagcagcggatggccggcatcggcgaggcggcgccggcgcacctgttcccgacggagcacgacgagatcgtggtgctcgcgtcgggcggcggcggcgtcggcggcgccggcggcgcggcggcggtgttcgaggcctccgtctgctgcgacgaccgctgcgacctcctcccggagctcatcgagacgctgcgcgcgctccgcctccgcacgctccgcgccgagatggccaccctcggcggccgcgtccgcaacgtgctcgtcctggcgcgcgacgccggcggcgccggcgagggcggcgacggcgacgacgaccgcgccggttactcggccgtctccaacgacggcggcgacttcctaaaggaagccctgagggctcttgtggagcggccgggcgccgccgccggcgaccggccgaagaggaggcgcgtcgtctccgacatgaacatgcaagctgcagcctagccggcggccatagctcaacatagctatcagtttgcttggtatactatactacgtattttgcttgccatgttttacttagtttttgtgtgctaattagttgccatctccatatatatatggctcttcatggtgataccaatattgccaattgatatgccatatatgattaagtaggatatatattaccattagggtttgcttgagctttcaccaaaagctgttccaaagccaatgcaaacccagccactgaataacaatgtcagcatccccaatatatgcaaggtttgcagacttacccaactaattaagcac

SEQ ID NO: 5998 - DNA, 1258 bp, Oryza sativa
  Predicted polypeptide sequence is orthologous to G1145
atcagctagcaaagcaaagcattttctcagctcaagttgcttgctcctcttctttctttcttcctcctccccttccctttcaggactcctccccccacatcagtagctttcactgcccaaaccctctttgtgggtggcaaccctagattattaatgtcctcctcctcatcatcaccatctcctcctcttcttcctcccctgcttctctctccagattctcttcatctggtcccttccttcccctgctttgcttgctcagctagctgatcgcacgtgggtagggtgagtgtgtgtgcgtgtgtggatgggagtccacgcaatgtcgtgccacggcggcggcggcggtggcggcgaaggggcactgtcgcggcaggggtcggtgtacagcctgacgctgaacgaggtggagagccacctgggcgagccgctgcggagcatgaacctggacgacctcctgcgcacggtgctccccgccgcggcggcggcggcggagacggcggggaggaagacggtggacgaggtgtggcgcgacatccagggcgccagcaccggccggcaccacgcgacgcccatgggcgagatgacgctcgaggacttcctctcgcgcgccggcgtcgccgtcgacggtgccgcctccgccgccggcgcgcattggctgcgtgggcactacccgccgccgccgccgccgacgacgacgacgctgcagtacgtgggcggctccggggcggtggtggacggcgtgtataaccgcgtggacgggcacggcgtcgcggggttcctctcgcaggtgggcgtggcggggcggaagcgcggcggcggcgtggacggcgtggtggagaagacggtggagcggaggcagaagcgcatgatcaagaaccgcgagtcggcggcgcggtcccgagcacggaagcaggcatacacgaacgagctcgagaacaagatctcgcggttggaggaggagaaccagcgcctcagggagcacaaggctgttgctgatttctcaacattccctagctgcgtcgatttcctgaaagcattcttgacgcagaagctggaaccagtaatgcagattgtgccccagccggagccgaagcagcagctgcgacgaactacttcggcctctttctaatcaaccaaccacaatgttcatagcgaaatgatttaaactcgatctctgtaggaaaatcaatgggggtttgtacttggggatgctggctgttgtgaacaagagctgaaacgacgaactcttttcttaact

SEQ ID NO: 5999 - DNA, 1593 bp, Oryza sativa
  Predicted polypeptide sequence is orthologous to G1145
acgtagcagtagctactactcgatcgatctatcgatccgattaatagtgccatgaaatatctctccatttgtggcagtaaattaagtactagctaagttagctaatgacactgttggtacttaaaggcttaaaagctagcagctgttgagctagctgtctcatgaagctagcttaattaagtctgatttatatatatatatatatgtagacatccagagagagagagagagagagagagagagagccagagacaagcttagcaacaacaaccaaaagcaaggagcactaactgcagctgttggcgatcgaattaaggatcctgcagctacaagcaagaaggtgcaggtgcagggtgcggccatggcgaactaccaccaccaggagtactaccagatggcggcggcggcagcggtggcgtggccgagggagccggacagcccgcagctgagcatcatgagcggctgcagctccctcttctccatctccaccctgagggacgacgacgacggcggcggcgtccgcctcgccggcgccgcgctgcccgccacgccggtgtcgctcgccgggatcgccggcggcgccagtacccccggcggcgacggggtggacatggaggtgcggcagcagagcggcggcagcggcgacgaccggaggaccatccggatgatgaggaaccgggagtccgcgcttcgctccagggcgcgcaagagggcgtacgttgaagagctagagaaagaggttcgccggctggtggatgacaacttgaatctcaagaagcagtgcaaagagctgaaacaagaggttgctgcactggtgatgcctacaaagagctcactgcgacgaacttcatcaactcaattctgaaggtcgaccaaaacaagcaagattatctgacgatacaaaatcattagaaagatctaaattatgtgtatttgcaatccggtgtgcgtttgtgcaggggtcaggcatgagagaggatattgtgtgtaggtgatcgatggatgctatgaactacctctgcagttagaaatgtgttagatcttgtctctgcaaagatgaacaccttttcttacttgttcaactcgatcagcatgcagtatcctgttcaatttttttccccttcagccattcagaaattcagaagtggctatcatgctttaattttgtttcaatcagtagtagtatttgttatctttgagggacagatgggcttgtctcttgtcagcattcaccttagctttacctcttactagtatattttatcactgagtgcgtttatgctcatagggcatatatatcttatgttggatataagtttttttttttttgtcttgtttagttaaactgaagatgcatggccgactgaacatgagaaaaatatcatttcgtttggaatgtcatggaaagcactttctgaatggctaacaggatataataaatatcagctctcacctttgtccactattgatagaaaaggaaaggcaagaagattgccttaattaacctaattgtcatcaaatcaaagtggccggcttatcgagaacctagctttgtctagaaactttgccttgaaatgaattgaaaaatcatgc

SEQ ID NO: 6000 - DNA, 1730 bp, Oryza sativa
  Predicted polypeptide sequence is orthologous to G1145
acatgccccatttccacccctcctatttcctctctttcacgcatctcgactccatctcactctcccccctccctcctctctcgctcgctgcgatctgcactgctactccggtaggtctcctcccccccccccttcctcgcgcggccgcggccaccgccggcgagaagcccgccgcggcggcgctgaccccctccgcctcttcccgcgcgcggccccgccagccggccaccgtctcgggtcaaatcgaatcgaatcgaatccaaagaggaaaatctggggttcagttgaaccctaatgcccccaggttaggtcagcctcgctgggtatcgcggctgctgaggttacttggagaggggtagggtggaatcctcgggggctgatttggtgtaattgagagcgccgattcatgattcaggcaatggcttcgcatgctggaggtagtggcggcggcggcggtggaagtggccgggatgctggctcggcgcagcgcgggccgatgcaggggttggcgaggcaagggtcgctgtatgggcttacactcaatgaggttcagagccagttgggggagccgttgcttagtatgaaccttgatgagctgcttaaaagcgtgtttcctgatggcgcggaccttgacggtggcggtggcggtggcggcatcgcgggccagtctcagccggccctggggctgcagcgccaggggagcatcacgatgcctccggagctgagcaagaagacggtggatgaggtgtggaagggcatccaggatgtgccgaagaggggtgctgaggagggtggccggtggaggcgggagaggcagccgaccctgggggagatgacgcttgaggatttcctggtcaaagctggggttgtcacggatccgaacgatttgccaggaaacatggatgtggtagggggcgctgctgcggctgcagctggtacgtctgatttgaatgccggagcacagtggctacagcagtatcaccagcaggctttggagccccagcatccaagcataggtgctccttacatggcaactcacctggcacctcagccattagctgttgctacaggtgctgttttggatccaatttactccgatggccagatcacttcgccaatgctcggggctctttctgatcctcagacacctgggcgcaaacgctgtgccacaggggagattgcagataagctagtagaaagaaggcagaagaggatgataaaaaacagggaatcagctgccaggtcaagagcgaggaagcaggcttacactaatgagcttgaaaacaaagttcttcgtctagaagaggagaatgagaggctaaagaagcagaaggagttggatgagatactgaactccgcgcctcccccggaacccaagtatcaactcaggcgaacaagctcggccgccttctgatggtgacgatgtccatagtaaattttgtagattatatggggtctgcccacatatttcgcatcctttggcggtaggaacaatcgatatagcttgagattccatcttccccctccagccggtggtggtttagagcttgtaaacaccagcaccagcagagccctagccatgtcgccccagctgctgatctcttcggaggctttgtcacttgtcagtatgtaaattctccaaggcacgtgtcgctgttaagttctcagagctccttggttatacatgattgggccctttgcctgtttcttgtggttggttgatacttagt

SEQ ID NO: 6001 - DNA, 933 bp, Oryza sativa
  Predicted polypeptide sequence is orthologous to G1145
atggcgtcgaaggccggaggcgggggcgtcgcgcggcgcggaggagggcggatgcggagtctggggaggcagggatccatgtacagcctcaccctcgacgaggtgcagagccagctgggcgagccgctgcacagcatgaacctcgacgagctgctccggagcgtgttccctgacggcctggccatcgccgacggtgccggtgccaccaccagtagccagcagcatcagccgggctcgggcctcctgcggcaggggagcatcacgatgccgcctgagctcagcaagaagacggtggacgaggtgtggaaggggatccaggctgctccgaagaggaatgccgaaacgggcggcggcggcggcggaggtcgacggcggcgagagaggcagccgacgcttggggaggtgacgctcgaggatttcctggtcaaagctggggttgtcacccaaggatctctcaaggagcttagtgatgtaggcaatgtggatccggttggaagaggtgttacagcaaccgggactgtggatctggcacctggatcacactggatagagcagtataagcagcagattgcatctactgatgctcatcaccatgggcagcaaggtgtgcagggtgcttattttccgaatcgattggtccctcagccacttaatgttggccccggtgctattctggagccatcctactctgatggccagacttcttcaggaatgatcggcggaatgtccgattcgcagacgcctggaaggaagcgaggcatgtcaggggatgtggcagataagttgatggagagaaggcagaagaggatgatcaagaacagggagtcagctgcccgttcaagagccaggaagcaggcctacactaatgaacttgaaaacaaggtttctcgtttagaagaggagaatgtgaggctaaagaggcaaaaggagtga

SEQ ID NO: 6002 - DNA, 804 bp, Oryza sativa
  Predicted polypeptide sequence is orthologous to G1146
gggaaaaggttgtgctggtgcaagatgcgactctccagggtgtctttgatgctctgaagaaggcttgtgcttctgcatgatgtatgttaaatgtgcatatgtgaaaactactcacttaactgaatagaaagagtgtcaacttaactagtgcccttttatctgtacaactctgtcctgcaatgaaccctgtaaacggttaattaaaaaaaaaaaaaaaaaactcgaggaagcatgtttttaagatgagcaaacagtatttagcaaacgttgcccttaaaatcaatgttaaggtgggaggaagaaatacagtacttgttgatgctttgacaaggaggattccccttgtgagtgataggccaacgatcatttttggtgctgatgttacacatccccatcctggagaagattctagcccttccattgcagctgttgttgcttctcaagactggcctgaggtcaccaaatatgccggattagtgagtgcacaggcccatcgtcaggaattgatacaggatctttttaaagtatggaaagatcctcaaagaggaactgtaagtggtggaatgatcagagagcttctcatttctttcaggagggcaactggacagaaaccccagaggattatattttacagggatggtgtcagtgaaggacagttttattaggttctgttttatgagcttgttgcctttagaaaggcatgtgccattttgaagccgattataagccccccgtaaccttggggggggccaaaacctaatacacaggctggttgctatacccaaggaccacgactggggcaga

SEQ ID NO: 6003 - DNA, 3548 bp, Oryza sativa
  misc_feature (7)..(7): n is a, c, g, or t
  misc_feature (26)..(26): n is a, c, g, or t
  misc_feature (28)..(28): n is a, c, g, or t
  misc_feature (33)..(33): n is a, c, g, or t
  misc_feature (42)..(42): n is a, c, g, or t
  misc_feature (3362)..(3362): n is a, c, g, or t
  Predicted polypeptide sequence is orthologous to G1146
tttcganccctttgaacccgtttaanangaccnactataggncgaattgggtaccgggccctgcagtagttgcatcagtgacgaagggttctaatgcctttctgtcccgcctcgcattaattctttggcttggttggatgcgagagaaaaaagaggagagattttggtagaattgtaagatttttgttactactaccactcgttttcttggcttggtttggtttggtgtttgatcacgcggtggtgacattataagggcgcggttgcgcaggtgttcgaccagcgggtggcgaggtcggcggcgaggtggtggtggtgcgcacatgctcgaggtgctggacatggcgccgccccggcaccagccggcagctgggaaggcgggcggcgggcgcgggcatgggcatgggcatgggcatggtggtggtggtggtgggccggcggcgaggaagcagccgttgcagagtagcatggcgcagcccaaggcggagacggcggcggcgacggcggcggtcgcgccgccggagggagggaagaagtgcggcggcggtggcgggaggcggcgcggcgggcgcgggcgcggcggcagggcgggtgcggggccggggccggggctggcggcggcgccggccgtggtggtggcgcccgcggcgcgcgccgtcattgggccgccggtggcgagcaaggggctgtcgttctgccggcggccggggttcgggacggtgggcgcccggtgcgtcgtgaaggcgaaccacttcctcgccgagctccccgacaaggatctcacccagtacgacgtgaagatcacgccggaggtgagctcccggagcgtgaaccgggcaatcatgtcggagctggtccgcctctaccacgactccgatctcggaggtcgcctcccggcctacgacggccgcaagaacctctataccgccgggacgctcccgttcgacgcgcgcgagttcgtcgtccgcctcaccgacgacgacgacggcaccggcgtcccgccacgggagagggagtacagggtcgccatcaagttcgccgcgcgcgccgacctccaccacctccggcagttcatcgccgggcgccaggccgacgcgccgcaggaggctctccaggtgctcgacatcgtgctccgtgagcttgccaaccgcaggtatgtctcgatagggcggtcgttctactcgccggacataaggaagccgcagcggctcggcgatggcctacagtcatggtgtgggttctaccagagcatccggccgactcagatggggttgtcgcttaacattgatatgtcatctaccgcgttcatcgagccgctaccagtgatcgaattcgtggcccaaatactagggaaggatgtcatatcgaggccattgtcggatgcaaacagaatcaagatcaagaaagccttgcggggcgtgaaagttgaagtcactcaccggggaaatgtgaggcggaagtatcgcatttcagggctgacaacacaaccaactcatgaactgattttcccaatcgatgaccaaatgaacatgaaatctgtcgtacagtatttcaaggaaatgtatggcttcaccattcagcatccccatcttccctgccttcaggtgggaaaccaaaagaaggcaaactatctaccaatggaggcctgtaagattgttgagggtcagagatatacaaagaggttgaatgaaaagcagatcacatcattactcaaggttacttgccgtaggcctagagaacaggagatggatattctacagtctcaacaaaatggatatgagcaagacccttatgcaaaagaatttggaatcaacattagtgagaagctaacctcagttgaagctcgggtccttcctgcaccttggctgaaatatcatgatactgtgaaggaaaaggagtgcttgccacaagttggtcagtggaacatggtgaacaagaaagtgataaatgggtgcaaggtgaatcattgggcttgtataaatttctcaaggagtgtgcaagaaactactgctcggggattctgccaggagttggcacaaatgtgtcagatatccggcatggaattcaacagtgagcctgtgataccaatatactcagctagaccagatcaagtagagaaggcgcttaagcatgtgtataatatgtcattaaacaagctcaagggaaaagagcttgagcttcttttggccatcctccctgacaacaatggttctttatatggtgatataaaacgtatatgtgaaactgacttggggttgatatcacaatgttgcttaaccaaacatgttttcaagatcagcaagcagtacctggcaaatgtctcacttaaaatcaatgttaagatgggaggaagaaacaccgtgctgctggatgcaataagttggaggattcctttggtcagtgacataccaactattatatttggtgcagatgtcacgcatcctgaaaccggggaggactctagcccatccattgctgctgttgttgcatctcaagactggccagaagttacaaagtatgctggattggtgtgtgctcaggctcatcggcaagagctcattcaagatctttacaagacatggcatgatcctcaaagaggcaccgtaacaggaggcatgatcagggagctcttaatatccttcaggaaggccactgggcaaaagccattgagaataattttctacagggatggtgtcagtgaaggccaattctaccaagttctcctctatgagttggatgctatccgcaaggcatgtgcatctctagaaccaatttatcagcctcctgtaacattcgtggttgtccaaaagcgtcaccatacaagactcttcgcaaacaatcacaaagacagaagtagcacggacaaaagtggaaacattttgcctggaactgttgttgattcaaagatctgccacccatcagagtttgatttctacctctgtagccatgctggaattcagggaacaagtaggccagctcactaccacgtcctttgggatgagaacaatttcactgcagacgaaatgcagacattgacaaacaacctttgctacacttatgcacggtgcacacgctctgtttctgttgttccacctgcatactatgcgcatctggctgcgtttcgagcgcggttctacatggagccagagatgtcggagaaccagacgacgtcgaagagctccactgggacgaacggaacctcggtgaagccattgcctgcggtgaaggagaaggtgaagagggtgatgttctactgttgatgactgggagactacctttaactactcacatatgatgtacctaacattgtagaattttagtggtagggatttagaattagcttccttcaggaaagggagcanagcaagcatttggatcctgagcgacctcttttgaccactctgtaaagtactaagtaacgcatgtataatagttgttgtatcagtctgaaaaaaaggaagtgcactcaaaaaaaaaaaaaaaaaaaaaaaaaaaaaaaaaaaactcgagcgcgggtcgacaaggggtttcgaaaggggtttccaaag

SEQ ID NO: 6004 - DNA, 3003 bp, Oryza sativa
  Predicted polypeptide sequence is orthologous to G1146
atcgttgctcgaatatttccccgtccgctgtgcgtcgactccgactgctcgtgtgttcgcccgccgccgccgattcctatccatctcgcgagcgagcaggggcgccgtcgttcgtcctgctgcttccgccgcatccatcctgtgctaaagtttgtaccttgccttggaacattagtcatggagagtcagagaatgacctggctctacgatcgtcaccactccttgaaacataataaagctgaaagacaagccattctatcaacttatagattagcaaaacgtccaaatctctcttcagaaggtatgattggcgaaagttgcattgtgaggacaaattgtttcagtgttcatctggagtctttggatgatcagactatctatgaatatgatgtatgtgtcactcctgaggttggaatcaatcgtgctgttattagagagttggtaaaacagcagaaagattctggtttgggtggccgtcttcctgcctatgatggaaggaagaggctatacacatctggtccattgccatttgattcacatagatttcttgttctgctggatagtattgaagacagtcctgaagagtcaaggcacttgagagtgagagattttgtggtcactttaaaatttgctgcaaaaatttccttatggactttacgcaagttccgtggtgggaagccaaaccgagaaagtcgagcggccctgcgagcacttgacgttgttctaaaggaattacccactgcaaggtatacccaatttgctggttcattttactcacctaacttaggagaatgccgacaattgtgtaaggtcttggaaagctggcgtggttttcaccaaagaatacaagctactcagatgggacttcaactgaatatcgacgtgtcatcatcagtgttcatcaagcctgtacctgtggttgactatgttgcacagcttcttaacgaggacatcttattagacagaccattatgtagcactgagttcttgaagattaaggaggctctagaaggtctgaaggttcagattaatggcattttgttcaacacatatcatgtacaagaccttgtccatcaagcagcaagttttccagttaactttagtattcagtacccatctttgccttgcttgaaagtggctcattttggggagacaatatttctgccattggaggtctgtaaaattgctgagggacaatgtcaccagaaacagctcaatgcaaaacatatggctgctcttcttcaggtagctcgacagccccctaatgagcgtgactacaacattctgcagactgtgcatcagaacaaataccaggaggacccacatgctaaagagtttggcattaaaattgaggaaaaacttgtatcaattaaatctcgcatcctacctgctccttggcttaaattccatgacagtggcgagacgacagaattcttgccacaacttggcatatggaatatgatgcataagaaaatgatcaatggtgggagagtgaaaagctgggcatgtgttaacttttgctggagtgtacgggagtatgctgctaggaatttctgttatgaccttggctttatgtgccgagaatctgggatggtcttttcagttaaacctgtgcttcctctagtgattgctaaacctggatgtgtagaatctgcactcaggacacttcatgacgatgtcatggacatacttagaccacagggcagaaaacttgacctgctgattgtaatattgcctaacaacaatggatctctttatggtgatgtcaaaagaatatgtgagacagatattggactgatctctcaatgttgtcttgcaaaacatgttcttaagatgaacaagtggtatcttgcaagcgttgcccttaaaatcaatgctaagatgggcggaagaaatactgtactggttgatgctttagaaatgagactcccccatgttagggatacaccaactattgtatttggtgctcatgtcacccatccacatccaggaaaagctaatagttcttccattgctgctgttgttgcttctcaagactggcccgaggttaccaagtatgctggtttaatcagtgtgcaagcgtgccaccaggagtcaatacaaggtctttttaaagtccaggatgatccggaaagaggaaccacaactagcggaatgatcaaagagcatctcatgtctttctatcgagccactaaacggaagcccggaaggattatattttacagggatggtgtgagcaaaggacagctccctcaggctttgatgcacgaacttggtgccatcaaaatggcgtgtgcatctatgggacccgattataatccattagttacatacgtggtgctccagaagtgtcgccatacacgtctgtttgctgactactataatgcgaatactcatgattcaactgcaaacatacgggctggtactgtggttgattcaaatatttgccaaccaaatcagtttgatttctacttgtgtagccaccgcagcacgcagggaactaagcggcccaggtattatcatgttctgtgggacgagaacgacttcttggctggttctttccaagagctcacaaactacctctgctacacctccgcaacttgcacccaatccatatcagttgtggcccctgtgcactacgctcgtcttctgtcatcacgagctcgatgttacattaaaccacgctcgattggcgattcaacgagccacacctccttgccttctgaagaagatagcagcgcagcctcagagactggcagtcttcttcctataaaggataatttgaaaggggccatgtttttctgctagaactgctgccagcaagatctgctgtcattttgtacgtggtctgtacagtcccacagttcttggtagatttgactgagcagtcaaaactcattatcgttcagcgagattcaggtgtagcagctgtaggattactgataaacattgttcctgtaccgatactttagaagaaatgaattaattatatcttagaacagc

SEQ ID NO: 6005 - DNA, 3432 bp, Oryza sativa
  Predicted polypeptide sequence is orthologous to G1146
ggtcttcttccttcctcggcccggcctcgctcgctgcctgccagctgcagctgcaactctccatccatcgatcgatctcctcctactcccccgccgccgccccgtccaagacaagccaagccagccaccactccctgcatgccatggcctcacggaggccaacgcaccgccaccataccgaggctccagatcctggtggaagagggagagggagaggccgtgccgcccgatatgctcagcctcagcctcagcctcagcagcagcagcagcagcaaggacgaggatgccgtgctagaggtgcctcgccgccgccgccgccgcagcagcagcagcagcaacagccaaggtctactcctactcgtgctaccactgtcaccgtggcttcctcttcatctaccacggccaccgcatcatcaagccctctagctcccgagctgcgccaagcaataatggaagctccccgtcccagtgagctcgctcaaccctcacccactccgcctcaggaacaacctgtggatgccgctaccacgacgccgcaccatattccatcctcaagcaagtcaattaggtttcctttgcgcccggggaagggtaccattggcaccaggtgcatggtcaaggccaatcatttcttcgctcacctgcccaacaaggatcttcatcactacgatgtctccatcactccagaagttacatcacgcattgttaaccgagctgtgatcaaggagctggtaaatctgtacaaggcatcttatctgggtgggaggctgcctgcatatgatggtagaaagagcttatacacggctggcccattgccgtttacttcacaggagtttcagatcactttacttgacgacgatgatggttctggttctgagaggcgacagaggactttccgagtagtaatcaagttcgccgcacgggccgaccttcaccggcttgagttgtttttagctgggaggcacgcagaagctccacaggaggcactgcaagttcttgatattgtgctgcgagagctaccatcagcaagatatgcgccatttggacgttccttcttttcggcttacttgggtaggaggcaaccccttggtgagggattggaaagctggcgtggattttaccagagcattcggcctactcagatgggcttatcactgaatattgatatgtcagctacagctttcattgagccgttacctgttattgattttgttgcacaactattgaattctgacatccattcaaggccgctttctgatgccgaacgtgttaagatcaagaaagccttgagaggagtaaaggtggaagttacccaccgtggcaacatgaggcggaagtaccggatatctggtttgacaattcagccaactcgtgagctaacttttcctgttgatgaaggaggcacagtgaagtcagttgtacagtactttcaagagacatatggctttgccatccaacacacctaccttccatgccttacagttcagcgattaaattacctgcctatggaggtctgcaaaatagtggaaggacagagatactccaagagattaaatcagaatcagataagagctcttttggaggagacatgccaacacccacgtgatcgggagcgtgatattattaagatggttaaacataacgcttatcaggatgatccttacgcaaaagagtttggcattaagataagtgatcgtctggcatcagtagaggcacgaattttaccggctccacggcttaagtacaatgagactggtcgagagaaggattgcttaccaagagttggtcaatggaatatgatgaacaagaaaatggtaaatggtggtaaagtcagaagctggatgtgcgtcaattttgcccgtaatgtgcaggaaagtgttgttcgtgggttctgccatgaacttgctctgatgtgtcaagcctcaggaatggatttcgctccagaacctatccttccaccactaaatgcacatccagatcaagtggagcgtgctctaaaagctaggtatcatgatgcaatgaacgttcttggaccccagcgcagggaacttgatttgcttattgggatactacctgataacaatggctcgctttatggtgatttgaagcgcgtgtgtgaaatagatcttggaatagtttcacaatgctgttgcacgaagcaggtgttcaaaatgaacaaacaaattcttgcaaatcttgctctgaagataaatgtcaaggttgggggcaggaacactgtgctggtggatgctgtgtcaaggcgtattcctctggtaaccgacagacctacaattatatttggtgctgatgttacccatcctcatcctggagaggacagcagtccctcaattgctgctgttgtagcctcccaagattggcctgaggtgacaaagtatgctgggttggtttctgctcaagcccaccgacaagagctgatagaagatctatataaaatctggcaggatccacagagaggaacagttagtggtggcatgatccgtgagctgcttatatccttcaaaagatcaactggtgagaagccccagcgaataatattttacagggatggcgttagtgaaggccaattttaccaagttctactttatgaattgaatgcaatccgaaaagcatgtgcctccctggagacaaattaccaaccaaaggtgactttcattgtggttcagaaacgtcaccacacaagattatttgcacataatcacaacgatcagaactcagttgacaggagcgggaacatactccctggtacggttgtagattcaaagatccgtcatccaactgagtttgacttctacctgtgtagccatgctggcattaagggtactagtcgtccagctcattatcatgtcttgtgggatgaaaacaacttcacagctgatgcattgcagattcttaccaacaacctttgctacacctatgcaaggtgcactcgctctgtatcaattgttccacctgcttattatgctcatctggctgccttccgtgctcgtttctatatggaaccagatacatctgacagcagctctgtcgttagtgggcctggtgtacgtgggccactttctggctcatcaacatcacgtactcgggcccctggtggtgcagctgttaagccacttcctgctctgaaggatagtgtgaagagggtcatgttctactgctgaagctagggcctacatagctaaagctcttcgtttcttggcaacctgcctatgatggttgtaattatgtgtcaaaaaatcccataataatctgccagctgctatcttctccattgtactatgctggtcatgtttgccaaagttaccctatatgtatgtatattatgctattgttttttttttttttgcggggactattgttatcatgtattatgttttactgtcatgtctgtagttatgattcgaggagtttgcg

SEQ ID NO: 6006 - DNA, 3414 bp, Oryza sativa
  Predicted polypeptide sequence is orthologous to G1146
gatcaaccctctctctctctctctctctgcctcggcgacctcgcctccgcttactctcccacccagacaaaaccctctttgcctctcatggcgtcacgcggcggcgacggcctcgtcggaggagggcgcgggcccctcggtgggcgggacggtagagggcgcggcccggccggtgggcgaggcggcggaaggggaggcggccacccgcagcagcagcagcagcagcagccgggctacggccgcggcgacgggggcggccgtggtcctgcccctgctgctggtggtgtcgttggtcgaggaactggaggcggcggcggcggcgggcgcggggacggcggacgcggccgtggccgtggcggcggcggcggagatggcgttcgccctgctatggccgcggctccggcggcgtcgactcctggtccggttgctgttgctgctcggagtactcctcctcctactcccgcggtccagatccccgcggtggcgtcgtcgtcgtcagcgcagccagcggcggcggcgcagcctcctccggcagccgcggcggtttctgccctcgcgagggacgttgggaggcagctggctgtcgtggcgggcggcggccgccccgctccccccgcggcgccgccggcgcccatcccggtgtcgagcaagggcgtcgcgccaccgtcgcggccggggttcgggacggtgggggagaggatcgtggtgcgcgcgaaccatttcctcgtccgcgtctccgacaacgacatgatctacctctacgacgtgagtttgagtcccccaccaaagaccaggcgcatcaacagggtagtgatgtctgagctggccaggttgcaccgtgagtcgcatctcggtggcataagcttcgcgtacgacggaagcaaggccctgtacactgcaggaaaactgccgttcgactccatggacttcaagatcaagctgggcaaagagctcagggaaatcgagtacaaggtgacaattcgacgtgctggccaagcagatctgcaccacctgcacgagttcatcgccggccggcagagggactctcagcagcaaacgatccaagcactggacgttgtactgagggagtcaccttctctgaactatgtcatcgtttctcggtcgttctactccactatgttcggccgacaagacattggtgatgggctggaatgctggaaaggatactatcagagcctgcgcccaactcagatgggactctcattgaacatagacatatcctctaccccattcttcaaacctatcagcgtggtagaatatgtcaagaattgtctgggcacacctactaatgctaatggccctgaccctaggcggcctctttctgacattgatcgcctgaaggttaagaaagcactacggggagttcgtgttgaaacaacacaccaggggaagagcagcaagtacaagatcactacgattacatctgagccactgagtcagctgaacttttctatggatggaactacccagactgttattcagtacttctcgcagcggtacaaatacaggctgcagtacacgtcttggccctgtctgcaatccggcaacccttctaaccctatatatttgccaatggaggtatgcaccattgtagaagggcaaagatactccaagaagctcaatgacaaacaagtgactggcctcctgagagcaacatgccagcctccccagaaaagggagcagaaaatcattgagatggttcaacacaacaactacccggctgataaggtggtgagtgattttagaattaatatttccaatcagatggccactatgccagctcgcgtgctgcctgcgcccacgctgagataccatgactctggaaaggagaaaacttgtaatcccagagttgggcaatggaatatgatcaataagaaaatggttggtggagctgtggttcaaaagtggacttgcgtgaatttttcacgcatgcatattgatgccgtgcacagactatgcggcgaactagtttatacatgcaatgctattggcatggttttcaatgaaatgccagagatagaggtggggtcagctgctcctaataacatcgaagctgccctgagcaacattcacacaagggctcctcaactccagctgctcattgtgattctcccagatgttaatgggtattatggaagaattaagagggtgtgtgagactgaacttgggatagtatcccagtgcctcaagccaggccgcaagctcttgagcttagacaggcagttcctggaaaatgtctcactcaaaatcaatgtcaaggctggaggacgcaactcagttcttcagagacctcttgtacccggtgggcttgaaaacacaacaataatttttggtgccgatgtcacccatcctgcttctggagaggactcatcggcgtcgatcgcagctgtggtggcctccatggactggcctgagatcaccaagtacaaagccctcgtctctgcccagccacctcggcaggagattatacaagatctcttcaccatgactgaagttgcgcagaatgctgatgctccagcacagaaggctgaaggttcgaagaagaatttcatatgcggcggaatgttcagggagttgcttatgtcattctacagtaagaatgctaaacgtaagcctcaaaggataatattttacagggatggtgtaagtgatggacaattccttcatgttctgctctatgagatggacgcaatcaagaaggctattgcatctttggacccagcatacaggcccctggtgacatttgtggttgtccagaagaggcaccacacaaggctcttccctgaggtgcatggaaggcaagatctgacggacagaagtggaaatgttcgtccaggaaccgtggttgacactaacatttgccaccctagtgagttcgacttctacctgtgcagccatgccggaatccagggaacaagcagaccaacccactaccacgttctccatgacgagaaccgttttagtgccgatcagctgcagatgctcacttacaatttgtgttacacctacgctcgatgcacccggtctgtctctgttgtccctccagcctactacgctcacctggcagcattccgggcgaggtactacgatgagccccccgccatggacggagcttcgtcggtcggcagcggcggcaaccaggcggcggccggcggccagccaccggcggtgcgccgcctcccgcagatcaaggagaacgtcaaggacgtgatgttctactgctgatcgaatcggcgcctagcttgggttttaactacaaacattttgttggtcgctcgtcagtattcattcaggctgttagtgtactgtgctatctctgaaattgtgatggtgtcatttgggacatgttaacctgttgttgaacttgtgatctgtgatgttgatgcagctgct

SEQ ID NO: 6007 - DNA, 3636 bp, Oryza sativa
  Predicted polypeptide sequence is orthologous to G1146
aggtctgctctcctcaatcctcccccactccttgggtaaatcgttagcctagccgccacccgtactgagcgctccgccatggcgctcgtctgaacttcccctttagcgcccgccatggcctgccgccccatgtgagtaatgcggttatgtgtagcagggtagttttttcctattgctggagaagatcctccacttaaatggagaaaatcgacggggagatcgctcttttgttgctggatttctgtttattccgatctgttagactgctagtccctaaataggtgtagctttcgtttctgggcattctatttttcatggttgcggcgtcactttcatatctctttcacccatgaatcgactccgatagtgtgtgttactcgtaacctgtactactgcatttccattacatctagataatcagaaccgccactcaagtttcagtagtttggtcttgtaatggtggttctaattctgttggttgactgctctctgaaattaattttattcgtttagttattattatgtgatcttgaggtgtaggttcatgacttcatgttaagtagctccaaattattcttcattcccccctcctccccctgaaaatcttgttctgaattccaatagaaaagttattcttcctttttcccctgaaaatttcgttctgaattcccaataaaaaggttataaatttatatgcatgaagttcatcgagttgttctgaaaatcttacagttcgttatcaatacaaagactacttcaagtcaaacaagcaggattctacctgatgagctcatcaagttgcacgggttcacaactcttggtggcaaacggccagcatatgacggaagagagagtctctataccaatggttcacttccttttgaatcaaaggagtctgtggtcaaagtatttgatccagaaaagaatgctaaagaaagggcgcaaaaggaatttaagatcacaattgaaattgttggcaaaacaaacttgtaccacctccagcgctttctgctcggaaagcacaggggcatagcccaagaaatcatccatgtttttgatgttatcctcagtgataaactttctcggaatcatgtcacagggcccagatcctttctttgtactcagattggtcaccagggttacattggtgatggacttgactcttggagaggttaccatcaaagcttgcgcctgagaaagatagggatttcactcaatacggatatgtctgcagcatcctttatgcctgtgagaattatccaaattatagatgggttcctgaacataagttacacctcaagacctttgttagagcggaaccgtgtgcagctaaagaaagtattatgtcatgtttgcattgaaacaaaccaccatgatgaccaaatcggaagatataagataacagggatcacccctattcctatgagcaataacatatgtcctgttggtgaggaaggaacaacaatgactgttcttcagtacttctgtgatatggagaaaacaggtgtgcctagtgttggacattggaacatcgctgaagagaaaatcattaatggaggagctttggataattggacttctctgaatctttcacgaatgcgcccggaggaagtacaaaggttctgcagcgacctgattcagatgtgcaatgccactggaatgtccttctatccaagaccagttgtggacttccggtcatcacatcctaacaacatacagaatgctctgagggatgttcacaggccaatgcattcctatgttgattgtgatgagaatcatttttatgctgatgctcattgcaactgtaccgtgtctgtggtcccctcatcatcgaacgacaaagttgctgtggaacaggaggaattacaatttgcctcaacccctggcaacagtggacagggcaaatttcaggttggtttcctgctgaacagacagacgatactagtagatacagaaaatgacgactcagtttctgctgttatccagcaggcaattgaaaagacaaattattggccaaaggatgtgtattacacatactccatgggcatgattgacaaaaagaagatggtgaaggaatcacatctctataaaggttctctcatatttgtcaattccagaagccggggcggtggagagcctcctgctggttgcgagaggattgttgatagaatgattaaggcaaacaaaattcctctactggatcatatccatagtgtgaaggggcatgatccctgggctgaatggtttgagcgtgtgaacttaccaagatcccttttaacatcttcacaagaatggggtggtgtacttttgcaagatgcagcagctaaagttggacagatgttggctctctgtctggaaagggcccattgttctgggaaatgttttggtggctttgacatacgtgatgtctattatatagagtattaccagttgattgacattaatgcccccatgacggatttcacaagtagaagatatataaatgattggttatcgttcaataagattattgatgaccactttagatacactgatccaacctcaggttatctatcatatacactgtacgtggaagattttatgttcagaatatctttacttgaagatgtgccatctactggacgttcttggagggaaagggctgtctttttcaagaatatcagccttgaatcatcagagaggagagtccagattgttgaaggacttgtggggttttatcgtgaaagactcacttcagacagagaattattcgaggaggtattgcaggattgtggctattggaaaagacaaacaagaacggtgcctcgtatgatttctgcgttgacatattctgtaaagaatgaattgcaggactgggtacctgctaatcattactttgagaattgtgggtattcccagctttatttctgtagatgtttctttggacattatacagtaccaggaaggatcacgaagaaggaactggatacagctgtaggcatacttttgccaggtcatatcccaagggctcaaaaaagactgatggtcaactatgagaagacccaagtagatgctgcagtattgtcaccatcaggaaatactgcaaggttcagtgtgcatcatatttttggcattggttctgttggaaatgacctggctctcccacaaataaaaaaggctcttcctccctcgcaaagaaaaaggaaacaaacttgtgacaagtaagtctaactagcctactatacacatgtagctgcttctctgcaaacttcccgttggtagcagagagctctgatggcagcagcgggcaagctgtggaggtgcgttaacttcccaaagatcaaaggttcccaactgcttatatgatgagatgttggcgattcccatagagatgtggttgatgaagtttagttgaagattcccaactgcttataagacttctcttgaactggttgctggtagttttttttttgctgctcgttgtagtagattgtcagtgagcttctgtggtatgcaaggcactcagcttgacacaatgcaactatgccaagtatgttaagttcccagtagttttgttatctaacctttgttctctgtatgatatttgcctcatcagctgctctgctcaaaatgcttccttttatatttgtagttttg

SEQ ID NO: 6008 - DNA, 2503 bp, Oryza sativa
  Predicted polypeptide sequence is orthologous to G1146
gtggagctgtccggcagcaggaagttcaaggtggccatccggcacgtcgcgccggtcagcctgcaggacctgcggatggtcatggccggctgccccgccggcatcccgtcgcaggcgctgcagctgctcgacatcgtgctgcgcgacatggtgctcgccgagcgcaacgacatggggtacgttgcgtttggtcggtcttacttctcaccggggctcggatcgagggaactcgacaagggcatctttgcgtggaaggggttctaccagagttgccgggtcacgcagcagggcctttctctgaacatagacatgtcttcgactgctttcattgaacctggtcgggtgctgaattttgtagaaaaagctattggacgtcgaatcactaatgctattactgtgggatattttttgaacaattatgggaatgaattgatgaggacccttaagggtgttaaggttgaagtcactcaccgaggaaatctacgcaagaagtacagcattgctggcttcaccgagcagtctgcagatgttcagacgttcacatcatctgatggtatcaagactgtcaaggagtatttcaacaaaaaatacaatctgaagttagcttttggttatcttccatgcctgcaagttggcagcaaggagagaccgaattacctgcccatggagctttgcaatatagttcctggacaacgatacaagaacaggctcagtccgacacaggcttccaatctgattaacataaccaacgatcgtccttgtgaccgtgagagctccattcgtcagactgttagcagcaaccagtataacagtacggaacgcgcagatgagtttggcatagaagttgactcttatcctactactttaaaggctagagttttgaaagctccaatgctgaagtaccatgattctggaagggtgagagtatgcacgccagaggatggggcgtggaacatgaaagacaagaaagtagttaacggtgctacaattaaaagctgggcatgtgtcaacttgtgcgagggtttggataatcgtgttgttgaagcattctgccttcaattggtcagaacgtccaaaataactggactggactttgcgaatgtgagccttccaatattgaaagctgatcctcataatgttaaaactgatcttcctatgcgctatcaggaagcatgcagctggtcgagggataacaagattgacctcctacttgttgtaatgacagatgataaaaataatgccagcttatatggtgacgttaaaagaatctgtgaaacagaaatcggtgtattgtcacagtgttgtcgagcgaagcaagtctacaaggagaggaatgttcagtactgcgcaaatgttgctcttaagatcaatgccaaggctggaggaaggaactcggtatttcttaatgtagaagcaagtttaccggttgtttcaaagagcccaactattatatttggtgctgatgttacccatcctgggtcctttgatgaaagtaccccttccattgcttcggttgttgcttccgcagactggcctgaggtgaccaagtataattctgttgttcgtatgcaagcttctcgtaaggagattatacaagatcttgatagcattgttagggaacttctcaatgcattcaaaagggactccaagatggagccgaagcagctcattttctacagggacggcgtaagcgagggtcagttccagcaagttgtagagagcgaaataccggagatagaaaaggcttggaagtctctgtatgctggcaagccacgaattaccttcatagtggtgcagaagaggcatcatacaaggctgttccccaacaattacaatgatccacgcggcatggatgggactggaaatgttcgtccaggcacagtagttgatacagtgatctgtcaccctcgagagtttgatttcttcctgtgcagccaagccggggatcaaagggacaagccgtcctagccattaccatgtgctgcgcgacgacaacaacttcaccgcagatcagcttcagtctgtcacaaacaacctgtgctacttatatacaagctgcactcgctcggtgtctattccacctcctgtttactacgctcataagctcgcattccgcgctcgtttctacctcacccaagttcccgtcgccggtggagatccaggtgctgctaagttccagtgggtacttccagagattaaggaagaggtgaaaaagtccatgttcttttgctagtcgtccttgtgcccccctgaaactgaagcctggagccagccggcaagctctggaaatgctctgaataatcaaacttggaagaataagcacctgcccaggttgccattcgtttccatgtggcatggaggatggcatcctgaaaaggatattgtcatgtttgtgtggtttttaaacgacattgaagtttatctccggtgttactatctcagcactttggttgttttattttgttatgtctgaagatatagacacaaaacttcatttttgttt

SEQ ID NO: 6009 - DNA, 3177 bp, Oryza sativa
  Predicted polypeptide sequence is orthologous to G1146
atggcctaccgcggcggaggccgaggtggccgcggcggcgagcagcggccgccctactccggccgcggcgacgtccctggccgtggtggcggtggtggtgggggtggagccccgccgtaccgtcccgcctcgggcttcgtgtggccgccgccggggatgacgccgcggccggggcctcctcagccgcagtacccgcggccggggccgccggccgtcgtctacggcgcgccgatgccggcggcgcaccaccagggcgcgtaccagcccgggggcgtgtaccgtgcgccctccccgggggttccggtgatcggtggctacgcgcgcagcacgcccgtcaccatccgggcgcctccgccgtcgcactcgtcggctccggctccgtaccagccggcggcggccgcgccggctccctcgtcgtcctccacggcgccgtccgctacggctctggccaaggagttcgagcagaagctgttcgtgtcggagaccgcgctggcgccacccgcggcggtggcgtcggccgcggccgcgccggctggcgaggcgtcggtggagtcggacaaggatctggcaccggtgtcgaagaaggggctcgcccaccctgcgcggccggggttcggagcggccgggaagaaggtgatgatccgcgcgaaccacttcctcgtcaatgtcgccgacaacaacctcttccactacgatgtttcaatcaatcctgagtcaaaatcaagagcaacaaatagggaagtactcaatgagctcatcaagttgcacgggaagacatctcttggtggcaaattgcctgcctatgatggaagaaagagtctctatactgctggttcactcccttttgaatcggaggagtttgtggttaagctaattgatcccgaaaagaaggataaagaaagggcggagagggagtacaagatcacaattcggattgctggcagaacagacttgtaccacctccagcagtttttgcttggaagacagagggatatgccccaagaaaccattcaagttcttgatgttgtccttagggagtcaccatcttggaattatgtcacagtgtccagatccttcttctctacccagtttggtcaccggggtgacattggtgagggacttgagtgttggagaggttactatcagagcctgcgcccaacacagatgggcctttcgctgaatatagatatatctgcaacgtccttttttaagcctgtgacagtgatccaatttgtggaggagttcctgaacatacgtgacacctcaagacctttgtcagaccgggatcgtgtgaagataaagaaagcattacgtggggttcgcattgaaacaaaccaccaagaggaccaaatcagaagatacaagataacagggattacccccattcctatgagccagctgatatttcctgttgatgataatgggacaaggaagactgttgttcagtacttctgggataggtacaattacagactgaagtacgcttcttggccctgcctacagtctggcagtgattctcgccctgtatacttacctatggaggtgtgcaagattgtagaagggcagaggtactccaagaagcttaatgacaaacaagtgaccaacatccttagagcaacctgtcaacgcccccagcagagggaacagagcattcatgagatggttctccacaacaagtatacagaggataggtttgctcaggagttcggtatcaaggtctgcaatgacctagtctctgttccagcccgtgtgctgcctccacccatgttgaagtatcatgattctggaagggagaaaacttgtgcacccagtgttggacagtggaacatgattaacaagaaaatgatcaatggaggaactgtggataactggacatgtctgagtttttcacgaatgcgtcctgaggaggtacaaaggttctgtggtgacctgattcagatgtgcaatgccactggaatgtctttcaatccaagaccagtcgtggatgtccggtcaacaaatcctaacaatatagagaatgctctgagggatgttcacaggagaacatcagaactgctagccagagagggaaagggaggcctgcagcttttaattgtaattctgcctgaagttagtggttcttatgggaaaattaaaagggtctgtgagactgaccttggcattgtatctcaatgttgtttgccaaggcatgccagcaggccgaacaagcaatatttggaaaatgttgcactcaaaatcaatgtcaaggtcggagggcgcaacactgttcttgagcgagcctttatccgcaatggcataccatttgtgtcagaagtcccaacaatcatctttggcgctgatgtcacacaccctccacctggagaggactctgcatcatctattgctgcggttgtggcatctatggattggcctgaaatcaccaaataccgaggtctggtctctgctcaaccacatagacaggagataatagaagatctctttagtgttggtaaagatccagtgaaggttgtaaatggtgggatgatcagggagttgcttatcgcattccgcaagaagactggcagaaggcctgagaggataatcttctatagagatggtgtaagtgaaggtcagttcagccatgtgcttcttcatgaaatggatgccatcagaaaggcttgtgcatctttggaggagggatatctaccacctgtcacatttgtagtagttcagaaaaggcatcacacaaggcttttcccagaggttcatgggaggcgagacatgactgacaagagcggaaacatccttcctggaactgtcgtggaccgtcagatttgccatcctacagagttcgatttctacctgtgtagccatgctggcatacagggtactagcaggccaactcattaccatgtcctttacgatgagaaccattttacagccgatgcacttcagtccctgaccaacaatctttgctatacctatgcgcgatgcacccgggcagtgtctgtggtcccaccggcctactatgctcatcttgctgcattccgcgctcgctactacgtggaaggagagagttcggatggtggctcgacccctggcagcagcgggcaggctgtggcgcgagagggccctgtggaggtgcgccagcttcccaagatcaaggagaacgtcaaggacgtcatgttctactgctga

SEQ ID NO: 6010 - DNA, 3644 bp, Oryza sativa
  Predicted polypeptide sequence is orthologous to G1146
gggtagaagcagaggtaagcagggcagagagtagaaacaggagcactgcattactggtagtgggagcgtaaagctctctcctctcttcttcttcttcttcttggcgttttccctcatctccttctactagtactagtacatcaccctcccactcttcttcatcttccgcccagcgaggttcgtctggatgtgagctgaatctctccgtctgcccaagttgattgagttggtcgactgaatgggatcaaggagaccaagactgcctgggtttggtgaggactgtgagcctcgtggtggtgggagaggaggaggtggccgtggccgtggcagctactacccacaggcacagcaataccacccacaaggacatggtggccgtggaggagcaggctactaccatggtgctgctcctcaacctcgcggcgcaatggtggtgcagcaatggcgtcctgctactgctgctgctgagcatttgggccatcaacagccctacaacagcagtgtgagaccacagcactattatggtccgtctgccatagctcccgagctgctccaagcaatggatgctccacatgagcctcctgccaatgtctcctcaccagaagcagcctctccggaggcatcatcaccacggtctcttgctcttgaggtcacagagcagcttcaggacttgtctgtgcagtaccaattaagtgagagccaggaagagattgtccaacatgttcctgtgtccaccaaatcatttaaatttcctcaccgccctggaagtgggagtattggaaccagatgtttagtgaaggcgaatcacttctttgctcaactgccagacaaggatcttcatcagtatgacgtttcaatcaccccggagcttacatcacgaattcggagccgtgctgtgatggaagagttggtgagactgcacaagatgtcatacttgggaggacgtcttccagcctatgatggtaggaagagcctttacacggccggtccattgccgtttacttcaaaagaatttcgcatctctttgcttgaggaagatgatggttctggttcggagaggcgtcagaaaacatataacgtggtgattaagtttgctgcaagagctgatcttcaccgtcttgagcaatttctagctggaaggcaggcagaggctccccaggaggccttgcaagttcttgatattgtcttgcgagagttgccaacagcaagatatgcaccctttggtcgatccttcttctctcctgacctggggaggagacgatccctcggtgagggactagaaacctggcgtgggttttatcagagcattcgtcctactcaaatgggcttgtcactgaatattgatatgtcggcaactgctttctttgagccgttaccagtcatagattttgtcatacagcttttaaatactgacatccgctcgaggcccttatcagatgctgagcgtgtcaagatcaagaaggccttaagaggagtgaaggtaggagttactcaccgtggcaacatgcgccggaagtatcggatatctggtttgacatctcaggcaactcgggaactgacttttcctgttgatcaaggaggcacagtgaaatctgttgtacaatattttcaagagacatatggatttgcgatccagcatacctatcttccttgtctgcaagttggcaatcagcagcgtccaaattacctaccaatggaggtctgcaaaatagtggaaggacagaggtactccaagagactgaaccagaatcagataagggctcttttagaggagacatgtcagcgcccacacgatagggagcgtgacataattcagatggtgaatcacaactcctaccatgaagatccttatgcaaaggagtttggcattaagatcagcgagcgtctggccttggttgaggcacggattttacctgcccctcggctcaagtataatgagactggcagagagaaggattgcttgcctagagttggtcagtggaatatgatgaacaagaaaatggtaaatggtggtagagtcaggagctggatatgtgtcaattttgctcgaaatgtgcaagagagtgttgctagtggattttgtcgtgaactggcccgcatgtgccaggcctcaggaatggactttgctttggagcctgttcttccatctatgtatgcacgtcctgatcaagtggaacgagctctgaaagccaggttccatgatgcaatgaacatacttgggccacagcacaaggagctcgatttacttatcggactgcttcctgataacaatggttctctttatggtgatttgaagcgtatatgcgaaattgaccttggattggtttcccagtgctgttgcacaaagcaagtgtttaaaatgaacaaacaaatcctagcaaatcttgctctgaagataaatgcgaaggttgggggaaggaacactgtactggttgatgcagtgtcgagacgcattccgttggtaactgacaggcctactattatattcggtgctgatgtcacccatcctcaccctggcgaagatagcagcccatccattgctgctgttgtggcctcccaagattggcctgaagtgacaaagtatgctggtttagtttctgctcaatctcacagacaagagttaatagatgatctgtataacatcacgcatgatcctcatagagggcccatctgcggtggaatggtcagggaacttcttatatccttcaaaagatcaactggtcaaaagcctcaacggataatattctatagggatggtgttagtgaagggcaattttaccaggttctattgcatgagcttgatgcaatccgaaaggcttgtgcatcactcgaagcaaattaccaaccgcaggtgactttcattgtggttcagaagcgccaccacacgagattatttgcacacaaccacaatgatcagaattcagtcgacaggagtgggaacatattgcctggtactgttgttgactccaagatttgccatcctacggagtttgacttcttcttgtgcagccatgctggaatcaagggcacaagccatcccgctcattaccacgtcctgtgggatgaaaacaacttcacagctgatgcgttgcagaccctcaccaacaacctctgttacacttatgcgaggtgcacacgatccgtatctattgttccaccagcatactatgctcatctggcggcgttcagagcccgtttctacatggagtcagatagctcggacagtggttcaatggcgagtggtcgtggaggaggttcgtctacatcgcgcagcactcgtgctgcaggtggtggagccgtcaggccccttcctgcactcaaggacagcgtcaagaatgtcatgttctactgttagaattctactactgcttcgcttggctactactatcagttagcctttaaattgcctcccatttgattgcacttagttgttcatcatgggaagcctcaaataagaagtatgcaagacttctgaagccacatgctatcatgttgtgtgtttctgggacacaccattctatttcacattatctgtagactctatcccactatttcataaaagctgggcttcccctggctctatttgtactctaattcgtatggacctgtttcatcatttcaaaatggtcaattgtcttgtttgc

SEQ ID NO: 6011 - DNA, 3746 bp, Oryza sativa
  Predicted polypeptide sequence is orthologous to G1146
ttgaggcggaggcagcagcagcagtgcggtagtgcaagcgctagtggaggagttgggaggaggccccctagggtttcccgagaccgcctccccccgcgcctgcgccgccgctcgccgagcgcgcgctccgtgcccatcatggtgaagaagaaaagaactgggtctggcagcaccggtgagagttctggagaggctccaggagctcctggccatggttcttcacagcgagctgagagaggtcctcaacagcatgggggaggacgtggttgggtgcctcaacatggtggccgtggtggtgggcaataccagggccgtggtggacattatcagggccgtggagggcaaggttcacaccatccaggtggagggcctcctgagtatcagggtcgtggagggccaggttcacatcatccaggtggtgggcctcctgactatcagggccgtggaggatcaggttcacatcacccaggtggtgggcctcccgagtatcaaccgcgtgactatcaaggacgtggtggtccacgccccagaggtggaatgccacagccatactatggcggacctagggggagtggcggacgtagtgttccttcaggttcatcaagaacagttcccgagctgcaccaagccccacatgtccaataccaagccccgatggtttcaccaaccccatcgggagctggctcatcctctcagcctgcggcggaggtgagcagtggacaagtccaacaacagtttcagcaacttgccacccgtgatcaaagttcgaccagccaagccattcaaatagcaccaccgtcaagcaaatcagttagattcccgttgcgccctggcaagggtacatatggggacaggtgcattgtgaaggcgaaccatttctttgctgaacttcctgataaagaccttcaccaatacgacgtatctattactcctgaggttacttcacgtggcgtgaatcgtgctgttatgtttgagttagtaacgctgtatagatattcccatttgggcgggcgtctacctgcctatgatggaaggaagagtctttacacagctggaccattgccatttgcttctaggacatttgaaattactcttcaagatgaggaagatagtcttggtggtggccaaggcacccaaaggcgtgagagactatttagggtggtgatcaagtttgctgcccgtgctgatcttcaccatttggctatgtttctagctggaaggcaagcagatgctcctcaagaagcccttcaagtccttgacattgtgttacgtgaattgcctaccacaaggtactcaccagttggtcggtcattttattctcccaatttagggagacgccagcaacttggtgagggtttggaaagttggcgtggtttttaccaaagcataaggcctacccagatgggtctctcactgaatattgatatgtcatcaactgcatttattgagcctctacctgtgattgactttgttgctcagcttctgaacagagacatctcagttagaccattatctgattctgatcgtgtgaagataaagaaagctctaagaggtgtgaaggttgaggtgacgcatagaggaaacatgcgtagaaaatatcgtatatctggactcacttcacaggcaacaagggagttatcattccctgtcgatgatcgtggtactgtgaagactgtggtgcaatattttctggagacatatggttttagtattcagcacaccactttgccttgccttcaagtgggcaatcagcaaaggcccaattatctgcctatggaggtttgtaagatcgttgagggacagcgttactcgaagcggcttaacgagaaacagattactgcgctattgaaagtgacttgccagcgacctcaagagcgtgaactggatattttgcggactgtatctcacaatgcataccatgaagatcagtatgcgcaggaatttggcataaaaattgatgagcgtcttgcatctgttgaagctcgtgttctgcctcccccaaggcttaaataccatgatagtgggagagaaaaggatgtattgccgagagttggccagtggaacatgatgaataagaaaatggtcaatggtgggagagtcaacaactgggcatgtattaacttctctagaaatgtgcaagatagtgctgccaggggcttctgtcatgagctggctatcatgtgccaaatatctggaatggattttgcactggaacctgtgctgcccccacttactgctagacctgaacatgtggaaagagcactgaaggcacgctatcaagatgcaatgaacatgctcagaccgcagggcagggaacttgatttactgattgtaatactgcctgacaataatggttctctttatggggatctcaaaagaatctgtgagactgatcttggattggtctcccaatgttgtttgacaaaacatgtttttaaaatgagcaagcagtatcttgcaaatgttgcccttaaaataaacgttaaggtggggggaaggaatactgtacttgtggatgctttgacaaggaggattccccttgtcagtgacagaccaactatcatatttggtgcggatgttactcatcctcatcctggagaagattccagtccttccattgcagctgtggttgcttctcaagactggcctgaagtcactaagtatgctggattggtgagtgcccaagcccatcgtcaagaattgatacaagatcttttcaaagtatggcaagacccgcatagaggaactgttactggtggcatgatcaaggagcttctcatttctttcaagagggctactggacagaaacctcagaggataatattttacagggatggtgtcagcgaggggcagttttatcaagttttgttgtatgagcttgatgccattagaaaggcttgtgcatccctggaacccaactatcagcctccagttacctttgtggtggtccagaagcggcatcacacaaggttgtttgctaataatcacaacgaccagcgtactgttgatagaagtggaaacattctgcctggaactgttgttgactcaaagatttgccatccaaccgagtttgatttctacctgtgtagccatgctggcatacagggaacaagccgtcctgctcattatcatgttctgtgggatgagaacaaatttactgcagacgagttgcaaaccctcacgaacaacttgtgctacacgtatgcaaggtgcactcgctctgtatcaattgtgcctcctgcgtactatgctcatctggcagccttccgagctcgcttttacatggagccagagacatctgacagtggatcaatggcgagtggagctgcaacgagccgtggccttccaccaggtgtgcgcagcgccagggttgctggaaatgtagccgtcaggcctctacctgctctcaaggaaaacgtgaagcgtgtcatgttttactgctaagagcttgggctgtaccccgtatgcgccaaggaatgtagtactatgttatgttattttagcacttgcactctgtcgttgatcccgttaaaacgggtatgctaccataagctgttggactattctgggtattgtagtactacttgttttgtatttgtgtttgtgacgctgcagagcgtgaacaacgcaagtctggtacttgtatcgttgtgtttgtgggaacctaaatcttgttggacctttgttgtgcttgaagaaccaagttaaataatcctgtcagtatagggatttaattgctgcttggc

SEQ ID NO: 6012 - DNA, 3747 bp, Oryza sativa
  Predicted polypeptide sequence is orthologous to G1146
gaattatttctttgttctcctcctcctgattcgtcgtccgtccctaggaagcaaaggagaaagtttccactctgtctgcgggatatatcatatatatctcaatcgatccgccattggcgatcgacgaagtgatcaggggctagctcctttgcgctgcggctttgaccgcggtgtcgaagcttcttgcacatggccttccagttggacaacgggtactactcccatcaagctttagccatgatgagaaagaaaaaaactgaaccccgtaatgctggggaaagttctggaactcaacaagccactggagctcctggacggggtccttcacagcgacctgagagagctcacagcatggaggtggtggttggcaacctgccaatcctcaatatgctcaacaagctggtcgtggtggtggacaacaccagggacgtggtggacgttaccagggtcgtggagggccaacatcacatcaaccaggtggtggtccggttgaatatcaagcacatgagtactatggccgtggtgtccaacggcaaggaggaatgccacaacacaggagtggcagtggtggacatggagttcctgccagtccatcaagaacagttcccgagctgcaccaagcctcacaagaccagtaccaagctacggtggttgcaccatcaccatcaagaactgcaccatcttcgctgcctgttgaggccagcagcgaagaagtccaacatcagtttcaggaacttgccatccagggtcaaagccccactagccaggccattcaaccagcaccaccatcgagcaaatcagtgagatttccaatgcgccctggcaagggtacatttggtgataggtgcatcgtgaaagccaaccatttctttgctgaattgcctgacaaagaccttcaccagtatgatgtgtctataactcctgaggttccttcacgtggtgtcaatcgtgctgtcattggagaaattgtaacacaatataggcagtctcatttgggtggccgtcttccagtctatgatggaagggagagcttatacacagctggtccattaccatttacttctaggacctttgacgttattctgcaggatgaggaagagagccttgctgttgggcaaggtgcacagaggcgtgagagaccatttaaggtcgtgatcaaatttgctgcacgcgctgatctccaccatttagccatgtttttagctggaaggcaagcggatgctcctcaagaagctcttcaagttcttgacattgttctacgtgaattgcctactgcaaggtactctccagttgcaaggtcattttattcgcctaacttaggaaggcgccaacaacttggcgagggcctggaaagttggcgtggtttttaccaaagcatacgacccacgcagatgggactttctctgaatattgatatgtcatcgacagcattcattgagcctctacctgtgattgactttgttgcacagcttttgaacagagacatctcagttagaccattatctgatgctgatcgtgtgaagatcaagaaggccctaaggggtgtaaaggttgaggtcacacatagaggcaatatgcgcaggaagtatcgcatttctggccttacctcgcaagcaacacgagagttgtcttttcccattgataatcatggtactgtgaagacggtggtgcaatacttccaggagacatatggatttaacattaagcacacaactttgccttgcttgcaagtgggcaatcaacaaaggccaaattatctaccaatggaggtctgtaagattgtggagggacagcgttactcaaaaagactaaatgagaagcagataactgctcttcttaaagtgacctgccagcgccctcaagagcgtgagctggacattttgcagactgtgcatcacaatgcataccatcaggatccatatgcacaggagtttggcataaggatcgatgagcgacttgcatctgttgaagctcgtgttctaccacccccctggcttaagtaccacgatagtggcagagagaaggatgtcttgccaagaattggccaatggaatatgatgaataagaaaatggtcaatggtggtagagttaacaactggacatgcatcaatttttctcgtcatgtccaagataatgctgctaggagtttctgtcgcgagcttgctattatgtgccaaatatctgggatggacttctcaattgatcctgtggttcctctagtgactgcaagacctgaacatgtggaaagagcgctcaaggcacgctatcaagaggccatgaatatactgaaaccacagggcggggagcttgacctgctgattgcaatattgcctgacaataatggttctctttatggcgatctcaaaaggatatgtgagactgatcttggattggtctcgcaatgctgtcttacgaagcatgtttttaagatgagcaaacagtatttagcaaacgttgcccttaaaatcaatgttaaggtgggaggaagaaatacagtacttgttgatgctttgacaaggaggattccccttgtgagtgataggccaacgatcatttttggtgctgatgttacacatccccatcctggagaagattctagcccttccattgcagctgttgttgcttctcaagactggcctgaggtcaccaaatatgccggattagtgagtgcacaggcccatcgtcaggaattgatacaggatctttttaaagtatggaaagatcctcaaagaggaactgtaagtggtggaatgatcagagagcttctcatttctttcaagagggcaactggacagaaaccccagaggattatattttacagggatggtgtcagtgaaggacagttttatcaggttctgttttatgagcttgatgccattagaaaggcatgtgcatctttggaagccgattatcagccacccgttacctttgtggtggtccagaagcgtcatcacacaaggctgtttgctaataaccacaaggaccagcgcactgttgacagaagtggaaatatactaccaggcaccgtggttgattcaaagatatgccatcctactgagtttgatttctacctgtgtagccatgcgggcattcagggaacaagtcgccctgcacattatcatgttctgtgggatgagaacaagttcactgctgatggtttgcaaactctgacaaacaacttgtgctacacctatgcaaggtgcacccgttccgtatcaatcgttcctcctgcatattatgcccatctcgcggcatttcgagctcgattttacatggagccggatacttcagatagtgggtcgatggcgagcggtgcccatacccgtggcggtggcccccttcctggtgcacgcagcactaagcctgctgggaatgttgctgtaaggccgcttcctgatctgaaggaaaatgtcaaacgtgtcatgttctactgctaagtttgggaatatttgtgtatgggggaaaacgtctgacggtttgagtcgccccctgttatctaagacggaacgacctatagtgtgtgtacgttaatgattgtggtgctgtgaactatcgaccatgatctggttgtttatctattatcaacactagaagttgaggattctagactctttcagtgtggctactcaaatcatatcgtcgaagaaatgtaataattgacaattacattgctgccatgtttccaggacaagctgatctcagctactgcggttcctttccacttgttggatgcgcaccttgattcgc

SEQ ID NO: 6013 - DNA, 3168 bp, Oryza sativa
  Predicted polypeptide sequence is orthologous to G1146
atgtcttcgcgcggcggcggcggcggaggccgccgcggtgggcgaggcggcggtggtgggcgggaaggaggcggaggtggaggtggaggtggcgggaggggtggccagggtaggggcgatctcggcgtcgtcggcgagcggcaaggcggtggtcgaggggcgggtgagcgcggaggccgtcacgacgcgccgcgcggccgtggcggcgtcgctgtgggcgccggggctgggcggcagcagcagcagccattccacgccccggccccgccatctggcggcggcggacgaggcggcgtgcaggtgcagcccaatgcggcggcgcgtcgacccgtaggcggcgggcgcggcggcgtcggagtgccggcgcctgcgccggcggttgcggtgggggctctgtgcggcgagatgaaggggaagatggttgtgtcgggtggagcgccgccagcaggccagggttcgtcgttggcggcggcgcagggcacggacaatgtcaagagagagccatctcaggtcgccgcaccggcgcccgcgcccccgcccgcgacgctgccgccgtcgtcgagcaaggcggtgaccttcccggcgcgtccggacgtcggcacgatcgggaggcggtgccgcgtccgcgccaaccatttcctggtgcaagtcgcggacaaggacatctaccactacgacgtggtgatcactccagaatcaacttatcgtgagagaaatagatcaataatcaacaaacttgttgcgttgcacaaacaattcttggatggtaggttacctgtctatgatggaagaaagagcatatatactgcaggtccactacctttcaaaaccaaagactttgttgtcaagcacattaatcctttgaggggtaaccaacgggaggaggaatacaaggtgaccataaagcaagcctccaaaacagatctgtacagccttaagcagtttttggttggaaggcagagggagttgccacaggacactattcaagctcttgacattgctcttagggaatgccctacctcagtaaattttacttgtgacaggtatgtatctatctcaaggtcatttttctcccaatcatttgggcatggtggcgagattggtagtggtacagagtgttggagggggtattaccaaagtctgcgccccacgcagatgggactgtcgctaaatatcggtatggatttacctcaaaatatttctgcaacagcattttacaaggcccagccagtgatggactttgcagttcagtatttgaacatccgagatgtttcaaggcgcttgtctgatcaagatcgtattaaactgaaaaaggccctaaaaggagtccaaattgtggcaactcactggaaagagaaatccatacgttacaagatcactggaataccctcagctccaatgaatgaattgatgtttgatctagatggaaacaggatatcagtcgtccaatactttaagaaacagtacaattactccttaaaacatgttaattggccatgccttcaagctggcagtgatagcagaccaaaatatttgcctatggaggtctgcagtatacttgaaggacaacggtattcgaagaagctaaatgagcatcaagttacaaacattctaaggatgacatgtgaacgacccgcacaaagggagagcagtatcatagagattgttaatacgaactcttatggcaatgatgattgtgcaaaagaatttggcatcaaagtcgctaaccaacttgccgtggttgatgcccgtgtactgcctacccctaggcttaaatatcatgactctggaagagaaaaagtatgtaatccttccgttggacaatggaacatgattaacaagaggatggtaaatggaggatgtatcaaccattggacctgcctatcttttgcttctcggatgcatgtaaatgacattaggatgttttgtgaagacctggttggcatgtgcaataatattggcatgcaaatgaatacgagaccatgtgtggatatcatacaaggacagcaacgcaacatcgagggtgcaatcagaaatatccataggcaatcttcagaaaagcttgaccagcaagacctgacagggcagcaacttcagttattaattgtaatattgactgaaattagtggttcttatggaaggataaaacgaatttgtgaaacagaggttggtgtgataactcaatgctgtgcacccaagagtcttcagaaaggtgggaaacagtatcttgaaaatctggccctaaaaatgaatgttaaggtcggggggcgaaatacagtacttgaagatgcgttgcacaagaaaataccaattctgacagatcgtcctacgatagtgtttggagcggatgttacacatccatctcctggggaggatgcttctccatccattgcagcggttgttgcatccatggattggccagaagttacaaagtacaaatgcttggtatctacacaaagtcatagggaagaaatcatatctaatctttacacagaagtgaaagatccattgaagggaattattagaggtggaatgattagggagttgctcaggtctttctaccaagaaactggacagaaacctagccggattatattttatcgagatggtatcagcgagggacagtttagccaagtgttgctttatgaaatggatgcaattcgcaaggcatgtgctagtttgcaggagggctaccttcctccagttacatttgttgttgtccagaaaaggcatcacacccgcctatttccagaaaatcgtcgagatatgatggatagaagcggaaatatccttcctggaactgttgttgacacaatgatctgccatccgagtgagtttgacttttacctctgtagccattctggtatcaaggggacgagccgtccaacacattatcatgttcttttagatgaaaatgggttcaaggctgatacgctgcaaaccctaacctacaatcttagctacacctatgcccgatgcacccgagcagtctccatagttcctccagcatactatgcgcatctgggagccttccgagcacgctactacatggaggacgagcattctgatcagggctcttcttcctccgtaacgacgcgaacggatcgatcgacgaagccgcttcctgaaatcaaggagaatgttaagcggttcatgttctactgctga

SEQ ID NO: 6014 - DNA, 690 bp, Oryza sativa
  Predicted polypeptide sequence is orthologous to G1146
gtggatccccgggctgcaggttttttttttttttttttttttgaggtcaaaacgacttatagtatagaaaggagagagtacaaccctaggagacaggtcaccacagtccacaagcatttaacagtagaacatcacacctaggacacgatcagcaatctttggaacattcagaaactcaggcaactcagaagacacttcattcctgatgcttgatccatcgccaaacttcccgagatagcttcgtcctcgggctgcagcaagatgagcatagtatactgggggaactatagaaacagcacgggtgcatcgtgcatacatgtaacataggttgtgcgtaagcaactgaagcccgtcagcagtgaaatgattttcatcgaagataactgtataatgcgtaggtctactgtttccctgagaagtatggctacacaaataaaaatcaaaacccgaaggatggcatatgtcttggtcaatcacagttccagagggaatctgtgcaacttgttcagtataattactgcaaagtgtgtgagggaaaatcctggtgtgatgccttttctggacaatcactaatgtgatgggtggcagataatcctcttgtagagagaggcatgccttcctgatggcatctacttcatgaatgataacctggctgaattgactttcgcttattccatctctgtaaaagat

SEQ ID NO: 6015 - DNA, 3165 bp, Oryza sativa
  Predicted polypeptide sequence is orthologous to G1150
atggagggggagcgggagggggtggtggccaagaacgaggacaacgcaggcggaggtggtggtggattaggtacaggtggtaatggtggtggcggcggcggcggcagcgcgaacgggcggaggaggtggaggggcgggggcagcagcgggtataggcagcacccgatcatccaggcctacccggcgctcctgccgctgccgataaacggcgccaccggccacgcacacatcaacggcgcggtctcgctgccgctgcctctgccgccgccggtgctgctgtacctgcagccgccaccgccaccgccgctgctgcccctgctccccaaggtcgccgccgccacgttctacggcaagccacccaaggcggccgacgcggcaccgaggggctcaatgtggaagcacaggccatcgaaaaagccgccaccgcatgccattaccgccgcgctgctgccgctcccgcggggtattgatttgctaacagatggcaaggcgcttcaggagaaaatattcttcgcaaatgaaagaaaaacatctgaaaaggaggtaaatcatgtagacacccatgagaagtttactgttgcaccactggataatgcaatagcacggagacctgacatgggtggtgttgagggggccgagatccctctttctgcaaaccatttccttgtccagtttgatcctggccagaagattttccattacaatgttgacatatctccgcgtccatcaaaagaaacagcaagaatgatcaagaaaaaattagttgaagaaaatccaagtgttctctcaggttcccaaccagcctttgatggccgcaagaacttatatagtcctgttagatttcaggaggacagggttgagttctttgtcagcctcccagttgcattagcacgatgttcagtagttaaagaggatactggccacatgcttgacaaacagaaactcaagactttcaaagtgaatgtccggttggtttcgaagttatgtggtgaggacttgaacaaatatctgaacgaggacaaggatggcatccctcttccacaagattacctccatgcattggatgttgtgttgcgtgaaggtgctatggaaagttctatccttgtgggtcggtcactgtatgcacgctccatgggggaagcaagggacattggtggtggtgctgttggattaagaggtttctttcagagattgaggccaaccaagcaaggccttgcccttaatgttgatctctcactctcagctttccacgagagcacaggcataatttcatacttgcagaagcgctgtgacttcttgaaggaccttccacagaagaaaacaagggctttggcagaagaggagcacagggaggtggagaaagcattgaaaaatatccgggtatttgtgtgccatcgtgagactaatcaaaggtaccatgtgcatagcttgactaaggagacaacagagaacctcaagtttcgcgaccgaagtgggaaggatcttatggtggtggattacttcaaggagcactataaccatgatatacaattcaggaaccttccatgcttgcagattggcaggagcaagccatgttatgtgccaatggagctttgtgtagtttgtgagggccagaagtttcttggcaagctgtctgatgaacaaacttctaagattctgaaaatgggttgtgaaagaccgagtgaaagaaagggaatcataaagggtgttgtcaaaggtgcatttcatgcaagaagcgatacttatgctgatcagtttagtctccaagtgtcgaaacacatgacgaaactctctgggagggttctcttgcccccaaaattaaagcttggcagcagtgggcgcatcaaggacataacaccggaccgatttgatcgacagtggagctttctggatagccatgttgcagagggttccaagatcaagagttgggccttgataagttttggtggcaccccggagcagcacttttgcattacaaagtttgtgaaccagctatcaaatcggtgtgagcagctaggaattctgctaaacaagaagaccattatcagcccaatatttgagaggattcaactactcaataacgtgggaattttggagggcaagctcaagaaaattcaagaagctgcatcaggcaacttgcagttgctaatctgtgtcatggagaggaggcaccaaggctatgctgatctgaagcgaattgcagaaacatccattggtgttgtgacacaatgttgcctttactccaacttgagcaagctgacctctcaattcttgacgaatttggctttgaagatcaatgcgaaactcggtggctgcaatattgccctatacagcagctttccatgccaaattcctagaatatttttgtcggaggagccggtgatgttcatgggtgctgatgtcacacacccgcatccccttgatgattcaagtccatcagtggttgctgtagttgcaagcatgaattggccgtcagcaaataagtacatctccaggatgagatcacagacacaccggaaagaaatcattgagcaactggatgttatggctggtgaactgcttgaagagtttctaaaagaagtggggaagctcccaagcagaatcatattcttcagagatggtgtgagcgagacacagttctacaaggtgctgaaggaggagatgcatgcagtgcgcacaacttgttcgaggtatccgggttacaaacccttgatcacattcatcgtagttcagaagaggcatcacactagactcttccacagggagaggaatggcagctcgtcacactactctgatcagaacataccaccaggaacagttgtggacactgtgattacacacccaagggaatttgatttctatctgtgcagccactggggcaccaaggggacgagccggccaactcattatcatgttctgtgggatgagaataacttccgttccgacgaagtgcagcagttgatacacaatctttgctacacatttgctcggtgcaccaggccagtttctcttgtcccaccggcttactacgcacatctcgcggcatatagaggcaggctgtaccttgagaggtcagatacaactatgtacagggtcagtccgttgcagactgtgccgctacctaagctcagagacaatgttaagaggctcatgttctactgctag

SEQ ID NO: 6016 - DNA, 1756 bp, Oryza sativa
  Predicted polypeptide sequence is orthologous to G1181, G1850
aaagacttccggtccgtaccttcgttttcacacgcgaaaactgcctttcttccggcatctggaagctactactactacggtcggtcctcgccggatcagatccggccgcctccccggcggatggcggagcagggggcgggcgaggcggatgcgggcggcggggagccgccgccggcggcggtgatgacggcggcggcggaggcgttggcggggcagaggtcgctgccgacgccgttcctgacgaagacgtaccagctggtggaggacccggcggtggacgacgtgatctcgtggaacgaggacgggtcgacgttcgtggtgtggcggccggcggagttcgcgcgggacctcctccccaagtacttcaagcacaacaacttctccagcctcgtgcgtcagctcaacacctatggatttaggaagatcgtgccggaccggtgggagttcgccaacgactgcttccggcgaggggagaagcgtttgttgtgtgatatacaccgccggaaggtggtggcggcggctgccgcggcgccgccgccgccgtcgccgggatggcgacggcagctgccgcggtggcttcgggagctgtgacggtggccgcggcgccgatacctatggcgctgccggtgacgcgggcgggctcgccggcgcactcctcggaggaacaggtgctgtcgtcaaactctgggtcgggggaggagcaccggcaagcgtctgggtccggctctgcgcccggcggcggcggcggcggctccgcgtccggcggcgacatgggcgaggagaacgagcggctccggcgggagaacgcgcggctgacgcgggagctcggccacatgaagaagctctgtaacaacatcctcctcctcatgtccaagtacgccgccacccagcacgtggagggctccgcggggatatcctccatagcgaactgctccggcgagtcgtcggaggccgttcccccgccgccgcctctccccccggcgatactcgatctaatgccctcgtgccccgccctggccaccgccgccgccgctgcggggctcgccatagacggcgagcccgacccgagcgcgcggctgttcggcgtctccatcggcctgaagcggacgcgagacgacgccgccgccgccgccgacgaagacggcggcggcgaggatcaggccgagcacggcggcgcggacgtgaagccggaggcggcggatccgcatcccgccggcggcggcggcggaagcagcacggaggcgtcgccggagtcgcacccgtggcccatataccggccaacccccatgtaccacgcggtcaggctcacttgcaacgggccggacagggccgggtccgaccaagacgggtccagctccagccaaacgatgggacctggtgaattcgacgatctgcaaaagatgatggtggtgcaacagagcaacttcgtgatgcactggggacgctcggaatgcggtagtggcgtaaggggttttggatggtgatggcagacaacagcaaatggtgttgtgatccacggaggcggagatggtgcggtgatgggtagctgggactagttccaattctccctttccatcctctcgggttgcggcggaaagttcaagtcatcgttgaaggtttaaagctaactcttcaagctttgtgtgtgtgttggtgtgtttgtgtgttttcctctgcatgaggattggagtctaagaacttgtatgttatggttgtgtgatatagaggctagattaataaaaaaaattcattatct

SEQ ID NO: 6017 - DNA, 1938 bp, Oryza sativa
  Predicted polypeptide sequence is orthologous to G1181, G1850
atctgccatgaaaggaagcaggcttgcggtgaaagaaagttgtctgccgatgacgatgccaatgccagagactttcgcacagtacagtaatccattgcggtcaactagggcctacggtcaactctgcagggtgccaggccggcggcggcacgcgtgcgtcgacggctgggggcaggaccgcgcccgcacgaggggagacgacggccagcggcgctatgcgcagtgccgcggtggctggggagatatttggagatggggaggctacattacatgcgggtcaccgcgggagacggggatggtgaatggtgcaccgtccccgcccccgccatccccgatggtgatgagttttggaccattagattcaccatgggtgaagcaaccagacaccacggtgtatccaggccagatctgcgcggccgccggcggcggcggtggcatggctgaccagaccgctgctgccgttgtcgtcggaggaggagcggcggcgacgatgggggagccatctccacctccgccggcgccggcagcggaggcggcgggggtgggggtggggcagcagcagaggacggtgccgacgccgttcctgaccaagacgtaccagctggtggatgacccggcggtcgacgacgtcatctcctggaacgacgacggctccaccttcgtcgtgtggcgccccgccgagttcgcccgcgacctcctccccaagtacttcaagcacaacaacttctccagcttcgtccgccagctcaacacctacggatttaggaagattgtcccggacaggtgggagttcgccaacgactgcttccgccgaggggaacggcggctgctctgcgagatacaccgccggaaggtgacgccgccggcgccagcggcgacgacggcggcggtcgcggccgcgatcccgatggcgctgccggtgacgacgacgcgggatggctccccggtgctgtccggcgaggagcaggtcatatcctccagctcgtcccccgagcccccgctcgtgctgccgcaggcgccgtccggctccggctccggcggcgtcgcgtccggcgacgtgggggacgagaacgagcggctgcggcgggagaacgcgcagctcgcgcgggagctcagccagatgaggaagctctgcaacaacatcctcctcctcatgtccaagtacgcctccacccagcagctcgacgccgccaacgcctcctccgccgccgggaacaacaacaacaacaactgctccggcgaatccgccgaggcggccacgccgctcccgctccccgccgtcctcgacctcatgccttcctgccccggcgccgcctccgccgccgcgcccgtatcagacaacgaggagggaatgatgagcgcgaagctcttcggcgtctccatcggccggaagcgaatgcggcacgacggcggcggcgacgacgaccacgcggcgacggtgaaggcggagccgatggacgggcggccgcacggcaaggacgaacaatcggcggagacgcaggcctggcccatttaccggcccaggcccgtttaccagcccatccgggcctgcaacggatacgagtacgaccgagccggcagtgaccaagacgagtgtggagccaagccgagcaaccaggacaagaaagatcttcttcgacggtgggttgttctgatttctgaatctctgcaactgcacggccgtcaagttgtgggggctgtgcaagaatggcggcgcgaccgtcgtggccatcgacggcctcctgcaggtcacgttcagttgcgtacttgcgtcaacaacctcctggtcaccggcgccggcaccctcgacgctggacgagagtacgagaccaactccctacccaggccacgacggtgagatcttagggtttgtttagttactgaagtttgaagttaaaagttcggaaaaaaaagttaaaagtttatgtgtgtagaaaa

SEQ ID NO: 6018 - DNA, 1172 bp, Oryza sativa
  Predicted polypeptide sequence is orthologous to G1181, G1850
ctctctggatcttcttctccgtctcctccccggtctcgtgtgagcgctactcccggcccacaggttcttcatggcgtcgccggcggcggggacgccgccgttcttgacgaagacgtacgcgatggtggaggacccgagcaccgatgagaccatctcgtggaacgactccggcacggccttcgtggtgtggcgccccgccgagttcgcccgcgacctcctccccaagcacttcaagcacagcaacttctcctccttcgtgcgccagctcaacacctacggattcaagaaggtggtggcggataggtgggagttcgccaacgactgcttcaggagaggggagaagcacctgctcggtgggatacagaggcggaaggggtctgggaccggaggcgcgggggcggcgccggcggggggcataccgacggcgataccgatctcgtccccgccgacgagctccggcggggagcccgcggtgtcgtcgtcgccgccgcgcggggcggcggggatcgcggcgggggtgagcggcgcggtggccgagctggaggaggagaacgcccggctgcggcgagagaacgcgaggctggcgcgggagctggcacgcgcgcggcgggtctgcgacggcgtgcggcgcctcgtgtcgcggtacgaccacgaccacggcggcggggaggaggaagcgggggagggcgacgtgaagccgatgctgttcggcgtggcgatcggcggcaaaagatcgcgcgaggagaacggggaagacgaggaggaggaggaggaggaaggggctgacgaggacggcgaagacgatgaggtggaggaagacgacgaggagagagagaggcacgcggcgcggcgggtccccgtgagggaggggaaggtcaggaggacgacggagctgtcggatctggacgtgctcgcgctgtccgtgcgggcggcggccgcggcgaggccgggcggggcctcccgtgaccgcaagagctcggtctcgtaacggttgttgacttgctgttgattttatatgcggcgtaaaactgagaaaattggatggcacatgagccaaattgaattgtagttcgtaccagtaccaagcaaactgcagccactttacagggtactaaactatactttcgggagtagtaggaacattgtagccttggttgtcatgatgatgtaaa

SEQ ID NO: 6019 - DNA, 2791 bp, Oryza sativa
  Predicted polypeptide sequence is orthologous to G1190
ggtggatgcagagtagctgggggcaaagaaaaaaaaacatttaattcttgcaatcctagctagtaatatatattcgagtcgaattgtttgtttgtttgtttgttgctaggtttgtctgggggtttggttagttataaaaagagagctagcaattctccacatttctctcccggttcctccgctgcaaccgttctcttgcttcaattctcgattcgccatgcatgcaagagtctgctgaacgccgattgattaattgtcttgtagtatctaggaaagtaatccgctgctgtatcctcctcctatctggattctggagtgatccctgcccgctggctccatcccgccgctgccgacacacataattaaacagctactagttgatcgatattatttcttctcttctcttggggtcatccctctcaaatcaagctctactactctacatactctctatcgggtgccggcactgcagtcccccaggtgagtgagtgagtgagtggagtgcggtggcagagagctagctaggcatgaagtacagcaaggaagcaaagcccgagagggcggcgggagggcggtcgagagccgtgccggtggcgctcctgttggtcgtgctctgcgccttctccttctacctcggcgggatctacagcaccggccgcagcttgctcgatgtcaatggcatcgtcgtcaagggggcctcttcttcctcctctgcctctgccgttgccattcaaaaggacaccaacaccaaagccgtcgtcgtcttcccagagtgccccgccgactaccaggactacactccctgcaccgatcccaagcgttggcgcaagtatggcaactaccggctgagcttcatggagcgtcactgcccaccggcggtggagcgcaaggagtgcctggtgccgccgccgcaggggtacaaggcgcccatccggtggcccaagagcaaggaccagtgctggtacaggaacgtcccctacgactggatcaacagccagaagtccaaccagcactggctccgcaaggaaggcgacaagttcatcttccccggcggcggcaccatgttccccaacggcgtcggagcctacgcagacctcatggcggagctcatcccgggcatgacggacggcacggtgcgcacggcgctggacacgggatgcggcgtagccagctggggaggcgacctgctggggcgcgggcggggcatcctgacgctgtcgctggcgcccagggacaaccacgaggcgcaggtgcagttcgcgctggagcggggcatcccggccatcctggggatcatctccacgcagcgcctgcccttcccgtccgcggcattcgacatggcgcactgctccaggtgcctcatcccgtggacagagttcggcggcctctacctgctggaggtgcaccgcgtgctccgccccgggggcttctgggcgctctccggcccgcccgtcaactacgagaaccgctggcacggctggaacaccaccgccgccgcgcagaaggccgacctcgaccgcctcaagaagacgctcgcctccatgtgcttcaagccctacagcaagaagggggacatcgccgtgtggcagaagtccaccgaccctgcctgctacgacaagctcacgccggtctcctcccctcccaagtgcgacgacagcgtcgacccggacgccgcctggtacgtgcccatgcgctcctgcctcacctcgccttcttccacttcctcgcgctacaagaagctggcgctcgacgccacccccaagtggccgcagcgcctcgccgtcgccccagagcgcatcgccaccgtccccgggagcagtgccgccgccttcaagcacgacgatggcaagtggaagctccggaccaagcactacaaggctctgctcccggcgctggggagcgacaagatcaggaacgtgatggacatgaacaccgtctacggaggcttcgccaccagcctcatcaaggaccccgtctgggtcatgaacgtcgtctcctcctacggacccaactccctcggcgtcgtcttcgacagaggcctcatcggcaccaaccacgactggtgtgaggcattctctacataccccaggacgtacgatctattgcatcttgatggcttgtttactgcagagtctcataggtgcgagatgaagtttgtacttcttgagatggaccgtatccttcgtcccactggttatgccataatccgcgagaacgcctactttctggattctgtagccaccattgccaaaggaatgagatggaactgtgacaagcatgacaccgaacacaaggcagacaaggagaaggtcctcatctgccagaaaaagctttggtcaggaaagaacacccagcattgaaaaaaaaaatcaataacttgatagcctcaccttgatcgaacctggagggatcacaatgtaaatctgctcaacgatttcaagacagtgctcaacctaaggcacttcaccctcccactagacttcacactctgatacaagaacgttcgtataatgattaaattaaataaaatgagcaatactccaatataggatccaatacttcctactctctgccagttatcacacaattattttttacagttactaggggaccaattaattaataccaccaagaggcagctgtaagttattacttttttttagaatggacaactgtaagttacttttatactactatatagaatgttcatttgtattagccatagcttgtttctacgattgtaacaataggaacggctatatatttattttaattgaatgtttacaggagc

SEQ ID NO: 6020 - DNA, 1831 bp, Oryza sativa
  Predicted polypeptide sequence is orthologous to G1202
gatagtactagctaaatgctcgtgcgttacaacagaattctaaaagagaacttcatttttctaaaaccattccccattgtcgactcacgagactatagatgcatcaataaaattttattggttagctcgcatgacaaaatgattcctaatcatgatcctaacttaaagttgctattaaattttctaatggattttttgcgatttcgatagcctggttttcttgaatggctgtgatgatttggctgccccctcgagatcatctggtatcttcttggttccttggtaatatgttcagctagctgtcatactaggtggccttgctccccagcaagttaccagttgcagctatttcttgtctgtacatgatgtaacgaatgattctactcatttgttcatgtacggagttacggagggagtactatcaacatgttgcccagaaccataggcatttgtaacaattgggaattgacagttgggctaatctgagccattcaagtatatttcctttgttttcaaccatgttttacctccttactttcttatggctgtgcttgtaatgatctgagtctggtattctggtattgtttctgtttggtgagaaattaatattactatacaaacaatttttttttagattcgttgatctcattttgacttccatttaggccactcagttgtcatttgcatgtcgccctgttcatatacagtagcatatgcgagatgttggaactctttcaagttttgcttttgctgaggcatttaactttttgccacttttaagatgtggcaattaagaatttgttactcacaatctatgacagacattgtggatccagtagcaaatccttaattgccacttgtaaatagttaaatatctcttcatttctatgtagtttattcattcctttttttcttaaggaatggaatgttgactatttattaacttagctgtagtgtgatcattattattgtcctttcatactttaaggatatactcctgttcatccatattttgatgtttgttacttctttagttcttgaatggctgtgatgatttggctaccccttgaagatgatttgacatcttctcgccgtttgttacttctttagttcttgaatggttgtgatgatttggctaccccttgaagatttgacatcttctcgttcttggccatgtacatcagtcttggatgtagaggccatgttttaatccattatctaaaataaatatcttgttggttcattagcagtatgttcagttagctgtcatactaggaggccttgctgcccagcaaggtaccagttgcaggcttgcagccatttcttgatagtacatgctaatctactcatttgttcatgtacagagagacggagggagtatttacattttgccggagccacaggcacattaaactgtttggaattggcaatcgggttaatctgagccattcaagtcatttcctttgttttcatccatgctttgccccaatggtatttgttctttacagttttaccagcaggcgccttaataagcacgaagtcttggcaaaatgtttgttggtaatggccccagggacgaacccatcgacttgtgtgaattgctttgcgaatcttcggcttcagcttattacggatgtaacttcaacatcatctgttagtccctcgttagctttggctaattgtttctttttctggggagggaattttgtggctaaatttggaggttttgctccatgatatgcaaccagttttctgacaaattgttgttgctaatgccacatgatgaaatcagcaggcattgccagtggtgcacgctggaatgaacggttgt

SEQ ID NO: 6021 - DNA, 1290 bp, Oryza sativa
  Predicted polypeptide sequence is orthologous to G1206
gataactacatatactgccctacattggataatggaaagccagaagatctcacacacttccagaagcattgggtgaaaggcgaacccgtaattgttcaacaggttctcaagaaaatgtcatgtttgagttgggagccaccagatatgtggtctaaagtacatggcaccggcactagtcctgagatgaaaaacgtgaaggctattgattgtttatcttgctgtgaggtcgagatatgcactcaagacttcttcaatgggtattatgaaggtcggatgtatcaaaatctatggcctgaaatgcttaaattgaaggactggcctacatcaaatcattttgaagagcttttgccttcccatggagttaaatacatgaattctttaccttttcaaccatacacaaacttgaagtctggtttgctgaatgtctcaaccttgcttcctgatgacatcttaaagcttgacatgggcccaaaatcatatatagcttatggctatgcacaggaacttggtagaggagattctgttacaaagcttcactgcgatttgtctgatgcagttaacgttttgatgcatactgctgaagttgacccttccgaggaacaaatagatgcaataaaaagtttgaaaagaagacatacagcgcaaaatgaaaaggagtgttctgggaatgcagacggaaattatacatctcctaaaatctgtggggatgcaaatgagttgtcctgtcctataaacagtgagaccaacaagggaggtgctttatgggatatttttaggagggaagatgttccaaaactgaaattgtatctcgacaagcattctaaggaatttcgccatatatactgttctgcagttcaaaaggtatgtaaccctgtacatgatgaaacattttatctaacagaagaacacaagagaaaactcaaggaggagcatggaattgagccttggacatttgtacaaaaacttggggaggcagtattcattcctgctgggtgtcctcatcaagtacggaatcttaagtcctgcaccaagattgccttggattttgtatcacccgagaatgttaaggagtgtctcagcttaaccgaggacttccgaagacttcctaagaaccacagggccaaagaagacaaattagagctaggtgtggttcaaaatggacccaagcccacataccctcgagaaactattctaaactctcaatgggacatcttgttgtttgcatatcatccaaatagttatgacaaagtttaagaagatagattaatatgtgataatcactcttcaaac

SEQ ID NO: 6022 - DNA, 650 bp, Oryza sativa
  misc_feature (1)..(1): n is a, c, g, or t
  misc_feature (9)..(100): n is a, c, g, or t
  misc_feature (240)..(240): n is a, c, g, or t
  misc_feature (249)..(249): n is a, c, g, or t
  misc_feature (389)..(389): n is a, c, g, or t
  misc_feature (410)..(410): n is a, c, g, or t
  misc_feature (421)..(421): n is a, c, g, or t
  misc_feature (423)..(423): n is a, c, g, or t
  misc_feature (431)..(432): n is a, c, g, or t
  misc_feature (584)..(584): n is a, c, g, or t
  misc_feature (634)..(634): n is a, c, g, or t
  misc_feature (637)..(637): n is a, c, g, or t
  Predicted polypeptide sequence is orthologous to G1206
nacattgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttattgcatctatttgttcctcggatgggtcaacttcagcagtatgcatcaaaacgttaactgcatcagacaaatcgcagtgaagctttgtaacagaatctcctctaccaagttcctggtgcatagccataangctatatantgatttgtgggccccatcgtcacagctcttaacgagtgtcatccacggaatgcaagggttgacgcacattcagccaaagccagaacattcgaaggtttggtgtactgggttgacaaagtgtaacagacattcagtggtantattaaagcgtccagtagggnacaggggcaananaggcgtcnnttcaacacagtggacttgtggactgtcagcgcccagataccttaccaatcttcaagccatttcgaggcccatagcatttgtgactaacatccgaacccttcagtaactacgcccattggacacgacagtccttggaggtgcgatatcgtcgnaccctcacgagcacagatacacacaatccaatacgccccttccacggtanttnttacactccctca

SEQ ID NO: 6023 - DNA, 700 bp, Oryza sativa
  Predicted polypeptide sequence is orthologous to G1225
gtgtcataaattctcctctgttacccatcgtacgtagaccaacatccccgggggtattttactatactagtagaggctattgcatgggtgatcactgatcagaattgcgtctcgctgctgctgctgttgatgctgctccatatctgccatggccgattgcttttgaccagagattccatggcggaaaggccattgcttcccttggccccttgggtggaggaagggtgcggcatggcgacggtggacgacatcgcagcggcggtgcaccacgtgctctgcatcatcgacgccgaggcggcgtcgcagatgctgctcgccggggaggcctccggttagcgtggccacctagcaagataggcgcgcggcggcggccggtgtaacaaatctgtaaagtgtagcggatctcgatcgatctctcccctcccgtaggcgagtcgggtgatttgggggtcggtggcgtagggcaaaagcccgtgtaagtgcaataacatgcggcccgttgtaatcctagccggttttttttttttttgccgtcgagtgtgtgcgttttgcggttttctcggcggaagtcgacgtggaatccgggggagtgagacggtgaagagagggtttttttatccttgcttgtccctccatgttgggccgactaggtacacagcctatgggcttgagattagcacatggtccggcccaattgaac

SEQ ID NO: 6024 - DNA, 449 bp, Oryza sativa
  Predicted polypeptide sequence is orthologous to G1229
gcggtgaagatcatcgccgccctggagggccgatcgctggagattcttcacgccaagatcagcaccgtcgatgacaccgccgtcaactccttcactgtcaagattggaattgagtgcgagctcagcgctgaagagttggtacaggtgattcagcaaacgttcacatgactcacgcatgtttcgaccgaccaactgttgaagctgaaattaattaagtatagcatgcagcagaaacagagcgaacagccaagggagcactagagtcgacaatacgtgttgggctctctgtgtacgagtgtgtctgcatttgcgagatgaaattcaatttagtttcaattcagatttgcctctagtgctcatcatgcacgtgctaattttgcatttatttttgtctttttgttaattctcgtgcaaattgatttttctacatatataggactatcggattc

SEQ ID NO: 6025 - DNA, 3749 bp, Oryza sativa
  Predicted polypeptide sequence is orthologous to G1242
atcgctcggtccttcgaacccccaccgcctccgtcgacacattccgcgctcgaatcgaatctacgaaaccctagcccgccaccgccgccccaatggcgaagccggtgaagtacgacgaggaggaggaggaggtctcgtcctccggcgaggaggaggaggagcagtcggacggcgccgggtccggatctggcgaggaggaggatgaggaggaggaggaggcgcccgcggcggcggccggcgaggcggctggtggggaagaggaggaggtggatgaggaggagatcgaagccgtcaccaccggtgccggcgccgacgaggaagaggaggaaagcggtgcggccgccgccgcccccggggagggcgatgaggagtcgcagtccactgaggacgacgaggccgtcgtgggggaggacgacgacgcagatgaggctgaaggaggtgcagtagtagggaaacgtgagaaagccaggctcaaggaaatgcagaaattgaagaagcagaaaatacaagaaatattggatacacagaatgctgcagttgatgctgacatgaacaataaagggaaaggacgattgaagtacctactgcagcaaactgaaatatttgcacattttgccaaagggaaccaatcaaaagagaagaaaccgcgtggaaggggacgccatgcctcaaagatgacagaagaggaggaagatgaagaataccttaaagaagaggaagatgcccttgctggttcagggggaacacgcttgctttcacagccttcatgtataaaggggaagatgcgagactaccaactagctgggcttaattggctcatacggttgtacgagaatggtatcaatggtatattggctgatgaaatgggtcttgggaaaactcttcaaactatttcgctgctgggctatctgcatgaattcaggggaataactggtccgcacatggttgttgcaccaaagtctactcttggcaactggataaaggaaattcaacggttttgccctattctacgtgctgtgaaattcttagggaatccagaagagaggaaccatataagggagaacctattgcagccaggaaaatttgatgtgtgtgtcactagttttgaaatggcaatcaaagaaaaaactacactgaagcgtttcagctggcgttacattattattgatgaagcacatcgcataaaaaatgagaattctcttctgtccaagacaatgaggatttataatactaattatcgtctccttatcacaggcacaccactccagaataatctccatgagctttggtctctcctcaacttcttgttgcctgaaatatttagctctgctgaaacatttgatgaatggtttcaaatttctggtgaaaatgatcagcaggaggttgttcaacagcttcataaggttcttcgcccatttcttcttcgaaggcttaaatctgatgttgaaaagggattaccccccaaaaaggaaactatccttaaggttggaatgtctcagatgcaaaagcagtactatcgtgccctgcttcagaaagatttggaggttattaatgctggtggtgaacgcaaaagattgcttaacatagccatgcagttgcgcaagtgctgcaaccatccatatttattccaaggagcagaacctggtccaccttacacaactggtgaacatctagttgagaatgctggaaaaatggttctgttagataaattgctgcccaaactgaaggatcgtgattctagggtgctcattttctcacagatgaccaggcttttggatatattggaagattatcttatgtacagaggctatcagtattgccggatagatggaaatactggtggagaagatcgtgatgcatccattgaagctttcaacaaaccaggcagtgaaaagtttgtttttttgctttcaaccagggctggtggccttggcatcaaccttgctactgctgatgttgtggttctttatgatagtgattggaatccacaagctgatctgcaagctcaagaccgtgcacataggataggtcagaagaaagaagttcaagttttccgattttgcactgagtataccatcgaggagaaagtgattgagagggcatacaagaagcttgcattggatgctttggtcattcaacaaggccgactggcagagcagaagactgtcaataaggatgatctgttgcaaatggtaagatttggtgcggaaatggtattcagttccaaggacagcacaattacagatgaggatattgaccgtatcatagctaaaggagaggaaacaacagctgagcttgatgcaaaaatgaaaaagttcacagaggatgctattaaatttaaaatggatgacactgcggaattgtatgattttgatgatgataaggaggaaaacaagcttgattttaagaaactggtcagtgataactggatagagccacctagaagagaaaggaagagaaactactctgagtctgaatactttaagcaagcacttcgccaaggtgcacctgcaaaacctagggaaccacgaattccaagaatgccgcacctacatgatttccagttcttcaacaaccaaaggctcaatgaattgtatgaaaaggaagtccggtaccttatgcaagcaaaccagaagaaagatactattgatggtgaagatgaagatcagctggagcctttgactgcggaggagcaggaagagaaagagcagttgttagaagagggttttgcaacatggacgaggagagacttcaacacatttattcgtgcatgtgagaagtatggtcgaaatgatattaggagtattgccgctgaaatggaggggaagacagaggaggaagttcaacgatatgctaaagttttcaaggagagatacaaggaactgagtgattatgatagaattatcaagaatattgaaaggggagaggccaggatatcacggaaggatgaaattatgagagccatcgggaagaagttagaccgctataagaatccatggttagagttgaaaatccagtatggacagaacaaagggaagttctataatgaggaatgcgaccgttttatgctttgcatggtgcataagcttggttatggaaactgggatgaactgaaagctgccttccgcatgtcgcctttgttccgatttgattggtttgtcaagtccagaaccacccaggagttggctaggagatgtgatacccttatccgtctagttgagaaagagaatcaggaatatgatgagcaagaaaggcaggcaaggaaggacaaaaggatggctaagaacatgacaccgacaaagcgatctgcgttaagggtttcagaaggtgaaactactccatcgaattctttcaagaggcgacgccagtcccttatggatgactatgtgggctcgggaaggcgtaagcgaggttgatcgggcgttgcctgctgctccctttcaagcttgtcggaagtctgggagagctttgaaatgtgcgcgctatgtgatgtttaaagcctctaggcgcacttaactcatcgctgaggcctaactcagtatgatagtgtagtggtatataatactatatgttttctctgcggggatttcatgaccgctctggctagcctatgcattaggaatcagatgtactatggattatccaactttggtagaggtgaactcatcgaagctacccttttaaatccctatgcttatgttacattggccaaaagtccgctcctaatccgagtattctatcttccgagt

SEQ ID NO: 6026 - DNA, 4000 bp, Oryza sativa
  Predicted polypeptide sequence is orthologous to G1242
ggatttctttcctcttccgtttcttcactagttcatttcacgccgcccccgcgcgagcggcgacaaggcgaaaccgcttcaatataagatcaccccaatcccccaattcggcaactccaatccaattcaattccccacccccgatccgcctctcgcaaatctcccgaaaccctagccgccaccgccgccgccgccgcctcgagcgaggcgtgatggggaagccggggaagtatggcgacggcgacgacgacgactcggaggaggagcagctctccccttcgtcttccgccggcgaggaggaggaggaggaggtagaagaggaagagggggaggagcagcaggaggagcagggggaggaggaggaggggtttagcggggacgaggaggagcaggaggtggagggtgaggcggatggggagcaagtggaggaggaggaagaggaggagtctagtgtcggggaggaggaagcagaggcggagggtgaggaggaggaagaggaggtggaggaggagcagggggctggggaagaggaagaggaggaggttgatgaggaggagatcgaggcggtcaccaccggcgccggaggggacgacgacgacgaagaagtgggcgatgacgggggcgcggaggaggagtcgcagtccacggaggacgacgaggtcgccgccgggaaggatggcggcggtgaagatggcgacaagttggaagatgctactggaaacgcagagatcgggaagcgggagcgagcaaagctcagggagatgcaaaagctgaagaagcacaaaatccaggaaatactggatgcccaaaataaggccattgatgctgacatgaacaacaaggggaagggacgtctgaagtatctcctgcagcaaactgaaatatttgctcattttgcgaaaggaaaccaatcgacagagaagaaatcacgtggaaggggacgtcatgcatcaaagatgacagaggaggaagaagatgaggagtatctcaaggaggaggaagatgcccttgatggtgcaggagggacccgtctggtttcacaaccatcatgcataaaaggaaagatgagagattaccaactagctggacttaattggctcatacgcttgtatgagaatggcatcaatggaatattggctgatgagatgggtcttggaaaaacccttcaaactatatcactgcttggatatttgcatgagtttagaggaataaccggtccccacatggttgttgcaccaaagtccactcttgggaactggatgaaggaaatacaacggttttgtcctgttctgcgtgctatcaagttcttaggaaaccccgaagaaaggaaccatatccgggaaaatttgttagtcccagggaagtttgacgtctgtgttactagttttgaaatggcaattaaagaaaaaactgcattgaagcgtttcagctggcgttatattattattgatgaagcccaccggataaaaaatgaaaattcccttctctctaagactatgaggatttacaatactaattatcgtctcctcattacgggcactccactacagaataatcttcatgaactttggtctcttctcaacttcttgttgcctgaaatatttagctctgctgagacttttgatgattggttccaaatctcaggggaaaatgatcaacatgaagttgttcagcagcttcataaggttcttcgtccatttctgcttcggaggcttaaatctgatgttgagaaaggtttaccaccaaaaaaggaaactatacttaaagttggaatgtctgagatgcaaaaacaatattatcgtgctctgcttcagaaagatctggaggttgtcaatgccggtggtgaacgcaaacgccttcttaacatagccatgcaattgcggaagtgctgcaaccatccatatttattccaaggtgctgagcctggtccaccctataccactggagaccatctaattgagaatgcaggaaaaatggttctgttagataaattacttcccaagctaaaggaacgtgattccagagtacttattttctcacagatgactaggctcttggacatcttggaagattatctgatgtacaaggggtatcaatattgccgaattgatgggaatactggtggtgaagatcgtgatgcttcgattgaagctttcaacaagccagggagtgaaaaatttgttttcttgctttcgactagggcaggtggtcttgggataaatcttgctactgctgatgttgttattctttatgacagtgactggaatcctcaagtggatctgcaagcgcaagatcgtgcacatagaattggtcaaaagaaagaagttcaagtttttcgtttctgcactgagtatacaattgaggaaaaggtgattgagagagcttataagaagcttgccctggatgctttggtcatacaacagggtcgattggcagagcagaaagctgtcaataaggatgagctattgcagatggtcagatttggtgctgaaatggtattcagctccaaggatagcacaataacagatgaagatattgaccgcatcatcgctaagggagaagaagcaacagcacaacttgatgcaaaaatgaagaagttcacagaagatgctattaagttcaaaatggatgacactgctgaactgtatgattttgatgatgataaggatgaaaacaaacttgattttaagaagttggtcactgacaactggatagagccaaccagcagaagagaaaggaagcgaaactactctgagtctgattatttcaagcaagcacttcgccaaggtgcaccagcaaaacctagggaaccgagaattcctcgaatgccacacttgcatgatttccagttcttcaacactcagagactcaatgaattatatgagaaggaagtcaaataccttgtgcaagcaaatcagaaaaaggatacggttggtgagggtgatgacgaagatcaactggaaccgttgactgtggaggagcaagaagagaaagagcagctattggaagagggcttttcgacatggacaaggagggacttcaatacattcatccgtgcttgtgagaagtacggtcgtaatgacataaagaacatatcctctgaaatggaggggaaaacagaagaggaggtgcagcggtacgctaaagttttccaggaaagatacaaggaattaaatgattatgaccgagttattaagaacattgagaaaggagaagcaaggatataccggaaggatgagattatgaaagctattgggaaaaagctagaccgctataagaacccttggttagagttgaaaattcagtatggccagaataaagggaagttatacaacgaagaatgtgatcgttttatgttatgcatggtgcacaaactcggatgcggaaactgggatgaactgaaagcagcctttcgcatgtcgcccttgttccgatttgattggtttgtgaagtctagaacaacccaagagctagctaggaggtgcgagaccctcattcgtctagtggagaaggagaaccaagaatatgatgagcgtgagagattggccaggaaagataagaagaatatgtcgccagcaaagcgttcttcatcaaggtcgctcgatacccctccacaaagctcttcgaagaggaggcgccagtcctacactgaagccaatgcaggctcgggaaggagaaggcgagggtgatctgattattgttcgttcctccccccatatgcatttagggagctcatttggaggttgacatgaaacccaaggggaaaccccagatacatcccaattgtctagcagtagctttagctcaaaaaaaaaaaaaaaaaactagcagacataactctagtgagatggttagcttgtataccggttaaagtggttgtgttttaaagttttaaattggacgggcaacattacaaattttaggtgatcataactataacaagtagttgatctctcttttggagacatcaatcaaataaaacaaagttgcttttacctgt

SEQ ID NO: 6027 - DNA, 641 bp, Oryza sativa
  Predicted polypeptide sequence is orthologous to G1246
gagacggccgactacgtggccgcgctggagatgcaggtcaaggccatgcgcgccctcgccgacgcgctcgccgccgcgcagctctcctcgtcaactccgcagcaggcggaggccgccgccgacgagaccgagatggagaggtgagggtttcgtggtcaatcgtgagttcatcacacgatcgatgatgctggattcgattcgatggctcggaaattggaacggctcggggaaaaaataagggcgattaattagtggattattattgcgagagggtttgggatttgaggagggtaattgcgatgattgatgctgctgataatgctgctgctgctgctgctgctgatgatgatgatgatgacgatgatgatttgtaaattcttgatacttgtataagtaatgctgctctgctcctctcttgtttttttctccttgattcttgaaatgtttttctcctcctgatttccaaatcatgttggggattcctgatttcctgtttcatcttgattagtagtattatgctgtgattggggattagtgtgttttgccctgtgttaatcagggattatatgttctctctttttttttttttgcttgcgaagaattggagagaaaaaaatgtgaattctctcaaaataggtatt

SEQ ID NO: 6028 - DNA, 1928 bp, Oryza sativa
  misc_feature (769)..(771): n is a, c, g, or t
  misc_feature (779)..(779): n is a, c, g, or t
  misc_feature (790)..(790): n is a, c, g, or t
  Predicted polypeptide sequence is orthologous to G1246
gtctttctcctcctcgccagggaaaggcccccccgccgccgccgtcgtcgttccagctatagctttccccgccggcggtggcgatcgatcgatcctctcctcgtcggttgattagggtcaagaattcttccctctcccagcttggttgaatttcttggtttgatcaaggggaggaattaattgagaggtgaattagttcgccggagtttgtttctctctctctctcctcttctctgagctgagagggggaggagagaatcaagtgacgagttatagtatggcgaggagcggcggcggcaatggtgggggagaaggtggcggcggcggcggcaatggcggtggcgggggagggttgaagaaggggccgtggacgcaggcggaggacaagctgctggtggaccacgtgcggcggcacggcgaggggaactggaacgccgtgcggcgggagaccgggctgcagcgctgcggcaagagctgccgcctccggtgggccaaccacctccgccccgacctccgcaaggggcccttctcccccgacgaggagcgcctcatcctccgcctccatggcctcctcggcaacaagtgggctcgcatctcctcctacctgcatgggaggacggacaacgagatcaagaactactggaacacgcggctcaagcggcgggtgcgcgccggcttgacgccgtacccgccggagatcgagagggagatcgcgcacctccgcgcgcagaatctcaacctgtccgccgaaggcggcggcggcggcggnnntatgctgnctttcgcgttncttctttacccgagcatcccgttcgccttgcagcaggcgccggtggtggcgccgtcgccgtcggcgtcgcaggcgaattcgccgccgctgatcaaccagaattacccgctcctgaaccagatgcaggggctgcagcttctccacctcgccaaccaccagcaggcgccgccgccgcagcagcagcagcagcagcagccggcgttccaccaccaccacgacggcggcggcggcggcgggttcgtctcgtcggggctcccgccgctgccgaacagaccgcgcgagctcccttcgaaccaattcgagacggcgacgagcggcggcggcggcggctgcgacgcgctgctcgagtcgctgctgctcggcgacgaccacctcctgccgcggcccaaccccgccatgctcagggtgggctccatgcccgagctgatgtaccgcgagcctagctcaagccacgtgctccatggcggcggcggcggcggaggcgccagcgacagtgacgtcacctcgcagtatcctccgggagaagaggacccgcattatggcgggagatgggacttcatcttcgaggacgtgaaacccaagaggaaggcggcgagcgcggtggaggagatctccggcatgttcggcatcgccccgggctccatcccgggggaatggttcaaccccggcggcgtcggcagcgccgccgccgccgccggcgggtcgtcggctccgtctccggggccgtcgtccgtcgtcaccaccgacgacgacttcaccctcgagatgcagcagatcatgtcgtcgctgccgctgcttcaacctgaagagcatcataactggaacgcataaagctttggaacagcaagatgagagatgatttggtagtgagagagagagagagactgtaaatcggttctgatgagcagtgagaaaaaatgttggttcttgttttttgttgtttgtactgggccttattgtcggatctgtcacgcgctctgccttttgagttgcaaactgtttttcgttattgctatcaagtaattaaaagggtttctcgtagttgatagtccttgtctaaatcagtgaagagattcaagaaaattcagctgatatattggaaatccactccagcaactgtggagtatgttccttgtcc

SEQ ID NO: 6029 - DNA, 534 bp, Oryza sativa; identical to SEQ ID NO: 5112
  Predicted polypeptide sequence is orthologous to G1248

SEQ ID NO: 6030 - DNA, 828 bp, Oryza sativa
  Predicted polypeptide sequence is orthologous to G1255
gacaaagctgggtaccgggccccccctcgagtttttttttccttttttttttttttttttgattaccaataaagtttgtattttgcaatcctgaatacatacaataatttatccccctttcaaaatttaaagttgggagaaagtgaaagaacttctattcaactcaacaaacatatgagggcatcactgaatcaattagttgtatatattgattgattgatttacatgtatatctcctggcctcgaactgtacccgtgcaggacaaccaatggacatatatgcatacatatagcacagctacaggctactactgtcaaccaaccccctgaatctgaagggaggaaaaaaactttcaaaactttcagcaattgagcgcaggggtactgtatacctctcaacaaatagtacaattcactttttagtattatcattattattatagtaataattattattaaaagtccttggatccttagcaaccatcaatggtgaactgatggaaaaagaagacgcatgtgtgaccgtaaaagaaaccagctaaaactaatgcagtttcgacgagttgttttgttcttgtgtgatttcatggcgagcgcgcggccggcagatcaaacttccgccatgcagcgctacgcgacgcacgccgtggcgaccgcggcggtggcggcggcggcggcgctcttgacgaagcggcccttcatccgcggccgcttctcggcgttgagcttgcgcacctcgtaccggatcttcttggagaagagccgcgtccgccgcttctccctgtacctcgacacccgcgcctccctgccgccgtccatccccagcct

SEQ ID NO: 6031 - DNA, 1841 bp, Oryza sativa
  Predicted polypeptide sequence is orthologous to G1255
gacactactgttcccatttttttttgttaacggcgaaaagtgttgtgttgtttgggtaggcagggtgttcgacggaatggcgagcgccgccgcggcgacgggcgcggcgctgggggcgcgcacggcgcgggcgtgcgacgggtgcatgcggcggcgggcgcggtggcactgccccgcggacgacgcgttcctgtgccaggcgtgcgacgcgtccgtgcactcggcgaacccgctggcgcggcggcaccaccgcgtgcgcctcccgtcggcgtcctcctcgccggcatcctcccctcgctcggcggccgctccacgtgccggatcagacgaccccgacgcgccggcgtggctgcatgggctcaagcggcggccgcgcacgccccggaccaagcccgggggaggcggcaagcacgacgcctccgccgcgacggtggccgcggcggcggcgtcggcggtcccggacctcgaggcggaggagtccgggatcgtgggcgacaccgaccacgacgtcggggaagaggacgacgaggacctgctgtaccgcgtccccgtgttcgaccccatgctcgccgagctctacaaccccgtggcggccgacgacgaggagcagcagatcgagcagaagcctgctgcacgcgtcgtgccgttctcggagccgtcgccggagttcgcctccggctcggtggaggcggacggcctctccggcttcgacgtgccggacatggagctcgccagcttcgcggcggacatggagagcctcctcatgggagtcgacgaggggttcgacgatctgggcttcttggacgacgagaagcctcacgtgaaactggacctggacatggacatggacttcgcctccatctcgccggcgccggcgccggagcgggaggagaggaagaggaagcggccggagatgatactcaagctcgactacgagggcgtcatcgactcgtgggcccgcgacggagcctcgccgtggttccacggcgagcgccctcgcttcgatcccagcgagtcatggccggacttcccggcgggaagccggggagggctcggcgcggcggtgacggcggtgaccggcggcgagagggaggcgcgggtgtcgcggtacagggagaagcggcggacgcggctgttcgccaagaagatccggtacgaggtgcgcaagctcaacgccgagaagcggccgcggatgaagggccggttcgtcaagcgcgccgccgcgctgccgccgctcccgctgcccaggcaccagcatccgccgccgccgccgccgcgcgctctgccgccggtgccgatgatgctcgcgccgcgcggcgcgcacgggcgctaccgtttttgagagctaccgctctcgatcggcttccgatgcgcatgcgcgcgtcgtctagctacatgcatgcatgcatgctagcgatagccgtttgcgtgatccaacaataagtacaaaaatactactatatatatatacaaacatacaaactcgtcgaatcatcgatcgtagcatgttggtttcaggtttaattgtttgggggtagtgttagttttgagcagaattaatctttgtgaattagggcgccctaccactctactatacgtaccaaatgtaccatgcatgtgtgcactgaagcagccggcaggttgtgtacttgtgcacaatttcatgtgcaaattaagtaggtaagttatgtgtgtggtagctaggctaggatgtgtactttcttggttttctgtaagaaagatcctgctaattataaaggttgttgtagattttgatcccggatcaatgtatgtaaaggcctatatgtatatactggtatatatatacagtgtttaagatc

SEQ ID NO: 6032 - DNA, 1941 bp, Oryza sativa
  Predicted polypeptide sequence is orthologous to G1255
gagaggttttttgtggaatcatcttttgtgctgggagatttcttctgtttgttcttttgtttcgtcgtgacgcatgagctgcagctcggagaaggcggccggggccgtgggcggcaaggcggcgcgcgcgtgcgacagctgcctgcggcggcgggcgcggtggtactgcgcggcggatgacgccttcctgtgccaggggtgcgacacgtcggtgcactcggccaacccgctcgccaggcggcacgagcgcctgcgcctgcgcgtctcgtcgcccccgccgctgacggcgcgggcgtcggtggaggaggaggcggcggcggcggtggggacgacgacgacgacgacgtcgaagagagagggcggcgtcacgccggcatggtcgaagcgcaaggcgcgcacccggcgcccgcaggtcaagagcgtcgggcagctgctctcgaggcggctcgtcgtgccggagatggcggtggagtcgtcggacgaacggaaggccgacgaagacggagctcacgaggagctcgaggggcagttgctgtaccgcgttccggtctttgacccctccctcgccgagttctgctcgcgcccccgatcgatgacgcggcggccgcatcctcatcgtgcttcaaggaggacgccgccgacggcgccgtggaagacgcaaagtatccggcagctgcggcgtcgtcgcccgtgcagcagctcccggatagctttgtcaacttcgaaccgacggacgccgagctgagggagttcgccgccgacatggaagccctactcggacaaggcctggacgacagcaacgagctgcaggactcgttctacatggagaccctagggctaataacgccgccggtagaagaatccggccgggtgaagatggagctcgacggcggtgttgcctccaacagcagggtatctctcccatcatgccgcgctcatccgaagccggaggacgtcgaatccgccgacgtgctggacatcgatttcaactgcacctcgccggacgaacagaagtcgtcggcgagcaacggcgccgcagccgattcgcagttcttccacaggagcctggatctcaggctcaactacgaggcgatcatcgagagctggggcaactcgccgtggaccgacggccggccgccgcacggccagctcgacgacttctggcccaacgaccaccattactcggggttgtgggctgcgggagggggcgggcatggcgcggaggtggggatgatgacggtgaggccgcggatggacggcccggggcgggaggcgcgggtgacgaggtacagggagaagcggcgtacgcggctgttctccaagaagatacggtacgaggtgcggaagctgaacgccgagaaacggccgcggatgaagggccggttcgtcaagcgcccctccgccgccgccgccccgtgcgccgtcacctagacgtacgatcgcgcacggcccggcgcgcggcaccatgcgtacgtgtccggtgtcgagacttgcctgcgttcgatcgtatgcctcatggactcgattggcacaaaagttcacgcaaaatttgtcgaagctgcacgattcaagtagtataacgttgttcaattcaaaagtttttctcttccttttttttttcggttttgttggtgtttggctcggtgcttttggatctcttttatctctgttccatcgaccggagagaaagtaggcgattgtacttgtgtaaacattggtgttcatggttttgtagaaacactccataaaggaaacaaaatgacttgtatatgtaaactgggttgtgcctgcgccacacccatgtacattgagtaatcagtacatacttaattattttcttgcatgtagataactggacaagtatctgaaaacttaccgggacgatcaaaagtgttcatgataatcacattcataaaatcactgctgtaagcattgtccgct

SEQ ID NO: 6033 - DNA, 1294 bp, Oryza sativa
  Predicted polypeptide sequence is orthologous to G1267
attttccatcccctccatcatgagctccaattagccgcacaccgatcccctcctcttcttcccccccttctcctctctcctctttttttcctcatccgtgcgcgatactgcgcttagtttgtgggtggggggagtgatcatcaccaaagccacaaagggggcgcggagagatattatatattctttgggaaagcgttggattagtttttctcgctttgggctttttatccggagttggagtgtgtgtgcgccgggagtggtggtggtgatggcggccggagaggaggtgatggatcggtcgacgtcggccgaggacgggtactgcagcgccggcacggactcgccgcgggcggagtccgtcgacgagcaaggggccgccgaggagtcgtcgccccggggagggcagaagcgggagctcccctcgccgtcggcttcgccgtcgtccccgctgccacctgccgcgaagcgcagccggaggtcagtggagaagcgggtggtgtccgtgccgatcgcggagtgcggcgaccggccgaagggcgccggggaggggccgccgccgtcggactcgtgggcctggcgcaagtacggccagaagcccatcaagggctctccctacccaagggggtactacaggtgcagtagctccaaggggtgtccggcgaggaagcaggtggagcgcagccgcgccgaccccaccgtgctgctcgtcacctactccttcgacggcgccaaagcctgagccggtggctgacggacagcaccccgagccagcggagaacgaatcgtcggcgtcggcggagctggaggtaccggagccggagccggagcaggaatctgagccggttgtgaagcaggaggaggagcagaaggaggaacagaaggctgtggttgagccggcggcggtcacaaccacggtggcgccggcgccggcggtcgaggaggaggatgagaacttcgacttcggatggatcgaccagtaccacccgacgtggcaccggtcgtacgcgccgctgctgccgccggaggagtgggagcgcgagctgcaaggggacgacgcgctgttcgcggggctcggcgagctcccggagtgcgccgtcgtgttcggccgccggcgcgagctcggcctggcggccaccgcgccgtgctcctgatgatcacctcctcttttctttttcctccccttttacaatttccctttttttttttgcttttctttagttctccttggagtaatttggattggaggttagtacatagcttgggtgatcaatgggagtgagtggcttaactgttc

SEQ ID NO: 6034 - DNA, 1942 bp, Oryza sativa
  Predicted polypeptide sequence is orthologous to G1269
gtgtttcctcttcctctcgcatcctagcggcagcggcagcggcagcctcctcctcctccgccgccgccgctcctcttccctctcccaactcccgtacgggcgtacggccgcctcgtcgccggattttttttttcgttcccccggcgagcttgcactctcttttcttcgattctctttcggctttgcttcttcggtcgcttttttttttggctgttcctggtcgatcccggcgaaggaggtggtcgggaagcaagatttgaactactcctcctcatggcttccatgccgcagctggaggaaaaggattcatccgatttggcaatcaacaaaggcccgtcgctggatcttgtcaaatctcccttgatgatgaatgatgcatctgcaactgtaactgcaatgcagcccaacgaggggatggaggagttccctgtcaaggttcggaagccttacacgatcaccaagcagcgggagaagtggacggaagaagagcacgacaagttccttgaggcattgaagctgtatggtcgctcttggcgtcagatacaagagcacattggcacaaagactgctgtccaaattcggagccatgcccagaagtttttctcaaaggtggtgcgtgagcccggttccaataatgcgattgagatccctccacctaggccaaagagaaaaccacttcatccgtaccctcgaaagtgtgcgaattctggatcggacgcaaatccagcaacagcgcaattgaagcttgctcctggctcatcttcatctggctctgatcaagagaatggttctcctatatcggtgctatctgcgatgcagtcagatgcttttggatcgtcagtatccaatccatcaaccagatgtacctccccagcgtcatctgacgatggaaataacattcccacattcacgagtggggaagataataatgtgccttgtgaaccaacagtgatagatccgtcccagtcccacaaggaaatagaccaagatagaaaagacgtgaataatatgtctgaagaggattcttcagaagaagaggtgcaagaaacaagcttgaagctatttgggaggacagttgtcatcccagatccaaggaagagaagctcctcagatccgaagcatgaaagtgaggagcagatatcacagccttccaatgaagaaatgttgcaggcttcttcatcggttggggagattccagcggcatattgtgcaccaaatggttggtttatgtcatacaattctttcccattccaattcggtgaatcagcggcagatgctagaattccccctttacacgtgtggtggccttactacggttttgctcccattagccatcctagaggactaagcacagtgatgcagcagactgaaggtagtgacgagagtgacggtgtgaagagccactcatccgaatcaagttcggactccggggaaaatgtgcagatgaccgctccccagagctcgagaatagtggaatcacttggagcgatttacgtccgagactcaggttcaagttttgagctaaaaccgagcgcaaattcagcgtttgtaagagtgaagccaagcaacagcggagatgaaggggtaataaggggatttgtgccttataaaagatgcaaatttcaataacgcaggcaagcgggtattttcttgaaagctgctaatttaacagagaagagtaggagcacgaacgttgcttgcatcactgtatttttttttgtttgtttgcggggattggtggtgcattaatgaattgtttgctgcttgcaccttaaaaaggatagagatggtgtaagcagtttgttgctgtaagaatgttacatgtagactagtacttaaaattataggggatgccaatctctgccctgatgatgttgtaaaagcagtacgcaccatgttttacctctggttgaaagctaagctgttaatggaaattgatctc

SEQ ID NO: 6035 - DNA, 3047 bp, Oryza sativa
  Predicted polypeptide sequence is orthologous to G1272
ggtgtggagaggcgaggcgttcgagtttcgagaggagggaggggggacaaggaggaggagcgcaccaccctctcggagaggtcgcctccgttcttgcatcgttttctttggatagggcagcgctttgacagctttggggagttagtcgagaagtgtgcacatggagtccaacagtggtgaaatcgaggagttgccacctcccccacctttgccaccaaatgctgagccaattaaaactgatgatacaaaaaagttatcaaaacctaagagggccttgatggctcgctctggttgtggcaaaaaagggcagccgatacagctgctgacgaaccacttcaaggtttcactgaaggcagcagacgaatttttccatcactactatgttaatctgaagtatgaggatgatagaccagtggatggaaagggcataggtagaaaggtgctggacaaactccagcagacctatgcgtctgagctggcaaataaagattttgcatacgatggtgagaagagcctgttcaccattggtgctcttcctcaagtgaacaatgagttcacggtagttctggaagacttcaacactggaaagtcatctgcaaatggtggcagccctggcaatgacagtccaggaaatgacaggaaaagggttagaaggccatatcagacaaaaacttttaaagttgagctgaactttgcagcaaaaattcctatgagcgccattgctcaggccttgagaggccaggaatctgaaaacacccaagaagcaattcgtgttattgatatcatattaagacagcattccgcaaaacagggttgccttttggttcgccaatcctttttccataacaatccttcaaattttgttgacttgggtggtggtgtgatgggctgtaggggattccattcaagcttccgagctacacagagtggactttcactcaatatcgatgtgtccacaacgatgattgtgaaacctggtcctgtggtagattttctacttgccaaccagaaggttgatcacccaaacaaaattgactgggcaaaggccaagcgtgctccgaagaatttaaggataaaaacaagtccagcaaatactgaatacaagattgttggtttgagtgagagaaactgctatgaacaaatgttcactttgaagcaaagaaatggtgatggtgaacctgaaggtgtggaagtatctgtttacgagtactttgtgaagaatcggggcatagagttgagatactctggtgattttccctgtatcaatgtggggaaaccaaaacggccaacttattttccaattgagctctgctctcttgtgcctttgcaaaggtataccaaggctttgagtacactacagaggtcttcgcttgttgagaagtccaggcagaaacctgaagaaaggatgtcagttttgtctgatgtgctgaaacgcagcaactatgattcagagcctatgttgaattcttgtggtatttcaattgctcgaggttttacacaagttgctggcagggtgctgcaggcccccaagctaaaagctggaaatggtgaagatctttttgcacgtaatgggcggtggaactttaataataagaggctcattaaggctagcagtatcgagaaatgggcagttgttaacttctctgcacggtgtaatattagggatcttgtccgagacatcatcaagtgtggtggcatgaaaggaattaaagtagaagatccatttgatgtcattgaggaggacccttcaatgcgacgagctcctgctgcaagaagggtagatggcatgattgacaagaaaaaaaaagcttcctggacaaccaaagtttctgctctgtgttcttgctgagaggaagaattcagatatttatgggccctggaagcggaaatgtcttgctgaatttgggattattacacaatgtgtggcccctactagggtcaatgatcagtatattacaaatgtactgttaaagataaatgcaaagcttggtggcttgaactccctgcttcaaattgaaacatccccttccattcctcttgtatccaaggtcccgacaataatattgggaatggatgtttcccatggatcacctggacagtctgatataccttcaattgctgcggtcgttagttctcgtgaatggcctcttgtatcaaaatacagggcttcagtccgttctcagtcacctaagttagaaatgattgatggactatttaagccacaaggagctcaggaagatgatggcctcattcgggagttattagttgacttctataccagtactggtaaacgtaagcctgatcaagtcattatcttcagggatggggtcagtgagagccagtttacccaggtgctgaacattgagctggatcaaataattgaggcatgcaagtttcttgacgaaaactggtctccaaagtttacactgattgttgcacagaagaatcatcataccaaattttttgtgcctggatctcaaaataacgttcctcctggtactgttgtggacaacgcagtctgtcatccaaggaacaatgacttctacatgtgtgcgcacgctggaatgattggaactacaaggcctacacattatcatatccttcatgatgagataggcttctctgctgacgatcttcaggagttggtccactccctttcctatgtctaccagaggagcactacagccatatcagtcgttgcacccatttgctacgcgcatctcgctgctgctcaggtcagccagttcatcaagttcgacgagatgtcggagacgtcgtcgagccatggtggccatacctcggcgggcagcgctccggtgcccgagctgcctcgcctgcataacaaagtcaggagctccatgttcttctgctgagcagccgcttggctgctatgttatggcctgaacttgtggatgttttggtagtcttgtttatgtcgtgtttgtttaagtaccagctggggggtggatgttattaggctggatgccgcacttctgaacctgttaggataactactgaacctgtccatcttaatcgcagcttgttcc

SEQ ID NO: 6036 - DNA, 3385 bp, Oryza sativa
  Predicted polypeptide sequence is orthologous to G1272
gggtgagcatccgcatcctctttctgattcatctctctctctcccaccgggactacttttttctggaatttgcttgcgttcgtcaatcctagcttctcttctaaatcttggaagaagctcttctcttcttttcagcgccataaccttaatacaagtaacaatctgtttgttccccaaaaagtttgagggtttaactgaacccctatgtctcaagttggatccgctcctgtaacgtttcccccttaaaaattttttttgggggttcaactaaaccctaggtttattggtatctgctcatagaatggacgctcatgatggtgaggccgatgagttgccgccgcctcctcccgtacctgcaaatgtggtgcctattaaagctgatgacgttgagagcgaggtgccagcaaacaaaccagcaaaacctaagcggtttccaatggccaggcctggtttagggagaaaaggacagccaatccagctcttggcgaatcattacaaagtttctgtgaagagtagtgaagaatatttcttccactacaatgttattctgaagtatgaggatgatcgaccggttgatgggaaaggggtaggtcgaaaggtgattgataaactgcagcaaacctaccgttctgagctttcaagcaaggactttgcctatgatggtgaaaagagcctgtttacaattggtgctcttccacaagtaactaatgagttcacagtggtgttggaggatgtttcaactggaaagactgctgccaatggaagccctggaggtaatgacagccctggaggtagtgacaggaagagagttaggagaccataccagaccaagactttcaaagtggagctgtgctttgcagcaaagatccctatgaatgcaattgctcaggccataaaaggtcaagaatcagagaactcccaagaagctctcagagttcttgatataatattaaggcagcactctgctaaacagggctgccttttagtacgccagtcatttttccacaacaatcctaataactttgttgacctgggtggtggtgtgatgggctgtcgaggattccattcaagtttccgtggcacacagagtggactttctctgaatatcgatgtttcgacaactatgattgttaaacctggtcctgttatcgattttcttcttgccaaccagaaagttgatcaccctgacagaattgattggcaaaaggccaagcgtgctctcaagaacttgaggataagaaccacccctgtgaattcagaattcaagatcattggtttgagtgacagaaattgcaacgaacagatgttttcgttgaggcagaggaatgggaacaatggggatgttgatgaagttgaagttacagtctatgattactttgtgaaaaacaaaggcatagagctgcgctattctggcaatcttccttgcataaatgtggggaaaccaaagcgtccaacttattttccaatagagctatgctctcttattccactacaaagatacaccaaagctttgtcaacactgcaaaggtcctcccttgttgagaaatccagacagaagccccaggaaagaatgtcagtccttaatgatgcacttcgacatagtaattatgattctgatcccatgttgagggcatctggcatttcaattgcccaaaattttactcaagttgaaggaagggtcctgcaacccccaaagctgaaagctggcaatggtgaagatatattcccacgcaatggtcggtggaacttcaacaataagaaactgattcagacctgttctgtcgataagtgggcagtagttaatttctctgcacgctgtgatgtgcgaaatcttatccgggacctcataagaaatgcatctgcgaaggggattcaaatggccgaaccttttgttgtgtttgaagagagcccctcattgaggcgagcacctgtatcaagaagagtagatgatatgtttgaacagataaaatcgaaacttcctggagctccgaaattcctcttgtgccttcttcctgagaggaaaaattgtgaagtttatggtccttggaagaggaagtgtcttgctgaattcggtattgtcacacaatgccttgctccacaaagagtcaatgatcagtacctactcaatttgctattgaagataaatgccaagcttggtggaataaactcattgctgcaaattgaagcatccccttcaatacctcttgtatcgaagacacctaccatcatcttaggtatggatgtgtcacacggtcaaccaggacaatctgatagaccttccattgctgcggtggttagctctcgccaatggcctctcatctctaaatacagagcatcggtgcacactcagtcacctaagctagaaatgatgtcttccttgtttaagccacgaggaactgaagatgatggcctcattcgggaatcgctgattgacttctacactagttctggaaaacggaaaccggatcatgttatcgttttcagggatggagttagtgaaagccagtttactcaggtcattaacattgagcttgatcagatcattgaggcatgcaaatttctcgatgagaagtggtcaccaaagttcacagtgattgttgctcagaagaatcatcataccaaattttttcagtctggatctccagataatgttccgccaggtactgttgtggacaaacaagtgtgccatccaaggaattatgacttctacatgtgtgctcatgctggaatgattggaacgacgaggccaacacattatcatgttctgcacgatgagataggtttctcccctgatgatctgcaggagctagtgcactcactctcttatgtgtatcagagaagcacaacagccatatcagttgttgctccgatttgctatgcccatcttgctgctgctcaggtgggcacattcctcaagttcgaagatatgtcggacgcgtcgtccagccaaggaggtcatacgtctgtcggaagtgtaccggtgcctgagctgcctcgcctccatgagaaagtgaggagctccatgtttttctgctgatcgtgccgcctctcgatcaaatgctcgccgacgttgagaaatccggtgatcggcctgggggaactactagtacttttgcttctcataattaggaacatgtatggaacctatgtacctgcccttggcatgctgcctgtgtcatggattatctgctggtaggagtatcctttaaccaaacccttttagcttttaagttaggtttaatggactgctgtttagtatgtggtgtggtgttagtaagtttccagacttcgacattgtgcagctatgcctattgctggttatggtcccttcccttctatgtagcatgtgccgtttccctttgtctgagttgattttagaaatagt

SEQ ID NO: 6037 - DNA, 812 bp, Oryza sativa
  misc_feature (802)..(803): n is a, c, g, or t
  misc_feature (805)..(806): n is a, c, g, or t
  Predicted polypeptide sequence is orthologous to G1272
tttttttttttttttttttttttgcaaaagcattgctgaatcactgaaacatggtgaattctaacaagcaaggccttgcaacgagaggatcaagaacttactgcttaacagagtgctgcctgagcgtgatgtcaagaaccctatgagcctccatcgagttctctgtctcctgccctcttagcacctcggcaatggcgctcatgggaaccttcgccgcgaaggagatctccaccatgaacttcttcaccgccatcggctgcttcatcctcttcctgtcactccccctcgggcttccatcgtctcctccggggctccgcctcgtcgtcgtcctgcacacagcaaaaaaaccaaagaaatggtgctcaccaccttcacaattttttttagatactggaaaatggttacatctccgaactctgccaacagacgtcaccacctggacatagcaacagttacatatccatagtttacttgccttatcagccgcgaacaaaatttaatttatgaaacctaatttcccagctgacctcgaaggctcccccgccacagacaactacgggcgcactggccttttaaacgactatcaggactacccgaagatgtctaagtaagtcgagcgcagggccagaaacatcaagaagagggtccaacagacatggcgcctcgagcacccaggtagcgactacaggagaaaccggaacgagctgctgtgaacgacagccggcactccgtgggctcacgtcgtcacaactgtcctcactgcttcgctgcagtactatgaacgacgagaaagcaagaaaannannagttgg

SEQ ID NO: 6038 - DNA, 2670 bp, Oryza sativa
  Predicted polypeptide sequence is orthologous to G1272
atggctgccaaaattggtgaaattgtccaagtacataatgataatcctgtaaagagagtacctattgcacgacctagctttggccgtgaaggaaagcaaatcaagctgctctcaaaccacttcactgtgaagcttagtggaattgatgcggttttctaccaatacagtgtttccatcaaatctgaggatgataaggtgattgatggaaagggtattggccgaaaggtcatggataaagtgctgcaaacatacagctctgagcttgctgggaaggaatttgcgtatgatggtgaaaaatgtctatttactgtggggcctcttccacagaacaactttgagttcactgttatcttggaggaaacatcttcaagagctgctggtgggagtctagggcatggaagccctaatcaaggtgacaagaagcgatcaaagtgcacacatcttgcaaaaaaaattgtagtgggcataagttatgcagcaaagattcccctgaagtcagtagctttggcccttcaaggaagcgagtcagatcatgctcaggatgctctgagagtccttgatattgtcttaaggcaacaacaggctaagcgaggttgcctgcttgttaggcaatcatttttcagtgatgactttagaaacttagttgatttaactggtggagttagtggatgtcgtggactccactcgagtttccgtactaccattggtggtttatctttgaacatggatgtttcaaccactatgattgtgactcctggaccggtttttgatttcctccttacaaatcaaaatgtcagagacattagagatatcgactggcccagggccaagaaaatgttgaaaaacctgagagttaaagctattcacaataacatggagttcaagatcattggtctgagtgatgagccatgctctagacaaacattccccatgaaagtacgaaatggaagcagtgaaggtgaaaccgttgaaattactgtccaggaatattttaagtccaagcaggtggatttaacaatgccttatttgccatgtcttgatgtgggaaaaccaaaacgcccaaattatgttccaattgaggttgctggcaccaatcctctgtgccatatggtatcacttcaaagatatacaaaggcgctttcttctcaacaaagagcaaccttggttgaaaaatcacgtcagaaacctcaagagcgcatgcgagttgttactgatgctgtaaaaaacaatagatatgatgatgatccaatcttatcttcttgtggaattaaaattgagaaacaactcactcgtgtcgatggtcgtgttctgtctgcaccaacgctagtcgtggggaatagtgaagattgcattccaaacagaggcagatggaactacaataacaagaggctatttgagcctgtcaagattgagcgttgggcaattgttaatttctctgctcggtgtgacatgagccggatctcaagagacctgataaactgtggacgaactaaaggcattattattgaacgccctttcaccttggtagatgaggatagccaatctaggagatgtactcctgttgtaagggttgaaagcatgtttgaaaaagtgaaagcaaaccttcctggtcctcctgaatttttgctgtgtgttttaccagaaaggaaaaattgtgatctctatgggccatggaagaagaaaaaccttcatgagatgggtattattactcaatgcattgttcctagtgttaagatgaatgatcagtactataccaatgttcttctgaaaatcaatgctaagcttggtggaatgaactccaagctttcattggagcatcgacatatgattcccattgtcaatcaaacacccacattaattttgggaatggatgtttcacatggttcgccaggtcgagctgatgtaccatcaattgctgcggttgttgggtccagatgttggccgctgatatcacgctacagagcatctgtccggacccagtctccaaaggtagagatgattgattctctttttaagccactggacgatggaaaagatgatggcataataagggaacttctactggacttctacaagaccagtcaacaaagaaagccgaagcagataatcattttcagggatggtgtgagcgagtctcaatttagccaagtactgaatgttgagcttaatcaaattataaaggcatatcaatatatggatcaggggccaattcctaagttcacagtgatcattgctcaaaagaatcaccacacaaaacttttccaagaaaatactccagacaacgttcctccagggactgttgtagattctggtattgttcatccaagacagtatgatttctacatgtatgctcatgctggacctataggtacctcaaggcccacccattaccatgtcttgctcgatgagattggtttcttgcccgatgacgtgcagaaactagttttgtcgctttcttatgtgtatcagaggagcaccactgcaatatctgttgtggcacctatctgttatgctcatctcgcagcagcgcagatgggccagttcatgaaattcgaggaattcgctgagacttcgtctggaagtggtggtgtcccttcgtcatcaggagcagtggtcccagagttgccgcgcctgcatgctgatgtctgcagttcgatgttcttttgttga

SEQ ID NO: 6039 - DNA, 612 bp, Oryza sativa
  Predicted polypeptide sequence is orthologous to G1273
atggaggaggatgatgggttggccttgatgacgggggcaaaccagagcttatggagttactacaagtgcaccagctcccgatgcagcgccaagaagcacgtcgagaagtccaccgatgacccggagatgctcatcgtcacgtacgaggggtcgcaccatcacggcccgcagccgctcttcccgccgcacatcgcccagccaccgccgccgacgtcggtagtgggcttctccgccgcctccggcgctggcccgccgccgtcgtcgcccgcggcggcggcaaggaagaggaagaactatgtcagggcggccttctcgccgacgacgtccgaggacgacggcgacggcgccggccggctacggccagagtggccacaagacgatgggacgtcgtgtgacgtcgccgagttacgacgacgtggcgacgcggagcacgccgcgccgcgtcgtgtcgcgacggatcgctcgtgcgacgatggcggcggcggcggctcgacctcggcctcgtcgtccgtggcgcgcgctgacgccgctacggcgctgtcctctgactcgccgccgaccatatggtcgtgcctggactggccgtggtcccaggaaacactgtttctgtag

SEQ ID NO: 6040 - DNA, 2449 bp, Oryza sativa
  Predicted polypeptide sequence is orthologous to G1289
cttctgcaactctctgcactgtccccgcttccttccacggccacggcggcggccatcgccgccgtcggcgatctcgccctgctccatcccgctctcccgtttccaatcccccaaccggagcagaaatggccatctcctccgccctctccttcctctcctatcgcaagcgccctatcgttgtttccgtcttcctcttcctcctcctctcatccctcttcctcctcttcagccccgcacctgccgcgctccctttcttctccttcccctcctctcacctctcctcctcctcctcctctcctatcgccgccacgccgccacccctgactccagtttccgtccccgccaacgcatcttcaccggagaccccagttgacgcgtccggtgggagcaacgctggcgccaccgcacccaccagggacgctcctcagccagatcgcagtcggagcacgccccctgccgccgtcggagtgcgtggatcggcgggcaccaacggaaccagcaggggcgtctcggccggcggcgatggagcaggagcagcagcggcggcggcggcaggtgtggcggtgccgtcgtgggaggtgtgcgaggtggggaagggagtggtggccgcggactacataccgtgcctggacaacgtgaaggcggtgaaggcgttgaagtcgctgcgtcacatggagcaccgggagcgccactgcccgacggcgccgaggccgaggtgcctcgtgccgctgcccacggggtaccggtcacccttgccgtggccgcgcagccgtgacatgatttggtacaataatgtccctcatccaaagttagtggaatacaagaaggaccagaactgggttaggaagtctggcaattattttgttttccctggaggtggaactcaatttaaagctggtgtgactaaatacattcgatttattcaacagatcatgccaaacattgaatgggggacccatacaagaactgttctggatgttggatgcggtgttgccagctttggtggatacttgcttgacaggaatgtcattactatgtctgttgcacccaaagatgagcatgaagctcagatacagtttgctctcgaacgtggaattccagcattgttggcagtgattggaacacaaaaacttccattccctgataattcatttgatgtgatccattgtgcaaggtgtagggtccactggtatgctgatggtggaaaaccattattagagcttaatagagtgctcaggcctggaggatactacatctggtctgcaactcctgtatatcgtcgtggcaaaagagatgaagacgactggaatgcgatggttactctgaccaagtcaatttgctggaggacagtagtaaaatctaaggatgttaataggattggtgttgttatatatcagaagccaacctcaaattcttgctactttgagagaaaacagaatgaaccacccctatgccctagtagggaaggatcacattccccttggtatgcaccacttgatagttgcctcttgttacctgctgtgtcaagttcaggtgaaggaaacagctggcccatttcctggccagaaaggcttaacatcaaatactcaactatatctgacaacgcttctactcagttttctcaagaaaaatttgattctgacacaaagcactggaaggaccttgtttcagaagtatatttcaatgagtttgcagttaattggtctaccgttcgcaatgtcatggatatgaatgctggttttggaggatttgcggcgtcactcatccacaaacctttgtgggttatgaacgttgtaccttttgatcatccagaagccttgcctatcattttcaacagaggtttgattggggtatatcatgactggtgtgaatcttttaatacatatccccggacctatgatcttgttcacatgagttatctccttcagggcctcacaaataggtgtgatatcattgaagtagcagcagaaattgataggatacttagacctggaaaatggttcgtgttgcaagatactgagcaagtgattagaaaaatggatccagttcttcgctctttgcactacaggactgcaattgtgaagcaacaatttcttgtcgctacaaagggcttctggcgcccatacagtgcaggttctgagtcaagatgattcatgcttcgtcttctgttgctgttagtaaaaatcaaacaactgatttgattctttaaattctaattacatggattcttcgcatagcatagatgacacaaattagccccatatcaacggtgagttcattccctctgtttgtagttagcagtccatattaaccatcgggcttactgagttgattcttttgtttccgttttgttgtgtacaaattaaagaacttatggctacagcaatagccaataggttagcaataacagattgtggattttgaaagcatgtcttgattattcattggt

SEQ ID NO: 6041 - DNA, 2930 bp, Oryza sativa
  Predicted polypeptide sequence is orthologous to G1289
gatataccaaaatcgaaggggaagaaggctcatcaccaccgtcgaaaacgacctgcacccaccgccaccgccaccgccgccgccgccgccggccggccaaggccaaccacgcaacccgccgtggccgcgacgctccacttcccccctgactccgtcctcccacccgcccaaccaaccgaccgaccaaccgagtgaacaagtgaccaaccaccaccaccaccaccatcgccaccaccgtcttcgatctctctccgcctctccggcatctcttcacggcggcggaggaggagggagcagcgacgatggccgtgcccacctccgaccagcgcaagcggcggcccttcctcctctcgctgtcgctcttcctcctcgtctccgcgctcctcgccctcgccttcctcttcctcgacccctccgcgcaatccctctccgtcctctcctcccgcctcaccgcccctactacgacgctcgcgcctcccgcggtcgtcgccggcggcgccgaagccggggagagcgccgacgcaaccgaaaaagccgaagagaccgcatcgcgaccagacgacaccgccgccgccgtcaacgccgacgctgcagcaggggaaggtggtggaagtagcgagtcgccacggctcgatgcggataagggcgccgccgccacggagggagtggcggatgacgacggcggcggtggcggggacgagccggcggcgaaggtgaggtgggagacttgcaggccggggagaggggtgtcgtcggcggactacatcccgtgcctcgacaacatgagggcgatcaaggcgctgcgctcgaggcgccacatggagcaccgggagcgccactgccccgtggcgccgcggcccaggtgcctggtgcgggtgccctccgggtaccggtcgcccgtgccgtggccgcgcagccgtgacatggaagctactgtcgtgaggcagaatagagaatgccagataagagctgtaatgttgggtgtcaagcagattgtgcttagtgatcctttaatgtggctaaatttccttttgtgcatatactattttaaccactagtatcgttttataggctttcaactttcaaggcagtgagtgcagtgtgtgtatttatgatagttacatgaatatcttatggttaagatgccattaactgactatttgaagccatctcatttcatttccaaatccagatttggtacaacaatgttcctcaccctaaattggtggagtataagaaggaccaaaactgggtaacaaaatctggtgactatcttgtcttccctggaggtggaactcaattcaaaactggcgttacaagatacattcagtttattgaacagactttgagggggctaaacacaaaggctatgcttgcattgactctgttggggttcggtaatttgaatataatgcccaccattcaatggggaacacacacaaaaactgtcctggatgttggatgtggtgttgccagctttggtggatacttgcttgacaggaacgtcattaccatgtcatttgccccaaaggatgagcatgaagctcagatacagtttgcattagaacgtggtattccagcatttctagctgttattggaacacaaaaacttcctttccctgatgaggcatttgatgttgtccactgtgcaaggtgcagggtccattggtatgcgaatggtggaaaaccattgttggagcttaacagagttctcaggcctggaggatattacatttggtctgcaacccctgtctaccgtcaagaaaaaagagatcaagatgactggaatgcaatggttaaacttaccaaatcaatctgttggagaacagtggtaaaatctgaagatagtaatggaattggtgttgtcgtatatcaaaaaccagcatcaaactcttgctacctggagagaaggacaaatgaaccccctatgtgttctaagaaagatgggccccgttttccttggtacgctcctcttgatacatgcatttccagttcaattgaaaagagcagctggccccttccttggcctgaaagacttaatgccagatatctaaatgtgcctgatgattcttcaagtaccgacgagaagtttgatgttgatacgaagtattggaaacatgccatttcagaaatatactataatgattttccagttaattggtcatccacccgcaatgtaatggacatgaatgctggttatggaggttttgcagcagcacttgttgataaaccattatgggtaatgaatgttgttccggtcggtcagcccgatactttgccagttattttcaacagaggccttattggggtatatcatgattggtgtgaatctttcaacacgtacccacggacctatgatctccttcacatgagctatcttcttggaagtcttacaaataggtgtgacatcatggaggtagcagctgaaatagacaggatattgagacctgacagatggtttgtgttgagagacaccacagaaatgataaaaaagatgcggccagttctcaagtccctgcactacgaaactgtagttgtcaaacagcaatttcttgttgctaaaaagggtttctggcgttctggcaagtgagcctcctgatcagaatgacgctcaaatgttttcagggtagtcatcaacagcaaacaattcaattgattctttacatccctattgattagttcttatacagaagacagagtttgatcaaaccaaggattaggcatgttgattctacaaaatacttatacagaacagttagttcgacaaaaatacatatacacatcttgtttatggggggccattacagtaataggcttaggctagtccactagtgctcacaagtttgtaatcatattattattcttttacattcagaaacagatacttttcagggaaacattatgctctttcacgaatacatcctctgtcc

SEQ ID NO: 6042 - DNA, 1914 bp, Oryza sativa
  Predicted polypeptide sequence is orthologous to G1289
atggccatctcctccgccctctccttcctctccgatcgcaagcgccctatcgttgtttccgtcttcctcttcctcctcctctcatccctcttcctcctcttcagccccgcacctgccgcgctccctttcttctccttcccctcctctcacctctcctcctcctcctcctctcctatcgccgccacgccgccacccctgactccagtttccgtccccgccaacgcatcttcaccggagaccccagttgacgcgtccggtgggagcaacgctggcgccaccgcacccaccagggacgctcctcagccagatcgcagtcggagcacgccccctgccgccgtcggagtgcgtggatcggcgggcaccaacggaaccagcaggggcgtctcggccggcggcgatggagcaggagcagcagcggcggcggcggcaggtgtggcggtgccgtcgtgggaggtgtgcgaggtggggaagggagtggtggccgcggactacataccgtgcctggacaacgtgaaggcggtgaaggcgttgaagtcgctgcgtcacatggagcaccgggagcgccactgcccgacggcgccgaggccgaggtgcctcgtgccgctgcccacggggtaccggtcacccttgccgtggccgcgcagccgtgacatgatttggtacaataatgtccctcatccaaagttagtggaatacaagaaggaccagaactgggttaggaagtctggcaattattttgttttccctggaggtggaactcaatttaaagctggtgtgactaaatacattcgatttattcaacagatcatgccaaacattgaatgggggacccatacaagaactgttctggatgttggatgcggtgttgccagctttggtggatacttgcttgacaggaatgtcattactatgtctgttgcacccaaagatgagcatgaagctcagatacagtttgctctcgaacgtggaaaaccattattagagcttaatagagtgctcaggcctggaggatactacatctggtctgcaactcctgtatatcgtcgtggcaaaagagatgaagacgactggaatgcgatggttactctgaccaagtcaatttgctggaggacagtagtaaaatctaaggatgttaataggattggtgttgttatatatcagaagccaacctcaaattcttgctactttgagagaaaacagaatgaaccacccctatgccctagtagggaaggatcacattccccttggtatgcaccacttgatagttgcctcttgttacctgctgtgtcaagttcaggtgaaggaaacagctggcccatttcctggccagaaaggcttaacatcaaatactcaactatatctgacaacgcttctactcagttttctcaagaaaaatttgattctgacacaaagcactggaaggaccttgtttcagaagtatatttcaatgagtttgcagttaattggtctaccgttcgcaatgtcatggatatgaatgctggttttggaggatttgcggcgtcactcatccacaaacctttgtgggttatgaacgttgtaccttttgatcatccagaagccttgcctatcattttcaacagaggtttgattggggtatatcatgactggtgtgaatcttttaatacatatccccggacctatgatcttgttcacatgagttatctccttcagggcctcacaaataggtgtgatatcattgaagtagcagcagaaattgataggatacttagacctggaaaatggttcgtgttgcaagatactgagcaagtgattagaaaaatggatccagttcttcgctctttgcactacaggactgcaattgtgaagcaacaatttcttgtcgctacaaagggcttctggcgcccatacagtgcaggttctgagtcaagatga

SEQ ID NO: 6043 - DNA, 496 bp, Oryza sativa
  Predicted polypeptide sequence is orthologous to G1290
ccagcgcctcatcttcgccaacaccgctgcagcagggagactgtaggccttgaggtgctaatatctgtcaggcctatccaggaggtagccagccggcggcaacggctgttccacgccgacatgtgatgtgtgcaattatgtctgtagacactaagtaatgtttatcgtcgatgacttatatgtaccgtggcttatctgtatgagacactttgtaatgcttgctatatactccctccattttaaaatgtttgacacggttgactttttagtatatgtttgaccattcgtcttattaaaaaaatttaagtaattatttatttttttcatatcatttgattcactgttaaatatattttcatgtacatatagttttacatattttacaaatatttttgaataagacgaacggttaaacatgtgctaaaaagtcaacggtgtcaaacattttgaaacggaggaagtatgtggcttgtgctagttgtgcaaattctgtcca

SEQ ID NO: 6044 - DNA, 954 bp, Oryza sativa
  Predicted polypeptide sequence is orthologous to G1304
atggggagactgaggccgccgtgctgcgacgagagcagcgtgaagaaggggccgtggacgcgggaggaggacgagaagctcgtcgcctacgtcgaccagcacggcggccatggcagctggaggtctctccccaagcgagccgggctcaacaggtgctgcaagagctgccgtctgcgatggattaactatctcaggcctgacatcaagagaggcaacttcactcctgaggaagaacaggccatcattaccctccactccgtcctcggcaataagtggtcgaccatcgcgacacgccttcctgggcgcacggacaacgagatcaagaactactggaacacgcgcctcaagaagaggctcatcggcgccggcatcgacccggccacgcaccgcgcgcggccgcggccgccggcgcctggggacctcgccaccgcgctcccgcagctggtggcgctcgccagcctggccgtcgacctcgccgtcggccacgccgccgcagccggcggtgcgtggggcgccgccaacggcgccgtcgactaccagcaggccgacgcggcggcggcgcagctgcagtgcctccagcacctcctcctccagccacagacgacgccggccacctcggcgacgagcggcggcggcggccacccgaccgagctgaacgcggcgagcagcttcctgacccaagccgtcgcgtcctacgccgccgccgccgcgactcctctcccttctctcgtggtacccggtggtagccagcctctcgagctgaaacggtggcaagatcacatcggcggcgaccatgttggcgccgtgtcgcccttcgccggcgcggcgacggtgaccggccaccacggaggcggcggcggcggcggcggcgagtttctgccctcggagctgacggcgttgctgtgcagtgcgaacgccatcgatgatttgcaatccagtaatctagatttctga

SEQ ID NO: 6045 - DNA, 435 bp, Oryza sativa
  Predicted polypeptide sequence is orthologous to G1309
taaccgcagccaaggtggctggagctatttgccagaccgctctctacgactatcgactcccggttgatgccaagacacacttcggtcctccattgaccagcgtcgagctatatctcaaggacgccggcgctcacaagactactgatgagaaaatcgaaggccatattgtcgtgagaggaccttccgtggctggaggagaagtcaatgttgggattcccggaaaaattcgacatgacaatacccttgcttatgcttgatttcgtagagctacgtgcggaatagggtggtgatgccatcggagatggagacagcaagatatacagattgatcgaacttggcctctcggtccatagattattctatctagcatttatgatcttttcatggttctctcgaaaccgagagagtacgatatacaaaagtatggcattccct

SEQ ID NO: 6046 - DNA, 1640 bp, Oryza sativa
  Predicted polypeptide sequence is orthologous to G1313
gttgccgcacatatactcgtgctcgcgctcacgccgccgcccccgaaactccccgctccgccattgccgggggaggcgatctcccatctccatctcccatctcgcctcagcgaactccccttcacatcgcgtctcttccgtcgcagagagtggcggccggtgaccatttccggtgggagggcggaggttttgtcccggctccggcgacactccacactccgacagcccaccgctccgtcaccctgcatttttggtcaggatgcacgagagcgacagcagtcctgattctgacaggacacactggtatatgagcaatagcgatgacgagtcatttgttgataaagataaagattgcagaaggagcaccgtagccctgctgttgaagaaaggtccatggacatcttgggaggactccatcttagagaagtacatcaagaagcatggtgaaaggaactggaagcttgtgcagaagaacactggcctcttgaggtgtggcaagagttgccgtcttcggtggatgaaccatctgaggcctaacctaaagaagggggctttcagcaaggaagaagagaataaaattattaatcttcatcgcaaaatggggaataagtggtctcggatggctgctgatttgccagggcgtactgataatgaaataaagaactactggaacactcgaataaagaaatgcaagaacaatcgttcgcctttgtatcctgctaatgtatgcaacgatgctttgaatgaagatcaacatgagtctgctgaccccaacgttagggagaagctgaccaataatcatctagaagatactactagtatgtattctgcacccccaggttttcaggatgcttccatcagtaatatacttgataggagacttgcatcaaaagattatgactccatagaagatcaaagaaaccaaatagaagttgtagcaaaatatgagattccacttcctgtgttgaaaacaacgaacaatgacatatttccatcagcctctatctttgccaaccatggtatttcaaatggcaatctctctgctttgtccacaactgatgctttgcagatggagctccctttaatccaatttgatccaaacaaccagttcgtttactcaagggcttatgcgatgcacctaacaaactttgctttattaaatgatcaatcagaagaattactaaatgatactgatgtattgaactatgtggtgatgaaagaagagctttctggagggagtttgagtcctactattaatatgccatgtgaagcacataactccatggctgcctctaatgagctggtagtgccacaatatgaaggagatgctccacctcttcaagatgatttcacatcatatttctatttgaatgatactaatctatccatattcgaagacacaaatgaattgtttttggaaaacaagttggatactaaaggtaactgacgccagattgtcatgagttgctgctctcttggataaactcatcatgaaaccaagaattttattccatgaagctcgtgaacgagccagtcgttgctatctctcttattaggatttccagtttggatattgccgtactcctttacttttcttcatgtcgaaattaccatgcgtgctatgttgaatttcatctgct

SEQ ID NO: 6047 - DNA, 2412 bp, Oryza sativa
  Predicted polypeptide sequence is orthologous to G1313
atcctgcagactcgccccactctcttgctcagctcctcttcatccagtcctcaaaactctctctgatctctctctcttgctgaaaattctccgcacactccggtgggcttaagcggtggcggcgtctcgcctgggtgggcgagatccctctcttgctcgtccgcaaggtcgctccccctgcgagtccaatctactgacgagctgggaggagcaaaggagggggcaattggagctccgctcggttccaattcagccccaattttgagccccccggctgcggggttcggccagttgagacgccatgtatcgggtgaagagcgagagcgactgcgatatgatccatcaggagcagatggactcgccggtggccgacgacggcagcagcggggggtcgccgcaccgcggcggcgggcccccgctgaagaaggggccatggacgtcggcggaggacgccatcctggtggactacgtgaagaagcacggcgaggggaactggaacgcggtgcagaagaacaccgggctgttccggtgcggcaagagctgccgcctccggtgggcgaaccacctgaggcccaacctcaagaagggggccttcaccgccgaggaggagaggctcatcatccagctccactccaagatggggaacaagtgggctcggatggccgctcatttgccagggcgcactgataatgaaataaagaattactggaatactcgaataaagagatgccagcgagctggcctacccatctatcctaccagcgtatgcaatcaatcctcaaatgaagatcagcagtgctccagtgattttgactgtggcgagaatttgtcaaacgatcttctgaatgcaaatggtctttacctaccagattttacctgtgacaatttcattgctaattcagaggctttaccttatgcaccacatctttcagccgtttctataagcaatctccttggccagagctttgcatcaaaaagctgtagcttcatggatcaggtaaaccagacagggatgctaaaacagtctgatggtgtgcttcctggattgagcgataccatcaacggtgtgatttcctcggtggatcaattctcaaatgactctgagaagctcaagcaggctgtgggttttgactatctccatgaagccaactctaccagcaagattattgcacctttcgggggtgcacttaatggcagccatgcctttttaaatggcaatttctctgcttctaggcccacaagtggtcctttgaagatggagctcccttcactccaagatactgaatctgatccaaacagctggctcaagtacactgtagctcctgcgttgcagcctactgagttagttgatccctacctgcagtctccagcagcaaccccttcagtgaaatcagagtgcgcgtcgccaaggaatagtggccttttggaagagttgattcatgaagctcagaccctaagatccgggaagaaccaacagacatctgtgataagttctagttcttctgtcggtacgccatgtaatactacggttcttagcccagagtttgatatgtgtcaggaatactgggaagaacaacatcctggtccattcctcaatgactgtgctcctttcagtggcaattcattcactgaatccacccctcctgttagcgctgcatcgcctgacatctttcagctctccaaagtttccccaggttggactctgaaattcctcatccctctttgatgtgattattcggttatttatgatgtactgttttgcagcacaaagcacttcaatgggatctggagagcaagtaatggggcctaaatatgaacctggggacacttcacctcatcctgaaaacttcaggccagatgcattgttttctgggaatacagctgatccatcagttttcaacaatgccatagcaatgcttctgggcaatgacttgagtatcgattgcagacctgttcttggcgacggtatcatgttcaattcttcctcgtggagcaacatgccacacgcctgtgaaatgtcagaattcaaatgaattctgtatttggtatttgccagacgctacagcagattcttggtatcgttcttgctcattgtttggatcataacttgaggaagatctcgtcggttgtaattctgcattgctgacagagtccttgatggcatgcaggcactatcagatgttctcttatgcgactagcccttttgtccaataaagtagtgcatggagataagccggttaattattgttttcttttttgtattagagaaccctttttgtcatctctattgcccgaattctgttggaaattcgtcatgtttgtttgaacaatgtaagaccaattattgcatttgtggtgtactatcttgttgagcatttaccacttgccaatcaatagcaatttgttactact

SEQ ID NO: 6048 - DNA, 1355 bp, Oryza sativa
  Predicted polypeptide sequence is orthologous to G1317
tccgtctcctgctcccgccgctcttcacacggctaacgcctgcttggctgcgagacaaaccgaaccttttgctcttgcaccgcctgctagcgaactacgtgtgctcccgtgatcgatggggcgggcgccgtgctgcgagaagagcgggctgaagaaggggccgtggacgcccgaggaggacgagaagctcatcgcctacatcaaggagcacggccagggcaactggcgcacgctccccaagaatgccgggctctcgaggtgcgggaagagctgccggctgcggtggacgaactaccttaggccggacatcaagcgtggtcgcttctccttcgaggaggaggaggccatcatccagctccacagcatcctcggcaacaagtggtcagcgatcgcggcgcggctgccgggccggacggacaacgagatcaagaactactggaacacgcacatccgcaagcgcctcctccgcatgggcatagaccccgtgacccacgcgccgcgtctcgacctcctcgatctcacctccctcctcaagcccgccgccgccgccgcgtactaccccacgcaggccgacctcgacacgctccgcgcgctcgagccgctcgccggctacccggacctgctccgcctcgcctccgccatcctccccgccgccacgacgaccggcgcagccgccgccgccgccgccgagcaggcgcagcttttcctgccgtggctgcttcaggcgcagatggcgcagcagcaacagcaggtgacgccgccgccgccgccgccgccgcaggccgcggcgaccgaacagtttttgcaggccaccagcaccgcctgccaccaaatgccaggcctggttcacgccagcccgacgcagcagctggcgcagcaaccgcaggatcacatggcggcggcgacctgccaccgccgcggcgccgtgcagcacccgagctacgacaaccagctcgactacgtgccggcgctgatgcagatggcgtccgacgcgtccaacctgcagcagtggagcagcacggtttcgagtagcaacaaccacaacgtcaactccggcgtgtccacgccgttgtcgagcccagcagccgccggacagatcaactcatcctttacgacgacgacgacgacgtatggcttgaacgcgagcggtgacgtcgacgacgctgggctgctcatcaacatgcacctatccgagctcctcgacgtgagcgactacatgtaataagatttttccttgcgtggaaacagagccgaatcgaacactccacgccatgtaccaaaggggcaaaacatgatcatcacaagaggcaatttttgtacaggattgtaccaaaaaaaaaaaaaaaaaaaaaaaa

SEQ ID NO: 6049 - DNA, 1637 bp, Oryza sativa
  Predicted polypeptide sequence is orthologous to G1323
gcagcttggccgcacgcctgaacacacacaacagcagcagcagcaacagagcacggaggcagaggcaacaccgagacacgagttgttctgggcggcggcggcggcggccggggacggacgacgtacgatggggaagggccgggcaccgtgctgcgccaaggtggggctgaacaaggggtcgtggacgccggaggaggacatgaggctcgtcgcctacattcagaggtacggccacgccaactggcgcgccctgcccaagcaagcaggtttgctccggtgcgggaagagctgccgactccggtggatcaactacctccggccggacctcaagcgcggcaacttcaccgccgaggaggaggagaccatcatcaagcttcacggccttctcggcaacaagtggtcgaagatcgcgtcgtgcctgccggggaggacggacaacgagatcaagaacgtctggaacacgcacctcaagaagcgggtgtcgccggagcagaagaagggtgggggcaagagcaagaagaagacgacctgcaccgacgtgctcgtcccgtccccatcgccgtcgtcgtccaccaccaccacgaccaactgctccagcggcgactcagccggcgagcagagcaacacgagcaaggaggaggaggaggagacggacaagatcgagatccccatgctcgagctcgacccctgctgcttcgacttcgacatgctggttgaccccgttgtcccggacacgtactgccccgcggtgtcggcgtcggcgtcggcgtcggcgccgacgtcgccgtgctcgtccacgtccccgtcgtgcgcccgtgcaggcgtggacccgctgctcgacctgcccgaaatcgtggacctcgggccggagctatggagcatcatggacggcggcgccggcgacgggtgcaccgaagcgccgccgccggcgtggagcaatgcggcggcggcggcggcggccaatgcaacagtggccaccacgaccagcctggaggaggaggaggggaaggagtggtggttggaggacttggagaaggagctcgggctgtgggggcccacggacgactaccactgccacccgggcccacaaggtcagcccggtcgcgcgggcccaccaccctccgccgttgtggaggacccagtgtcgtgctacttccaagcgggccccacggcagccgccacgtggcagggacacgagccctcggctgtcatcacgagtaaccccatggattactacgtgtaagctcgtcgttaattacccatttttatctctagattaggagatatacgattacccaactcgaccgaatcgtccagtgatgctacatacttctagtacaatacacgcgtataattgtacgaccgtataaaggagtactataccaatccaatacgaagacggcatcgatgggaacaacacatgcaaagatgcatatatgcttttgggcagtaaaaaaggtgatagttaggctaggatgcacaaaaaaggtgttaatttttttttttgggatgtctatatatgttgggcagattaagtggtgcatgcaatcacaaatgagtcaagattgccggtacgagttaaccagagatgtaacttatgtacttttaacatcagtttccagcagatgttggtattg

SEQ ID NO: 6050 - DNA, 1665 bp, Oryza sativa
  Predicted polypeptide sequence is orthologous to G1323
ggatgatagggagagggagaggagacagaacgccctgcccgtttcagacctcggcgcgtgcacatatataccaccccctcccggtctcccatgcgctctcgatcaccatcttctgcttcatccatcatccactgctactctgtccgggaaacgttcagacagaggtgggcatggggaggggacgagcgccgtgctgggccaaggtggggctgaacaggggttcgtggacgccgcaggaggacatgcggctcatcgcctacatccagaagcacggccacgccaactggcgagccctccccaagcaggccggattgctgcggtgcggcaagagctgccgcctccggtggatcaactacctgcgccccgacctgaagcgcggcaacttcaccgccgacgaggaggacaccatcatcaagctgcacggcctactcgggaacaagtggtccaagatcgcgtcgtgcctgcccgggaggacggacaacgagatcaagaacgtgtggaacacccacctgaagaagagggtgtcgcagagagagaagccaggtgacaccaagaagaagggcaaggccgcggacgccagcgacgacgccgacgcgcattccccgtcgtcgtcggcgtcctcctcgacgacgacggcggccaataacaacaacagcggcgacacggccggcgagcagtgcggcacgagcaaggagcccgagaacgtcgacgtgtccttcttcgagcaagacatcgacatctcggacatgctggtggacgcgcccacggaggcgccgctggtcgcggcgccaatgccgccgtccccgtgctcgtcgtcctccctgacgacgacgacgtgcgtcggcgccgtgtcggacgagctgctcgacctgccggagatcgacatcgagccggatatatggagcatcatcgacggctacggcggcgatgagcccggcgacggcgatgcaacagtgccatgtaccgccagcccgggagaggagggagcagagtggtgggtagagaatttggagaaggagctcggcctgtgggggcccatggacgagtccctggcccatccggacccacccggacaggtttgttacccgggcccactcacggaaacagagggggacccagtctccacctacttccagtccgggcccaccgcctctccgctccaggagatcgcatcacccgccgttctctcatgattccaccgatggatcacgtccgtccgatttggagcagaaggcggagtttaaccaatagtgatctgatccaacggacaagatagatcgatcaagatagatcggccactgcactatcatctacagcaaatacgaatcgatcaacacaatttacccgctatatttgacgcgacgacgaagagtgattaatttgtttggtgttgcagtaaatggcgaaggtttagattaactaggatgcacatacaaaaagggtcaagccgtcaaacacaaggcgaaagtgtagtagagacacaacacaagtgtttactaccttctagtactctttttttaacatttttaacccaagaaaatgtagtttttgattgggcatgggacggcactccattgaagagccaatgagaagtgctatatatatcacacactcctatattgtaacatttgtacttatattattgagaagtgccaatgagtttgc

SEQ ID NO: 6051 - DNA, 1577 bp, Oryza sativa
  Predicted polypeptide sequence is orthologous to G1324, G2893
aaggggatcatacatcgacctcatcatccaatccaccaactgaccaacaacatttatactactagtagtagaagaagaagctctagatagctatatatcccagctgctgcaaaggtagtagacagcaatgtcgcagaggagagttgcagggcccatgggagtgatgagcaagcagcagcaggaggccatggcagaggagatgatggagctgaggcgaggaccatggaccctcgaggaagacaacctcctcatgaactacattgcctgccatggcgaaggccgctggaatctcctcgcccgctgctccgggttgaagaggacgggcaagagctgcaggctaagatggctcaactacctcaagcctgacataaagcgcgggaatctgacgccggaggagcagctgctcattcttgagctccattccaggtggggaaacaggtggtcgaggatagcgcagcatctgccggggaggacggacaacgagatcaagaactactggaggacgagggtgcagaagcaggccaggcagctcaaggtcgacgccaacagcaccgtcttccgcgacgccgtccgctgctattggatgcctcgcctcctcgagaagatggccggagcagccaccgaccccactccgccgccgccaccgccactccaccaccacgccgccatggccaccgcctcctcctcgccgttcgacttcgacacccacctgcagcaagcagaagcagcaacggcgtgcgtcgtcccgaacaacgtgtaccaccaccacatcgacccgagcccgagcacgtcgacgtcggccggctcgacggcggccgcggcggcgttccagccgctgccctgcttctccgagctgagatgggaccagcagatgcagtcctccggcgagctcgacgacggcgccgccggcgtgttcgtcgactcggcgtcggcgctgggaagcctcagcctcgacgggctggaccttggtccggccgagtactactccgactcgacgctcctcgactacctcaactccagctgcaccggcagcgccatgatgacgatgatgaccgcctccggcaacgccggcagctacaactactgcggcggcgccatggacggcggcgacacgtggaggtccgacgaggtgtgccaagcggcggcgagaaagctcggcgagtggggaggaggaatctagctagctagctaggtagctacgtatccagctgagcttagctgtagctaaaggctaagtggatggatggatcatggatagatgagatggtaagttgcttcttgtgatgtctctccattaaagcgagatgagatgatgatcatgatgatgatgttgatgatgctgtcacattagctaatggatgagttgttccatcatatcgatcaagatagaagtactagtgatcgatcaagcaaaaatcaaaagtagaagatgatcaatagcgtgatgattccgatcgatggagagaatattattgagatgtgtttaaacatattagctagagctagctagcttcttgtagtggttgatcgatcgatggtgcatgtaactattgttagtagtagtactttgttaatgt

SEQ ID NO: 6052 - DNA, 1421 bp, Oryza sativa
  Predicted polypeptide sequence is orthologous to G1330, G2423
gaccattttcctcaaacgatatagctagctctactacacacttgctctgcccgatgatgatggcgcgagaggtgagcagcgaggaggaggctggcggcggcgacgagctccggcgagggccgtggacggtggaggaggacctgctcctcgtcaactacatcgccgcccatggcgagggccgctggaacgcgctcgcgcgctgcgccgggctgaagcggacggggaagagctgccggctgcggtggctgaactacctgaggccggacgtgaggagggggaacatgacggcggaggagcagctgctgatactggagctccatgggcggtgggggaatcggtggagcaagatcgcgcagcatctccccggccgcaccgacaacgagatcaagaactactggcgcacccgcgtccagaagcacgccaagcacctcaactgcgacgtcaactcccagcagttcaaggacctcatgcgctacctctggatgccccgcctcctcgaacgcatccaccgctcctcccaatcccaatcccacgacgccgacgacgccgacctctccgtctccgccgccaccagctgcatcacctccgacctcgtcgtcgacgcgcatcacccgccgctcgccatggccgacagcaacgactctgcagccatgtggcagcaacatcaagcaccacagatgagcgtcgccggcgcgccgccgccgacgacgacgatggcccaacatgtagtactgccgaccgcggcggcgtcgtgccaccagatgcaggatcagttcgtctgcgcgcgcgcggcggagacgacgacgtgctgctggtccgagtcggagtcgctgccgggtctcgcggggctgtactacgacgacgcggcggcggcgctgccggagtttgacgtggagaccatggccatgtggggccctgaggacgacccatggtacacgcaaatgcttggcttgtgaaaaccgttgaccaaatatgatgccttcctacctacacctacacatttgtgtggattaaagaagaaggagatgcttattatttggaggttaatttgatttgatttaacccccaataatctcgtctccagttcttaccacatatatcgtcaattctcaagtacagtacattagctacactttagtacagtagtagtattttggaacatgcatggagtaattacttaagctacacttggtagttttcctcctccatgatcatcaagtaaaagcatgcatgcatgatcatggatggagataaactacagtgctaattaaattagtctggatgtacggttaatcgatcgcttggtttttactatactgcctgaattactccattcttaatttctcgggacggatgaaacggattggtttaatttgtttgtaataatgtatatcaagctagctagctagcttaatttggtg

SEQ ID NO: 6053 - DNA, 1404 bp, Oryza sativa
  Predicted polypeptide sequence is orthologous to G1330, G2423
gagctgcacccttgcatcttctctctctctctcttcttcttcttcttcttctccatatctcctactcctcgtgaagatcgatcgaccatcggcaatttcattcggtaatagttaagctaagatcaaatcaagattggcgaaacgatggagatggtgctgcagaggacgagccaccacccggtgcccggggagcagcaggaggcggcggcggagctgtcgtcggctgagctccggcgagggccgtggaccgtcgatgaggacctcaccctcatcaattacatctctgatcacggcgagggccgctggaacgcactcgcacgcgccgccggtctgaagaggactgggaagagctgccggctccggtggctgaactatctccggccggatgtgaagcgcggcaacttcaccgcagaggagcagctgctcatcctcgacctccactcccgatggggcaaccgatggtccaagatagcacaacatttgcatgggaggacggacaacgagatcaagaactactggaggaccagagtgcaaaagcatgccaagcaactcaattgtgatgtcaacagcaagaggttcaaggatgccatgaagtacctatggatgcctcgccttgccgagcgcatccatgccagggctggcgctgttgatgatagcggagactacagcaacaacgacttatcatgtgtatctggtgtaacaatggccactgttgctaattgttttgatggctctccgagcatggtgactagctcatcttccgattcgttcacgtcggagtcacaagatttgaagaagattaacttacatgtgcatggtgatgatgagaagatgaactctgaagactggatgcaggaggtggaccatgagttttggtctacagagattcagcctaataatgaacagtttcaggaccaacagcttaacggttgggtgcaaggtttttctgagggtttgtccgaaactctatggagtctagaggacatatggaagatgcaataaattttacatttacaaaggacatatttgtaaaatagaatagagagacatcaaggaaggcaaagagaaaaagttctttagtcatatactgtacgttgagacacttaagttctttgccaacttcaatgttttttttcttttatttttgctgcctctttcgatccctgaaggggtttttgccttctagatgtctaggggttcaaagaggaccagaggagatatatatgtgtttggatatgttgatatatgagctgatatatgccttactatatatatactccagaattgcactgaggattacatatccaattcagacatgcaaaccttaccagttgcaatattgtaaattacatgtccaattttgtagtttcatcttcctcatcataaaaaaattatgttgtgtcg

SEQ ID NO: 6054 - DNA, 882 bp, Oryza sativa
  Predicted polypeptide sequence is orthologous to G1330, G2423
atggacgcgccgtgtggatggacgacgtcggcggcggcggcggtggcggaggaggaggatgttcggagagggccgtggacggtggaggaggacgcggtgctggccgggtacgtggcggcgaacggcgaggggcggtggaacgagctggcgcgggcggcggggctgaggcgcacggggaagagctgccgcctccggtggctcaactacctccgccccgacgtgcgccgcggcgacttcaccccgcaggagcagctgctcatcctcgagctccacttccggtgggggaaccgctggtccaggatcgcgcagcacatgccggggaggacggacaacgagatcaagaactactggcggaccagggtgcagaagcacgccaagcagctcggctgcgacgtcaatagccgccagttcaaggacgtcatgaggcacctctggatgccgcgcctcgtcgagaggatccacgccgccgccgcctcgtcggaacgcgccgcgccgccgccgtgtgccgccgcgccggctagtcacagcggcatgtgccactcacctgacccgtcaaccacgacgtcgagcatggcagggtcgtcggtgacgcacggcgagcagttcccgtcgtcgacgaaccaccacctgatgaccatggccagcgtcaccaccgcagcggcagattggtccagcgagcaatgcggcagcggcagcgccaccagcacgagcgttgggatcagttatgacatgttcgaggggagctggtcggagctcctcgcccgcgcctacgacgacgacggcgccgattcttcgctgctgccggacttccaaatggcagacaccggagacaactgctggtggagtaatttggaggacatctggtcacagcagccgtactga

SEQ ID NO: 6055 - DNA, 1645 bp, Oryza sativa
  Predicted polypeptide sequence is orthologous to G1330, G2423
gagtttcatcgcagcacacatccatccatccatccatctatccagagagcacagcaacggcgcatatatagtacccctctaccaaagcacaacaaccagaatctcctgagctcgatctagctactagcttgatctatccgatcaatcgactggcccgcgaggatcgatcgagactcgaaagggagggattttgatccggatcggtcgacgatggacatggcgcacgagagggacgcgagcagcgaggaggaggtgatgggcggcgacctgcgtcgcgggccgtggacggtggaggaggacctcctgctcgtcaactacatcgccgcgcacggcgagggccgctggaactcgctcgcccgatcagcagggctgaaacgcacaggcaagagctgccggctccggtggctgaactacctccgccccgacctccggcgaggcaacatcacgccgcaggagcagctgctcatcctggagctgcactcgcggtggggaaaccgctggtccaagatcgcgcagcacctcccgggacgcaccgacaacgagatcaagaactactggcgcacgcgggtgcagaagcacgccaagcagctcaagtgcgacgtcaacagccagcagttcaaggacgtcatgcgctacctctggatgccccgcctcgtcgagcgcatccaggccgccgccgccgggcagcagcagcagcaggaaggcggcaccgacacgccgcccctgtcgtggcagcacggcggctccgacgggctctacgagtcgccggagctcccggcgcccgatgccagctgctggccagccgagtactgcgcggcggccggcggcgcgcagtcgggcggcacgcctgcaccggagctgtcgagcaccacggccgggtcgtcgtcgctgtccacggactccggcgccggggcgcagcccagctggcccacgcaggccgacggcgccgagtggttcaccaccgcctgcgacgcctccagcgccaccggcggcgtggccatgcgcgacacggagctggagctggcccagccgccgtgccagggcgggcagacgtggacgacgtccgagtcgtcgctgcctggcctcaccttccccgacctcgccgtcgcggacttcgagatcggcggcttcgacgtcgatagcttctggacgagcatggaggacgaccagctgtggtgccccacccaggccgccgtgtgaaaagtcagcacggccgccatgggaatccgccgcggcgagcgagcgcgcgcgcgcgcgacacccgcgggtgcacaaccgccggggacgcgtagcggagcggagaagcggattagaagaaggagagaagctatctgggggattagaacaagattaatcgcctcacgatgccatttttggactcctagctcccagactattctaactccagttcttttccgtttctttctcctttttttacttcctagggtaaaaaaaaagaagttaaagtgtagccgttatactagtgttgatgctgctgttactaaagtttgtccgttaaattttactcattctttttgagtaaatacagtactgccactactgtatgtacgagctgaactctgtaggattgacaggattactgtacacttctagaaaccggtaataaaagcaaagctccgacgcc

SEQ ID NO: 6056 - DNA, 371 bp, Oryza sativa
  misc_feature (332)..(332): n is a, c, g, or t
  Predicted polypeptide sequence is orthologous to G1330, G2423
attctcaaacacaccccacagctacagctgatcactagctagctactgagatcgatcgatggatttggagatggagatgatgaggatggcgatgagcccggcgatgtcgtcggcgacggcggcggcggcgagcgaggacgagggcgacctgaggagggggccatggacggtggaggaggacatgctgctcgtcgactacatcgccaaccacggcgagggtcgctggaactcgcttgctcgctgtgcaggtgattaattaattattcagtcaattgattaatcagttgatcattcgatcgatcgatcagagattgagattaattaaatagttnacgatctctgtgtgccaaatagccaatactgttgtgttg

SEQ ID NO: 6057 - DNA, 2761 bp, Oryza sativa
  Predicted polypeptide sequence is orthologous to G1340
gacttccgaacttgaagctctcctctctctctcctgccatggctggccatcacccaccaccggccgatctcctcctccgttgatcctctttctatttccttgcgccatagcgtttgcctcgacgaggagaatccatttttcccctttcccctctccctccaccttgagataaaccgccaccaccaccttctcttatcgccggagttgagctcctgccgtcgccgttccggcctcctcccctaactccttcgctgggcgaccacttccccgggtgcgtgtcgctcgggaacacacttggccgccgctgttgaggccgttccaccatcggagcaccggcgtcccttctctctctctctctctctctctctctgctgttcacgggaagaagagaaggaagaagaagacgagaggaagaagaaggagaaaaaaaaaaaaataaagagctactgacagcgcgtagattccgccgttttggaagatcgcgatcgcgaggaaaagtgttcagaagattcttttgaagaagcaagtacttctgagctgaagacgaagttagaggaccaaggcacatacccagttgagttttgcctgtggagtagagctgaagccccgctaggatcgcctttttcgcttctatcgttctcttccgatgtgagtactaagtgcctcttttgtaagtatttacactttatttatgtttggaactatatattacttgtcgttttgtgtacctgactggtcctggatagggatttaatacacaaaataatctagaaatttggggctaaatttctgggcgtgacaatccctcagccatatatatggtgatgggtgaatgggcccatttgaatatgtttcgttaggtttgtgtgcccaaaactccataggcttgaatatgagtttgattctcctcctactttatgtatatttcttctcaactttagtagtttgtcaccagcgtccaaatatacaccaactctcgtggaatttgttagaaataaatcctaccactatgttggatgttttacattttcatattaatgaaggtattgacggtgtaaatttggtatttaattcagtagtggcatataatggacatgcttgccagtcaaagttacaaatctatttctcatttgttacaacttgcttgcaatactaaaagtcaaatagaggaggacatggaaaaacaacacgctatgtttttgcctccttttactaaccatttgctggaagtgcataatcatgaaaaggaggagagagacatgattgaaccatcattccctttattcacactcaaattcgatgcacctccatcatctgaagaaatcaccaaaggtaaactagatgatgctaaaactaatcaaggtgaatgtgttgttaataaattgaatttgtccacttttcatgctatagtagggcaaccattaatgaaaccaattgttgagattactttgtcacaagttgatttttttttgttgttccttgtgataaagaagagttgcgtgatactgcttcacttatactcattccacaattagtgaatgaacatgatattcctattgttaatcctttatgtgttgattttaagcatgttgttcacatgtctaatgaagttaaggaacgcaaagtattgtcttctttaaatactttgggctatgttcagtttgatgatatttgtgagctagtaaataatttgaagaagaaattattggctaagtttgaattgccatgtccaactaatactatattttatatctttggcaaacataataatagaggattatatttggtgcacataatttatatatatttagatttggaacctcttataattacgtgagaaaatagcaagctagagagtagtatcattgctaatcatgttatctcgagtttgtgttgttttgatttgaagcatcaggtcggttttaaggaagaggagagaccggatcactctttgtggtcaccatgcacctagatagttgcgccatatgagtactcggcttctgaagaagggagcaaatgagtagcaagcgaaacaatcaaatgtggcatcgatgttctttgttgtgcgtctatatcgggtacatttgtttcattggatattaatactatttgctaaataactgatgatattacatgacgaaagtttgttgcatttattttcatgtaggcacttctatgtgcaagaccatgcactacacgataagcaccatatggaaaaactgaggacggttttctatgaagaagaggaggatgatgtgacctggctaccataggtataacaattgttcacttcagggatcaagaagaatacatcaagatcaagccgtccaagtgatggaatcaaattcggctacctgctaccgtgctgacttcaaacgactgtcaaatatgtatacaagctctgttttggttctgtgagtatttgatggatagctcttatcggagtcctctttccaacggatctagcctcatcgccaaattccatctcagtcatccgcaatcaaagaaacatggtgctaaaatacctgtcgtgggcctttggatttgtaacttcatttaggaccccggcccatgtggggtgagccccatcctggtggagcacgaccctagggaccctttggtcgtcccctcatctccttaaatagccatgtatcccttcagagtgtctagagtttgtttagattaaagtttagccattgctactttaccttgtacttacacgtgtcggctagaccacctaattactcatctttgaaacccc

SEQ ID NO: 6058 - DNA, 445 bp, Oryza sativa
  Predicted polypeptide sequence is orthologous to G1341
aagtatgagaagagcattggggtcacaagagcaatgaccttgaacaaccttcagacaggtttccctaacgtttttcaggcgatgacgggattcgccagcgtttgcatggaagcgtttgaatcggtgtacaacttcaagagttcagatcggatccttgattcgaagaggctactaacatgagattctgagaagttgtcttttgttggtgcttggtaggtcactgtataaagtgtatacagttctagagttcttgtagaatagcaggtggaacagggtttaacttacaaccgtctctgtctgttatcgtcttctatcttatggtactagagtaggcaggcacagaaatgcctcgagttcatttactcgctgtgaacgaacttgaggccttgttcttcctctttttggttagctctgaggtgtttgtccattcttggattcgaaatct

SEQ ID NO: 6059 - DNA, 1553 bp, Oryza sativa
  Predicted polypeptide sequence is orthologous to G1361
ggttccctcctctcctcctttctctctccctcctcccgcgcgcggggtctcgccttaacgtttgccgcatatgggggcgacgagcaaagcgtaggccggagggagggacagggagagagagagagagaggctttctggctcgctctctctgcacgatctctcgtcttgttggattatacagccatgacatggtgcaacagcttcaacgacgtgcgcgccgtggagaacaacctggccaccgccgccgccgtggccgcggccaagaagcagcagcagcagcagcaggtctcccagcacgtcaacctcatcaagacctgcccctcctgcggccaccgcgcgcagtatgagcaggcagcggcggcggcgacgatccaggacctgccggggctgccggccggggtgaagttcgacccgacggaccaggagctgctggagcacctggaagggaaggcgaggcctgacgcgcggaagctccaccccctcatcgacgagttcatccccaccatcgagggcgagaacggcatctgctacacccatcccgagaggcttccaggagtcggcaaggacggcctgatccggcacttcttccaccgcccgtcgaaggcgtacacgacggggacgcggaagcggcggaaggtgcacaccgacgagcagggcggcgagacgcggtggcacaagaccggcaagacgcggccggtgttcaccggcggcaagctgaaggggtacaagaagatcctggtgctctacaccaactacggcaagcagcgcaagccggagaagaccaactgggtgatgcaccagtaccacctgggctccgacgaggaggagaaggacggcgagctcgtcgtgtccaaggtgttctaccagacgcagccgaggcagtgcggcggcggctcggcagcgacggccaaggacctctccgtcgacctcgtcgccggtaacaacatcaaggctagcaatgctgctgctgaacaccaccataacgacggcgtcggcggcggcggccacggtggcaacaacagcagcatgctgaaggaagctgcaggcattgtagatttctacaacccagcggcggcgctaatcggctacagccaggcggctcctaacaacagggcggctgcttctgctcatttgacgatgcctaactttgaggtgcacacaggaggtgcaggctttggcccctgatggatggaagaaaacaaagcaaattaaacatatttgactgatgatatatataggttagatggagagggcagggcaggtatatgatggcaaatgtgcatcatgcatgctagcatggtgtaatttgcatcgagtgaaaaaaaaggagtttactaaaccgtctacgtacgtattactggacaataaggagtgtgtcgagtgagttgctgcacagatgttgaagcgtaggggggtcgatattcttacagtgttcattattgttacatgtgtacacatatataacttgacattctcaatttttttgtttaatgatatatatatatatatatatatatatatatatatatatatatatatatatgttgttctat

SEQ ID NO: 6060 - DNA, 1539 bp, Oryza sativa
  Predicted polypeptide sequence is orthologous to G1361
gaagctttccttcttcttttttccccctctcgacgatctctctctcatcaggaccccggccttaagttgtttcttccctatcagctcaggtctctctcgatctctcctagctagatagatagcttaattagcagctagagatgtgtctctagctaagctaactagctagtaggcttcttcttttaatccggcattgttcttggctgctggtcttagtttttggctgtcatgtatggagttagtggtaaaatactaggttaattaataatataaggcgtgtgtatatattggtgtggaggaggaggagaaagggggttggccggagagatcgatgacgtggtgcaacagcttcagcgacgtccgcaccgccgtggacagcagcttgtcgccggccgccgccgtggccgccgccgcggggaagaaggcggcggcgtcgctcgccgtcctcgtcaagatgtgcccctcctgcggccaccgcgcgcggtatgaacaggagacgacgacgatccaggacctgccggggctgccggccggagtgaagttcgatccgacggaccaggagcttcttgagcatttggaagggaaggcgaggccggactcgaggaagctccaccctctcgtcgacgagttcatccccaccatcgagggcgagaatggcatctgctacacccatcccgagaggcttcccggtgtgagcaaggacgggctggtgaggcacttcttccaccggccgtcgaaggcgtacacgacggggacgaggaagcggcggaaggtgcacagcgacgaggtcgacggcggcgagacgcggtggcacaagaccggcaagacgagaccggtgatggccaacggccggcccaggggctacaagaagatcctcgtcctctacaccaactacggcaagcagcgcaagccggagaagaccaactgggtgatgcaccagtaccacctcggctccgacgaggaggagcgggacggcgagctcgtcgtctccaaggtcttcttccagacgcagcccaggcagtgcggctccaccgccgccgccgccgccgccaaggaggcctccgccgccgtcgccgccgccgtggtgaacagcaactactccatcgtccatggccatcaaggtggtggtggtggtagctttctcaaggaggcaaacgttgtgcacgagttctacgacccggcagcaacgatgggttaccggccacctgctcctgctgcgcacttcgcgccaaacttcgcggtgcacgcggcaaggaacagctttggtggcccttgaaggaaaaaccaaaattacacaaaatctaaacattaccgtttataccgatatgattcacataggtgccattatattacattcttaaccttacattcatccatcagttatttgcagttttgttcaaagttgttatatcgtttccgatgctatactgtgcaaagattattactacacgccgttctaactcgaaaatgtcaattaatgtatcagtttgtacatgtatacatgcacacggaagaggtcctgatgatgcatcacttcat

SEQ ID NO: 6061 - DNA, 717 bp, Oryza sativa
  misc_feature (20)..(20): n is a, c, g, or t
  Predicted polypeptide sequence is orthologous to G1361
cttcgccaagaagcgcaagncggagaagaccacctgggtgatgcaccagtaccacctcggcgagctggacgacgagaaggaaggggagctcatcctctccaaggtcttctaccagacgcagacgcggagcgccgccgcagcagaggcaccggtaagctcgggtgctgccatggaggtgcagggacagcagcagcaagtgctgaagctgcaggctgatgatggtcacttcagctcagctcctaccaagaagagactgcatcaggatgttgtagcacaagtaaaagttgatcggggtcaccactgcatgccagcacaacgccaagtcaacttcaatttgaaagtaactcctgtgcccaccaccagttcattccctgtcgttgtcgacaaacagttgtattctcctgtggcgctattccgaagtgaacatcttcatggaagaacttcaattcatcagccccaaaaagcagattggcctcaccagcgctggcctcctgacaaccaagatcaacatggataacttcctggattcacagtagatgaacttaactggtaaatggttctagtgttgattttgaaacgtacaacagaaactggctgtaatatcttcggctactgctagagtgctagtgctagtaacctatctacttctgttcttagcccgtagggcagtattgtttcttattgagaatgactgtctatatacatgtcaaatctctt

SEQ ID NO: 6062 - DNA, 909 bp, Oryza sativa
  Predicted polypeptide sequence is orthologous to G1363, G1782
atggattggggatttgagatctggaatggcacggacactggacaacaaacaaagaaacaattttcgcatttaggatttttaagagatagttttcccactaggcgccacgacgggacggacgctacaggaatgcaagttgaagaacctgaaaaatgcatgcagtacggaacaatcgaaatgctggctgctttatttccaggaattgagacttgtggagtcggaaagcagatagcaaccccggacgtgcacccaaccaacctacacttaccagccgcattggatgccgttgctccccacacacaccgaaccaacggtgactccttcaggagaactgttgatggtcctatgaggtcaacgttgacttttgataataatcattctgtagtgccaagtcaaaacattgattacggccagccaatggcttgcatttcatacccatacaacgattctggttcaggagtttgggcatcctacagttcacgctcggtgccttaccttcacgaatctcggcatcgccatgcaatgaagagggctaggggcactggtgggcgattcctgaataccaagcagctccagctgcagcaacagtctcacactacctccaccaagaccaccacagacagccaaaattcttcaggttcagtccatctacggctaggtggtggcgcaatcggagatcaaactccatttccgttcaaagcaatggattcacaagctaacatcaagagagctgcagcttctgcttccaccttcactgtaacttctgcggcacagaaagacgacgccttcttcgaccgccatggccaccatctcagtagcttctccggccattttggccaggcaagcgcacaaggtggcgtcggcagcatgcataacgggtcacagcagagggttcctgctatgagatga

SEQ ID NO: 6063 - DNA, 503 bp, Oryza sativa
  misc_feature (68)..(68): n is a, c, g, or t
  Predicted polypeptide sequence is orthologous to G1363, G1782
gcacaggcttgcatttcatacccatacaacgattctggttcaggagtttgggcatcctacaggtggangctcggtgttccatcctcaaattgtgggaggaggcacatcgccaagagttcccttgccctccctggagatagcagatgatgggcccatatatgtcaatcccaaacaatatcatggaattcttcgcagaaggcaactgcgtgctagggtagaggcccagaataagctcgtcaaaacccgaaagccttaccttcacgaatctcggcatcgccatgcaatgaagagggctaggggcactggtgggcgattcctgaataccaagcagctccagctgcagcaacagtctcacactacctccaccaagaccaccacagacagccaaaattcttcaggttcagtccatctacggctaggtggtggcgcaatcggagatcaaactccatttccgttcaaagcaatggattcacaagctaacatcaagagagctgcagcttctg

SEQ ID NO: 6064 - DNA, 886 bp, Oryza sativa
  misc_feature (858)..(860): n is a, c, g, or t
  Predicted polypeptide sequence is orthologous to G1363, G1782
ggtgggacgacagaaggatttcaagaagaacaagggatatccattcctctcatagagcacctgcttgcaagtcccacagatacaatgggttttggtgaaagcacccaggcaatcaacgtaagcttgatggtcctgggaaagtgtcaactgaattatctctagtcaatctagaagctaaaaatttgcatcctaaacctgagtgcaaccaacctcttgaacacatacctaccaagggtatgaagtgtactccactgctaccactacctacagaacatgctgatgatgagcctatatatgtgaatgcaaagcagtaccatgcaattatccgaaggagacaacgtcgaaaaattgttggatcagaagataaagtagcagcaattcgaaagaggatccttgttgaggctcgccaaaagcaagcaaaattgaggcgtagaggaaaaggcggacggtttattagcatagaacatccccttgaactttctatggatgatcagatatcgaaaaacggaggaagtgcctcgccttcttcatctacagtgtcagaaaactctagcaatgtgaacggttttacaggagatctctaatgccatggatagcagcaaaggtcaatcgcaatggctaccatctgaagaaaaaaaatctctaatgaactgaagtactgtgcaaccaattatgtctgtgggaaggcaatgacctatttatattggcggggctggggctacattgagggcttccccctttagtgtaaacatggcgggcactaagcaaccccgaaagggcttgttgtgccccaaaaaaaaaaaagggggcacacggccttttctaccccccgacccactccgaccccctgccctttannnagagaagaaagaaagaaaaaaaaaag

SEQ ID NO: 6065 - DNA, 538 bp, Oryza sativa
  Predicted polypeptide sequence is orthologous to G1380
gccggtgctcccgccgcggccgcccccgccgccgccgatccccgacggtgactgccgcagcgactgcgggtcgtcggcgtcggtggtggacgacgactgcgcggacgccgccgcctcgccctcgtgccggctcccgttccagttcgacctcaacctgcctcctggtggaggcggcggcggcggcggcggctttggctgtgcctacgacgacgaggagctgaggctgacggcgctgcggctctgagcccccaaccccaccggtcgttggagaaagaggaaaaggagaaaaatatttggttcttcccttctctcgtagccgacatgatccttccgcgctttgtgttgttcttgtttacttgatctgatgatgattaatgtggcccgatctgcgtatctgcctgcttgctgctggcgatagatgatgattgctgcgtctcgcagcagctcgctgtggttgtgctgttgtaatatagcaacattttacttgcttccttcctgtgaggaagcagacagctaaagtaacttattttcaatcttt

SEQ ID NO: 6066 - DNA, 820 bp, Oryza sativa
  Predicted polypeptide sequence is orthologous to G1380
cctgtctgaggtacggtcggaattccgggtgaccacgcgtctgccacgctgtcgagcgcaaatcaatcacccaccatacaccggtcgaacacttggcgctctcgcccgccttagctcgctctgctcgtggtgctcgtacccgaacaagaacggacatggctcccaggaacgccgccgaggccgtcgccgtcgccgtggcggagggcggaggagacggcatggagcccaggttccgcggcgtgaggaagcgcccgtggggcaggtacgctggcggagatccgtgacccggccaggaaagcgcgggtgtggctcggcaccttcgacaccgccgaggccgcggcgcgcgcctacgacagcgccgtgctccacttccgcgggcccaaggccaagaccaacttccccgtcgccttcgctgcacgcccaccaccacgccccgccggcgccgctggccaaggcggcggtgctgggcgtcgtcagcccgaccagcagcacggtcgagtcgtcctcccgggacacgcccgctcgccgccccggtggcggctgggtcaaggcccaggtgcccgcctcgccttcgctcgatctgagcctcgggatgtcggccatggtggccagccagccgttcctgttcctcgaacccagagtcgcggtgaacgtggccgtcgcggcaccggtagctcgccggcgggcgtcgtcagcgtaagaacgcagtaactcgctggacagcagagcacactggtcgtcgcaacgaggggagcctccggcgtgggtgggtaactaactgcgcgcaatagagggagatagccaaaaaaaaaccccaaat

SEQ ID NO: 6067 - DNA, 1126 bp, Oryza sativa
  Predicted polypeptide sequence is orthologous to G1380
aagcaccaatggtccctgcaggtacggtcggaattccgggctcagctcaacccagcagcgcagcagctcaagccttctcgcgttgcagcgccgcgccgaggaggtgtttgttgatttgtggagatggtggggggagaggtcatgtgcgaggcggcggcgccgaggtacaggggggtgaggaagcggccgtgggggaggttcgcggcggagatccgggacccggcgaagcgggcgcgcgtgtggctcggcacctacgactccgccgaggccgcggcgcgggcctacgacgtcgccgcgcggaacctccgtggcccgctcgccagaaccaacttcccgctcgtctcctccctcccgctcccgtcgccccactaccacctccccgggaaggcggcggcggcggcgccgccggtggccggccccgcggtgcagcgcgagctccaccgccgagtcctccgagcgggcctcgccggcccagaccggcggcccacgggaggcggcggtgcccccggaggcggctcccgcggcccatgagcacccggagcccgacgccgcgaaggcccacagcacacatgcccctcgacagcccccgccaggcctaacgccgcacacacctcaccggcaccgccccgcgtccaccgcgctcgcacctaacaaccaccccagaccgcagcccggcccccccagacaccagaccccagccctccgagctacaacgcaccaccccacccccagacccggacaccaaccccgccccccaagcacacacaaccccgccacccctccaccccgccacctcacacccgaacgaccgaacgccccagctacaaccaccggcagacccccacgccgccagaacgacgcgaccgcccgccgcagcggccactcccgggcagccgcccggccccacgcacacggacggcagcgcccacgcagcacgcaacaccggcccccccgaagaagcccacgcgcaccgccccgcgaggcgcccgctcccgggaccagcggagggcggcgccgcgctgcgcggggcgaccgggcggggcacgggcgcgcgcggcgccgccaccacgcccgccgcgccacccgcacgccgcaccccgccccccacccgcgcgcacccccaccc

SEQ ID NO: 6068 - DNA, 2328 bp, Oryza sativa
  Predicted polypeptide sequence is orthologous to G1382
gactctcacgagacagcttcccacgcagcgcagcgcaaccgcagcaatggccgattcgccaaaccctagctccggtgaccaccccgcgggcgtcggcgggtcgccggagaagcagcccccggtggatcggcgcgtcgcggcgctcgccgcgggcgcggcgggcgcgggggcgaggtacaaggcgatgtcccccgcgcggctgccgatctcgcgggagccctgcctcaccatccccgcgggcttcagcccctcggctctcctcgagtcccccgtcctcctcaccaacttcaaggttgaaccctctccgacaactggtactctgagcatggctgcaattatgaacaagagtgcaaatccagacatacttccttcgcctagggataaaacatctggtagcacccatgaagatggtggctctcgagattttgaattcaagcctcatctgaattcatcctctcaatcgacggcttctgctatcaatgatcccaaaaagcatgaaacttctatgaaaaatgaaagcctgaatactgccctgtcatctgacgatatgatgatcgacaatatacctctatgttctcgtgagtcaactctcgcagtcaatatttcaagtgccccgagccaactggttggaatggttggtttaactgacagctcacctgctgaagttggtacatctgagttgcatcagatgaatagctctggaaatgctatgcaggagtcacagcctgaaagtgtggctgaaaagtctgcagaggatggttataactggcgcaaatatgggcaaaagcatgttaagggaagtgagaacccgagaagctattacaagtgcacacatcctaactgtgatgtaaaaaagctattggagcgttcgcttgatggtcagattactgaagtggtttataaagggcgtcacaatcaccctaagccccaacccaataggaggctgtctgccggtgcagttcctccaatccagggtgaagaaagatatgatggtgtggcaactactgatgacaaatcttcaaatgttcttagcattcttggtaatgcagtacatacagctggtatgattgagcctgttccaggctcagctagtgatgatgacaatgatgccggaggagggagaccttaccctggagatgatgctgttgaggatgatgatttagagtcaaaacgaaggaaaatggaatctgctgctattgatgctgctttgatgggcaagcctaaccgtgagcctcgtgttgtagtacaaacggttagtgaggttgacatcttggatgatgggtaccgctggcgcaagtatggccagaaagtagttaaaggaaaccccaatccacggagttactacaagtgcacaaatacaggatgcccagtcaggaagcatgttgagagagcatcacatgatccaaaatcagtcataacaacatatgaaggaaaacataaccatgaagtccctgcgtcgaggaatgcgagccatgagatgtccactccccccatgaagcctgttgtccatccaattaacagcaatatgcagggccttggtggcatgatgagagcatgtgaacctaggacatttccaaaccaatattctcaagcagctgaaagtgacaccatcagccttgatcttggtgttggaatcagcccgaaccacagcgatgccacaaaccaattgcagtcctcagtttctgatcagatgcagtatcaaatgcagcccatgggttcagtatacagtaatatgggacttccagcaatggcaatgccgactatggctggcaatgcagctagcaatatatatggttcgagagaagaaaaacctagtgaaggttttactttcaaagccacaccgatggaccattcggctaacttatgctacagtaccgccggcaatttagtcatgggtccgtgagagtctatactaatgcttatagctcgagaatcatatattaccaatgcttcgtattgacattctcttcagaaagatgctcctatcattgacacatcagttgaaccggaggcgagagctgtacctgtgggctgcagcaaaatacaccacatgggtcttctggagcggcaaaggccttgttgtatacttgtatgtggcactggccctatattcgttgtacagtgaacccgttaagattaattagatcatcagaatttggttttctttaactatcttcgccttcagtggaatgtggatagaacatggattatggttgatttggttttgtgagcttgtctaattctcttttgtgacaaagctttgtatctcactgcatatgtacaatgccgttggcagtaaagatatgcaaatgtgatacctgtaacacg

SEQ ID NO: 6069 - DNA, 297 bp, Oryza sativa
  Predicted polypeptide sequence is orthologous to G1389
tgcggttcatgccccctggtttgtgtggcactcgggtgtgtgtggtggaacgacccgtgatgcgtcatgttctatccgtgagattgatcttcccggtcggagacctgctagtgtagagaaagctgcgtgagagagtgcgaggagagataaatgcctgcccctgtatgagcggatatggaccccccaaccttggctgcccatgtttggtgatgtgtagttctgagcttgcgtgttctctgaacctgttggatctttaataccgagagtatggcttttgttaaaaaaaaaaaaaaaaaa

SEQ ID NO: 6070 - DNA, 1108 bp, Oryza sativa
  misc_feature (774)..(774): n is a, c, g, or t
  misc_feature (870)..(870): n is a, c, g, or t
  misc_feature (1048)..(1048): n is a, c, g, or t
  Predicted polypeptide sequence is orthologous to G1399
acaggtccgaagtcttagtgaccacgcgtccgggacgcgtggtgcggacgcgtggggccccggcgagctctcctccgccgcctcggcgcgccacctctcctctcctcgcgccgcgggggagaagccgaacgggcgccggagacacggcgcggattgcctcaccccccctagtggccgtatcaactatcacccttggtgcgcggcctcctcgcgcgcgcgggaacggcgatcgtatcggggtcggatcggattggagccacagcccacagcagaggcaccaacacctgagcagctgaactcaactaagcggcatgcacaccagagtcggcttgcactcacacgctacaaccctgccacttgtacgaatggaagaatggttggactgcagcaggggatgctcgggcccccctgttgtgtctgccccttgaaacggggagaaaaactcatcaagtaattgaaggtggtgaataaacttttacggggcattatcatcgttcctaggttcagctgcaaaaagttaaagcaaattgccaaagatgacatctgaagagaataaagctgttgcacataatgaaccactacccatggagcagacattaagctctggtgctaagcgtaagcgtggtcgtccacggaagtatgagtaccgggctgctgtaatttcccttttgtggtgaggccattcggagggtccacctcttccagccacaagatagtcaaaatccgcaggggggatacgatcccctactcaggggaccttggccaataggccanaggttggccacagcggcgcttaataacggacccgatcgcccgtggaaactccgccgccctataagggccggggagagccctataggggccggcggnacatgccccagcggggaaaggccattaactcgcatccgccacagcgccgacaccccgcggtggcgacggacgtaacacctaccacgtcgtgagacgataccgaaagacgagcaagcacagccgccctctcgaccaccgcagcagtgaacgactagacgagaaaccagcataacgtagngtcgctgcatatgcacacgacgacggtagacagccaacggtgaggacacgactagacaaa

SEQ ID NO: 6071 - DNA, 388 bp, Oryza sativa
  Predicted polypeptide sequence is orthologous to G1399
tggcttattacaacttaccaagagatgacttttatctaaattctgttagtgtgcaagctgcaacgctcgttttagttctcctcaatcgttctagcagatttcatcgtaaatggaaaatcgtttaagattagcagccaaaagtaatgctatcagttctctatcgttatcgattgaagacacgcgcggtcattattattccttgagtcaaaatgattcgattagtttgggaacacccacaacaagttatgctgctgcggcagcaacgaatgcaacaacgcccagtgcactttgtatgcttatcaatggtcgtcgagtacagcaacattataaactattaaccgatggtgttgttcaagtgtgccgtgttccacatgctaaaaatatcatt

SEQ ID NO: 6072 - DNA, 1854 bp, Oryza sativa
  Predicted polypeptide sequence is orthologous to G1411, G2509
gtggcaactggttagacttttttttccctttgcctataataaagccatctctcataaagccatcgacctcatctcctcctcctcctctctctgtctctctctggctgttcttatcagtttacgttgtcctcatcgtcgccggcgccgccctcaaaagcttcatagatagctcgatcgatcgatcccgtcgtcgtcgatcgtcgtcgacgcagcagcctcgccggcggccggagactggggagatcgatcgagagggagggaggttgagtaaggtggatccacgggtcaggcatggcaagaggcccctaccggccggcgaggaggaggaagaagaccagccaccgcctccgacaccaccagcaaagcaggagcagcaggacgaggaggagctcgccgcggtcgtcatcagcggcggcggagcaggagcagctccggcgccggagacgtacgcgcagtactactacgcggcgcgcgccgaccacgacgcctccgccatggtcaccgcgctagcccacgtcatccgcgccgcccccgacctgcacctcccccaccacccatcctcctccgcctccgccgccgcccacccgcagcaggcttcttccttctacccgaccgccgccgccgccgcctcctcgccgtccgaccagctcgccgccgccgccgctgccgaagagcaagggaggaggcggcactacagaggtgttcgacagcggccatgggggaagtgggcggcggagataagggacccgaagaaggcggcgagggtgtggctggggacgttcgacacggcggaggacgccgccatcgcctacgacgaggcggcgctccggttcaaggggaccaaggccaagctcaacttccccgagcgcgtccagggccgcaccgacctcggcttcctcgtcacccgtggcatcccccccgccgccacccacggtggcggctactacccctcgtcgtcgccggcggcgggggcatgccccccgccgcggcagcagcagacggtcgtgccgtacccggacctcatgcggtacgcgcagctgctgcagggcggcgtcggcggcagttacatgccgttcggcggcgccgcgacgatgtcgtcgtcgacggtgtcgtcctcgtcggcgccgcagatactcgacttctcgacgcagcagctcatccgggccggcccgccgtcaccaatgccatcgtcgggctccggctcggcgaccgcggcggcgtcgtccacgacgtcggcgtcgtcgcccggtgcatggccgtacggcggctcggagcgcaagaagaaggattcgtcgtcgtgacgtcactggatggatcgatcgatgcatgaatatgccatgcatttgagaggaagaggtcaagtttttttttaagcaatggaaatggattacatcttcggcctcggcacgtggacagaaagagatcaagtgatatggatcgagaagaatgtttagctgatctgctctttactctgcacgatcgaggagatgaaaatgcatgcaatatgcatggaggggtaagtgttaagtggttaattggtgatttttgcgggttaattaattacatggacattaatttttcttttgatcaccttttgtttattttttctctgaaaactatcttcttttgttcatttttattttcttggaggtacttaattaattagctaggttaattagctggtgatttttagtttgttgtttccctccttttgttcaagtgtgaactaattgtgcaaaattagtccaagtaaagcaaagagagaggattcttatttaattattggttaaacattacccttttttaagatgaaacatgatgtctttttttaaaaaaaaaatctgaatgattacc

SEQ ID NO: 6073 - DNA, 475 bp, Oryza sativa
  misc_feature (130)..(130): n is a, c, g, or t
  misc_feature (147)..(147): n is a, c, g, or t
  misc_feature (200)..(201): n is a, c, g, or t
  misc_feature (252)..(252): n is a, c, g, or t
  misc_feature (288)..(288): n is a, c, g, or t
  misc_feature (293)..(293): n is a, c, g, or t
  misc_feature (364)..(364): n is a, c, g, or t
  misc_feature (383)..(383): n is a, c, g, or t
  Predicted polypeptide sequence is orthologous to G1412
tcggacctcaaaaggataccctggatggaatgccttacaatgccaccccaggggttcaaaaggcgacgaggacgacggaggaagtgtcgtgccatgctcgcgacagaaccacagagggcggaggacaggntgctgcgtggcggacantaagcgcccagtgccaagacggaacaacacccacgtgtgccgagtaaataccnnatggctgctggaatgcaccgtgccctgggctggaaattgtaaatggatgcnacggctgatgaaatataatagagtgatggctaagtnaggtnttgtgagtgttcgaccatggtgacattaagtgaaaaggagcacccatgaatggttgttgaggatcgtgttntgtttgacagcaaggagcnatggccaaatatatatatatacccatgggctcccgatgttgctttgctgtatttttcactgttttcctggtgaaaaaaaaaaaaaaaaaaaa

SEQ ID NO: 6074 - DNA, 933 bp, Oryza sativa
  Predicted polypeptide sequence is orthologous to G1417
atgaacacttttacacttttcagggatgaggtgcagaaagcttcagagaaggttcatcggcatcacgcgaacgacgacgaggccgggttattcctgtcacttgggcttagcctcggatcgtctcctgatgcgtgccagtgccacgccagcaagaaagacgaagcggacgccggcaacggcggcggcgacgggtacctcgccctcgcgctgcgttgcgcccccgccgccggcgagccaatggtgcatcccaagaggcagagggccaccaccaacagcagcagtagcagcagcatctgcggcgaatacgggggcggcgccgccgccgccgccgtgccggcgggccacgacgacgacgaccggtcttgcatgatcacggctgcgtcgacggcgaatcggcctggccgggtcgtactcagaacacgatgcagcgcacccacggtgaaggacggttgtcaatggcgcaagtacgggcagaagacggcgaagggcaacccgtggccgcggggctactaccggtgcaccggcgcgccggggtgccccgtgaagaagcaggtgcagcgctgcaaccacgacacctccgtcctcgtcaccacctacgatggcgtccacaaccaccccatcacgccctacgccgccgcgctccctccgtcgtcgtcgtcctcctcatcggcggcggtagccatgctcgcctcctcctcgtcgtcttcgacgtggtcggagcttcagcgcgcgatgccggcggcgcagtcgtcatggagccagagaaactaccctattcaggcagatgtcgtggcgaaggcgatctgggaccccaagttccaggcgacggtggcggccgccgtcgcgagctacgtccgtgaccgtgagcagagcgcgcgcgttgccggtgggaagggtgccggagagctcttcaacttggctcctccatgctga

SEQ ID NO: 6075 - DNA, 1509 bp, Oryza sativa
  Predicted polypeptide sequence is orthologous to G1417
atggagatgatggtgcagaagcaacgacacgaggagggggaagaggagcgaggaggcttgtgcgcccgcgagatcaaggagctcgacttcttctccgccgccggtgccggtgccggccggagagacgacgacgacgtcctccgtgcggatgggatcagcagcagccacgccggatttatggtcagcactgcgctggacttgctgacagcggtcaacgacggtgatcatcatgaggagaagaaagggcagtcaaatattcaccaaagcaagcagatggatgcggcggcgacgacggtggagggggagctccggcaagccggcgaagagaaccggcggctgcggcggaggctggaggagctcaccagcagctatggcgccctctaccaccagctcgtccaggcgcagcagctgcacaccaagcatcagcagcaggctccgatcgccggcgtgcagttgctggacgcgctcgcggcggcgtctccggcgagccaccggcgacgagcggcggcggcggtggacggcgatagaacagctgactctgatggtggcgagggcgacgagaacgtgtcgccttctcttggtagcaagaggccggcggcggcagcgacgttaacgcggctgacgccggagagcggcagcggcggggagaataatggcggcggcgagcaggcgccggcggcggagatggcgccgtgccggaaggccagggtgtcggtgcgagcacgatccgaggctccaatgatcagtgatggatgccaatggaggaagtacgggcagaagatggccaagggtaacccttgccctagagcctactaccgatgcacaatggcttcgcaatgccccgtcagaaaacaggtgcaacgatgcgcggaggacaagagcatcctcatcaccacctacgagggcacccacaaccacccgctgccgccggccgccgccgccatggccaagaccacctccgccgccgccgccatgctcctctccggccccgccgtcagccgcgacgcgctgttcgccgcccaccaccacgtcgtcgcgccgccgcccttcttccaccacccctacgccgggtccaccatggccacgctctccgcctccgccccgttcccgaccatcacgctcgacctcacccagccgccgccgacgacgacgaccaccgccgccgccgccatgctccagctccaccgcccttatgccttctcctcattgccgttctcgatgtacggcgccggcggcggctcgcaccggccgcccgtcgtcctgcccccgccgtcgtcggtggtggagacgatgaccgccgcgatcaccagggaccccaacttcaccacggcggtggcggccgcgctctcctcgatcatggcgggaggcggcgcccaagctcgaacacctccacgcggcgggagtgacgccgccggagacatcaacggaggcggcggcgccgaccacgccactgccggagcacgcgccgcggcggcggcgacgcagccttgcggcacgtctcccacctga

SEQ ID NO: 6076 - DNA, 290 bp, Oryza sativa
  Predicted polypeptide sequence is orthologous to G1425
tgataccaccttccgagtttcgcgttctcgccttgggtggaacgccacaaagtgttgagttctcggcctcctgcgccgatgggtggtataccggtgcctctagccctccagggaccgtaggcctggttccgccgcccgcctgctgccttggggtatcgagagggaatgagggatgggaggtagagtggagaggacggaggtagaagataaggcatgtaaccaaataaaatttctgtgcattgacggagtaagtagtgcatatctttgatttcaacaaaaaaaaaaaaaaa

SEQ ID NO: 6077 - DNA, 2363 bp, Oryza sativa
  Predicted polypeptide sequence is orthologous to G1435, G2741
ggccgacgcgccattgccctcgtcctcttcctcttcctcttcctcgtcgtcgtcgtcgccgagccgtcgcatggtggacgccgctgcggcctccggggacgcgtgcggccgcgtgacggagtgggagaccggcctgccggctccaggcgagatgacgccggtctcgcaccagctcgtcccgccggcgctcgccgccgccttcgggatcgacctcgcggccgtgggcgtgctcctcccctctccctccgtcgactcccctgtctcccacctcttcttccccgtcgacgaggacgacgacgaggatgaggagggggagggcgaggggggtaacgatgacgcccccgccgccgccgccgcgggcggcggcggcgggaggtgcgggaagaaggcgaggatggtgtggacgcccgagctgcaccaccggttcgtcgaggcggtggcgcacctcggcgagaagggcgccgtgcccaaggccatcgtgcgcctcatgaacgtcgacggcctcacccgcgagaacgtcgccagccacctccagaagtaccgcctctacctcaagcgcacgcgcgtcgccgccacgccgcctccttctccaccaccacctcctcctcctcctccgcccctgccgccggcgatgtacgtcccctgcttcgccgcgaaaccacctctcgacgcagctaaccgcagcgattcccctccttccagaacctcggacgcaacgactaagcagtaagctttatattttgcaaatttttttccccaaaagatagccaaaatcagatagtacgttttttttcctttttttttctcatattttcgaggatccaagtagatatattgagtatttaatttcgtcaggaatcaagtgaaaccaatcaaagaggtacaatatattgaactcctgtcgtctgcaaaatcgaaatttggcttaccgtccgatggcaagttgagggatagtacatttcaagtacagttatgcacatatcgggaacaagatatagaccacactaaaatgccgctccttgcaaaaatttatcaaaccattgcatatattagttttctcttggtgatagagttcattcttttcggtaccagtgttgtcctcctggcgaaaatgtttttagccacagacatccttgggccgtttagctagaattactctcttttttttttctctgcgcttgatccgtatagaatgtttgttgtttatacttttgtaaatataatacttactactagttacgagtactatattatattaaaaaaaacttaacgtttacatgtcttccttctttcttctgtaacttaaaagccaacttttatgtttggcatacatatccattgttgtcgcaaccaaaattcattagttagatagcaaaatatagtagtttctgttttcagtaacgcgatgatagactattgaaagcaactttatgctcacaccaccttccctttaagagcaatttaggtatttaagttctttgaaggaactgctgtaatgatacccagttgatgattgaatggtggtggggttatctgtaatgtgcttccttgaatcagaagacttgggtatatggttaggagtacttccctcccttgccaccaccttgatgttgaaatggactgcccatttcaatgattatttgatgctttctggggcaatcaatcattgttagaggaattatttgttcctagcatgatttatactttaatataattaatattagtaaaggtcagcactatgttaattccatggtttgggggttctggcttctagcagtattccccacattcatggagctagcaaaggcatatgtctaaccttttactatgtgtgttcactcttaatagttgatacagtttctgaattgtttcctcgttttattctaactggttagctagctcaaggctagagaaggaaatgcaccaagagtgaattatattcagaagttgtgtctcttaagaattaggggacagaacatacaatatttttggatcatttcaagtgcatgctttccatgcatgctcccatcaaaagggataacgagacttgtccacgaggctacgacgcaaaactcggctaaaataaatatggaaatgctgctcatatccaagaacggcctcaggaaagatgcaaagtttttttctgtgtgagctgctaatgctcgaggtattgtctgaaggctacaggcacaataaggtttaccaaaggaattgtaattaggtttcctctgatctagattcagtttcaaattcatgcagcgtgctgtatcaaatgctgcctagatgtaacatcatttttcctcatcatgtatgtgtaagatgctactctttctaacctggtgacatcggcaaagctgctcccc

SEQ ID NO: 6078 - DNA, 579 bp, Oryza sativa
  Predicted polypeptide sequence is orthologous to G1435, G2741
atgacgccggtctcgcaccagctcgtcccgccggcgctcgccgccgccttcgggatcgacctcgcggccgtgggcgtgctcctcccctctccctccgtcgactcccctgtctcccacctcttcttccccgtcgacgaggacgacgacgaggatgaggagggggagggcgaggggggtaacgatgacgcccccgccgccgccgccgcgggcggcggcggcgggaggtgcgggaagaaggcgaggatggtgtggacgcccgagctgcaccaccggttcgtcgaggcggtggcgcacctcggcgagaagggcgccgtgcccaaggccatcgtgcgcctcatgaacgtcgacggcctcacccgcgagaacgtcgccagccacctccagaagtaccgcctctacctcaagcgcacgcgcgtcgccgccacgccgcctccttctccaccaccacctcctcctcctcctccgcccctgccgccggcgatgtacgtcccctgcttcgccgcgaaaccacctctcgacgcagctaaccgcagcgattcccctccttccagaacctcggacgcaacgactaagcagtaa

SEQ ID NO: 6079 - DNA, 1243 bp, Oryza sativa
  Predicted polypeptide sequence is orthologous to G1435, G2741
ccacctcgactcaactcaactcgcacaaatatcttctctcttctcacccaccgcccgattcttcgagtccccgatttggttcggcctgaagaagggtctgggtctctctagagagtgagtagccatcgatttgagatttgattagtaattcggaggaggaggaacgagtggtttttttgatttgatttgatttgattgagaagaaaatccgagtattatgggcgaggaggcgccggaggagtacgagctgggcggcggggaggacgagcgggtgatggagtgggaggcggggctgcccggcgccgacgagctgaccccgctgtcgcagccgctggtgccggcggggctggcggcggcgttccgcatcccgccggagcccgggcgcacgctgctcgacgtgcaccgcgcgtcggcggcgacggtgtcccggctgcggcgcgcgtcgtcgtcgtcgtcgagctcgttcccggcgttcgcgtcgaagggagcgggagcgggagcggacgaggcggagtcagggggaggcgcgaatggggggaacgggaacaccaacaacaacagcagcaagagggcgcggctggtgtggaccccgcagctgcacaagaggttcgtggaggtggtggcgcacctggggatgaagaacgcggtgcccaagacgatcatgcagctgatgaacgtggagggcctcacccgggagaacgtcgccagccacctccagaagtatcgcctctacgtgaagcggatgcagggcctctccaacgagggcccttccccctccgaccacatcttcgcctccacccccgtcccccacgcctccctccacgaccaggttccttctccttaccacccccacccccaccaccactcctacaacaacgccgcctatgccgccaccgtctcctcctaccaccactaccaccacgccaaccactgatccattccttctcatcatcatttcatttccacatctatataccacatactactccataacgaaggtgtttcatcaataagagaagagaagagaagagaatgctccctcaactgtaaactcctaattctaattaagggcaaagtgtatccatccatccatccacgctgtttgtttgtagctgttgttaattgagctggatgcatgacatgtatctctatgtacctacctgcgtgacaaaggcatcatgcatatgtatggttcccttgcaatttggggaatccagaaatgattcatacttgtgattcttgc

SEQ ID NO: 6080 - DNA, 873 bp, Oryza sativa
  Predicted polypeptide sequence is orthologous to G1444
atgaggatcaggaggcggcctcagtccctgcaggctctctcctccctgcatccctcctcagatccatccactgctccccagcctccaccaagaaaccatggacgttactggctctcggtagacaaggtggatgaggaggagaagaagtcggagcggttgcacttgcacccaaatgcggatcttgccgacgacgactcgtcggcggcgatgcgcgcggccgcggcattgccgttgttcccgcaggacaatgcggttgtggaatgcagcaagatcaggccccgtggtggtgcacagcagggagcagcagatggtcacaggagcctagagaatggccattacagcaagcctgatccggcgatcaggagtactacaggagagcgtctcgtcaacggcgtcgtccgggcaatgccagtggccgcgaacgcgaaggaagagaccaagaacgacggcggcggcggcggcggagccaagaagcggcgtggcccggcggtgctgatggaggggtcacgttgcagccgcgtgaacgggcgcgggtggcgctgcagccagccgacgctggtcggctactccctctgcgagcaccacctcggcaagggccggatgcggagcgtcaccggcggccgcggcggcgccggccagctcggccgcaccgagccgaggaagaacaccgccgccgccgctgtcgccgcggcgcccaaggcggcggcggcggtggctgagccgccggtggtggtggtggtgaatcatgaatgtgaattccatgttccgttttctgtgaattgcaaattccatggcgtcttcgtggaagaactggaagatcacactgcagatgatctgctcttgaccagaatttcccgtgatagattccattga

SEQ ID NO: 6081 - DNA, 1566 bp, Oryza sativa
  Predicted polypeptide sequence is orthologous to G1446
ggcacaaagtctgaggcggaactaacccaccaatccgccaccaacccagagcgccgagaagcccaaccgcggcgagcagtgtgccacgggccggcgcgccggcgaactcctcctcctatgctcgccgccggcgatgcccagcccgctgaaggagcgacccgccggccgactcggccgcctcctcgccgcgctccgcccggcgcgcgctggcccgctccccgtccagacaggcttccccacctccctcgctgacctcgtcgtcaagaaccatggccgcctcaagaagccctccgcctcggcgtccaggcgcaagaagcgcggcgggccggaggctcccccctcgccctcgccctcgccctcgccttcccctccgccgcagccttcctcgccaccaccaccaccaccatccccgccgcctgcggccgctgtctcggtctcgccgccaacccagccgagaccgagaccggaacttccgccggtggaggccgtcctccgccgccagcccaagggccgcgtgttcggccttgggctggggttcgtctcgctcgtcggcgtggtgtcgctcgccctcctcgtgatctggagcaagaaggtggtcgcggccgtcaccgtcgcctccttctcgctcttcctgctcgagtccgtcaggtcctccgcgctttcccggcggccgcggcggccggcggcgaacaacaagctggatttggacgggcgcggctacgtctcgccgatccgggaggtggagccggcgagggcaagcttctccgattcctccaggcgaagcgagttatccatcctcaccattgaggagagaagcgaggtaggcgacgattcgatagtcgccattgaggagagaatcgcggcaggcggcgacgactcaagcaacgccaaggtcaagaccaagaaacggtcatggaggaagctgattccccgcaagttacagaagggcatgaagggcaaggaggcggaggattcgtcgggttctttccgcagcagcgaaggcaaccgaggtgacgccacggcgacggattcctcggactctcgccgtggaatgcgcaccaaggccgcggacgccttcgtcgccagatcgatggattcttcgccgtctttccgcgggaacggaggcgacacggacgccgacgcttacagcaatgccacgcgggtagaaatcgacgcgccggccgatgtcctcgccggagacggcgacgccgtgggagggacccggtcctccgtcgcgctcctggtcgttgccgtcgttctcgtaggcctcgtcgccggcaagctcccggccgtcgtgttcaccgtgctttgcggcgtgttcattagctcggttcagagattgccggcgggcggtgacggcaacggcgatcggagctttacatggtggtttaggatcaaacccaaagatgtaaattagtggcagaagaaaggggagagttgagtgacaaaagaaagaagcagcaaatacataaatatttgttcttgttgctcgtgtcgttcgtgctttgcattcattccttactgaatcggaactcgaagtgcaatgttaacttaacaacgttatgt

SEQ ID NO: 6082 - DNA, 998 bp, Oryza sativa
  Predicted polypeptide sequence is orthologous to G1449
ggtggattgcagaagatgatgctgcagtgatcccgtccactagctggtgaattggagagacggatggagctcgagctcggcctcaggctcgcgctgccgtcgccgtcgccgtcgccggcgacggcgacggcggctgggagtgagcttgaccttctcaacagcgcgccggggtcctgccgcaagaggggcttcgaggaggcgctcggtgggttcaaaaccgacgacgacaacgacgacggcaatggccgcggcggtgacggcgattccgacggcgaaatgggcaacaagaggaggaagctggtggggtggccaccggtgaagtgcttgcaccggcggcgcgacggtggctgcggtggcggatatgtgaaggtgaagatggaggggttggccatcgggaggaagctggacttgtccatcctcggctcatacgctgagctgctcgacacgctccaccttatgttcccctccactaaccaagaggatgggcacgatcgtcgtcgacgtcacccatacgctgtcacctacgaggatggggaaggagactggatgcaggtcggagacgtgccatgggaggcctttgccaagtcggtgaaacggctcaagatactggtgtaactgactgcaaattaagctactagtactagtctttactacttcgaataaaattgtacgtgaacgggattattttgttcacgtttctctcatcataaatgtgtagtgtttcagcaatttcataagcatgacgaatgaaatctcgtagctgttgtcatcaatcaccttgcatttcgtgtcaaactacatctgtggccagcgcacagtagtgttagtatagtgtacaccgtagagtcacctcgctgtgatcagcacgtgcatgcatctgtataatacaccgccacatatgcacaggatggtactgaatactgagcatatcctgtacggggagttcagatatgggtgttatggcctaccaaagtgaatcttatcacatttttttaatc

SEQ ID NO: 6083 - DNA, 3731 bp, Oryza sativa
  Predicted polypeptide sequence is orthologous to G1451
gaggaagctgcaagaggaactgaggaaggaagcaagaaagcaaaccaaaccaaaccaaaccaagaagcaaatctcagttgcaactcttgagctcagaagaagttgcaacagaagaaggagggagaagggaagcatctcagctagctaggcaggaagcatgctcctagcctccctctccggctgcggcggcggcggcggcggtcggatctgccggagagcggcggccggggagcccagagctgagagctaaccgtgcagacctcgcggccgcgagatctgaccacgcgactcctcggatcaagcggtgtcgcctcccgcagcagcatttccccccccccccccccccccgaagatcacagcctttttttccactggttcttgctggtcttggaagtggggaaaaaaaattctcatcacctcgtcgatggagaagcttacgacgcttgctcggtagatttgatttttctttttcttcttcttccgggggaagcgtaattgcgaaacagcgaaagaagaagtgttggtgagttggcgaaactgagaaagcgatggtttttgggaaggcgctgtgatttggcctaaaaaggaggaatctttccttcgttctctccttccttccccagcttcgtgcacgctcttatattgcatttcagatcggtcttgtgattggtcttttggagagagagagagagagagaagaaaaatgaggctttcgtcgtcgtccggcagcgtcctcccggctcaggcggcgtcgccggaagctgtagaagaacaaaatgcctgaattcggagctctggcatgcgtgtgccggtccccttgtttcgttgcctgcagtgggtagccgagtggtttatttcccacagggtcacagcgaacaggtagctgcatcaacaaataaagaaatggagtctcagatccccaattatcctaacttgcctccacaacttatttgccaacttcacaatgtgacgatgcatgcagatgcagaaacagatgaggtttacgctcagatgacgctacaaccacttagcccgcaagagctcaaggacccatatctaccagctgaattaggttctgccaacaaacagccaacgaattatttttgcaaaacattaacggcaagtgacacaagtacgcatggcggattctctgttccccgtcgagcagctgagaaagtgttccctccgctggattttactcagcagcctccagcacaggagttaattgcaaaagatcttcatggcaatgagtggaagtttcgtcatatctttcgtggtcagccaaagcgacaccttctaactacaggctggagcgtctttgtaagtgcaaagagacttgtcgccggggattctgtcctatttatctggaatgacaacaaccagcttcttctgggaattcgtcgagctaaccgcccacaaactgttatgccatcttcagtcctatctagtgatagcatgcatattggtcttcttgctgcggctgctcatgctgcttcaacaaatagccggtttacaattttttataacccaagagcaagcccttcagagtttgttatcccactttctaaatatgttaaggctgtatatcatacccgtatatctgtgggcatgcgtttcaggatgctttttgagacagaagagtcaagtgtacggagatacatgggcacgataacaggaattagtgatcttgatgctgctcgttggccaaactcacattggcgttctgtaaaggttggctgggatgaatcaactgccggagagaggcagccaagggtgtcgctttgggagattgagcccttgacaactttcccaatgtacccatctccttttccactcagactgaagcgtccatggccaacaggcttgccttcattacatggtggtaaggatgacgacttgacttcttctctcatgtggctccgagacagcgcaaatcctggtttccaatcattgaatttcgggggtctcggtatgaatccttggatgcagccaaggtttgatgcttccttacttggtctgcaacctgacatgtatcaaacgatagctgcgactgctttccaggacccaacaaagcaggtctctcccacgatattgcagttccagcagccgcagaacataggtggcagagctaatacacttctgccaagtcagattttgcagcaagtgcagcctcagtttcagcagcagcaatacctccaaaacatcaacgagaccacaatccaagggcatgctcagtctgagttccttcagcagcagctccaacgctgccagtcgtttactgagcagaagccacagctgcaaacccagcaacaacagcaagaatcacagcaacaacagcagcagcaatcgcagtgtatgcaagtcccacaacatcagcaaatgcaacagcagaagaacatgaccaactatcagtctgtacctaatgcattgtcaccgttttctcaactctcctctccttctcagtcttcacctatgacactgcaaacagtattaccattctcccagccacagagctatccagacacgagtatgagctcattatcaccatccaacacatccaccatgcataatgcattgaggccattttcatcggaagcaccttcgcacctaagcatgccaagaccgactgcagtacctgtccctgacccatggtcatcgaagcgagttgcagtggagtctttgcttccctctcgtcctcaggttacatcgcagatggagcagttggactcaacagcacctagtataccacaaagctctgcgttggcgccgcttcctggaagaggatgcttggtggatcaagatgggaactctgatcctcaaaaccatctgttatttggcgttaacatagattcacagtcacttctaatgcaaggtggcatcccaagcctccagggtgagaatgattcgacggcaattccttattccacctccaatttcctgagcccgtcgcagaatgatttccccttggatcaaacactaagtagtgcagactgcttagatgaatcaggatatgtgccgtgttcacagaattctgatcaagtgattaatcgaccacctgcgacctttgtgaaggtttacaaatcgggaacctatggaaggtcacttgatatcactagatttagtagctatcatgaacttcgtagagaactagggcgcctatttggccttgagggccagttggaaaaccctttgagatcaggctggcagcttgtattcgtcgaccgagaggatgatgtcctcctcgttggcgacgacccttggcaggaattcgtgaatagcgtctcctgcataaagatactttcaccacaggaggtgcagcagatgggcaagccctttgagcttttgagctcggctcccggaaagaggctaggtagcagctgtgatgactatgtgagcaggcaggaatcaagaagcctgagcacaggaattgcatctgtcggctcagttgaattctgaagcaagggcgctaacgagcccttcaatcaaatctagcctgttacctatgtttctgcagtttttcttcccctagttttgagacctggaactgaaagaacatagatccatgcttagctaagttatgtaccatctaataattatgctatatgatatcaaattccaagtagaaactatcaacttttggtatatatatatataccaaaactttgttccatgaaacactaatcctgtgaatgtaggccatctaaattatcaggctcaccgcgaagtttagc

SEQ ID NO: 6084 - DNA, 3262 bp, Oryza sativa
  Predicted polypeptide sequence is orthologous to G1451
gtcgctactgtacggccccctgcgctgcgccccccctcgtcgcgcacacgcacacacgcactcgcactactcgaaccacgcgaacccctctctttctctctctctctctctctcgcttaaatgccacaaacctaatcatttccacccctcttgcgctctctctctctctctccaaccccaccctttctccccaccatggtggcgatctccgagctcgggtgagcggaagggaaagaatgcggccgatttgaggagggggatggggttttcgggtggatttgtgaggggatagattaagagtttgtgcttctctggtttggtcggaggaggaggagatgagctcgtcgtcggcggccagcatcgggccgccgcagccgccgccgccccccgcgccgcccgaggaagagaagaagtgcctcaactcggagctatggcacgcctgcgccggcccgctcgtctgcctccccaccgtcggcacgcgcgtcgtctacttcccgcaaggccacagcgagcaggtggcggcgtcgacgaacaaggaggtggagggtcacatcccgaactaccccaacctgccggcgcagctgatctgccagctccacgatgtcacaatgcatgcggatgtggagactgacgaggtgtacgcgcagatgacgctccagccactgaacccacaggagcagaacgatgcgtaccttcccgcggagatggggataatgagcaagcagccgacgaattacttctgcaagacattgacggcgagcgacaccagcacgcacggggggttctccgtgccccgccgtgctgctgagcgcgtcttccctcctttggatttcacacagcagcctccagcccaggagctaattgcacgggatattcatgacatcgagtggaagttcaggcacatctttcgaggccaacccaaacgacacctgctaaccactggctggagcgtttttgtcagtgctaagagacttgttgctggagattctgtgcttttcatatggaacgagaaaaaccagcttttacttggaataagacgtgccagtcggccacagactgtgatgccttcctctgttctttcaagcgatagcatgcacataggtctccttgcagcagcagctcatgctgctgctacaaacagccgtttcactattttctacaacccccgggcaagtccatcagaatttgtcataccactgtcaaaatacatcaaggctgtttttcacacccggatatcggttgggatgcggttcaggatgttgtttgagactgaggaatcaagcgttcgcaggtatatggggactataactgaagttagtgatgcagacccagtccgttggcctagttcctattggagatctgtgaaggttggttgggatgaatcaactgcaggggaaagaccaccaagagtttctttatgggaaattgaaccattgacaacctttccaatgtatccatctctgttcccactgagagttaagcatccttggtattcaggagttgcttccctgcatgatgacagcaatgctttaatgtggctgagaggagttgctggtgagggaggttttcagtctctgaactttcagtcacctggtattggctcctggggacaacagaggctccatccatccttactgagcagcgatcacgatcagtaccaagcagtagttgctgctgctgctgcttcccaatctggtggttacttaaaacagcaactcttgcaccttcagcaacctatgcagtcccctcaagaacactgcaacctcaacccattattgcagcaacaaattctgcagcaagcaagccagcaacagataattaatcctgatgcccaaaatatccaaacgatgttgagcccaagtgctatacaacagcaactccagcaactacagcaaatgcagcaagttcagaatgatcagaagcagaagattcaaccagatcaaagctaccaagttcctacaagtgcagttctcccaagtccaacatcattaccgagtcatttgcgagaaaaatttggcttctctgatcctaatgcgaattcttcaagcttcatcacctctagcagtagtgataacatgttggattcgagcttccttcagggaagttcgaaagctgtggacttatctcgatttaatcagcctgtagctagtgagcagcagcagcagcagcaacaggcatggaagcagaagtttatgggttcacagtcagtgtcttttgggggctcggttttgcataactcacccacaagcaaagatggttctgttgaaaacaaaattggtcgtgatgtgcaaaaccagtccctttttagtccacaagttgactcttcatccctcctgtacaacatggttcctaatctgacttcgaatgtttcggatggcaacttatcaacgatcccttctggatcaacttatctgcagaatgcaatgtatggttgcttggacgactcttctggtttattgcaaaatacaggagagaacgatccagcaaccagaacatttgtgaaggtttacaagtcaggttcggttgggaggtcgttggacataacccggttctctaattatgctgaacttcgagaagaactgggtcagatgttcggcattaagggtcaattggacgaccctgatagatcaggctggcagcttgtattcgtcgacagggagaatgatgtgcttctccttggagacgacccttgggagtcctttgtgaatagtgtatggtacatcaagatactttcacctgaggatgtgcataagatgggaaagcaaggaaatgatccacggtatctgtcctgaagtgagagaacatggtgccatttctgggcttccaggaggattctgcagtgcatggtggcactcttgctctcgacaatgcacgtcgtcagaagtcccaaatttgtatcttgcatgtacgccgtacatgtttccagaactctctgttacctattcggtgcaggccaccggaaccacgaaacctgatattttgtaggttccacttaggaatcagtatcggtttaactcttatcctagatgatttgtaactcgcacggcagtccactgttttcatgtttcatcgagtcttcctagacattaaacttagttgatattgtatcaggatttatgtgtattgagattcctctacatgctttcaaccaaaaaaaactgcaataatcgaagcgcacgaggattgtttcaattcgtgttgtaggatctggattttcaccgattgtccggttatgtcagtttcgagaggagctgtcaatctg

SEQ ID NO: 6085 - DNA, 3885 bp, Oryza sativa
  Predicted polypeptide sequence is orthologous to G1451
gagctcacctccactcgtggggttaaaaccccgagaactgcacagcagcagcagcacacggcgcagcagcggcaaaggcggcagcagcagcagcagcaagaaccgagcaaagtcgcaagaagcgagcacacacactcctctctctctctccctctctagctactgttgttcttggagttgtagaggaggaggaggtggtggtggaggtggtggagatagggggaggatgctgatgctcctagtcctatcctagttcgtcgtcaactccggcggcggatctgcggtggagcggcggctggattgtcgagcggtgagggtgacacgcatctccggagctcgccgcaggcgggagggatctgaggcgcgtttcttaatttgccttctctttgagctagctgcaaaggcggcggcgtgcggcggcggcggcgtcttggcgcgcgcattctatccggcgagtcgacgacgacgacgaccttcgcgccggtgtagcggcgcccgtgatgtgaaggaattcgagctcgctcccttgggatcgaaaaggttgcgggttggagaggcaagaaggtttggccggtttggggaaggagagaaagcgatggtggtggtggtggtggtggtggctgggttgcttgctccatgacacgacagcgcgtttgggaacgcctcgtgatctcggtgcagaaaggattccttctctgctccatttcttgcactctccactttgcattctagatcggttgggggaagaagaagaagagaagaagaagaatgaagctctcgccgtcggccggcggcgtctccgaccagccgccgtcgccgccggaagttgcagaggagcagaagtgcctaaattctgagttgtggcatgcatgcgccggccctctcgtttcgctgcctgcggtcggtagtcgggtggtttattttcctcaaggccacagtgagcaggtagctgcatcaacaaataaggaaatggagtctcagatccccaactatcctaacctgccgccgcagcttatatgccagctacataatgtgaccatgcacgccgatgcagagacggatgaagtctatgcgcaaatgacgctgcagccactcagcccgcaagagctcaaggatccattcctacccgccgagctaggcactgccagcaagcagccaacaaattatttctgcaaaacgttaactgctagtgacacaagtacacatggtggattctctgttccccgtcgagcagcagagaaagtatttcctccgctggatttcactcagcagcctccagctcaagagttgatggcgaaagacctccatggaaatgaatggaaattccgtcatatctttcgtggccaaccgaagcggcatcttctgactacgggttggagcgtctttgtaagtgcaaagagactggttgctggagactctgtcctttttatctggaatgacagtaatcagctgcttctgggaattcgtcgggcaaataggccacaaacggtcatgccatcatcagtattgtctagtgacagcatgcatattggtctgcttgctgcagctgctcacgccgcatcaacaaatagccggtttactattttctataatccaagagcaagcccttcggagtttgttataccactggctaaatatgtaaaggctgtctaccatacccgcatatcggtgggcatgcgtttccggatgctttttgaaacagaagaatccagtgttaggagatacatggggacaataacaggaataagtgatcttgatcctgttcgttggatgaactcacactggcgctctgtcaaggttggatgggatgagtcgactgctggagagagacagccaagggtgtctctttgggagatcgagcctctgacaactttcccgatgtatccatctccttttcctctcagactaaagcgtccatggccaacaggcttaccttctttatatggcggaaaggaggatgacttggcttcttctcttatgtggcttcgagatagtcaaaacacaggtttccaatctctgaattttggaggacttggtatgagtccgtggatgcagccaaggctggatagttccctacttggtctgcaacctgacatgtaccaaacgatagcggcggcggcggctttacagaacaccactaagcaagtatcacctgccatgctgcagttccagcagccgcaaaacattgtcggtagatcttctcttctatccagtcagattctgcagcaagcacagcctcaatttcagcagatgtaccaccaaaacatcaatggcaactcaatccaaggccatagtcagcctgagtacctccagcaaccgcttcaacattgccaatcatttaacgaacagaagcctcagttgcagccgcagcaacagcagcaagaatcacaccagcagcaacctcagcatcaacaaatgcaacaacagaaacacttgtccaactttcagactgtaccaaatgcattgtcggttttttcacagctttcctccacccctcagtctacaccctccacattgcagacagtttcaccattctcacagcaacataatttccctgacacaaatatcagttgtctctctccatccaatgtctcatccatgcacgatacactgagatcattcccttcagaagctgcttcagacctcccaggtgtgccaagaatcacccctgtacctgtctctgacccatggtcatctaagcgagttgcagtggaatctacgatcacttctcgcccacatgacatttcatcacagatagagaacttcgacttgacaccttctagtattcctcaaaactccacgttagcaccactgcctggaagggaatgcctggtggatcaagatgggagctctgatcctcaaaatcacttcttgtttggtgtaaatatagactcacagtcacttttgatgcaagatggcattccaagccttcacaatgaaaacagttcaagcacaattccatattccacatccaacttccttagcccttctcaagatgattatccattgagtcaaacactaactactccgggctgcttagatgaatcaggatatgttccatgttcagataatgctgatcaagtgaagcgaccgcatgcaacctttgtgaaggtttacaaatctggaaccgttggaaggttgctcgacatcactagatttagcagttatcatgaacttcgtagtgaggtagggcgcctttttggccttgagggccagttggaagaccctttgagatcaggctggcagcttgtatttgttgaccgagaggacgacgttcttctagttggcgatgatccgtggcaggaatttgtgaacagtgtgtcttgcataaagatactttcgccgcaggaggttcagcagatgggcaagccgggcattgaactcttctcgacttctgcaaggagacttggcaacagctgtgacaactacatgagcaggcaggaatcaagaagcctaagcactggaatcgcgtcggtgggctcagttgagttctgagaaatagggagctcatagcacccggcgttaggcgtccagttctgtacgtctctgtagctcttagttctgtgacctggaacccaagcacataggtcaagtgtagctctaagttatgcgctgtctggtaattatgtcatattacattgacttttagtggtacctattacattttggtatacatgccgacactttgtttcctggaatactgatcatgttaacttagggcatctaattattaggttcatgttgagtagtgctgtagtgccgcaggcgctagctttggccatattctgtatattgatgatgttttcctcctgcaatgtactgttaatgacagcaagtaaggttttccatgcaactgtgaaaattcagttcaagaactattgagct

SEQ ID NO: 6086 - DNA, 3878 bp, Oryza sativa
  Predicted polypeptide sequence is orthologous to G1451
ggaagaaaaaaaaaactcgaccaccacctccaccactcacacctcgatccggccatggcggcctagccctagcacctagggttcgcgcccccaccaccctccccgccgtctcggaggccgcgcgcccccagctcccgcctcgctgtcgcgccgcctgattccgccgccggcgccgaatgctacgccgtttggtggtggtggtggtcgtcgtcgcctgattccgcgatctcgtgagctccggggggtgcgcggttgcggcggcggcgcctgagaggaaggctggactcgtccgcggcggcggcggctgcgggctagtgtcggtggcgatttgagggcggcggtttgggttagccgtcgccgagagtgaaggtgctgtgttttgagtgcttgggatgagctgcgtgttgatctgatgaactcggggtcggcggcgttcttcggtttctccgctcacttgctcccgccgttggcgaaaatccggttcttcggatcgagttgcggtcgcctgggtgtttttcatcagttttgggtgaaaatactcgagctctgaggggggtgattggtttccaagtttgattgatttaaagagtttgtgtggaattttttcggggagatgaaggggaggatttgctgcgacggtccaggttttggttagttgttgagggagaaaaaaatggaagatatttctgggcgcaagagaggaaggcaggtgtttgctgctgctgctgggagcatgatgggaagctgaccagcagcttctccagtatcctggtgcggcggagtttcgtgctctttggcgacgggtgcactggtgattggagatgaagctctctccgccggcgtcggcggatatgccgcaggccttgccggagaacgacggggaacaaagatgtctgaactcggagctgtggcatgcatgcgctgggccccttgtgtctttgccagtggtcaggagcagggtcgtctactttccacagggccatagcgagcaggttgcggcatcaactaataaggaagttgatgctcaaatcccaaattatccaaacttacctcctcagttaatctgccagcttcataatgtcaccatgcatgctgatgcagagacagatgaagtctatgctcagatgacattgcaaccattgagcccggaagagcaaaaggagcctttccttccaatggagttgggtgctgctagcaagcaacccactaattacttctgcaagacattgactgcaagtgacacgagcactcatggtggtttctctgttccccgccgggcagctgagaaagtcttccctccactagatttttcacagcagccttcggcacaggagctgattgcaagagatttgcatgataatgaatggaaatttcgccatatatttcgtggtcagcctaaaaggcatctcctgacaacaggctggagtgtgtttgtgagtgcgaaaagactagtagcaggagactctgttatatttatctggaatgataacaatcaacttcttttgggaatacgtcgtgcaaatcgccaacagactgttatgccctcttccgtgttgtcaagcgatagcatgcatataggtcttcttgcagcagcagctcatgctgcagccacaaatagtcgcttcactattttctataaccccagggctagcccttctgaatttgtgattccattggccaagtatgtgaaagctgtttaccacacacgtgtatctgttggaatgcgttttagaatgcttttcgagacagaggagtcaagtgtcaggcgatacatgggtacaatcaccagcataagtgatctagattcagtgcgctggccaaactcacactggcgttctgttaaggttggttgggatgagtccaccactggtgataaacagccaagggtttctctttgggagattgagcctttgacaacctttccgatgtaccccagtgcttttcctttaagacttaagcgtccgtgggcttcaggactgcctatgcatggcatgttcaatggtgggggaaatgacgattttgcacgctattcttctctcatgtggcttcgagacggaaatagaggaacccagtccctgaattttcaaggacatggagtctcaccatggcttcagccaagaatagattctccattgctgggccttaagccagacacgtaccagcaaatggctgcagcagcactggaagaaattcgatatggggacccttcaaagcagcatccagctactctgcaataccaacagactcataatctgaacagtggattaaattctctgtttgcaagccatgttctagggcaggtgcagtttcaacctcagcagtcacccctgcaagttgttcagcaaggccattgtcagaacactggtgactctgggttccttcaaggtcagcttccacggctgcagttgcataacactcagcagctgctaaaggagcaagagttgcagcagcagcaaagacagcatgttttacaagagcaatctagtcaagagatgcaacagcagctcccatctagtgatcatcatgttgctgatgtagcttctgagtctggatctgctcctcaggcacaatcatcattgcttagtggatcatcattctacaatcagaacctcttagaaggaaatagtgatccccctttacatctacacaacaatttccacaacttctctaaccaggaagcctcaaaccttcttattttgcctcgaagtagccaattaatggcatcagatgggtggccttcaaagcgattaactttagaatctgctgttcatcctgaagctccgtccatgcaccccaagattgagaaagtaaatcaccagggtatatctcattttcctggcgcctttccaccacaatcagcaagaggctgttccatcgtccaggattgcagggcagatgctgagaaccgcctactttcatcatcatttgaactccaggatggcatgacaagcatcataactgatgctaacagagaaactgatactatggccatacctttgttgagatatagtggtgcagatttgacaactgaaaacaccttagcaacctccaattgtttaggtgaatctggaacgttcaatcctcttaataacatatctgtaaatccatcacaaggagcaacctttgtgaaggtttacaaattagggtcccttgggagatcacttgacatctccagattcagcagctactgcgagttacgtagtgagcttgagcgtctctttggtcttgaaggccaactggaggaccctgtaagatcaggctggcagcttgtatttgtcgaccgggaaaatgacattcttctcgtcggcgacgatccatggcaggagtttgcaaatagcgtatggtgcatcaaaatactctcgccacaggaggtgcagcagttggttcgtggtggagacggccttctgtcctcacctggagcaaggatgcagcagagcaatgcctgcgacgactattctgcaagccacaacatgcagaatatcgccggaaacattgcatctgtagcgcctctggactactgagatgtagaccagaatccaaactaagcacccttaagactgcagggtcaccattcgtgatcgcctgcattccatgcgatcttcactagtcctgtccgaatcagtagcaactcagtcaataatatagctagatgatccgttgtattccatctgatcatggacatgctgtatgatagctgctttagctctattaaatctctaatggcaggcaactaggcaagaacagttctatgatgaatgatggcagtcgctgtagaattgaccttattctgtagctataatatgatgtctagaactgatgattccaatttccaaatggagcccggaacatattaaaatcaatcatttgtcgccttcttc

SEQ ID NO: 6087 - DNA, 2145 bp, Oryza sativa
  Predicted polypeptide sequence is orthologous to G1468
gaggttcaggagaactcgcggcattgctgcgatcgtgagttcgtgacaccggacggaggcgcgcacttgatcggcgctcccatctccaggtcgaattcgattccgccgcggcgaaccaagcgcatgcatgtgtgaatcttcaccgtctttgcatcatggccagatgcagccgtcgccgtcatcacctcgggcaccgccgccgacggcggcgcaggcgtcggggtacaagcacttctgcagagtctgcaacaaggggttcacgtgcggaagcgccctaggcgggcacatgagggcccacggcgtcggcgacggcgatgggttgggtgccgatgatgacgacgacgacgacgacgattcgctcggcgatgaggccgtgcggcgtgcgcgcggcggggcagatgatccttggaacgcgggcggcccgtcgtcgtcaggggcagcgacacacgtctacgagctccgcaccaatcctaaccgggtcacgaggagccgccaggtgtgcaagaactgcgggaaggagttcacgtcgtgggagcatttcctcgagcacggcaagtgcagctccggcgaggacgacgacgacgaggacgacgtggatcactcgctgcaaccgtggtcgccttcgcccgaggccgacggcgaagaggattctgcaccggccgccggttggttgaaagggaagcgctcgcgtcgctgcaagggcacaggagtcgatttgtcaccgacaccctcagcgtgcgctgccggcgaggaggaggacctggccaattgcctggtcatgctctcgtcgtccaaggtagatcaggcaggcgtcactgaagcagaacaacggtcatcttcttccgcgagtaaggaacataagagactgatcacgttcatggagccgacgacgtatgtactggatacagtgatggcgcttcccccgccggcgccggcgccacagtatgtctcgaccgtgcctcgaggcatgttcgagtgcaaggcgtgcaagaaggttttctcttctcaccaagctctcggcgggcaccgtgccagccacaagaaggtgaagggctgcttcgctgccaagctggagagcaacgccgcagaggtggctgagccatcacaccatgcagaggtcgctgatcggagcgaggacaatcccgccaaggccacttctgatgccaggaggaacgtgcacgcaagcatcgacggtgatggaaacgccggcacgagcgatgccgcggcagaactgtcgatggccatcgtgcccatagaaccgccggtcgccgcgctcgccgctgcaccgttgaagaagaagggcaagatgcacgaatgctcggtttgccatcgactgttcacctccgggcaggcgcttggaggccacaaacggtgccactggctgacgtcaagttcggcggatcacaccgcctcagtcccacccctagccgacgaccttgtcccgctctcgttccggccaatgttggacgcaccggagcccgctctcgacctcagcatcgcggcgaacccgccactgctggcctcggccgcaacagtccgtccgaaggtcggcggcagctcgtttcatctcgacgcgccaccaccggtatacatcccatcgtcgccggcgatacccagccaacggaacaaggctaccgcgacaaccggcagccagaacgccaacgacgcggtcgggttaagcaccgccgcagcagaggacgaggcggacagcaccaccgtcaagagagcgaggcttagcgatctcaaggacgtgagcatggcaggggagacgacaccgtggctgcaagtcggcattggctcctcgtctcgcgggggtgctgatgataacgacaaggagtgattgatctgcgaattgatcagtacatacatatatactgttacattatttccatgcgtttgcaattgcatatatgttgttcgcatgagcatataagtatttgccttcttttttgtgactttttcttttcttttagacttgtaggtttttttttcttctcaagatagtgagtatgttttacaaagaggtaacatatgaatttgggaagaggcagtagacttgtaggatttttttttcttctgaagagaagcaagtagtgagtattttttcacaagaggtaatgtattaatctgtcaagctgcgtgatc

SEQ ID NO: 6088 - DNA, 1701 bp, Oryza sativa
  Predicted polypeptide sequence is orthologous to G1468
atgtgtgaatcttcaccgtctttgatgcagccgtcgccgtcatcacctcgggcaccgccgccgacggcggcgcaggcgtcggggtacaagcacttctgcagagtctgcaacaaggggttcacgtgcggaagcgccctaggcgggcacatgagggcccacggcgtcggcgacggcgatgggttgggtgccgatgatgacgacgacgacgacgacgattcgctcggcgatgaggccgtgcggcgtgcgcgcggcggggcagatgatccttggaacgcgggcggcccgtcgtcgtcaggggcagcgacacacgtctacgagctccgcaccaatcctaaccgggtcacgaggagccgccaggtgtgcaagaactgcgggaaggagttcacgtcgtgggagcatttcctcgagcacggcaagtgcagctccggcgaggacgacgacgacgaggacgacgtggatcactcgctgcaaccgtggtcgccttcgcccgaggccgacggcgaagaggattctgcaccggccgccggttggttgaaagggaagcgctcgcgtcgctgcaagggcacaggagtcgatttgtcaccgacaccctcagcgtgcgctgccggcgaggaggaggacctggccaattgcctggtcatgctctcgtcgtccaaggtagatcaggcaggcgtcactgaagcagaacaacggtcatcttcttccgcgagtaaggaacataagagactgatcacgttcatggagccgacgacgtatgtactggatacagtgatggcgcttcccccgccggcgccggcgccacagtatgtctcgaccgtgcctcgaggcatgttcgagtgcaaggcgtgcaagaaggttttctcttctcaccaagctctcggcgggcaccgtgccagccacaagaaggtgaagggctgcttcgctgccaagctggagagcaacgccgcagaggtggctgagccatcacaccatgcagaggtcgctgatcggagcgaggacaatcccgccaaggccacttctgatgccaggaggaacgtgcacgcaagcatcgacggtgatggaaacgccggcacgagcgatgccgcggcagaactgtcgatggccatcgtgcccatagaaccgccggtcgccgcgctcgccgctgcaccgttgaagaagaagggcaagatgcacgaatgctcggtctgccatcgactggtcacctccgggcaggcgcttggaggccacaaacggtgccactggctgacgtcaagttcggcggatcacaccgcctcagtcccacccctagccgacgaccttgtcccgctctcgttccggccaatgttggacgcaccggagcccgctctcgacctcagcatcgcggcgaacccgccactgctggcctcggccgcaacagtccgtccgaaggtcggcggcagctcgtttcatctcgacgcgccaccaccggtatacatcccatcgtcgccggcgatacccagccaacggaacaaggctaccgcgacaaccggcagccagaacgccaacgacgcggtcgggttaagcaccgccgcagcagaggacgaggcggacagcaccaccgtcaagagagcgaggcttagcgatctcaaggacgtgagcatggcaggggagacgacaccgtggctgcaagtcggcattggctcctcgtctcgcgggggtgctgatgataacgacaaggagtga

SEQ ID NO: 6089 - DNA, 312 bp, Oryza sativa
  Predicted polypeptide sequence is orthologous to G1476
atggacggcgagggggcgccggcgaggcgggcgccggcggcgtcctactacgagtgcaccttctgcaagaggggcttcaccaacgcgcaggcgctcgggggccacatgaacatccaccgcaaggaccggagcgccggcggcaagtcgcagggcggcggccagcaccacgaaggcggcggcagcggcagcggtggcggcggcggccagcagcacggcagagatgtccacctgggcctcaccctggggaggaacgaggaagagagggacggcgtcgacctggagctcaggcttggccatgcccactatccttga

SEQ ID NO: 6090 - DNA, 724 bp, Oryza sativa
  misc_feature (620)..(620): n is a, c, g, or t
  Predicted polypeptide sequence is orthologous to G1480
gatgaataataccatatagttgtgatttattcgttggggggagctaatacaatatagatgatcttgctgatcaaaaaaataattaccactaagtagtaagcacgtaattagtagcagtagtagtgtacaaaactagcgtgagctagctcaaaatgagtactacatgggattactacgcccctacacatcgatcgatcgatttgatacaagattacaagcgacggcgcggcggcggtggccggcggcgggcggcgatcagaaggacgggacgacgccgtagccgaagtcgagcatgtaggaggatgggacggcggcggggtcgtcggcgtcggcgtcggcgtcgtcggcgtcgtggtcggcgcgcttggcgaagcggcccttgatccgggggcgcgtctcggcgtaggccttgcgcgacgcgtaccggatcgtcttctcgaaccgccggttcttccgcttctccctgtacctcatcagcctcgcctccctcccttcccccatcgccgccgcccgctccggcaccacgcccacgtcgaccaccgacgacgacatctgcgcgcttactacgctgtggctcggaggaggagtcgccgtgtacggcatgtagggttgaggcttcngcctcgtgaagtcgagcttcatgtccttcgcctccacgttgaggttgagcgcgccgtgctgctgccgctgctggtgggggtggtgctcggccgcggccttatcc

SEQ ID NO: 6091 - DNA, 1025 bp, Oryza sativa
  Predicted polypeptide sequence is orthologous to G1480
acaaacacacacaatttagcttagcttaagccacttgatctcaagctcaagcttaaaattagcttaagattaagccattaattagccaagctaactaagcaagcaagatcttgttgaggagatgatggcaagcgacggcagcgcgagcccggccagctgcggcggcgcggcgtgcggggtgtgcggcggcgcggcgacggtgtactgcgcggcggacgcggcggcgctctgcgtgccgtgcgacgccgcggtgcacgcggccaacccgctggcgtcgcgccacgaccgcgtgccgctcgcggtcgccatggcggcggcgagctccggggtgtacgaccacctgttcgcgcccgacgacgacgccgcctcgtcatgggctgccgccgcggcggcgggggcggcggtgcaggggcaggggcaggggagccccaacgacagctcgtcgagcttcaccaacgacagcgccgccgcctcctcgtcatcggacgacgacagcacggccgccgccggagtcagcggcgccggcggcgccggcgccgccgccacgaaggaggccaagttctggctctccttctccgacgacggccgcgccgacggcgtagggttctacatggacagcaccaccgctgccaccgcggcctacggcgtcgtgccaaccttctagaaagttccagaaacccctctcccaatgggcgccaacgcggcaacggcaatggcgttggcccgtcttaagacaaacattaagaaaagggcaacatgtcataatctcgccgtcatgctaatggtggcgcatggtgttcatgtcgtcgtcttcttcgccgtcgctttctgattccgtggtggaaacccgcatcactatttttaactgctgatgcgggttttcggtgggtggaattccaaattccatcggttaaaattagggggattattattaatgcattgtgacttttgtaagataactcatgtagttaatttctatggttcagtgctgaaataataaaaaaaatccaatgtgatttttctct

SEQ ID NO: 6092 - DNA, 1370 bp, Oryza sativa
  Predicted polypeptide sequence is orthologous to G1480
gcggcgcgtgcgcggtggcgccggcggcggtgcactgccggacgtgcgacggcgacggcggcggaggtgggtatctgtgcgcggggtgcgacgcggagcatgggagggcggggcacgagagggtgtgggtgtgcgaggtgtgcgagctcgcgccggcggcggtcacctgcaaggccgacgcggcggcgctgtgcgccgcctgcgactccgacatccacgacgccaacccgctggcccgccgccacgagcgcgtccccgtgcatccgatcgggtcatccgccgccccgccgccggacgcgctcctgctcggcggggagaacgacgccgctgccgccgtcgacggcggcggcggcggcaaggaggtgaagctggacttcctgttcgccgacttcatggacccgtacctcggcggctcccccgagctcgcgcgcttccctcacgccgacagcgtggtgcccaaccacaacggatcggccggtcccgcgatggagctgggcttcgccggtggcggcggcgccgccgtcaaaccgtcgtacagctcctacacggcggcttccctcggcaacagcggctcgtcgtcggaggtcgggctggtgccggacgccatctgcggcggcggcggcggcggaatcatcgagctcgacttcgcgcagtccaaggcggcctacctgccatacgcctcgacccctagccatagcatgtcctcgtcgatggatatgggcgtggcggcgccggagatgagcgactgcgcggcggcggcggccgggagggcgtacgcggcggaggggagagcggcgcggctgatgcgataccgggagaagcgcaagaaccggcggttcgagaagacgatccggtacgcgtcgcgcaaggcctacgccgagacgcgcccccgcgtcaagggccgcttcgccaagcgcgccgacgaccacgacgccgccgcgccgccgccgcagatcatgctcgacttcgccggctacggcgtcgtgcctaccttctagtgttctagctcatcgatctgaacgttttttgagctggcaaattgatcaagctggcgttgcatacgtacaacgtagtacttcaattcaccatgcataggattagccaaagttctagttgatcacaattcacaaacttgaaagttttttttacctagcctgattgagttttaggctagtttctgcaatcgtgtttgctagaacggctataactagttgtagttaatctggattttctgtatgtatggtgttttgtagtaccgatctgatgatgatgatgaagaaaaatatttgggcaaaatcgatcgatctcatccagtttctaattaacatgcatgcgatcgatcgattgcgcgcgagatctggattgagatt

SEQ ID NO: 6093 - DNA, 1388 bp, Oryza sativa
  Predicted polypeptide sequence is orthologous to G1480
gtgcccaacgcccaaaaaacacagccaaactccgcgagaaaccgagctgcgagcgagtgaaacgcaccacgcgccgagcggcaaagcgaagcgaagaagaaatggaggcggtggaggacaaggcgatggtgggagtgggaggagcggtggcggcggggtactcctcgtcgtcgtggaggttggggacgcgggcgtgcgactcgtgcggcggggaggcggcgcggctctactgccgcgcggacggggcgttcctgtgcgcccggtgcgacgcgcgggcgcacggcgccgggtcgcgccacgcgcgggtgtggctgtgcgaggtgtgcgagcacgcgcccgccgccgtcacgtgccgggcggacgccgcggcgctgtgcgccgcctgcgacgccgacatccactcggcgaacccgctcgcgcgcaggcacgagcgcctccccgtcgcgcccttcttcggcccgctcgccgacgcgccgcagcccttccccttctcccaggccgccgcggatgccgccgcggcgcgggaggaggatgcggatgatgaccggagcaacgaggccgaggcggcgtcgtggcttctccccgagcccgacgacaatagccacgaggatagcgccgcagccgccgacgcgttcttcgccgacaccggcgcgtacctcggcgtcgacctggacttcgcccggtccatggacggaatcaaggccatcggggtaccggtcgcgccgcccgagctggacctcaccgccggcagccttttctaccccgaacactccatggcccacagcttgtcgtcgtcggaggtcgcgatcgtaccggacgcgctgtcggcgggctcggcggcgccgcccatggtggtggtggtggcgagcaaggggaaggagagggaggcgcggctgatgcggtacagggagaagcgcaagaaccggcggttcgacaagaccatccggtacgcgtcccgcaaggcgtacgccgagacgcggccgcgcatcaagggccggttcgccaagcgcaccgccgacgccgacgacgacgacgaggcgccatgctcgccggcgttctccgccctcgccgcgtcggacggcgtcgtgccgtcgttctgaggaaggacgtacgcacggtacggcgagtcggcgacgtgcgccgtcgtaattttggcgcgccccgtgcgcgcgtgcatgcgtgcgtgtgtgcgacgcatggccccgtgtgacatgaataatatgtacagtagtttttcatccatggacgtagtattctattgtactccttgtactcctactactcctcttctgcctaaccaaggcttgtacattaccatgggagtagctgtttttgcaaccgtgaccatggttcagtgcttcaagttcaagggcgttaatgttactgtc

SEQ ID NO: 6094 - DNA, 861 bp, Oryza sativa
  Predicted polypeptide sequence is orthologous to G1480
atggggatggccaatgaggagtcgccaaattatcaggtgaaaaaaggcggccggattcctccacgatcgagtttgatttatccgttcatgtcgatgggaccagcagccggagaaggatgtggcctgtgcggcgccgacggtggcggctgttgctcccgccatcgccacgatgatgatggattccccttcgtcttcccgccgagtgcgtgccaggggatcggcgccccggcgccaccggtgcacgagttccagttcttcggcaacgacggcggcggcgacgacggcgagagcgtggcctggctgttcgatgactacccgccgccgtcgcccgttgctgccgccgccgggatgcatcatcggcagccgccgtacgacggcgtcgtggcgccgccgtcgctgttcaggaggaacaccggcgccggcgggctcacgttcgacgtctccctcggcgaacggcccgacctggacgccgggctcggcctcggcggcggcggcggccggcacgccgaggccgcggccagcgccaccatcatgtcatattgtgggagcacgttcactgacgcagcgagctcgatgcccaaggagatggtggccgccatggccgatgatggggagagcttgaacccaaacacggtggttggcgcaatggtggagagggaggccaagctgatgaggtacaaggagaagaggaagaagaggtgctacgagaagcaaatccggtacgcgtccagaaaagcctatgccgagatgaggccccgagtgagaggtcgcttcgccaaagaacctgatcaggaagctgtcgcaccgccatccacctatgtcgatcctagtaggcttgagcttggacaatggttcagatag

SEQ ID NO: 6095 - DNA, 1396 bp, Oryza sativa
  Predicted polypeptide sequence is orthologous to G1480
gtcagcctggtggggaggggaggtgggtcgccgaaagcttggctgagattcgcctcgcctcgccttctagctcgcggccgccgctagcgcgagtgagagactgagagtgagtgaggtggtgtggccatggagggggacgacaagtcggcggtggcgggaggggcgtactgggggctggcggcgagggcgtgcgacgcgtgcggcggggaggcggcgcggctgttctgccgcgccgacgcggcgttcctctgcgccgggtgcgacgcgcgggcgcacgggcccgggtcgcgccacgcgcgggtgtggctctgcgaggtctgcgagcacgcgcccgcggcggtcacgtgcagggccgacgccgccgcgctctgcgccgcctgcgacgccgacatccactccgccaacccgctcgcgcgccgccacgagcggctccccgtcgcgcccttcttcggcgcgctcgccgacgcgcccaagccgggttccggtgcccacggcggcgacgcggcggcggccgacgatgacgggagcaacgacgccgaggccgcgtcgtggctcctccccgagcccgaccacgggcagaaagatggcgccgtcggtgcaaccgacgagctctacgccgactccgacccttacctcgacctcgacttcgcgcgctccatggacgacatcaaggccatcggcgtccagaacggtccgcccgagctcgacatcaccggcggcaagctcttctactccgaccactccatgaaccacagcgtatcatcctcggaggcggcggtggtgccggacgcggcggcgggcggcggcgctccgatgccggtggtgagcagggggcgggagcgggaggcgcggctgatgcggtacagggagaagcgcaagagccggcggttcgagaagaccatccggtacgcgtcccgcaaggcgtacgcggagacgcggccgcgcatcaagggccgcttcgccaagcgcaccaagggcggcgcgggcgcggacgccgacgcggacgccgacgccgacggcgaggacgaggagatgtactcctccgccgcggccgccgtcgccgcgctcatggcgcccggcggctccgacgccgactacggcgtcgacggcgtcgtgccgaccttctgatcgatcgcaaccaaagccgctgtgtacactagcccttctcccccattgggctgtaattttgttgcatgcatttcgcgcgcgcgggaaatgctttctgtagcattaatcaattgtatgattattacacggaagtaatccggacttccaatctcctcttctctctctctactctgatccttccatccttgcatgtatattatcatcgcgaactgctgctaatctgcaaattgtaattttactaatcagtaatcagtacagtggtggttgc

SEQ ID NO: 6096 - DNA, 557 bp, Oryza sativa
  Predicted polypeptide sequence is orthologous to G1480
ttttttttttttttttttttttttcgggttccttacaacctacgtcaccttttcaatggtgcctaggcctcttgaaggacaatacaccaaggagaaaggtagtgtagaagcacagcagagtatataaaggatctttaaagaccacctagtccgttggcaggtcctgcacgcagctttcccttgtactcggcatgtaaaatagccttgttgcttactgcacaagttgcaccaatacattttgacgtatctatcagacaataatggaaacagttctagcccagcctatgtggtactaacttacctcttcacctgtatttccctgtattcggttgattgtcatgtgcacctcggtacgacttaaatcgccaggggctctattgagccacgcacatttctcaaatactaaaaaaaagtccgaagactttttctagtacaattcggtgtcccaaatgtagcatcatattcattggctccgaatcatgtctttgatcaatagtagggttgcccggatcctgtgattactaacgtacgttccaatcgttccgataaggtagtaa

SEQ ID NO: 6097 - DNA, 1380 bp, Oryza sativa
  Predicted polypeptide sequence is orthologous to G1482, G1888
gagcttattatatttccctccacttcgtcctcttcttcctcctccatccccatcctccatcggatgcactagtagctggccttgtaccctacctagcttagctacccacccatgtcctcctcctcgtctcctctcgctgtctgcctttgacttggagacctagctcgtcgatcgccggccatgcgggtgcagtgcgacgtctgcgccgccgagccggccgcggtgctctgctgcgccgacgaggccgcgctctgctccgcctgcgaccgccgcgtccaccgcgccaaccgcctcgccagcaagcaccgccgcctcccgctcgtccacccgtcctcctcctcctccggcgacggtggcgccgccgccgcgccgctgtgcgacgtgtgcagggagaagaggggcctcgtgttctgcgtcgaggaccgcgccatcctgtgcgccgactgcgacgagcccatccactccgccaacgacctcaccgccaagcacacccgcttcctcctcgtcggcgccaagctctcccccgccgcgctcgccgaacagccgctcccgtcctccgactgcagctccgacgacgacgccgccgccgccgccaccgaggaggagtaccactcctccgccgcatccaccggcgccgcagtgagcgcgcctcttgacgcctccagcaacggcgccggtggcggaggaggagtaggagggagcagcatctccgactacctcaccaccatctgccccggctggcgcgtcgaggacctcctccccgacgacgacgccttcgccgccgccgccgcgcaggcggggaaagagaaggacgagcgcgtgccgttcctcgacgccgacctgttcgacgtggtcgccggccggccggagaagaagggcggcgcgtgggcgccgcacgtgccgcacctgccggcgtggtgcctcgacgaggtgccggtcgtcgtcgccgcgtcggcggcgccagcggcgacacctgtaaaggcgaagcagggacacgtgcgggacagccactggagcgacagcgacgcgttcgccgtgccggagttctcgccgccgccgccgccggccaagagggcgcggcccagctcgcagttctggtgcttctgaacgccgccgccgccgtacaatctggccgccggcgagctcgacgaacacctcgatggatcgatcgaacacctgtgtaatcactcagctggtcactactacaagtagcaatcagcaagcttgatgtgccactgttactagctgctgctgtttaattagtgagtactaagctactactagttaattttggtgaaaactatgctactttgttactatataatgaagtatgtgtatcaaactaaactgagatgttggtaattaattatcgtattttgt

SEQ ID NO: 6098 - DNA, 1200 bp, Oryza sativa
  Predicted polypeptide sequence is orthologous to G1482, G1888
gatatcttttgtacacgggcgtactacgtgttacggctgaaccaatctatccccgtgctcgctgtgaggccattgaccagaggaaacggaggaggagagagcgatcgtggtcgtacgtacgttgggagagaagaagggacgcgcgcgcgcgcgccggagcggcagggcaggatgaaggtgcagtgcgacgtgtgcgcggccgaggcggcgtcggtgttctgctgcgccgacgaggccgcgctgtgcgacgcgtgcgaccaccgggtgcaccgggccaacaagctcgccgggaagcaccgccggttctcgctgctcaacccctcggcgtccggccgctcgccgacatcgacgacggcgccgctctgcgacatctgccaggagaagaggggtttcctgttctgcaaggaggaccgggcgatcctgtgccgcgagtgcgacgtgccggtgcacacggcgagcgagctcaccatgcgccacagccggtacctcctcaccggcgtgcggctctcctcggagcctgccgcgtccccggcgccgccgtcggaggaggagaacagcagcagcttctgctgcagcgccgacgacgccgtgccggccccggcggcgcccgccacgagccacggcgggagcagcggcagcagcagcatctccgagtacctcaccacgctgcccgggtggcacgtcgaggacttcctcgtcgacgacgccactgccgaggccgccgccgccgccgccgccacctcttccggcatctccgcgaacgggccgtgtcagggggtaacacggatcggagggctgcaagaatccgccggctaccctgcgtggatggcgcagcagcagctgtgctgcgacggcctcgtcgccggcgacgcgtcgccggctagccgggagcggtgggtgccgcagatgtacgcggatcagcttgccgccggcagcaagagatccaggacgtccactgcttcttcctactcctactggtgaaactaaagcaattgaggccatggtttgtacgtagtagatgttgtttcgggcttaattaatgactgcattttgcgcttccggacgggagtgtttgtgcgttatttttgaggcgcagaggaaaatctgagccttttgtatcccttcctttttgctcgtcacgactagtactgtatgttttttttctacgcaataacgagaatttttcctcttttccaatgc

SEQ ID NO: 6099 - DNA, 1220 bp, Oryza sativa
  Predicted polypeptide sequence is orthologous to G1482, G1888
accactcgtccactcctaataacctaccactctacttctccttgcaacatcgtcgttagtcctctaacccaaggcattgacctgagcttgttgtgcgcttctgccttatctgcatcccctcccggccgagacgcgaccatctttctttcccgcttcgttagctgtctctgccgatcgatcggactggacggggagacatgaaggtgcagtgcgacgtgtgcgcggccgaggccgcctcggtcttctgctgcgccgacgaggccgcgctgtgcgacgcgtgcgaccgccgcgtccacagcgcgaacaagctcgccgggaagcaccgccgattctccctcctccaaccgttggcgtcgtcgtcgtccgcccagaagccaccgctctgcgacatctgtcaggagaagagggggttcttgttctgcaaggaggacagggcgatcctgtgccgggagtgcgacgtcacggtgcacaccacgagcgagctgacgaggcggcacggccggttcctcctcaccggcgtgcgcctctcgtcggcgccgatggactcccccgcgccgtcggaggaagaggaggaggaagcaggggaggactacagctgcagccccagcagcgtcgccggcaccgccgcggggagcgcgagcgacgggagcagcatctccgagtacctcaccaagacgctgcccggttggcacgtcgaggacttcctcgtcgacgaggccaccgccgcctcctcctcctcagacgggctatttcagggtgggctgctggctcagatcggtggggtgccggacggttacgcggcgtgggccggccgggagcagctgcacagtggcgtcgctgtcgccgccgacgagcgggccagccgcgagcggtgggtgccgcagatgaacgcggagtggggcgccggcagcaagcgacccagggcgtcgcctccctgcttgtactggtgaaaaaaaaacgtgcgcttatcagccacagccagtacgaaatgtacgatgcttgtgtaccagtgtactgaggtagtagcgttagaagattaggaatttagtagtggatgttgattttgagcttaacgcgtgtcttggatgaatccctgactcctgaatgtttggggaattaatgtgagtggtagtgtcctctttgggcggcaaagaattatacgccccttgcgaacatgtcgaactgtacggtctgccatttaatctgcacgttcacccctc

SEQ ID NO: 6100 - DNA, 258 bp, Oryza sativa
  Predicted polypeptide sequence is orthologous to G1482
atggtgatccagctggtgctggccgacgacgacaagccaacgtttgcactgctgacgaagcttcacttatcggagactgtcatcaccgatgacgagggcgggtacgtatctcagcgaggtcatgtcgtagggctgtcctcgcctgcagatcctcgagcttccaatctcacaaagatgcaagtgaaggattgcttcgtcattgaattgaaggactcggccatgtcactctcgatgccggcgatggaggagttctgctag

SEQ ID NO: 6101 - DNA, 1199 bp, Oryza sativa
  Predicted polypeptide sequence is orthologous to G1482, G1888
catatcttttgtacacgggcgtactacgtgttacggctgaaccaatctatccccgtgctcgctgtgaggccattgaccagaggaaacggaggaggagagagcgatcgtggtcgtacgtacgttgggagagaagaagggacgcgcgcgcgcgcgccggagcggcagggcaggatgaaggtgcagtgcgacgtgtgcgcggccgaggcggcgtcggtgttctgctgcgccgacgaggccgcgctgtgcgacgcgtgcgaccaccgggtgcaccgggccaacaagctcgccgggaagcaccgccggttctcgctgctcaacccctcggcgtccggccgctcgccgacatcgacgacggcgccgctctgcgacatctgccaggagaagaggggtttcctgttctgcaaggaggaccgggcgatcctgtgccgcgagtgcgacgtgccggtgcacacggcgagcgagctcaccatgcgccacagccggtacctcctcaccggcgtgcggctctcctcggagcctgccgcgtccccggcgccgccgtcggaggaggagaacagcagcagcttctgctgcagcgccgacgacgccgtgccggccccggcggcgcccgccacgagccacggcgggagcagcggcagcagcagcatctccgagtacctcaccacgctgcccgggtggcacgtcgaggacttcctcgtcgacgacgccactgccgaggccgccgccgccgccgccgccacctcttccggcatctccgcgaacgggccgtgtcagggggtaacacggatcggagggctgcaagaatccgccggctaccctgcgtggatggcgcagcagcagctgtgctgcgacggcctcgtcgccggcgacgcgtcgccggctagccgggagcggtgggtgccgcagatgtacgcggatcagcttgccgccggcagcaagagatccaggacgtccactgcttcttcctactcctactggtgaaactaaagcaattgaggccatggtttgtacgtagtagatgttgtttcgggcttaattaatgactgcattttgcgcttccggacgggagtgtttgtgcgttatttttgaggcgcagaggaaaatctgagccttttgtatcccttcctttttgctcgtcacgactagtactgtatgtttttcttctacgcaataacgagaatttttcctcttttccaatg

SEQ ID NO: 6102 - DNA, 2055 bp, Oryza sativa
  Predicted polypeptide sequence is orthologous to G1483
caaaaaaaaacaatttgtgcggccattaggcgttgagacctcggcgaatggcagccggcgacgtcgtcccacctccaccgcgcccacgaatccattccattccattctccatcgccccccacccatgtcgcctcctcctccaccatattaccaccacctcctcctcctccgctcctcgcccaccaccactggaggaggagctcgggttcttgccgcggcggagctcgcacgcatgaagctactgtgcagcgcgtgcgaggcggcggaggccagcgtcctctgctgcgccgacgaggccgccctgtgcgcgcgctgcgaccgcgacatccacgccgccaaccgcctcgccgggaagcacctccgcctccctctcctctcccccgcctcctcctcctcctcctccgccgccgccctcgcgccgccgccgccgtcgccgcccaagtgcgacatatgccaggagagccacgcgtacttcttctgcctcgaggaccgcgcgctgctgtgccggagctgcgacgtggcggtgcacacggccaacgccttcgtctccgcgcaccgccgtttcctcctcaccggcgtgcaggtcgggcaggagcaggacgagcactcccctgacccgcctgagccgtctcctcctcctccgccgccgccgcctgcatccaagagcgaccacccggcgccgctctacggcgagggcggaggagggttcagctgggacgccgccgactcgccggccgcgggcggcctccccgactggtcggccgtcgtcgaccagttcggctccccgccgccgcgccacacggacaccgcgaccgtgacgaccccgccgccgaccaagaggagcccacgcgcgccggcgttcggcggccagggcggcatgatggattggcccctcggcgagttcttcggcggcttcaccgacttcaccggcggctttggcttcggcttcggcgacagtggcacctccaaggctgacagcgggaagctgggagggagcacggacggctcgccgtactaccggtcgtcatcggaagatgaccggaacgccgacgagctcttcgggcaggtaccagagatccagtggtcggtgccggagctcccctcgccgccgacggcctccggcctccactggcaacgccatccagccgccactcacggcggcggcggcggcggacccgacaccaccgccttcgtccccgacatctgctcccccgacagctgcttcccggccaccacctccaaacgccggaggcaataatgctagctagctaatagctatgtccagaggttgaagacgacgacgacgacgacgaccagccatgtgagtgtgactgcgattgctaatagctcgagacgctgacgtgatcgtgtgtggtaccacctttcatggcgatggcgccaactacaatgttaggtaggagaagctttctactcgtctggtggttggttggttggttgttgacgatgatgatctgttgccatttccggcgacatcgaggcggaaacagatctctctgattttgagtgcctgacatatgggtttcatgtctaatgggttcttatattagcgacccacattagcagtattgtagagaagacttgttgaaaacagccgcaatcagcattggctgacaaatacagttgggggagatcaatggaactacagtgtacagtctatgctctgcagcatctgattctgatcctgaagtctggaaagaggaagaagaagattagaaagaagagaggcctctgctttttcgatggccgaaactgagatgcacctcgctaattggtgggcagtggacaggataggataggggccatgtgatggattgatggtgatgctctactttgttcagaacagaagtctctgaattttggttggatcacagaaacttgtaaaagattcttgcatgtgtacagaagttttatactacagtagttagatagaaacatggatggatccgtgagaaaagaaaaatgctggtaatgttgtattgtactagtaaaagaaaatgttatatgtttttaactcggctgattcattctttttcg

SEQ ID NO: 6103 - DNA, 1450 bp, Oryza sativa
  Predicted polypeptide sequence is orthologous to G1483
gatacagtggagagataggggaagagagggagcgatccaatcgcgtcgctaaaaccctagcggctggctgatttgggggattgctcgtcggagagatgaagatccagtgcaacgcgtgcggcgcggcggaggcgcgggtgctgtgctgcgccgacgaggcagcgctctgcacggcgtgcgacgaggaggtgcacgccgccaacaagctcgccgggaagcaccagcgggtgccgctgctctccgacgacggcggcgccgcgcccgccgccgccgccccggccgtgcccaagtgcgacatctgccaggaggcttctggatacttcttctgcctggaggaccgtgcacttctttgcagagattgtgatgtttctatacacacagtaaactcctttgtttcagtacaccaaagattcctactaacaggtgttcaagttggccttgatcctgctgatccagttccacctgttgctgacaagcatgttaagagtgctggtggttcagtggattcagcaactaaacatttgcaaaggaatcctacagacttatctggtgaaaacagtgcatctttgcccagccaaaatgtaatcaatggtaattattctaggcagagttctgttacaatggccaagacaggacaggtcaattggactatgagcaacaacacaattagatcaatagaccctccacccaagtattcatcagaggaaagtccagcacttctgctagctagccacactagcaccatggcagcgtactccagtcaaatcagtaaggatagtgatcggatctacaacttaccattcacaggtggtaatgggtcagatagtctacatgattggcatgttgatgagttctttagtaactcagaatttggctttgctgagcatggttcttctaagggtgacaacgctaagccagggagtgctggtggatctccgcagtgccgtctggctgaaggcctgtttgtcgaaggacttctaggtcaagtgcctgacaatccatggacagtgcctgaggtcccctcgccaccgacagcctctggtctctattggcaaaataatttgctttgcccttcgtacgacagcaccatgttcgtccctgagatttcctccttggagaactctcagaacaacttcactgtatctgctggtttgaagcgccgaaggaggcagttttgatctgccgatagcatcagacaccattcggtttagttggcaggtcacgttgagaggagggcttcttgcctgcctgaccaaagccacaaaacacagggatggatgatcatccagtggtcagtctaaaaatatgttgtaatgtttgtgtttcgactatacgtttgttgctgaagtttaaaggcgagggaattgttgtgagatctgggatgacagatttgttgttaccaattttgtgaatagtgaaaataaaaagagcatggataagatcatgaatt

SEQ ID NO: 6104 - DNA, 793 bp, Oryza sativa
  Predicted polypeptide sequence is orthologous to G1483
gaattggtctctcgttgggctaacgacgcggcgatcgagtagcttagctagctgaagctgccacatgaagatcgggtgcgacgcgtgcgagcaggcggaggcggcggtgctgtgctgcgccgacgaggccgcgctctgccgccgctgcgacgccgccgtccactccgccaacaggctcgccggcaagcacacccgcgtcgcgctcctcctcccctcctcctcctccgccgccgccggcgacgacgaccaccaccccacctgcgacatctgccaggagaagacgggctacttcttctgcctcgaggaccgcgccctgctctgccggagctgcgacgtcgccgtccacaccgccactgcgcacgccgccgcccaccgccgcttcctcatcaccggcgtccgcatcggcggcagcgtcgacgccgccgccgcggccgacgtcatcgtcagcccaacaagcagcagcatcgcgccggccggctcggccagcagcaaccacgccggcgccgccggcaacaacaatggccggtcgccggcgccggtgaggttctcagggggagacggcggcgttgagccggagcagcagtggccgtggagtgacgtcttcgccgccgacgacgacgatgacgtcagcgccgccatggagcagtgctactatcatggcatctctgaacctcactcctccagcctcactggatgatggcagcttagcttcagtcaaattaattaatgagctgctataattgatttccatgaactgatcccacagaggtcatcaacatcgagaatattagtt

SEQ ID NO: 6105 - DNA, 1074 bp, Oryza sativa
  Predicted polypeptide sequence is orthologous to G1483
atgaaggtgctgtgctccgcgtgcgaggcggcggaggcgcgggtgctctgctgcgccgacgacgccgccctctgcgcgcgctgcgacctccacgtccacgccgccaaccgcctcgccggcaagcaccaccgcctccccctcctctcctcctcctcttcttcctcctctccctcccccccgacctgcgacatctgccaggacgcccacgcctacttcttctgcgtcgaggaccgcgccctcctctgccgcgcctgcgacgtcgccgtccacaccgccaacgccctcgtctccgcccaccgccgcttcctcctcaccggcgtccacgtcggccttgacgccgccgccgacgacgacgacaaacaccccccacaccccttgtcgtcgtcgctgccgcgcaacacggcaccgcccccgcagccgccgccgaagcgcagcccctcgccgatctacagcgatgacgacgtcatcgactgggccaccggtggccacgacatcggcatcaccggcaacctgcccgactggtcgctcgtcgacgagcagttcaacacccctgcgctgccgccggtggtgaccaagaccccgccgaagcgggcctcccgtggccccgtcacggccggcaccgccgcggcggtgttcggcaacctcgccggcggatcgccggactggccgctcaacgagttcttcggcttcgccgacttcagctccggcttcggcttcgccgagaacggcacgtccaaggcggacagcggcaagatcgggagcatggacggctcgccgaacggcggcaggtcgtcgtcgtcgtcctcctcctcctccgccgccgccgccggcggcggcggcggcggccaggacttcttcggccaggtgccggaagttcactgggccgtgccggagctcccctcgccgcccacggcgtcagggctccactggcaacgggacccgcgctacggtggcggcgccaccgacgccagcgcggtgttcgtgccggacatctcctcgccggagaaccccttccgttgcttcgccgccgccgccgccggtgaccataccatgaaacgccggaggagatgctaa

SEQ ID NO: 6106 - DNA, 1022 bp, Oryza sativa
  misc_feature (642)..(643): n is a, c, g, or t
  misc_feature (724)..(724): n is a, c, g, or t
  misc_feature (728)..(728): n is a, c, g, or t
  misc_feature (777)..(778): n is a, c, g, or t
  misc_feature (780)..(780): n is a, c, g, or t
  misc_feature (782)..(782): n is a, c, g, or t
  misc_feature (785)..(790): n is a, c, g, or t
  misc_feature (792)..(792): n is a, c, g, or t
  misc_feature (794)..(810): n is a, c, g, or t
  Predicted polypeptide sequence is orthologous to G1488
gtcgggcaccgcggcgccggcattcccggccaagaaggcggcgaagtccgccaagaagaaggacgggccgtcccccgcgccggcgccgaacgcggccgcgcaggcggcggcggaggggaggaggtgcctccactgcgagacggacaagacgccgcagtggaggacggggcccatgggtcccaagacgctgtgcaacgcgtgcggggtgcggtacaagtccgggcggctcgtgccggagtaccggccggcggcgagcccgacgttcgtggtgtccaagcactccaactcccaccgcaaggtggtggagctgcggcgccagaaggagatgcagctcctgcaccaccaccagcagccgccgccgcacgtgggcgcgggcggcggcggcgccgccggagggctgctccacgtgacgagcccgctgctgttcgacgggccgacgtcgtcggcgccgctcttcgccggcgcggacgaattcctgatccataaccgcataagcccggactaccggcgccaggctacctaggaaactattcattagcccaggaataattcagcgataaaaacagctaatttttttttgtcctgcaaaccgcattttgggtactctttatttctcagcttcttaagtttcttttttctttnnttgagaattttagtgtttttcccccttagaagcagactctgaggagtttctttcgtagcacatttttttttcttttgattnttgnatgcaggactcttagaagaagaggaacaggagcagttttcattgtttcnncnanaannnnnntntnnnnnnnnnnnnnnnnnctcttgaggggggcccggacccaattcgccctttatgagtgtttaccgccctacatggccgtgttttacacgtgggaatggaaaacctgcgttcccactaatggcttgagaaaatcccttttcagatggtaattacaaaggccgaccatgcctttccaaatgccccctaattggatggaacccctttacgcctttaaacgggggggttgtct

SEQ ID NO: 6107 - DNA, 1753 bp, Oryza sativa
  misc_feature (599)..(599): n is a, c, g, or t
  misc_feature (838)..(838): n is a, c, g, or t
  Predicted polypeptide sequence is orthologous to G1488
gagctgacctctctccgccccgcctccccttccgtctctccgcgctccagctccacgccaattaaaccctactcctcttgcgttgcgttatctgcggttccgtctcccactactcgcgcacacgtagaaacggaaggagaaacaaacaaaaggcgccgagtaacgcagatagagagttgtttccgcaccgagcgcgtccgcggcagtgtgtgtgtgtagcggtagcgcacgcgcggctcgcgggcgcgccggttgcaccagctgtgcgttgcggcgacgatggaggtgacggccgagttcggcggcgcctactacggcggcgcggcgggccgcgagaagaaggcgctgcagcaggggtgcggggaccacttcgccgtggacgacctcctcgtgttgccctacggcgaggaggatgaaacaacaagggagggtgaggccaccggcggtaaggaggaggctgccggctttgggaacgcgtcggcggactcgtcgaccataacggccctggatagctgcagcaattccttcggcctagccgacggcgacttccccggcgagctgtgcgagccgtacgatcaactcgcggagctggaatggcntatccactatatgaacgagggagacgacgcattcgccaccgaggacctccagaagctgcagctcatctccggcatcccctccggtgggttctcgacggcgagcgtcccgtcggctcaagctcaagctgcgtcggcggctgcctccatggcagtgcagcccggcggcttcctgccggaggcccctgtccccgccaaggcacgaagcaagcgctcccgcgctgcgcctggcaactggtcgntccgcctgctcgtgctgccgccgcctccggcctcccccgccgtcccggcatccatggccatctcgccggcggagtctggcgtgtcggcgcatgcgttccctattaagaagccgtcgaagccggctaagaagaaagacgcgccggcgcccacggcgcaggcgcagctctcgggcgtgccggtgcactcgggcggctcggcgccagcggccgcggccggggaagggaggcggtgcctgcactgcgagagcttacaagacgccacagtggaggacggggccgatggggcccaagacactgtgcaacgcgtgcggggtgcggtacaagtccgggcgactggtgccggagtaccggccggcggcgagccccaccttcatggtatcgaagcactccaactcccaccgcaaggtgctggagctgcgccggcagaaggagatgcaccagcagacgccgcatcatcaccagccgcaggtggccgccgccggtggagtggggagcctaatgcacatgcagagctccatgctgttcgacggagtgtcgcccgtcgtgagcggcgacgacttcttgatccaccaccacctaaggacagacttccggccgcccatctagagatgagtcgtgtgctagaattgatcaattagcccatgaataatctaaaagaaacccttgaaccaaaaaaaaaacagaagaactgatattttcttaggagtttccccagtttttgtctcttttcccttcgtttagtttgtgcgcttttgctcagctcgtcgaatttttcgtgtcaattttgtttatgatgctctttaagtttaccaccttttctagccgggagttgatttctctagcttctacttatcttcctctctatcttgccatttaatttgtaacgcatttcaaggtacttaaatctcttcttcc

SEQ ID NO: 6108 - DNA, 1092 bp, Oryza sativa
  Predicted polypeptide sequence is orthologous to G1493
atgagcagcggggcgccgccccacgccggcagcggcggcccgccgccgccggcggtgctcgcgctcccgcacgggatggtggtcgtcggagacgaggccgtgcagcgcgccgtcgtgctcaggcttggagtgaacttccgagcgacggtttgctcggagatcaacgccgccgtggagatgctgcgtgagagaacgaaagaattcgatttcgcggtgatttcagaagagtcgattagaagcttaaggccagagatcatgaagtttttaggcgaggagacagggctgaggctgctcggtatatgtctttttttcgacctactgttttgtatcgctgccggcggcatcacctcacgatggcagcaacggctcgacggcggcggcgatagcctcgtcggtaagaaggacgaccaacgggaggaaacatcgacggcgcgccgagaagacccagtgccaacaaaaatacttgaactgatgaaattgaggattgatccgatgaatgatccagaactaacacgtaataccgtttctagttatctccagaaatataaggcgtatcttcttaaacaagaacaaaaagaccaacaattacctattgatgacaataccaatactagttcaatcaaaagtcaacaaggatctgcatctcttcaacaacaaattatgaattacggtgaaaatgatagcatggacaatcaatcaataattctatcacaaacccgctacaatgaacatagtaacaagcaaccaaagttgttgacagccaattatcatgggcctaaaaacatgcatcatcatcacaaaaacaccaacatgcaaccttccaatgtactgcggcctcctaacttgatcaatgcaaagggattcaatatgtcctttaacaaggaagagatcaacgaagccatatatcagagccaactaacaacacgtcgagtttcagccactcatgctattgcaaaagcacaagccagctggagagtaacaatgacgaaagatatgcaccccatatctcaactacaccaacaagatgatgaaacaacacctgatgattcttctaataatacaaatagcatatatgaaaaatgtaagctttga

SEQ ID NO: 6109 - DNA, 2608 bp, Oryza sativa
  Predicted polypeptide sequence is orthologous to G1493
gagtcttctctcttctctctctctcgtctctctctcccccacctcttcttccctttcccccgcctccctctcctcttcgtcgtcacccgccgcctcccgctgaatccgcggcttgggaggagacgccggagtcgggggcgtggacgggggttggatctgcttgccttgatggtggcgattggagcgtgaattcgtgaggggggcgtggtggtggtggtggtggttatacggttttcggtttcgtgggcgggggagagatggcgccggtggaggatggcggcggggtggagttccccgtggggatgaaggtgctggtggtggacgacgaccctacatgcctcgccgtgctcaagaggatgctcctcgagtgccgctacgacgcgacaacttgttctcaggctacaagagcattaactatgctgcgagagaacaggcgtggttttgatgttataattagcgatgttcatatgcctgatatggacggattcaggttacttgaacttgttggccttgagatggatctcccagttattatgatgtctgctgattcaaggacagatatcgttatgaaaggaataaaacatggagcatgtgactacttaattaaacccgtcagaatggaggagttgaagaacatctggcaacatgttataaggaaaaagtttaatgaaaacaaggagcatgagcattcaggtagcctagatgatacagatcgtaccagaccaaccaataacgataatgagtatgcttcatctgcaaatgatggagctgaaggtagctggaagtctcagaaaaagaaacgggataaagatgatgacgatggtgaattggaaagtggtgacccttcttctacatcaaagaaaccaagagttgtttggtcagttgaactccaccaacaatttgtaaacgcagttaatcatctggggatagacaaagctgttcccaagaaaattttggagttgatgaatgttcctggtttaactagggaaaatgtcgccagccatttgcagaagttcagattgtatctgaagaggattgctcagcatcatgccggaatagctaatccattctgcccgcctgcttctagtggtaaagtaggctcactgggaggacttgatttccaagctttggctgcctcaggtcagatccctcctcaagccctggccgccttgcaggatgagctcctagggcgacctacaaatagtttggtattgcctggaagggaccagtcatctttacggcttgctgcagtcaaaggaaacaagccccatggggagagagaaatagcatttggtcaacctatatacaagtgccagaataatgcatatggggcattccctcaaagcagtccagctgttggaggaatgccttcattttcagcttggcccaataacaaacttggtatggcagactcaaccggcacattgggaggcatgagtaattctcagaatagcaatatagtcttgcatgaattgcaacagcagccagatgccatgctgtcaggaacccttcactctctagatgtcaaaccttctgggatagttatgccttctcagtcattaaatactttctcagccagtgagggtctctcccctaatcaaaataccttgatgatacctgctcagtcatctggttttctagcggccatgcctccatccatgaagcatgaacctgttcttgcaacttctcaaccatcgagtagtctgttaggtggtattgatttggttaatcaagcttcaacaagtcagcccttaataagtgcccatggaggggggaatctttctggccttgtaaatcgtaatccaaatgtagtaccttctcaagggatcagtacttttcatactccaaataatccatatttggttagtccaaattctatgggaatgggctccaaacaaccacctggtgttcttaagacagaaaactctgacgctctgaaccatagctatggttatcttggtggtagcaacccccctatggactctggcttactctcttcacaatcaaaaaatacacagtttggtttactgggtcaggatgacatcactggtagctggtcgcctctgccgaatgttgacagttatggtaatactgttgggctaagccaccctgggtccagttcatctagttttcaaagttctaatgtggctcttgggaaattgcctgatcaagggcgaggaaagaatcatggatttgttggtaaaggtacttgcattccaagccgctttgcagtggatgagattgaatctccaactaacaacttgagtcacagcattggaagcagtggagatattatgagccctgatattttcggatttagtggacagatgtgaaggcttcttgaatttgtaagtagggtaatcactggaaacaatttttagtgggttgatgaacggttgccgtgtttttcatttcatccttttttttttccttctgtaattggtttataaagggaataatttatgtgacagcatgtcgaatcttggtttatagaaggttgttcggtttaaacaactttggattatttagcctcatgtgacatagctcattttcctttgttcattttttgtgtacagttttctgattttgttgcaaatcttcttctctc

SEQ ID NO: 6110 - DNA, 560 bp, Oryza sativa
  Predicted polypeptide sequence is orthologous to G1499
cgctacatcaagttcctcaagcgccaggtccaggagctccagcaccagccgggaccgccgccgccgccgtatcccgccggagctgcaccggccgccgggcccagcacctcggccgtgggcccaccgggtcggccattcttgccgctgggtggaggagggcccatgatcgactgggtcggcctgaccaggccggtggacatccatgggccgacctcgtcgtcgtcctcgtcgtcgatgggcggcgccttgggtttcgggttcggctgcggcggcggcgggcagagcagccatgggatgcactgatggatgatgaaattgggatggagcaatatagctgagagagaggagattaactaagctagggatgcatggattggtggactagagaggtaattttggtaatttggttttggtcttggtttttattaattaatttgctcttgttgttggctcaggctactagctactctctctactccccactgagtagctaagctgctgccttgatgtttctcaaagtacaattaattaataagattagctagggtttgcattctaaa

SEQ ID NO: 6111 - DNA, 2077 bp, Oryza sativa
  Predicted polypeptide sequence is orthologous to G1506
ggcattccttcctccattatttctccatccctttcccctctcctcctctcctctaccttctctctaaaagactggatacagaacaaaaaaaagggaaaaaacagaaagaaaggaaagaaagaagaacacctaccaagcaagtcttggtctttgagttcatgggctgtggaattgttcccaggaatcccctctggctctgaaaagattcacaccgagcaacagttctttgatttttttccccctttgttttgctgaagaattgcttgtacagaactgcttctttcctgtttccgcttggttttccggtgtttattttgttggaattttcttgggccctttcttcttcgcttgtggaggcgaggggagaagagaggcatgggaaagcaaggaccttgccgtcattgcggagtcaccagtactcctctctggagaaatgggccaccagataagccagtgctctgcaatgcatgtggctcaagatggagaactaagggttcgctgacgaattacacaccaatgcatgctcgggatgatattgatgctgaggaacctagagctagcaagctgaaacctccaacattgaagctgaaggaacagaagcaactgaagaaaaatccaagccacatcacaatggagaatggaccattttctgatcaaaacttccgtaagatgggagatcctgacctaagtaatcgatctggttctggatcagcactatcatactcagagagttgtgccccctatggcactgctgatgcaagtgaaatgactgcttcagcacaatcacatgcttgggaatcacttgtgccatcaaagagaaggagttgtgtcactcggcctaagccttcacaaatggaaaaacttgcaaaggatcttaattccataatgcatgaagagcagctactttacctttcaggatcctcagaggaggatctaatttaccatagtgcaactcctgtggattcctttgagatgggatatggaagtatgcttctcagaccaaattcaaaatcactggaggaagaatcagaagcaagctctattcctgctgataataagtcatatattactagtgaatcttactcagggtcggtctcatttgtatatagtgaaagcaaggcaacaagcaaccaaaatgttataactgaacagccaaagaagtttctggtgcaaacatcagataatgctagaagggctaatctccatactgaaaatcaggatactctggagaatgcaaactcacctttagtttccctacatatggagggaaaagacagtgaagaaacaagagtaaagaccagtgcttcaaatcgccttacaaagtccaccatgaatcctctgaaaaggccgcatgacacccacttccaaagctccgtagaactaagaggaaccatgaggagtcctaaaagagtttctaaatatggtgatgctatgggtctaaagtgccaagcgtcgtttatgccgaaaccaggcaatggcaaagatttagcctgcagtgacagagcacttaacttattcatgttacccccggataaactatccatgctggttcctcctcagtatgccaacactgattctgatcaagacctgttgctggatgttcctcttaatgctcggcacccagaggccgagcttctttgccagccatctcaactgagctcagtagcccacagctccacctcagaggctgggaatgccggaggagaggggcgccttaagcagccctagttccagttccagttaacaagcaacttaggaacaggaagtagctgtagtttactttagtttccctggatcatggttccctttatttaccggccactgatggggcgttctgcggtttgttcatgctcttatcgtcgtcgccctggtttactaggcaatgtgcgtctgccaagttggcaaaaattgtgtgttcagctaacacttctagctgtgcttttggagtagacttgtgcttgtttgtagcatatggcttttggagaaggtatataactcaacatggctgtatggaaaagaggtaatctccttatgggtaaaatgaaaaaggaaagaaagatggaagttattaggagct

SEQ ID NO: 6112 - DNA, 659 bp, Oryza sativa
  Predicted polypeptide sequence is orthologous to G1510
taagaaagatcctaagtggcccgtagcagatgaagatcattttctctttgctcgtctggcgagtgcgtgcaagcagctgcctttgctgcaggtttgatgtttgtagggtcaaaagttatgagggcaaataatgcaaggctggcagtgcggcctgctgcctgactgacaaggcaacatggtggcttgtgagccctatgatgaatggagttgcgtaaaggcaaggcaggtgatgggcatgagcgggcaagcccactgtgatccacaaatgcaaggttggcatgttgcaagactggaggaaatgtaagccagagtgctggcacagctgcaggctgggtgggtgcaacatgtgctgcacctgatgcaggatgattgaaccttggtgtgcagggccatgagcgcatgcagctgacaagctgccagcgtgttggatgatgctgctgactttgggtgcggaatcctggactgcaagctgcaagctgcaaagctgctggtgtgggctgttggaacttggccatgctgaggatgatggtgatgctgaccctaggtactatagtgcacctagtagcattaccacccttgcggtgtattgtactgagttttaacatatagtggttctcggaagttagaaaataagctcagatatcaaaaaaaaaaaaaaa
